(12) United States Patent
Lu et al.

(10) Patent No.: US 11,718,860 B2
(45) Date of Patent: Aug. 8, 2023

(54) SYNTHETIC PROMOTERS

(71) Applicant: Massachusetts Institute of Technology, Cambridge, MA (US)

(72) Inventors: Timothy Kuan-Ta Lu, Cambridge, MA (US); Lior Nissim, Cambridge, MA (US); Ming-Ru Wu, Brookline, MA (US)

(73) Assignee: Massachusetts Institute of Technology, Cambridge, MA (US)

( * ) Notice: Subject to any disclaimer, the term of this patent is extended or adjusted under 35 U.S.C. 154(b) by 572 days.

(21) Appl. No.: 16/493,340

(22) PCT Filed: Mar. 13, 2018

(86) PCT No.: PCT/US2018/022093
§ 371 (c)(1),
(2) Date: Sep. 12, 2019

(87) PCT Pub. No.: WO2018/169901
PCT Pub. Date: Sep. 20, 2018

(65) Prior Publication Data
US 2021/0171977 A1 Jun. 10, 2021

Related U.S. Application Data

(60) Provisional application No. 62/470,754, filed on Mar. 13, 2017.

(51) Int. Cl.
| | | |
|---|---|---|
| *A01N 63/00* | (2020.01) |
| *A61K 39/245* | (2006.01) |
| *C07H 21/04* | (2006.01) |
| *C12N 15/85* | (2006.01) |
| *A61K 35/763* | (2015.01) |
| *C12N 15/86* | (2006.01) |

(52) U.S. Cl.
CPC ............ *C12N 15/85* (2013.01); *A61K 35/763* (2013.01); *C12N 15/86* (2013.01); *C12N 2710/16632* (2013.01); *C12N 2710/16643* (2013.01); *C12N 2830/008* (2013.01)

(58) Field of Classification Search
CPC ................ C12N 15/86; C12N 15/8695; C12N 2510/00; C07H 21/04
See application file for complete search history.

(56) References Cited

FOREIGN PATENT DOCUMENTS

| WO | WO 2009/007980 A1 | 1/2009 |
| WO | WO 2016/179226 A1 | 11/2016 |
| WO | WO 2016/205737 A2 | 12/2016 |

OTHER PUBLICATIONS

Kannan et al., 2018, ACS Synth. Biol. vol. 7, p. 832-841.*
Fu et al., A strict-late viral promoter is a strong tumor-specific promoter in the context of an oncolytic herpes simplex virus. Gene Ther. Aug. 1, 2003;10(17):1458-64. doi: 10.1038/SJ.GT.3302029.
Gayral et al., Targeted oncolytic herpes simplex virus type 1 eradicates experimental pancreatic tumors. Human Gene Ther. Nov. 25, 2014;26(2):104-13. Epub Feb. 2015. doi: 10.1089/hum.2014.072.
Kurayoshi et al., Cancer cell specific by ARF tumor suppressor promoter constructs. Biochem Biophys Research Commun. Jun. 2, 2014;450(1):240-6. doi: 10.1016/J.BBRC.2014.05.102.
Nissim et al., Synthetic RNA-based immunomodulatory gene circuits for cancer immunotherapy. Cell. Nov. 16, 2017;171(5):1138-50. doi: 10.1016/J.CELL.2017.09.049.
Qu et al., Evaluation of MCF10A as a reliable model for normal human mammary epithelial cells. PLos One. Jul. 6, 2015;10(7):e0131285, 16 pages, doi: 10.1371/journal.pone.0131285.
Su et al., Targeting gene expression selectively in cancer cells by using the progression-elevated gene-3 promoter. PNAS. Jan. 25, 2005;102(4):1059-64. doi: 10.1073/pnas.0409141102.
Vranic et al., Update on the molecular profile of the MDA-MB-453 cell line as a model for apocrine breast carcinoma studies. Oncol Lett. Aug. 5, 2011;2(6):1131-7. doi: 10.3892/ol.2011.375.
Guye et al., Genetically engineering self-organization of human pluripotent stem cells into a liver bud-like tissue using Gata6. Nat Comm. Jan. 6, 2016; 7(10243): 1-12.
Jeyaseelan et al., Real-time detection of gene promoter activity: quantitation of toxin gene transcription. Nucleic Acids Res. Jun. 15, 2001;29(12):E58-8.
Nissim et al., Synthetic RNA-Based Immunomodulatory Gene Circuits for Cancer Immunotherapy. Cell. Nov. 16, 2017;171(5):1138-1150.e15. doi: 10.1016/j.cell.2017.09.049. Epub Oct. 19, 2017.

* cited by examiner

*Primary Examiner* — Shin Lin Chen
(74) *Attorney, Agent, or Firm* — Wolf, Greenfield & Sacks, P.C.

(57) ABSTRACT

Synthetic promoters that are differentially modulated between certain diseased cells (e.g., cancer cells) and normal cells (e.g., non-cancer cells) are described. The synthetic promoters may be used to drive expression of gene(s) of interest in a specific cell type or during a specific cellular state. These synthetic promoters are useful, for example, for targeted expression of therapeutic molecules in diseased cells.

7 Claims, 10 Drawing Sheets

Specification includes a Sequence Listing.

SYNTHETIC PROMOTERS

RELATED APPLICATION

This application is a national stage filing under 35 U.S.C. § 371 of International Patent Application Serial No. PCT/US2018/022093, filed Mar. 13, 2018, which claims the benefit under 35 U.S.C. § 119(e) of U.S. provisional application No. 62/470,754, filed Mar. 13, 2017, the contents of each of which is incorporated by reference herein in its entirety.

FEDERALLY SPONSORED RESEARCH

This invention was made with Government support under Grant No. W911NF-11-2-0056 awarded by the Army Research Office and under Grant No. P50 GM098792 awarded by the National Institutes of Health. The Government has certain rights in the invention.

REFERENCE TO A SEQUENCE LISTING SUBMITTED AS A TEXT FILE VIA EFS-WEB

The instant application contains a Sequence Listing which has been submitted in ASCII format via EFS-Web and is hereby incorporated by reference in its entirety. Said ASCII copy, created on Feb. 2, 2022, is named M065670406US01-SEQ-JRV, and is 6,068,501 bytes in size.

BACKGROUND

Targeted therapy is useful for treating a myriad of different diseases. Cell type-specific and/or cellular state-specific control of gene expression enables, for example, targeted delivery of therapeutic proteins to diseased cells (e.g., cancer cells) without adversely affecting healthy, non-diseased cells.

SUMMARY

Some aspects of the present disclosure provide synthetic promoters that have differential activities in different cell types and/or different cellular states. The synthetic promoters may be used to drive expression of gene(s) of interest in a specific cell type or during a specific cellular state. In some embodiments, a synthetic promoter is used for diagnostic purposes to drive the expression of a detectable molecule (e.g., a fluorescent protein such as GFP) in a specific cell type or at a specific cellular state. In some embodiments, a synthetic promoter is used for therapeutic purposes to drive the expression of a therapeutic molecule (e.g., a protein, such as an antibody, or a nucleic acid, such as a siRNA) in a specific cell type (e.g., a cancer cell) or during a specific cellular state.

Thus, provided herein are engineered nucleic acids comprising a promoter that comprises the following consensus sequence: TFBS-AGA-TFBS-TCG-TFBS-GAC-TFBS-CTA-TFBS-ACT-TFBS-TGC-TFBS-GTA-TFBS, wherein TFBS is a transcription factor binding site sequence of Table 5. In some embodiments, the activity of the promoter is increased in diseased cells relative to healthy cells. In some embodiments, the activity of the promoter is decreased in diseased cells relative to healthy cells.

In some embodiments, the diseased cells are selected from breast cancer cells, colon cancer cells, and ovarian cancer cells.

In some embodiments, the promoter is operably linked to a nucleotide sequence encoding a therapeutic protein.

In some embodiments, the transcription factor binding site sequence comprises the following sequence: CCACGTGC (SEQ ID NO: 12265). In some embodiments, the promoter comprises the following sequence:

(SEQ ID NO: 12266)
CCACGTGCAGACCACGTGCTCGCCACGTGCGACCCACGTGCCTACCACGT

GCACTCCACGTGCTGCCCACGTGCGTACCACGTGCG.

In some embodiments, the transcription factor binding site sequence comprises the following sequence: TGCTGAGTCAGCA (SEQ ID NO: 12267). In some embodiments, the promoter comprises the following sequence:

(SEQ ID NO: 12268)
TGCTGAGTCAGCAAGATGCTGAGTCAGCATCGTGCTGAGTCAGCAGACTG

CTGAGTCAGCACTATGCTGAGTCAGCAACTTGCTGAGTCAGCATGCTGCT

GAGTCAGCAGTATGCTGAGTCAGCAG.

Also provided herein are cells comprising an engineered nucleic acid described herein.

Further provided herein are viruses, such as lentiviruses, adenoviruses, adeno-associated viruses, and/or oncolytic viruses comprising an engineered nucleic acid described herein. In some embodiments, the oncolytic virus is an oncolytic herpes simplex virus.

The present disclosure also provides methods of delivering to a cell, optionally in a subject, an engineered nucleic acid or an oncolytic virus described herein.

In some embodiments, the engineered nucleic acids comprise a promoter that comprises a nucleotide sequence identified by any one of SEQ ID NOs: 1-12263. In some embodiments, the activity of the promoter is increased in diseased cells (e.g., ovarian cancer cells or breast cancer cells) relative to healthy cells. In some embodiments, the activity of the promoter is decreased in diseased cells relative to healthy cells. SEQ ID NOs: 1-12263 include the sequence ATCATCTCACCTTGCCTCCTG (SEQ ID NO: 12264), used to amplify promoters of interest directly from the promoter library. It will be understood that "a promoter that comprises the nucleotide sequence identified by any one of SEQ ID NOS: 1-12263," in some embodiments, does not include the 5' SEQ ID NO: 12264. Thus, SEQ ID NO: 12264 may be excluded from any one of SEQ ID NOs. 1-12263.

Also provided herein are cells comprising engineered nucleic acids that include a synthetic promoter having a nucleotide sequence identified by any one of SEQ ID NOS: 1-12263.

The present disclosure also provide delivering to a cell or delivering to a subject (e.g., directly or via a cell) an engineered nucleic acid that includes a synthetic promoter having a nucleotide sequence identified by any one of SEQ ID NOS: 1-12263.

The entire disclosure of Nissim, L. et al. *Cell* 2017; 171: 1138-1150 is incorporated herein by reference.

BRIEF DESCRIPTION OF THE DRAWINGS

The accompanying drawings are not intended to be drawn to scale. For purposes of clarity, not every component may be labeled in every drawing.

DETAILED DESCRIPTION

Figure 1:
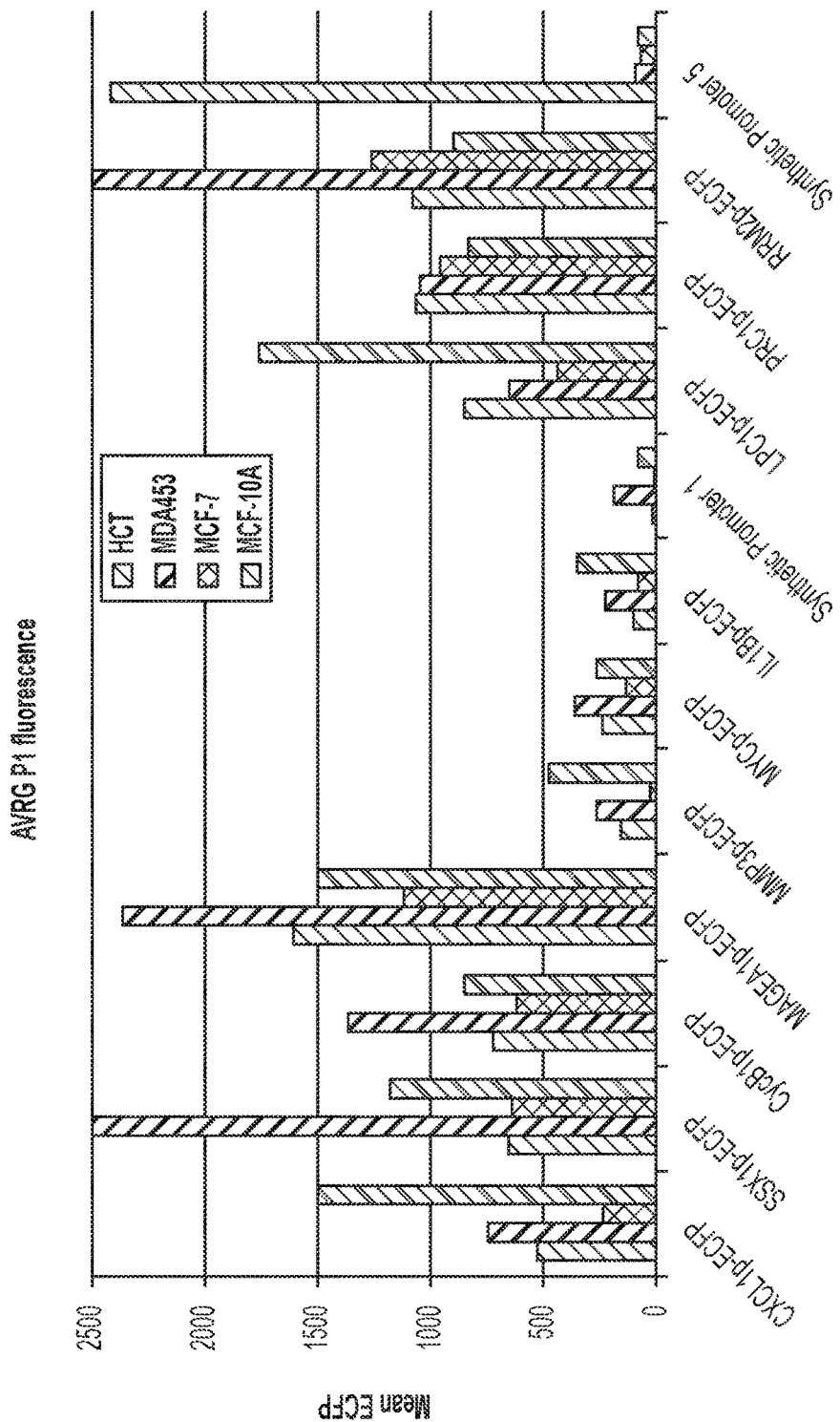
FIG. 1 is a graph showing the activities of synthetic promoters in four different cell lines: HCT, MDA-453, MCF-7, and MCF-10A.
Figure 2:
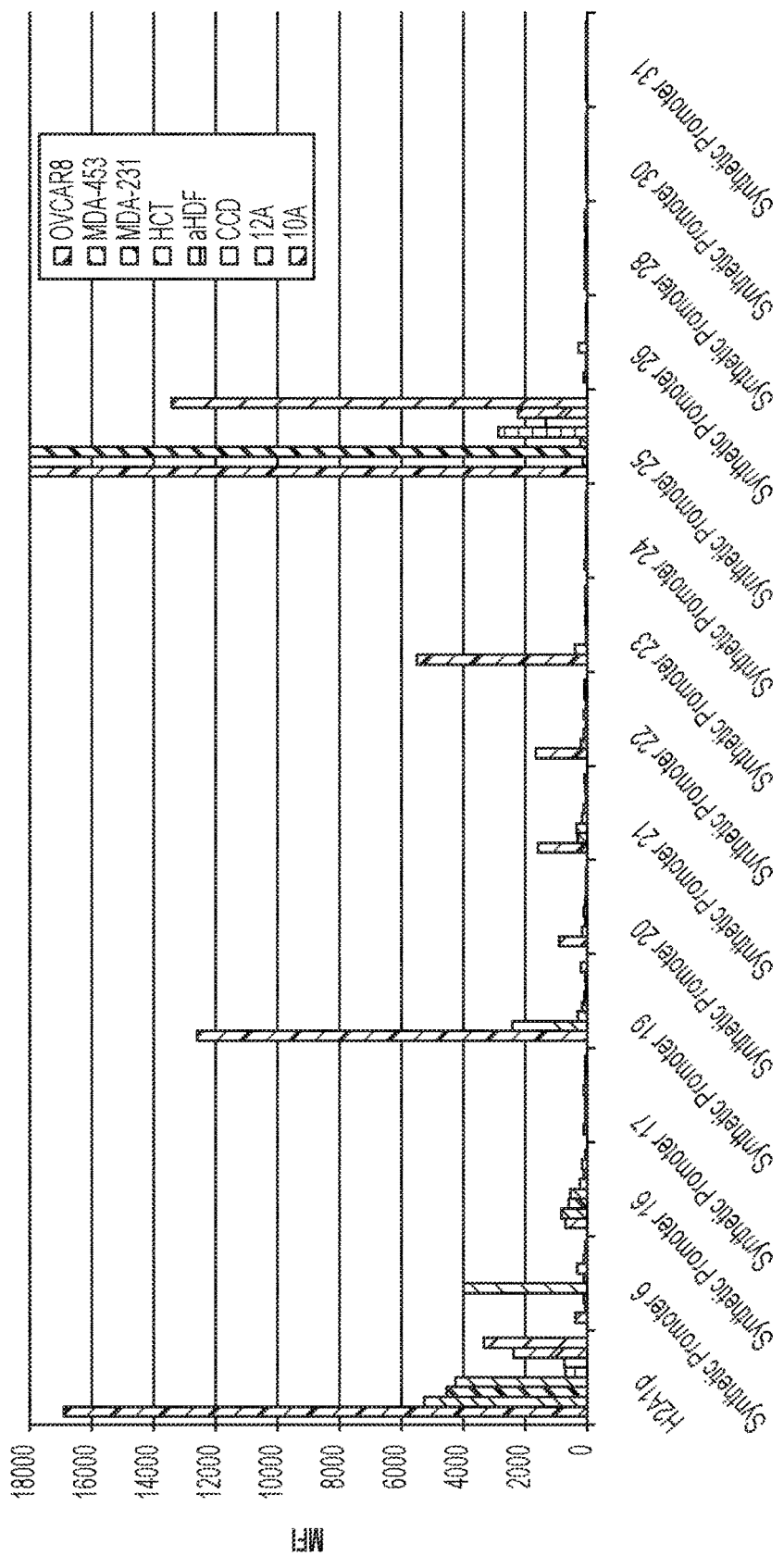
FIG. 2 is a graph showing the activities of synthetic promoters in eight different cell lines: OVCAR8, MDA-453, MDA-231, HCT, aHDF, CCD, 12A, and 10A.

Provided herein are synthetic promoters that are differentially modulated among various diseased cell types, relative to healthy (normal), non-diseased cell types. These synthetic promoters may be used for targeted expression of molecules/products of interest (e.g., therapeutic and/or diagnostic molecules) in select cell types (e.g., cancer cells or other diseased cells).

Synthetic Promoters

A "promoter" refers to a control region of a nucleic acid sequence at which initiation and rate of transcription of the remainder of a nucleic acid sequence are controlled. A promoter regulates (e.g., activates or represses) expression or transcription of the nucleic acid sequence that it is operably linked to. A promoter may also contain sub-regions at which regulatory proteins and molecules may bind, such as RNA polymerase and other transcription factors. Promoters may be constitutive, inducible, activatable, repressible, tissue-specific, cell type-specific, cell state-specific, or any combination thereof.

Promoters of the present disclosure are synthetic promoters. A synthetic promoters is a promoter that is not "naturally occurring." The synthetic promoters of the present disclosure may be produced synthetically (e.g., via chemical synthesis), or using recombinant cloning and/or nucleic acid amplification technology, including polymerase chain reaction (PCR) (see U.S. Pat. Nos. 4,683,202 and 5,928,906).

In some embodiments, a synthetic promoter may be 10-300 nucleotides long. For example, the length of a synthetic promoter may be 10-300, 10-290, 10-280, 10-270, 10-260, 10-250, 10-240, 10-230, 10-220, 10-210, 10-210, 10-200, 10-190, 10-180, 10-170, 10-160, 10-150, 10-140, 10-130, 10-120, 10-110, 10-100, 10-90, 10-80, 10-70, 10-60, 10-50, 10-40, 10-30, 10-20, 20-300, 20-290, 20-280, 20-270, 20-260, 20-250, 20-240, 20-230, 20-220, 20-210, 20-210, 20-200, 20-190, 20-180, 20-170, 20-160, 20-150, 20-140, 20-130, 20-120, 20-110, 20-100, 20-90, 20-80, 20-70, 20-60, 20-50, 20-40, 20-30, 30-300, 30-290, 30-280, 30-270, 30-260, 30-250, 30-240, 30-230, 30-220, 30-210, 30-210, 30-200, 30-190, 30-180, 30-170, 30-160, 30-150, 30-140, 30-130, 30-120, 30-110, 30-100, 30-90, 30-80, 30-70, 30-60, 30-50, 30-40, 40-300, 40-290, 40-280, 40-270, 40-260, 40-250, 40-240, 40-230, 40-220, 40-210, 40-210, 40-200, 40-190, 40-180, 40-170, 40-160, 40-150, 40-140, 40-130, 40-120, 40-110, 40-100, 40-90, 40-80, 40-70, 40-60, 40-50, 50-300, 50-290, 50-280, 50-270, 50-260, 50-250, 50-240, 50-230, 50-220, 50-210, 50-210, 50-200, 50-190, 50-180, 50-170, 50-160, 50-150, 50-140, 50-130, 50-120, 50-110, 50-100, 50-90, 50-80, 50-70, 50-60, 60-300, 60-290, 60-280, 60-270, 60-260, 60-250, 60-240, 60-230, 60-220, 60-210, 60-210, 60-200, 60-190, 60-180, 60-170, 60-160, 60-150, 60-140, 60-130, 60-120, 60-110, 60-100, 60-90, 60-80, 60-70, 70-300, 70-290, 70-280, 70-270, 70-260, 70-250, 70-240, 70-230, 70-220, 70-210, 70-210, 70-200, 70-190, 70-180, 70-170, 70-160, 70-150, 70-140, 70-130, 70-120, 70-110, 70-100, 70-90, 70-80, 80-300, 80-290, 80-280, 80-270, 80-260, 80-250, 80-240, 80-230, 80-220, 80-210, 80-210, 80-200, 80-190, 80-180, 80-170, 80-160, 80-150, 80-140, 80-130, 80-120, 80-110, 80-100, 80-90, 90-300, 90-290, 90-280, 90-270, 90-260, 90-250, 90-240, 90-230, 90-220, 90-210, 90-210, 90-200, 90-190, 90-180, 90-170, 90-160, 90-150, 90-140, 90-130, 90-120, 90-110, 90-100, 100-300, 100-290, 100-280, 100-270, 100-260, 100-250, 100-240, 100-230, 100-220, 100-210, 100-210, 100-200, 100-190, 100-180, 100-170, 100-160, 100-150, 100-140, 100-130, 100-120, 100-110, 110-300, 110-290, 110-280, 110-270, 110-260, 110-250, 110-240, 110-230, 110-220, 110-210, 110-210, 110-200, 110-190, 110-180, 110-170, 110-160, 110-150, 110-140, 110-130, 110-120, 120-300, 120-290, 120-280, 120-270, 120-260, 120-250, 120-240, 120-230, 120-220, 120-210, 120-210, 120-200, 120-190, 120-180, 120-170, 120-160, 120-150, 120-140, 120-130, 130-300, 130-290, 130-280, 130-270, 130-260, 130-250, 130-240, 130-230, 130-220, 130-210, 130-210, 130-200, 130-190, 130-180, 130-170, 130-160, 130-150, 130-140, 140-300, 140-290, 140-280, 140-270, 140-260, 140-250, 140-240, 140-230, 140-220, 140-210, 140-210, 140-200, 140-190, 140-180, 140-170, 140-160, 140-150, 150-300, 150-290, 150-280, 150-270, 150-260, 150-250, 150-240, 150-230, 150-220, 150-210, 150-210, 150-200, 150-190, 150-180, 150-170, 150-160, 160-300, 160-290, 160-280, 160-270, 160-260, 160-250, 160-240, 160-230, 160-220, 160-210, 160-210, 160-200, 160-190, 160-180, 160-170, 170-300, 170-290, 170-280, 170-270, 170-260, 170-250, 170-240, 170-230, 170-220, 170-210, 170-210, 170-200, 170-190, 170-180, 180-300, 180-290, 180-280, 180-270, 180-260, 180-250, 180-240, 180-230, 180-220, 180-210, 180-210, 180-200, 180-190, 190-300, 190-290, 190-280, 190-270, 190-260, 190-250, 190-240, 190-230, 190-220, 190-210, 190-210, 190-200, 200-300, 200-290, 200-280, 200-270, 200-260, 200-250, 200-240, 200-230, 200-220, 200-210, 200-210, 210-300, 210-290, 210-280, 210-270, 210-260, 210-250, 210-240, 210-230, 210-220, 220-300, 220-290, 220-280, 220-270, 220-260, 220-250, 220-240, 220-230, 230-300, 230-290, 230-280, 230-270, 230-260, 230-250, 230-240, 240-300, 240-290, 240-280, 240-270, 240-260, 240-250, 250-300, 250-290, 250-280, 250-270, 250-260, 260-300, 260-290, 260-280, 260-270, 270-300, 270-290, 270-280, 280-300, 280-290, or 290-300 nucleotides. Promoters may be longer than 300 nucleotides, in some embodiments. In some embodiments, a synthetic promoter may be longer than 300 nucleotide (e.g., 300, 350, 400, 450, or 500 nucleotides long or longer).

In some embodiments, the length of a synthetic promoter is 200 nucleotides or shorter. In some embodiments, a synthetic promoter may be 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, 160, 161, 162, 163, 164, 165, 166, 167, 168, 169, 170, 171, 172, 173, 174, 175, 176, 177, 178, 179, 180, 181, 182, 183, 184, 185, 186, 187, 188, 189, 190, 191, 192, 193, 194, 195, 196, 197, 198, 199, or 200 nucleotides long.

In some embodiments, a synthetic promoter comprises the nucleotide sequence identified by any one of SEQ ID NOs: 1-12263 (with or without the 5' sequence identified by SEQ ID NO: 12264). In some embodiments, a synthetic promoter comprises a nucleotide sequence that is at least 95% identical to the nucleotide sequence identified by any one of SEQ ID NOs: 1-12263 (with or without the 5' sequence identified by SEQ ID NO: 12264), and is able to regulate the expression (e.g., activate or repress) the sequence to which it is operably linked. For example, a synthetic promoter may comprise a nucleotide sequence that is at least 95%, at least 96%, at least 97%, at least 98%, at least 99%, or at least 99.5% identical to the nucleotide sequence identified by any one of SEQ ID NOs: 1-12263 (with or without the 5' sequence identified by SEQ ID NO: 12264), and is able to regulate the expression (e.g., activate or repress) the sequence to which it is operably linked. In some embodiments, a synthetic promoter comprises a nucleotide sequence that is 95-99% identical to the nucleotide sequence identified by any one of SEQ ID NOs: 1-12263 (with or without the 5' sequence identified by SEQ ID NO: 12264), and is able to regulate the expression (e.g., activate or repress) the sequence to which it is operably linked. In some embodiments, a synthetic promoter comprises a nucleotide sequence that is 95%-99%, 95%-98%, 95%-97%, 95%-96%, 96%-99%, 96%-98%, 96%-97%, 97%-99%, 97%-98%, or 98%-99% identical to the nucleotide sequence identified by any one of SEQ ID NOs: 1-12263 (with or without the 5' sequence identified by SEQ ID NO: 12264), and is able to regulate the expression (e.g., activate or repress) the sequence to which it is operably linked. In some embodiments, a synthetic promoter may comprise a nucleotide sequence that is 95%, 96%, 97%, 98%, 99%, or 99.5% identical to the nucleotide sequence identified by any one of SEQ ID NOs: 1-12263 (with or without the 5' sequence identified by SEQ ID NO: 12264), and is able to regulate the expression (e.g., activate or repress) the sequence to which it is operably linked.

Other aspects of the present disclosure provide synthetic promoters having differential activities in different cell lines or different cellular states. "Having differential activities" means the activity of a synthetic promoter is higher or lower in one type of cell or at a cellular state, compare to in a different type of cell or at a different cellular state, respectfully. In some embodiments, the activity of a synthetic promoter in one cell type or a cellular state is different from (higher or lower) the activity of the synthetic promoter in another cell type or another cellular state by at least 10% (e.g., at least 10%, 20%, 30%, 40%, 50%, 60%, 70%, 80%, 90% 100%, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100-fold, 500-fold, or 1000-fold). In some embodiments, the activity of a synthetic promoter in one cell type or a cellular state is different from (higher or lower) the activity of the synthetic promoter in another cell type or another cellular state by 10%-100%. For example, the activity of a synthetic promoter in one cell type or a cellular state may be different from (higher or lower) the activity of the synthetic promoter in another cell type or another cellular state by 10%-100%, 10%-90%, 10%-80%, 10%-70%, 10%-60%, 10%-50%, 10%-40%, 10%-30%, 10%-20%, 20%-100%, 20%-90%, 20%-80%, 20%-70%, 20%-60%, 20%-50%, 20%-40%, 20%-30%, 30%-100%, 30%-90%, 30%-80%, 30%-70%, 30%-60%, 30%-50%, 30%-40%, 40%-100%, 40%-90%, 40%-80%, 40%-70%, 40%-60%, 40%-50%, 50%-100%, 50%-90%, 50%-80%, 50%-70%, 50%-60%, 60%-100%, 60%-90%, 60%-80%, 60%-70%, 70%-100%, 70%-90%, 70%-80%, 80%-100%, 80%-90%, or 90%-100%. In some embodiments, the activity of a synthetic promoter in one cell type or a cellular state is different from (higher or lower) the activity of the synthetic promoter in another cell type or another cellular state by 1-1000 fold. For example, the activity of a synthetic promoter in one cell type or a cellular state may be different from (higher or lower than) the activity of the synthetic promoter in another cell type or another cellular state by 1-1000, 1-900, 1-800, 1-700, 1-600, 1-500, 1-400, 1-300, 1-200, 1-100, 1-90, 1-80, 1-70, 1-60, 1-50, 1-40, 1-30, 1-20, 1-10, 1-9, 1-8, 1-7, 1-6, 1- 5, 1-4, 1-3, 1-2, 5-1000, 5-900, 5-800, 5-700, 5-600, 5-500, 5-400, 5-300, 5-200, 5-100, 5-90, 5-80, 5-70, 5-60, 5-50, 5-40, 5-30, 5-20, 5-10, 5-9, 5-8, 5-7, 5-6, 10-1000, 10-900, 10-800, 10-700, 10-600, 10-500, 10-400, 10-300, 10-200, 10-100, 10-90, 10-80, 10-70, 10-60, 10-50, 10-40, 10-30, 10-20, 20-1000, 20-900, 20-800, 20-700, 20-600, 20-500, 20-400, 20-300, 20-200, 20-100, 20-90, 20-80, 20-70, 20-60, 20-50, 20-40, 20-30, 30-1000, 30-900, 30-800, 30-700, 30-600, 30-500, 30-400, 30-300, 30-200, 30-100, 30-90, 30-80, 30-70, 30-60, 30-50, 30-40, 40-1000, 40-900, 40-800, 40-700, 40-600, 40-500, 40-400, 40-300, 40-200, 40-100, 40-90, 40-80, 40-70, 40-60, 40-50, 50-1000, 50-900, 50-800, 50-700, 50-600, 50-500, 50-400, 50-300, 50-200, 50-100, 50-90, 50-80, 50-70, 50-60, 60-1000, 60-900, 60-800, 60-700, 60-600, 60-500, 60-400, 60-300, 60-200, 60-100, 60-90, 60-80, 60-70, 70-1000, 70-900, 70-800, 70-700, 70-600, 70-500, 70-400, 70-300, 70-200, 70-100, 70-90, 70-80, 80-1000, 80-900, 80-800, 80-700, 80-600, 80-500, 80-400, 80-300, 80-200, 80-100, 80-90, 90-1000, 90-900, 90-800, 90-700, 90-600, 90-500, 90-400, 90-300, 90-200, 90-100, 100-1000, 100-900, 100-800, 100-700, 100-600, 100-500, 100-400, 100-300, 100-200, 200-1000, 200-900, 200-800, 200-700, 200-600, 200-500, 200-400, 200-300, 300-1000, 300-900, 300-800, 300-700, 300-600, 300-500, 300-400, 400-1000, 400-900, 400-800, 400-700, 400-600, 400-500, 500-1000, 500-900, 500-800, 500-700, 500-600, 600-1000, 600-900, 600-800, 600-700, 700-1000, 700-900, 700-800, 800-1000, 800-900, or 900-1000 fold. In some embodiments, the activity of a synthetic promoter in one cell type or a cellular state may be different from (higher or lower than) the activity of the synthetic promoter in another cell type or another cellular state by 10%, 20%, 30%, 40%, 50%, 60%, 70%, 80%, 90%, 100%, 2 fold, 2-fold, 3-fold, 4-fold, 5-fold, 6-fold, 7-fold, 8-fold, 9-fold, 10-fold, 20-fold, 30-fold, 40-fold, 50-fold, 60-fold, 70-fold, 80-fold, 90-fold, 100- fold, 500-fold, or 1000-fold. In some embodiments, a synthetic promoter may be inactive in one cell type and active in another. In some embodiments, a synthetic promoter may be inactive in one cellular state and active in another. Methods of measuring the activities of a promoter (e.g., a synthetic promoter) are known to those skilled in the art, e.g., as described in Jeyaseelan et al., *Nucleic Acids Research.* 29 (12), 2001; Allard et al., *Cell Notes* (21), 2008; and Zaslaver et al., *Nature Methods.* 3 (8): 623-628, 2006, each of which is incorporated herein by reference.

In some embodiments, a synthetic promoter has differential activity (higher or lower) in one type of diseased cell relative to a healthy cell or another type of diseased cell. A "diseased cell" refers to an abnormal cell that is associated with a particular disease or condition. Non-limiting examples of diseased cells include: cancer cells, diseased neurons, diseased cardiomyocytes, diseased skin cells, diseased liver cells, diseased immune cells, diseased epithelial cells, diseased eye cells, diseased astrocytes, diseased microglia, and diseased stem cells. Other diseased cell types are encompassed herein. One skilled in the art is able to identify diseased cells. A "healthy" cell, also referred to as a "non-diseased cell," refers to a normal cell that is not associated with any disease or condition.

In some embodiments, a synthetic promoter has differential activity (e.g., higher or lower) in one cellular state relative to another cellular state. Non-limiting examples of different cell types that may transition between different cellular states include: embryonic stem cells, adult stem cells, induced pluripotent stem cells, neurons, cardiomyocytes, skin cells, liver cells, immune cells, epithelial cells, eye cells, astrocytes, and microglia.

In some embodiments, a synthetic promoter as provided herein is active only in or has higher activity in cancer cells. For example, a synthetic promoter as provided herein may be activate only in in breast cancer cells and remains inactive in non-breast cancer cells, or has higher activity in breast cancer cells compared to in healthy cells or non-breast cancer cells. As another example, a synthetic promoter as provided herein may be activate only in tumor cancer cells and remains inactive in circulating cancer cells, or has higher activity in tumor cancer cells compared to circulating cancer cells.

In some embodiments, a synthetic promoter has higher activity in a breast cancer cell relative to a healthy cell or relative to other types of cancer cells.

In some embodiments, a synthetic promoter has higher activity in a ovarian cancer cell relative to a healthy cell or relative to other types of cancer cells.

In some embodiments, a synthetic promoter has higher activity in a colorectal cancer cell relative to a healthy cell or relative to other types of cancer cells.

In some embodiments, a synthetic promoter comprises at least one (one or more) sequence identified in Table 5 (a specific transcription factor binding site sequence). In some embodiments, a synthetic promoter comprises at least one (e.g., at least 2, at least 3, at least 4, or at least 5) tandem repeat of a sequence identified in Table 5. In some embodiments, a synthetic promoter comprises 1, 2, 3, 4, 5, 6, 7, 8, 9, or 10 tandem repeat(s) of a sequence identified in Table 5. A repeat sequence of Table 5 may be separated from each other by a linker sequence. In some embodiments, the linker sequences comprises or consists of three (random) nucleotides (e.g., AGA, TCG, GAC, CTA, ACT, TGC, GTA). In some embodiments, a synthetic promoter comprises the following consensus motif: TFBS-AGA-TFBS-TCG-TFBS-GAC-TFBS-CTA-TFBS-ACT-TFBS-TGC-TFBS-GTA-TFBS, wherein "TFBS" is a transcription factor binding site of Table 5.

In some embodiments, a synthetic promoter may comprise a tandem repeat of a USF1 transcription factor binding site CCACGTGC (SEQ ID NO: 12265). In some embodiments, a synthetic promoter comprises the following sequence:

(SEQ ID NO: 12266)
CCACGTGCAGA<u>CCACGTGC</u>TCG<u>CCACGTGC</u>GAC<u>CCACGTGC</u>CTA<u>CCACGT</u>

<u>GC</u>ACT<u>CCACGTGC</u>TGC<u>CCACGTGC</u>GTA<u>CCACGTGCG</u>.

In some embodiments, a synthetic promoter may comprise a tandem repeat of a MAFK transcription factor binding site TGCTGAGTCAGCA (SEQ ID NO: 12267). In some embodiments, a synthetic promoter comprises the following sequence:

(SEQ ID NO: 12268)
<u>TGCTGAGTCAGCA</u>AGA<u>TGCTGAGTCAGCA</u>TCG<u>TGCTGAGTCAGCA</u>GA<u>CTG</u>

<u>CTGAGTCAGCA</u>CTA<u>TGCTGAGTCAGCA</u>ACT<u>TGCTGAGTCAGCA</u>TGC<u>TGCT</u>

<u>GAGTCAGCA</u>GTA<u>TGCTGAGTCAGCAG</u>.

Engineered Nucleic Acids and Output Molecules

Further provided herein are engineered nucleic acids (e.g., construct) containing the synthetic promoters described herein. In some embodiments, a synthetic promoter is operably linked to a nucleotide sequence encoding a molecule (e.g., a protein or nucleic acid). A promoter is considered to be "operably linked" when it is in a correct functional location and orientation in relation to a nucleic acid sequence it regulates to control ("drive") transcriptional initiation and/or expression of that sequence.

In some embodiments, a synthetic promoter is operably linked to a nucleotide sequence encoding an output molecule, such that activation of the synthetic promoter results in expression of the output molecule. The signal of the output molecule may be detected and its intensity is an indication of the level of activation of the synthetic promoter. As such, by comparing the signal from the output molecule, the activities of a synthetic promoter in different cell types can be compared. In some embodiments, a promoter that is operably linked to a nucleotide sequence encoding an output molecule may be used for diagnostic purposes. For example, when a synthetic promoter that has higher activity in a diseased cell (e.g., a cancer cell such as a breast cancer cell) is operably linked to a nucleotide sequence encoding an output molecule, the higher signal generated from the output molecule in a cell relative to another cell indicates that the cell is a diseased cell (e.g., a cancer cell such as a breast cancer cell). The example is not meant to be limiting. The synthetic promoter described herein may be used for the diagnosis of any disease, so long as it has differential activity in the diseased cell relative to a healthy cell or to other cell types.

In some embodiments, the output molecule is a detectable protein. In some embodiments, a detectable protein is a fluorescent protein. A fluorescent protein is a protein that emits a fluorescent light when exposed to a light source at an appropriate wavelength (e.g., light in the blue or ultraviolet range). Suitable fluorescent proteins that may be used as a detectable protein in the sensor circuit of the present disclosure include, without limitation, eGFP, eYFP, eCFP, mKate2, mCherry, mPlum, mGrape2, mRaspberry, mGrape1, mStrawberry, mTangerine, mBanana, and mHoneydew. In some embodiments, a detectable protein is an enzyme that hydrolyzes an substrate to produce a detectable signal (e.g., a chemiluminescent signal). Such enzymes include, without limitation, beta-galactosidase (encoded by LacZ), horseradish peroxidase, or luciferase. In some embodiments, the output signal is a fluorescent RNA. A fluorescent RNA is an RNA aptamer that emits a fluorescent light when bound to a fluorophore and exposed to a light source at an appropriate wavelength (e.g., light in the blue or ultraviolet range). Suitable fluorescent RNAs that may be used as an output signal in the sensor circuit of the present disclosure include, without limitation, Spinach and Broccoli (e.g., as described in Paige et al., Science Vol. 333, Issue 6042, pp. 642-646, 2011, incorporated herein by reference).

In some embodiments, a synthetic promoter is operably linked to a nucleotide sequence encoding a therapeutic molecule. A "therapeutic molecule" is a molecule that has therapeutic effects on a disease or condition, and may be used to treat a diseases or condition. Therapeutic molecules of the present disclosure may be nucleic acid-based or protein or polypeptide-based. In some embodiments, the synthetic promoter drives the expression of the therapeutic molecule in a desired cell type (e.g., cancer cell) but not in other cell types, due to the synthetic promoter's cell-specific activity. As such, targeted therapy of diseases (e.g., cancer) is achieved.

In some embodiments, nucleic acid-based therapeutic molecule may be an RNA interference (RNAi) molecule (e.g., a microRNA, siRNA, or shRNA) or an nucleic acid enzyme (e.g., a ribozyme). RNAi molecules and there use in silencing gene expression are familiar to those skilled in the art. In some embodiments, the RNAi molecule targets an oncogene.

An oncogene is a gene that in certain circumstances can transform a cell into a tumor cell. An oncogene may be a gene encoding a growth factor or mitogen (e.g., c-Sis), a receptor tyrosine kinase (e.g., EGFR, PDGFR, VEGFR, or HER2/neu), a cytoplasmic tyrosine kinase (e.g., Src family kinases, Syk-ZAP-70 family kinases, or BTK family kinases), a cytoplasmic serine/threonine kinase or their regulatory subunits (e.g., Raf kinase or cyclin-dependent kinase), a regulatory GTPase (e.g., Ras), or a transcription factor (e.g., Myc). In some embodiments, the oligonucleotide targets Lipocalin (Lcn2) (e.g., a Lcn2 siRNA). One skilled in the art is familiar with genes that may be targeted for the treatment of cancer.

Non-limiting examples of protein or polypeptide-based therapeutic molecules include enzymes, regulatory proteins (e.g., immuno-regulatory proteins), antigens, antibodies or antibody fragments, and structural proteins. In some embodiments, the protein or polypeptide-based therapeutic molecules are for cancer therapy.

Suitable enzymes (for operably linking to a synthetic promoter) for some embodiments of this disclosure include, for example, oxidoreductases, transferases, polymerases, hydrolases, lyases, synthases, isomerases, and ligases, digestive enzymes (e.g., proteases, lipases, carbohydrases, and nucleases). In some embodiments, the enzyme is selected from the group consisting of lactase, beta-galactosidase, a pancreatic enzyme, an oil-degrading enzyme, mucinase, cellulase, isomaltase, alginase, digestive lipases (e.g., lingual lipase, pancreatic lipase, phospholipase), amylases, cellulases, lysozyme, proteases (e.g., pepsin, trypsin, chymotrypsin, carboxypeptidase, elastase), esterases (e.g. sterol esterase), disaccharidases (e.g., sucrase, lactase, beta-galactosidase, maltase, isomaltase), DNases, and RNases.

Non-limiting examples of antibodies and fragments thereof include: bevacizumab (AVASTIN®), trastuzumab (HERCEPTIN®), alemtuzumab (CAMPATH®, indicated for B cell chronic lymphocytic leukemia), gemtuzumab (MYLOTARG®, hP67.6, anti-CD33, indicated for leukemia such as acute myeloid leukemia), rituximab (RITUXAN®), tositumomab (BEXXAR®, anti-CD20, indicated for B cell malignancy), MDX-210 (bispecific antibody that binds simultaneously to HER-2/neu oncogene protein product and type I Fc receptors for immunoglobulin G (IgG) (Fc gamma RI)), oregovomab (OVAREX®, indicated for ovarian cancer), edrecolomab (PANOREX®), daclizumab (ZENAPAX®), palivizumab (SYNAGIS®, indicated for respiratory conditions such as RSV infection), ibritumomab tiuxetan (ZEVALIN®, indicated for Non-Hodgkin's lymphoma), cetuximab (ERBITUX®), MDX-447, MDX-22, MDX-220 (anti-TAG-72), IOR-C5, IOR-T6 (anti-CD1), IOR EGF/R3, celogovab (ONCOSCINT® OV103), epratuzumab (LYMPHOCIDE®), pemtumomab (THERAGYN®), Gliomab-H (indicated for brain cancer, melanoma). In some embodiments, the antibody is an antibody that inhibits an immune check point protein, e.g., an anti-PD-1 antibody such as pembrolizumab (Keytruda®) or nivolumab (Opdivo®), or an anti-CTLA-4 antibody such as ipilimumab (Yervoy®). Other antibodies and antibody fragments may be operably linked to a synthetic promoter, as provided herein.

A regulatory protein may be, in some embodiments, a transcription factor or a immunoregulatory protein. Non-limiting, exemplary transcriptional factors include: those of the NFkB family, such as Rel-A, c-Rel, Rel-B, p50 and p52; those of the AP-1 family, such as Fos, FosB, Fra-1, Fra-2, Jun, JunB and JunD; ATF; CREB; STAT-1, -2, -3, -4, -5 and -6; NFAT-1, -2 and -4; MAF; Thyroid Factor; IRF; Oct-1 and -2; NF-Y; Egr-1; and USF-43, EGR1, Sp1, and E2F1. Other transcription factors may be operably linked to a synthetic promoter, as provided herein.

As used herein, an immunoregulatory protein is a protein that regulates an immune response. Non-limiting examples of immunoregulatory include: antigens, adjuvants (e.g., flagellin, muramyl dipeptide), cytokines including interleukins (e.g., IL-2, IL-7, IL-15 or superagonist/mutant forms of these cytokines), IL-12, IFN-gamma, IFN-alpha, GM-CSF, FLT3-ligand), and immunostimulatory antibodies (e.g., anti-CTLA-4, anti-CD28, anti-CD3, or single chain/antibody fragments of these molecules). Other immunoregulatory proteins may be operably linked to a synthetic promoter, as provided herein.

As used herein, an antigen is a molecule or part of a molecule that is bound by the antigen-binding site of an antibody. In some embodiments, an antigen is a molecule or moiety that, when administered to or expression in the cells of a subject, activates or increases the production of antibodies that specifically bind the antigen. Antigens of pathogens are well known to those of skill in the art and include, but are not limited to parts (coats, capsules, cell walls, flagella, fimbriae, and toxins) of bacteria, viruses, and other microorganisms. Examples of antigens that may be used in accordance with the disclosure include, without limitation, cancer antigens, self-antigens, microbial antigens, allergens and environmental antigens. Other antigens may be operably linked to a synthetic promoter, as provided herein.

In some embodiments, the antigen of the present disclosure is a cancer antigen. A cancer antigen is an antigen that is expressed preferentially by cancer cells (i.e., it is expressed at higher levels in cancer cells than on non-cancer cells) and, in some instances, it is expressed solely by cancer cells. Cancer antigens may be expressed within a cancer cell or on the surface of the cancer cell. Cancer antigens that may be used in accordance with the disclosure include, without limitation, MART-1/Melan-A, gp100, adenosine deaminase-binding protein (ADAbp), FAP, cyclophilin b, colorectal associated antigen (CRC)-C017-1A/GA733, carcinoembryonic antigen (CEA), CAP-1, CAP-2, etv6, AML1, prostate specific antigen (PSA), PSA-1, PSA-2, PSA-3, prostate-specific membrane antigen (PSMA), T cell receptor/CD3-zeta chain and CD20. The cancer antigen may be selected from the group consisting of MAGE-A1, MAGE-A2, MAGE-A3, MAGE-A4, MAGE-A5, MAGE-A6, MAGE-A7, MAGE-A8, MAGE-A9, MAGE-A10, MAGE-A11, MAGE-A12, MAGE-Xp2 (MAGE-B2), MAGE-Xp3 (MAGE-B3), MAGE-Xp4 (MAGE-B4), MAGE-C1, MAGE-C2, MAGE-C3, MAGE-C4 and MAGE-C5. The cancer antigen may be selected from the group consisting of GAGE-1, GAGE-2, GAGE-3, GAGE-4, GAGE-5, GAGE-6, GAGE-7, GAGE-8 and GAGE-9. The cancer antigen may be selected from the group consisting of BAGE, RAGE, LAGE-1, NAG, GnT-V, MUM-1, CDK4, tyrosinase, p53, MUC family, HER2/neu, p21ras, RCAS1, α-fetoprotein, E-cadherin, α-catenin, β-catenin, γ-catenin, p120ctn, gp100Pmel117, PRAME, NY-ESO-1, cdc27, adenomatous polyposis *coli* protein (APC), fodrin, Connexin 37, Ig-idiotype, p15, gp75, GM2 ganglioside, GD2 ganglioside, human papilloma virus proteins, Smad family of tumor antigens, lmp-1, P1A, EBV-encoded nuclear antigen (EBNA)-1, brain glycogen phosphorylase, SSX-1, SSX-2 (HOM-MEL-40), SSX-1, SSX-4, SSX-5, SCP-1 and CT-7, CD20 and c-erbB-2. Other cancer antigens may be operably linked to a synthetic promoter, as provided herein.

In some embodiments, a protein or polypeptide-based therapeutic molecule is a fusion protein. A fusion protein is a protein comprising two heterologous proteins, protein domains, or protein fragments, that are covalently bound to each other, either directly or indirectly (e.g., via a linker), via a peptide bond. In some embodiments, a fusion protein is encoded by a nucleic acid comprising the coding region of a protein in frame with a coding region of an additional protein, without intervening stop codon, thus resulting in the translation of a single protein in which the proteins are fused together.

A "nucleic acid" is at least two nucleotides covalently linked together, and in some instances, may contain phosphodiester bonds (e.g., a phosphodiester "backbone"). An "engineered nucleic acid" (also referred to as a "construct") is a nucleic acid that does not occur in nature. It should be understood, however, that while an engineered nucleic acid as a whole is not naturally-occurring, it may include nucleotide sequences that occur in nature. In some embodiments, an engineered nucleic acid comprises nucleotide sequences from different organisms (e.g., from different species). For example, in some embodiments, an engineered nucleic acid includes a murine nucleotide sequence, a bacterial nucleotide sequence, a human nucleotide sequence, and/or a viral nucleotide sequence. Engineered nucleic acids include recombinant nucleic acids and synthetic nucleic acids. A "recombinant nucleic acid" is a molecule that is constructed by joining nucleic acids (e.g., isolated nucleic acids, synthetic nucleic acids or a combination thereof) and, in some embodiments, can replicate in a living cell. A "synthetic nucleic acid" is a molecule that is amplified or chemically, or by other means, synthesized. A synthetic nucleic acid includes those that are chemically modified, or otherwise modified, but can base pair with naturally-occurring nucleic acid molecules. Recombinant and synthetic nucleic acids also include those molecules that result from the replication of either of the foregoing.

In some embodiments, a nucleic acid of the present disclosure is considered to be a nucleic acid analog, which may contain, at least in part, other backbones comprising, for example, phosphoramide, phosphorothioate, phosphorodithioate, O-methylphophoroamidite linkages and/or peptide nucleic acids. A nucleic acid may be single-stranded (ss) or double-stranded (ds), as specified, or may contain portions of both single-stranded and double-stranded sequence. In some embodiments, a nucleic acid may contain portions of triple-stranded sequence. A nucleic acid may be DNA, both genomic and/or cDNA, RNA or a hybrid, where the nucleic acid contains any combination of deoxyribonucleotides and ribonucleotides (e.g., artificial or natural), and any combination of bases, including uracil, adenine, thymine, cytosine, guanine, inosine, xanthine, hypoxanthine, isocytosine and isoguanine.

Nucleic acids of the present disclosure may include one or more genetic elements. A "genetic element" refers to a particular nucleotide sequence that has a role in nucleic acid expression (e.g., promoter, enhancer, terminator) or encodes a discrete product of an engineered nucleic acid (e.g., a nucleotide sequence encoding a guide RNA, a protein and/or an RNA interference molecule, such as siRNA or miRNA).

Nucleic acids of the present disclosure may be produced using standard molecular biology methods (see, e.g., *Green and Sambrook, Molecular Cloning,* A Laboratory Manual, 2012, Cold Spring Harbor Press).

In some embodiments, nucleic acids are produced using GIBSON ASSEMBLY® Cloning (see, e.g., Gibson, D. G. et al. *Nature Methods,* 343-345, 2009; and Gibson, D. G. et al. *Nature Methods,* 901-903, 2010, each of which is incorporated by reference herein). GIBSON ASSEMBLY® typically uses three enzymatic activities in a single-tube reaction: 5' exonuclease, the 3' extension activity of a DNA polymerase and DNA ligase activity. The 5' exonuclease activity chews back the 5' end sequences and exposes the complementary sequence for annealing. The polymerase activity then fills in the gaps on the annealed regions. A DNA ligase then seals the nick and covalently links the DNA fragments together. The overlapping sequence of adjoining fragments is much longer than those used in Golden Gate Assembly, and therefore results in a higher percentage of correct assemblies.

Figure 3:
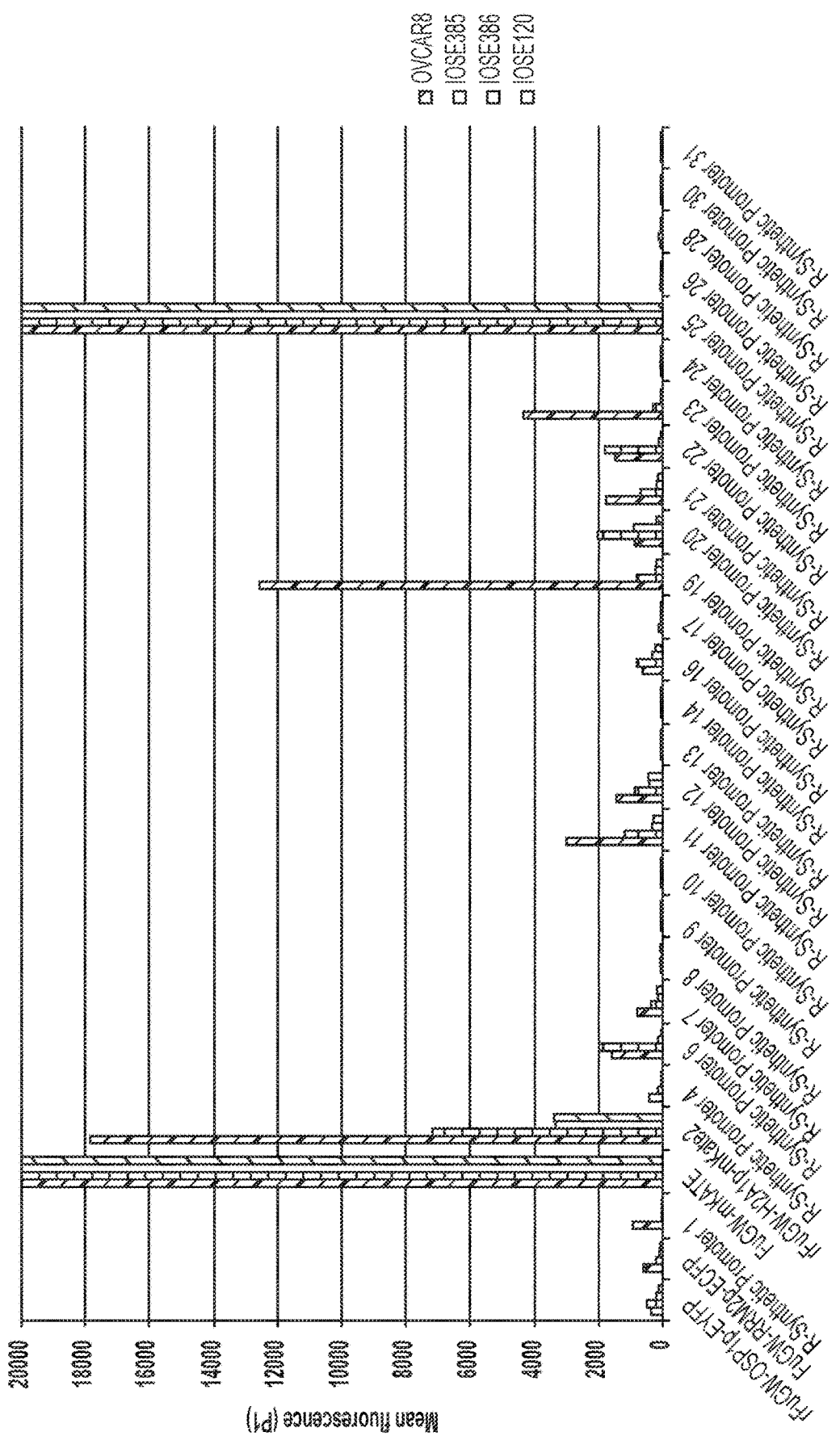
FIG. 3 is a graph showing the activities of synthetic promoters in four cell lines: OVCAR8, IOSE385, IOSE386, and IOSE120.
Figure 4:
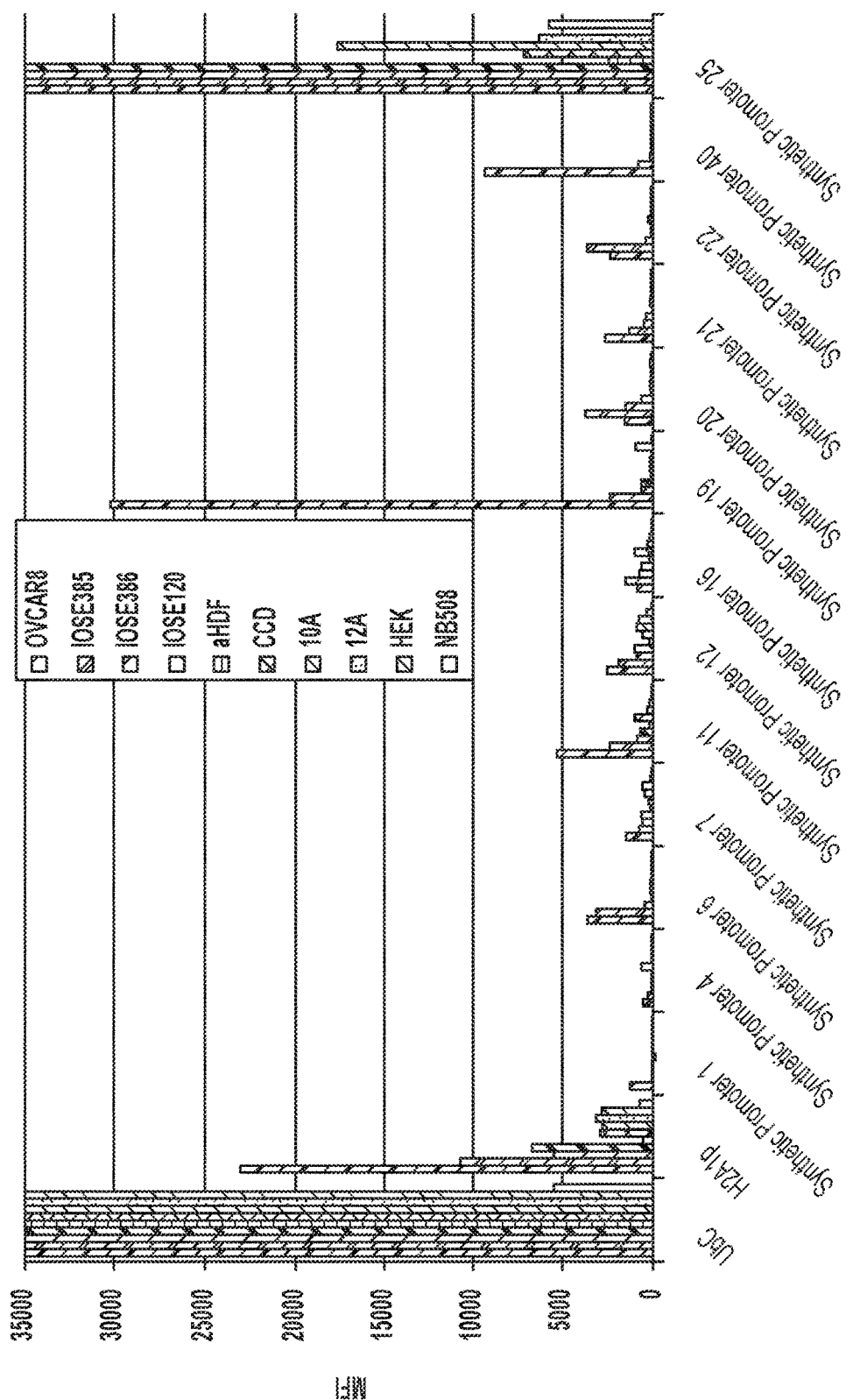
FIG. 4 is a graph showing the activities of synthetic promoters in eight different cell lines: OVCAR8, IOSE385, IOSE386, IOSE120, aHDF, CCD, 12A, 10A, HEK, and NB508.
Figure 5:
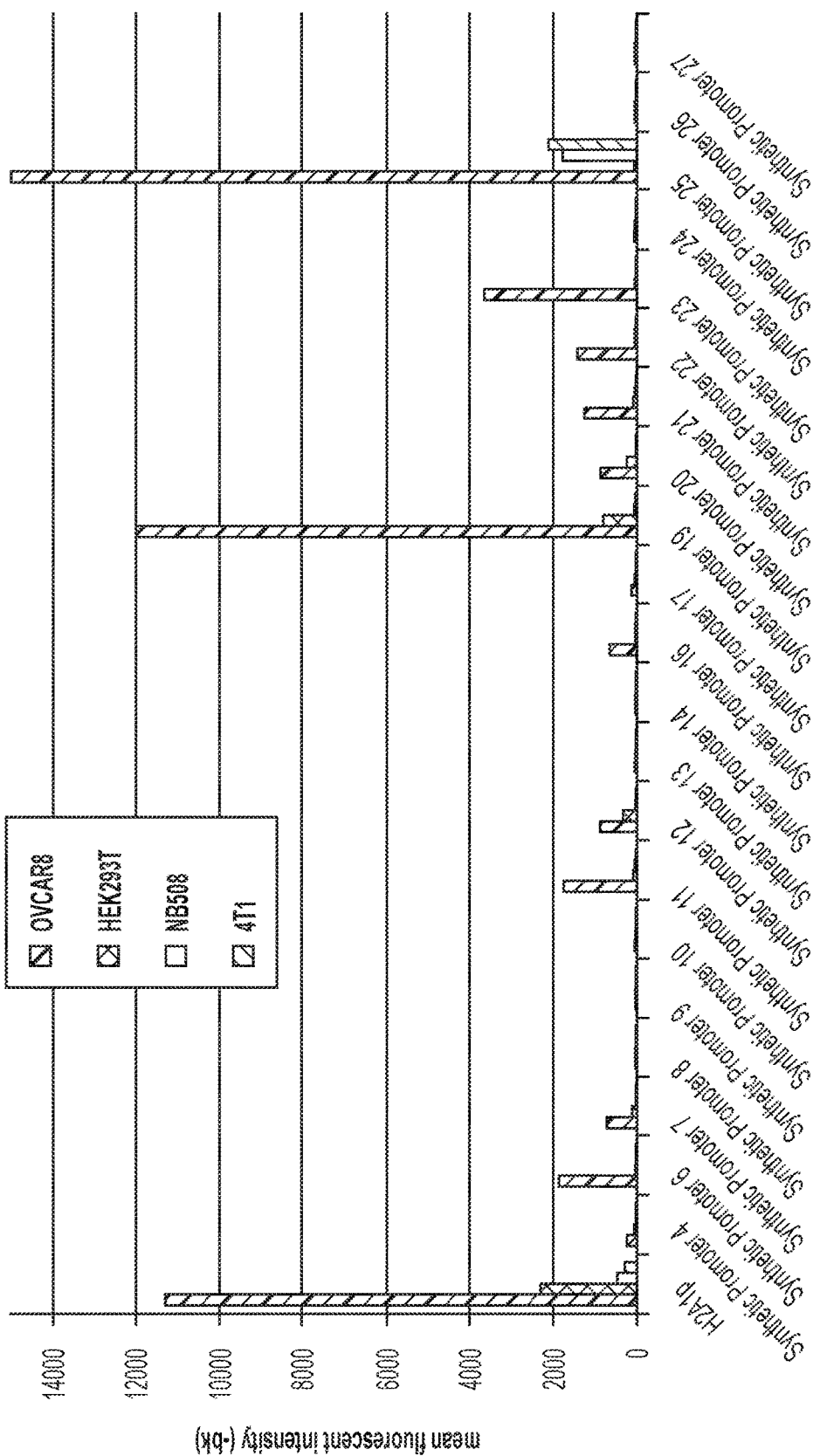
FIG. 5 is a graph showing the activities of synthetic promoters in four different cell lines: OVCAR8, HEK293T, NB508, and 4T1.
Figure 6:
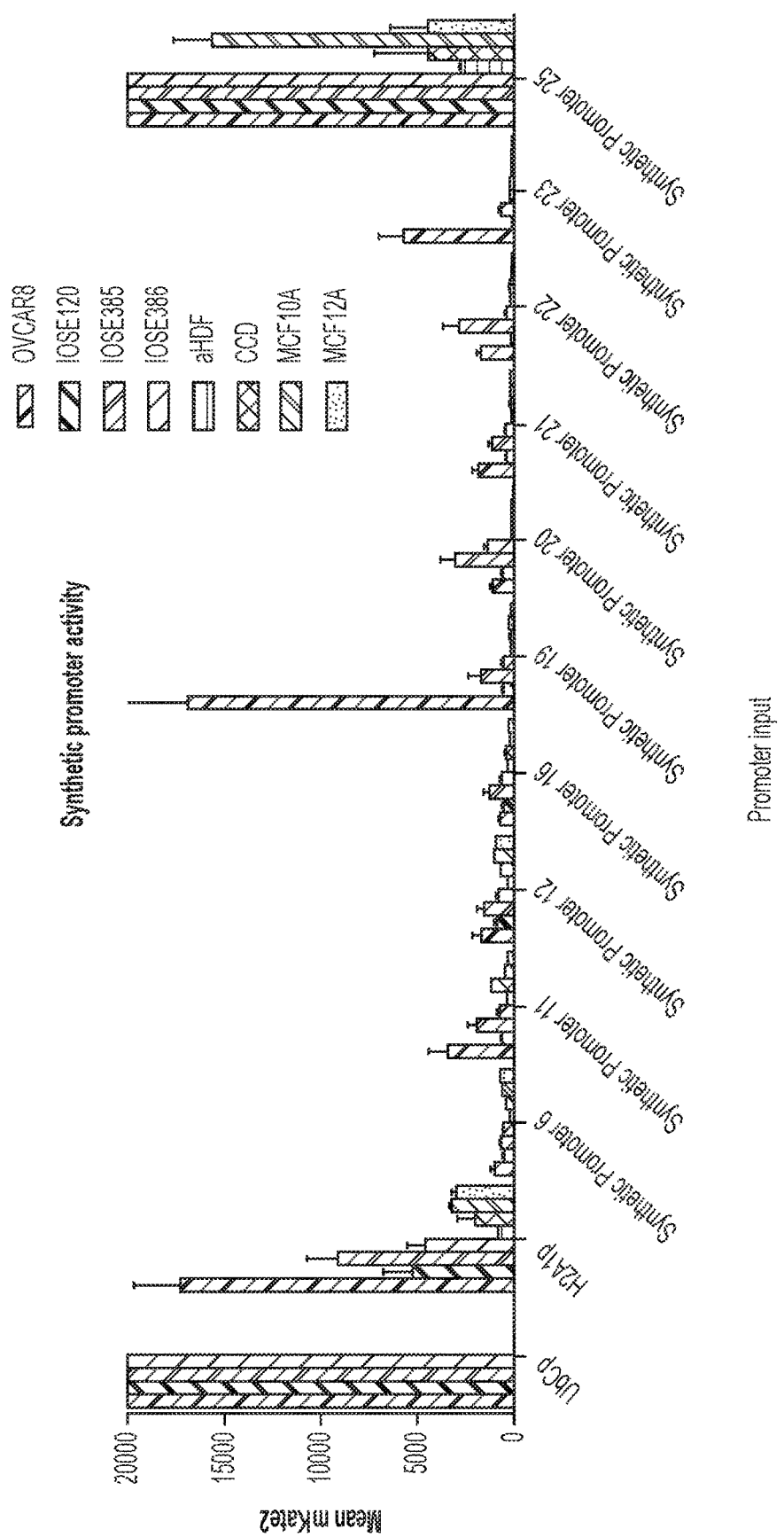
FIG. 6 is a graph showing the activities of synthetic promoters in eight different cell lines: OVCAR8, IOSE385, IOSE386, IOSE120, aHDF, CCD, MCF10A, and MCF12A.
Figure 7:
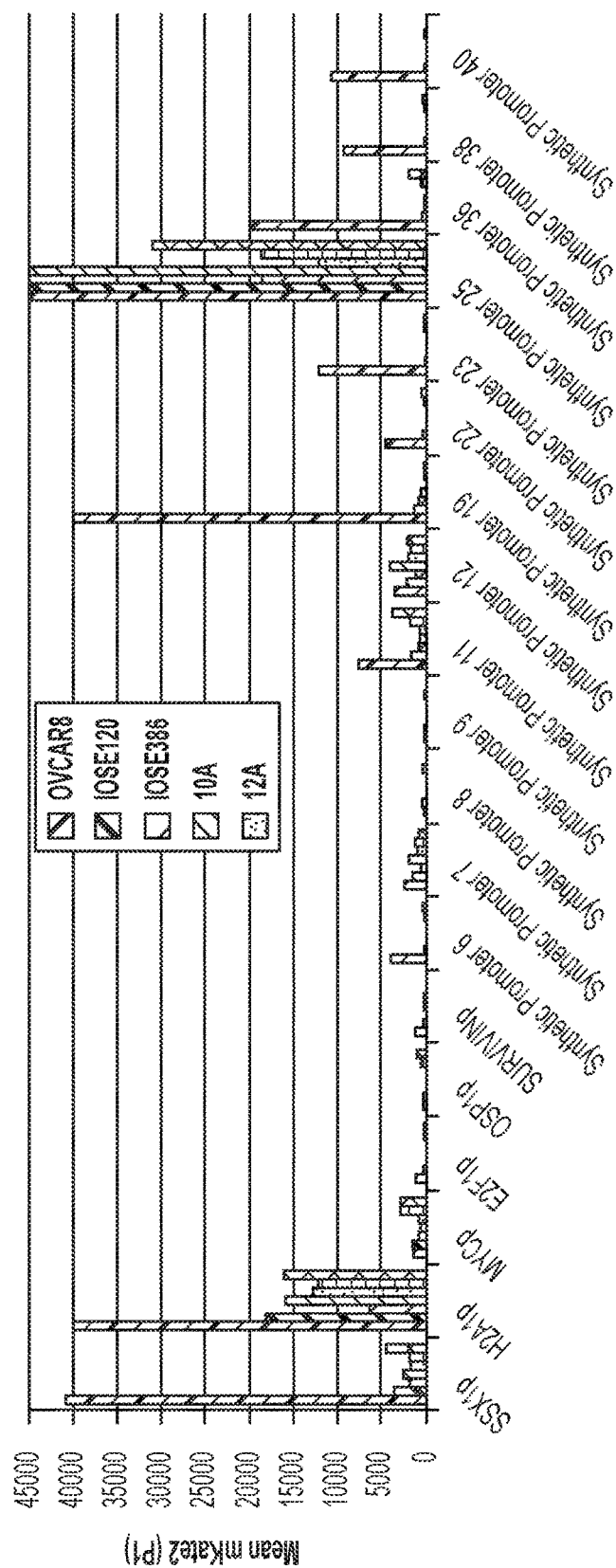
FIG. 7 is a graph showing the activities of synthetic promoters in four different cell lines: OVCAR8, IOSE386, IOSE120, 12A, and 10A.

In some embodiments, an engineered nucleic acid is delivered to a cell on a vector. A "vector" refers to a nucleic acid (e.g., DNA) used as a vehicle to artificially carry genetic material (e.g., an engineered nucleic acid) into a cell where, for example, it can be replicated and/or expressed. In some embodiments, a vector is an episomal vector (see, e.g., Van Craenenbroeck K. et al. *Eur. J. Biochem.* 267, 5665, 2000, incorporated by reference herein). A non-limiting example of a vector is a plasmid (e.g., FIG. 3). Plasmids are double-stranded generally circular DNA sequences that are capable of automatically replicating in a host cell. Plasmid vectors typically contain an origin of replication that allows for semi-independent replication of the plasmid in the host and also the transgene insert. Plasmids may have more features, including, for example, a "multiple cloning site," which includes nucleotide overhangs for insertion of a nucleic acid insert, and multiple restriction enzyme consensus sites to either side of the insert. Another non-limiting example of a vector is a viral vector, such as an oncolytic herpes simplex virus. Thus, the present disclosure provides oncolytic herpes simplex virus vectors comprising an engineered nucleic acid comprising a promoter that comprises the nucleotide sequence identified by any one of SEQ ID NOS: 1-12263, or a nucleotide sequences at least 95% identical to the nucleotide sequence identified by any one of SEQ ID NOS: 1-12263.

Cells

Cells comprising the engineered nucleic acids of the present disclosure are also provided. Engineered nucleic acids comprising the synthetic promoters described herein are, in some embodiments, delivered systemically or to a particular cell type, such as a cancerous cell, a benign tumor cell or other disease cell. In some embodiments, engineered nucleic acids are delivered to a subject having tumor cells or cancer cells, and the synthetic promoters drive the expression of the nucleotide sequence to which it is operably linked to specifically in the tumor cells or cancer cells.

A cancerous cell may be any type of cancerous cell, including, but not limited to, premalignant neoplasms, malignant tumors, metastases, or any disease or disorder characterized by uncontrolled cell growth such that it would be considered cancerous or precancerous. The cancer may be a primary or metastatic cancer. Cancers include, but are not limited to, ocular cancer, biliary tract cancer, bladder cancer, pleura cancer, stomach cancer, ovary cancer, meninges cancer, kidney cancer, brain cancer including glioblastomas and medulloblastomas, breast cancer, cervical cancer, choriocarcinoma, colon cancer, endometrial cancer, esophageal cancer, gastric cancer, hematological neoplasms including acute lymphocytic and myelogenous leukemia, multiple myeloma, AIDS-associated leukemias and adult T-cell leukemia lymphoma, intraepithelial neoplasms including Bowen's disease and Paget's disease, liver cancer, lung cancer, lymphomas including Hodgkin's disease and lymphocytic lymphomas, neuroblastomas, oral cancer including squamous cell carcinoma, ovarian cancer including those arising from epithelial cells, stromal cells, germ cells and mesenchymal cells, pancreatic cancer, prostate cancer, rectal cancer, sarcomas including leiomyosarcoma, rhabdomyosarcoma, liposarcoma, fibrosarcoma, and osteosarcoma, skin cancer including melanoma, Kaposi's sarcoma, basocellular cancer, and squamous cell cancer, testicular cancer including germinal tumors such as seminoma, non-seminoma, teratomas, choriocarcinomas, stromal tumors and germ cell tumors, thyroid cancer including thyroid adenocarcinoma and medullar carcinoma, and renal cancer including adenocarcinoma and Wilms' tumor. Commonly encountered cancers include breast, prostate, lung, ovarian, colorectal, and brain cancer. In some embodiments, the tumor is a melanoma, carcinoma, sarcoma, or lymphoma.

Engineered nucleic acids of the present disclosure may be used in a broad range of host cell types. In some embodiments, engineered nucleic acids are used in mammalian cells (e.g., human cells), bacterial cells (*Escherichia coli* cells), yeast cells, insect cells, or other types of cells. Engineered nucleic acids of the present disclosure may be used in vivo, e.g., in a subject such as a human subject.

In some embodiments, engineered nucleic acids comprising synthetic promoters are used in mammalian cells, for example, for research or therapeutic applications. For example, in some embodiments, engineered nucleic acids are used in human cells, primate cells (e.g., vero cells), rat cells (e.g., GH3 cells, OC23 cells) or mouse cells (e.g., MC3T3 cells). There are a variety of human cell lines, including, without limitation, human embryonic kidney (HEK) cells, HeLa cells, cancer cells from the National Cancer Institute's 60 cancer cell lines (NCI60), DU145 (prostate cancer) cells, Lncap (prostate cancer) cells, MCF-7 (breast cancer) cells, MDA-MB-438 (breast cancer) cells, PC3 (prostate cancer) cells, T47D (breast cancer) cells, THP-1 (acute myeloid leukemia) cells, U87 (glioblastoma) cells, SHSY5Y human neuroblastoma cells (cloned from a myeloma) and Saos-2 (bone cancer) cells. In some embodiments, engineered nucleic acids are expressed in human embryonic kidney (HEK) cells (e.g., HEK 293 or HEK 293T cells). In some embodiments, engineered nucleic acids are expressed in stem cells (e.g., human stem cells) such as, for example, pluripotent stem cells (e.g., human pluripotent stem cells including human induced pluripotent stem cells (hiPSCs)). A "stem cell" refers to a cell with the ability to divide for indefinite periods in culture and to give rise to specialized cells. A "pluripotent stem cell" refers to a type of stem cell that is capable of differentiating into all tissues of an organism, but not alone capable of sustaining full organismal development. A "human induced pluripotent stem cell" refers to a somatic (e.g., mature or adult) cell that has been reprogrammed to an embryonic stem cell-like state by being forced to express genes and factors important for maintaining the defining properties of embryonic stem cells (see, e.g., Takahashi and Yamanaka, Cell 126 (4): 663-76, 2006, incorporated by reference herein). Human induced pluripotent stem cell cells express stem cell markers and are capable of generating cells characteristic of all three germ layers (ectoderm, endoderm, mesoderm).

Additional non-limiting examples of cell lines that may be used in accordance with the present disclosure include 293-T, 293-T, 3T3, 4T1, 721, 9L, A-549, A172, A20, A253, A2780, A2780ADR, A2780cis, A431, ALC, B16, B35, BCP-1, BEAS-2B, bEnd.3, BHK-21, BR 293, BxPC3, C2C12, C3H-10T1/2, C6, C6/36, Cal-27, CGR8, CHO, CML T1, CMT, COR-L23, COR-L23/5010, COR-L23/CPR, COR-L23/R23, COS-7, COV-434, CT26, D17, DH82, DU145, DuCaP, E14Tg2a, EL4, EM2, EM3, EMT6/AR1, EMT6/AR10.0, FM3, H1299, H69, HB54, HB55, HCA2, Hepa1c1c7, High Five cells, HL-60, HMEC, HT-29, HUVEC, J558L cells, Jurkat, JY cells, K562 cells, KCL22, KG1, Ku812, KYO1, LNCap, Ma-Mel 1, 2, 3 . . . 48, MC-38, MCF-10A, MCF-7, MDA-MB-231, MDA-MB-435, MDA-MB-468, MDCK II, MG63, MONO-MAC 6, MOR/0.2R, MRC5, MTD-1A, MyEnd, NALM-1, NCI-H69/CPR, NCI-H69/LX10, NCI-H69/LX20, NCI-H69/LX4, NIH-3T3, NW-145, OPCN/OPCT Peer, PNT-1A/PNT 2, PTK2, Raji, RBL cells, RenCa, RIN-5F, RMA/RMAS, S2, Saos-2 cells, Sf21, Sf9, SiHa, SKBR3, SKOV-3, T-47D, T2, T84, THP1, U373, U87, U937, VCaP, WM39, WT-49, X63, YAC-1 and YAR cells.

Cells of the present disclosure, in some embodiments, are modified. A modified cell is a cell that contains an exogenous nucleic acid or a nucleic acid that does not occur in nature. In some embodiments, a modified cell contains a mutation in a genomic nucleic acid. In some embodiments, a modified cell contains an exogenous independently replicating nucleic acid (e.g., an engineered nucleic acid present on an episomal vector). In some embodiments, a modified cell is produced by introducing a foreign or exogenous nucleic acid into a cell. A nucleic acid may be introduced into a cell by conventional methods, such as, for example, electroporation (see, e.g., Heiser W. C. *Transcription Factor Protocols: Methods in Molecular Biology™* 2000; 130: 117-134), chemical (e.g., calcium phosphate or lipid) transfection (see, e.g., Lewis W. H., et al., *Somatic Cell Genet.* 1980 May; 6(3): 333-47; Chen C., et al., *Mol Cell Biol.* 1987 August; 7(8): 2745-2752), fusion with bacterial protoplasts containing recombinant plasmids (see, e.g., Schaffner W.

*Proc Natl Acad Sci USA*. 1980 April; 77(4): 2163-7), transduction, conjugation, or microinjection of purified DNA directly into the nucleus of the cell (see, e.g., Capecchi M. R. *Cell*. 1980 November; 22(2 Pt 2): 479-88).

In some embodiments, a cell is modified to express a reporter molecule. In some embodiments, a cell is modified to express an inducible promoter operably linked to a reporter molecule (e.g., a fluorescent protein such as green fluorescent protein (GFP) or other reporter molecule).

In some embodiments, a cell is modified to overexpress an endogenous protein of interest (e.g., via introducing or modifying a promoter or other regulatory element near the endogenous gene that encodes the protein of interest to increase its expression level). In some embodiments, a cell is modified by mutagenesis. In some embodiments, a cell is modified by introducing an engineered nucleic acid into the cell in order to produce a genetic change of interest (e.g., via insertion or homologous recombination).

In some embodiments, an engineered nucleic acid may be codon-optimized, for example, for expression in mammalian cells (e.g., human cells) or other types of cells. Codon optimization is a technique to maximize the protein expression in living organism by increasing the translational efficiency of gene of interest by transforming a DNA sequence of nucleotides of one species into a DNA sequence of nucleotides of another species. Methods of codon optimization are well-known.

Also provided herein, in some aspects, are methods that comprise introducing into a cell an (e.g., at least one, at least two, at least three, or more) engineered nucleic acids or an episomal vector (e.g., comprising an engineered nucleic acid). An engineered nucleic acid may be introduced into a cell by conventional methods, such as, for example, electroporation, chemical (e.g., calcium phosphate or lipid) transfection, fusion with bacterial protoplasts containing recombinant plasmids, transduction, conjugation, or microinjection of purified DNA directly into the nucleus of the cell.

Engineered nucleic acids of the present disclosure may be delivered to a subject (e.g., a mammalian subject, such as a human subject) by any in vivo delivery method known in the art. For example, engineered nucleic acids may be delivered intravenously. In some embodiments, engineered nucleic acids are delivered in a delivery vehicle (e.g., non-liposomal nanoparticle or liposome). In some embodiments, engineered nucleic acids are delivered systemically to a subject having a cancer or other disease and activated (transcription is activated) specifically in cancer cells or diseased cells of the subject.

Engineered nucleic acids, as discussed above, may be delivered to cells (e.g., cancer cells) of a subject using a viral delivery system (e.g., retroviral, adenoviral, adeno-association, helper-dependent adenoviral systems, hybrid adenoviral systems, herpes simplex, pox virus, lentivirus, Epstein-Barr virus) or a non-viral delivery system (e.g., physical: naked DNA, DNA bombardment, electroporation, hydrodynamic, ultrasound or magnetofection; or chemical: cationic lipids, different cationic polymers or lipid polymer) (Nayerossadat N et al. *Adv Biomed Res*. 2012; 1: 27, incorporated herein by reference). In some embodiments, the non-viral based deliver system is a hydrogel-based delivery system (see, e.g., Brandl F, et al. *Journal of Controlled Release*, 2010, 142(2): 221-228, incorporated herein by reference).

Additional Embodiments

The present disclosure further provides the additional embodiments set forth in the following numbered paragraphs:

1. An engineered nucleic acid comprising a promoter that comprises the nucleotide sequence identified by any one of SEQ ID NOS: 1-12263, or a nucleotide sequences at least 95% identical to the nucleotide sequence identified by any one of SEQ ID NOS: 1-12263.
2. The engineered nucleic acid of paragraph 1, wherein the activity of the promoter is increased in diseased cells relative to healthy cells.
3. The engineered nucleic acid of paragraph 1, wherein the activity of the promoter is decreased in diseased cells relative to healthy cells.
4. The engineered nucleic acid of paragraph 2 or 3, wherein the diseased cells are selected from breast cancer cells, colon cancer cells, and ovarian cancer cells.
5. The engineered nucleic acid of any one of paragraphs 1-4, wherein the promoter is operably linked to a nucleotide sequence encoding a therapeutic protein.
6. A cell comprising the engineered nucleic acid of any one of paragraphs 1-5.
7. A method of delivering to a cell the engineered nucleic acid of any one of paragraphs 1-5.
8. A method of delivering to a subject the engineered nucleic acid of any one of paragraphs 1-5.
9. A method of delivering to a subject the cell of paragraph 6.
10. The engineered nucleic acid of any one of paragraphs 1-5, wherein the nucleotide sequence is identified by any one of SEQ ID NO: 1-40 or a nucleotide sequences at least 95% identical to the nucleotide sequence identified by any one of SEQ ID NO: 1-40.
11. The engineered nucleic acid of paragraph 10, wherein the nucleotide sequence is identified by SEQ ID NO: 1.
12. The engineered nucleic acid of paragraph 10, wherein the nucleotide sequence is identified by SEQ ID NO: 2.
13. The engineered nucleic acid of paragraph 10, wherein the nucleotide sequence is identified by SEQ ID NO: 3.
14. The engineered nucleic acid of paragraph 10, wherein the nucleotide sequence is identified by SEQ ID NO: 4.
15. The engineered nucleic acid of paragraph 10, wherein the nucleotide sequence is identified by SEQ ID NO: 5.
16. The engineered nucleic acid of paragraph 10, wherein the nucleotide sequence is identified by SEQ ID NO: 6.
17. The engineered nucleic acid of paragraph 10, wherein the nucleotide sequence is identified by SEQ ID NO: 7.
18. The engineered nucleic acid of paragraph 10, wherein the nucleotide sequence is identified by SEQ ID NO: 8.
19. The engineered nucleic acid of paragraph 10, wherein the nucleotide sequence is identified by SEQ ID NO: 9.
20. The engineered nucleic acid of paragraph 10, wherein the nucleotide sequence is identified by SEQ ID NO: 10.
21. The engineered nucleic acid of paragraph 10, wherein the nucleotide sequence is identified by SEQ ID NO: 11.
22. The engineered nucleic acid of paragraph 10, wherein the nucleotide sequence is identified by SEQ ID NO: 12.
23. The engineered nucleic acid of paragraph 10, wherein the nucleotide sequence is identified by SEQ ID NO: 13.
24. The engineered nucleic acid of paragraph 10, wherein the nucleotide sequence is identified by SEQ ID NO: 14.
25. The engineered nucleic acid of paragraph 10, wherein the nucleotide sequence is identified by SEQ ID NO: 15.
26. The engineered nucleic acid of paragraph 10, wherein the nucleotide sequence is identified by SEQ ID NO: 16.

27. The engineered nucleic acid of paragraph 10, wherein the nucleotide sequence is identified by SEQ ID NO: 17.
28. The engineered nucleic acid of paragraph 10, wherein the nucleotide sequence is identified by SEQ ID NO: 18.
29. The engineered nucleic acid of paragraph 10, wherein the nucleotide sequence is identified by SEQ ID NO: 19.
30. The engineered nucleic acid of paragraph 10, wherein the nucleotide sequence is identified by SEQ ID NO: 20.
31. The engineered nucleic acid of paragraph 10, wherein the nucleotide sequence is identified by SEQ ID NO: 21.
32. The engineered nucleic acid of paragraph 10, wherein the nucleotide sequence is identified by SEQ ID NO: 22.
33. The engineered nucleic acid of paragraph 10, wherein the nucleotide sequence is identified by SEQ ID NO: 23.
34. The engineered nucleic acid of paragraph 10, wherein the nucleotide sequence is identified by SEQ ID NO: 24.
35. The engineered nucleic acid of paragraph 10, wherein the nucleotide sequence is identified by SEQ ID NO: 25.
36. The engineered nucleic acid of paragraph 10, wherein the nucleotide sequence is identified by SEQ ID NO: 26.
37. The engineered nucleic acid of paragraph 10, wherein the nucleotide sequence is identified by SEQ ID NO: 27.
38. The engineered nucleic acid of paragraph 10, wherein the nucleotide sequence is identified by SEQ ID NO: 28.
39. The engineered nucleic acid of paragraph 10, wherein the nucleotide sequence is identified by SEQ ID NO: 29.
40. The engineered nucleic acid of paragraph 10, wherein the nucleotide sequence is identified by SEQ ID NO: 30.
41. The engineered nucleic acid of paragraph 10, wherein the nucleotide sequence is identified by SEQ ID NO: 31.
42. The engineered nucleic acid of paragraph 10, wherein the nucleotide sequence is identified by SEQ ID NO: 32.
43. The engineered nucleic acid of paragraph 10, wherein the nucleotide sequence is identified by SEQ ID NO: 33.
44. The engineered nucleic acid of paragraph 10, wherein the nucleotide sequence is identified by SEQ ID NO: 34.
45. The engineered nucleic acid of paragraph 10, wherein the nucleotide sequence is identified by SEQ ID NO: 35.
46. The engineered nucleic acid of paragraph 10, wherein the nucleotide sequence is identified by SEQ ID NO: 36.
47. The engineered nucleic acid of paragraph 10, wherein the nucleotide sequence is identified by SEQ ID NO: 37.
48 The engineered nucleic acid of paragraph 10, wherein the nucleotide sequence is identified by SEQ ID NO: 38.
49. The engineered nucleic acid of paragraph 10, wherein the nucleotide sequence is identified by SEQ ID NO: 39.
50. The engineered nucleic acid of paragraph 10, wherein the nucleotide sequence is identified by SEQ ID NO: 40.
51. The engineered nucleic acid of any one of paragraphs 1-5, wherein the nucleotide sequence is identified by any one of SEQ ID NO: 41-49, or a nucleotide sequences at least 95% identical to the nucleotide sequence identified by any one of SEQ ID NO: 41-49.
52. The engineered nucleic acid of paragraph 51, wherein the nucleotide sequence is identified by SEQ ID NO: 41.
53. The engineered nucleic acid of paragraph 51, wherein the nucleotide sequence is identified by SEQ ID NO: 42.
54. The engineered nucleic acid of paragraph 51, wherein the nucleotide sequence is identified by SEQ ID NO: 43.
55. The engineered nucleic acid of paragraph 51, wherein the nucleotide sequence is identified by SEQ ID NO: 44.
56. The engineered nucleic acid of paragraph 51, wherein the nucleotide sequence is identified by SEQ ID NO: 45.
57. The engineered nucleic acid of paragraph 51, wherein the nucleotide sequence is identified by SEQ ID NO: 46.
58. The engineered nucleic acid of paragraph 51, wherein the nucleotide sequence is identified by SEQ ID NO: 47.
59. The engineered nucleic acid of paragraph 51, wherein the nucleotide sequence is identified by SEQ ID NO: 48.
60. The engineered nucleic acid of paragraph 51, wherein the nucleotide sequence is identified by SEQ ID NO: 49.
61. An oncolytic virus comprising the engineered nucleic acid of any one of paragraphs 1-5 or 10-60.
62. The oncolytic virus of paragraph 61, wherein the oncolytic virus is an oncolytic herpes simplex virus.

EXAMPLES

Example 1. Synthetic Promoter Activity and Specificity—Synthetic Promoters 1-40

Reporter constructs were constructed by placing the coding sequence of ECFP or mKate2 under the synthetic promoters. The reporter constructs were transfected into different cell lines as listed in Table 1. The expression of ECFP or mKate2 indicates the activity of the synthetic promoter in each cell line. The activities of a set of synthetic promoters (Table 2) were tested in different cell lines. The results are provided in FIGS. 1-7.

TABLE 1

Different Cell Lines for Testing Promoter Activity

| # | Line | Type | Tissue | Organism |
|---|---|---|---|---|
| 1 | OVCAR8 | cancer | ovarian | human |
| 2 | IOSE386 | normal | ovarian | human |
| 3 | IOSE385 | normal | ovarian | human |
| 4 | IOSE120 | normal | ovarian | human |
| 5 | HCT116 | cancer | Colorectal | human |
| 6 | CCD-841-Con | normal | Colon | human |
| 7 | SKBR3 | cancer | breast | human |
| 8 | MDA-MB-453 | cancer | breast | human |
| 9 | MDA-MB-231 | cancer | breast | human |
| 10 | MCF-7 | cancer | breast | human |
| 11 | MCF-10A | normal | breast | human |
| 12 | MCF-12A | normal | breast | human |
| 13 | aHDF | normal | adult dermal fibroblasts | human |
| 14 | NB508 | cancer | pancreatic | mouse |
| 15 | 4T1 | cancer | breast | mouse |

Examples of synthetic promoters used to regulate expression of ECFP:

TABLE 2

Synthetic Promoters 1-40

| Name | Sequence | SEQ ID NO |
|---|---|---|
| Synthetic Promoter 1 | CAGGGGATGCTTTAGGCGGGAAAGTCAGAGTTTCTGCCTCCAT TTCCCAGGGGATGCTTTAGGCGGGAAAGTCAGAGTTTCTGCCT CCATTTGTCATGCATCTCAATTACCCAGGGGATGCTTTAGGCG GGAAAGTCAGAGTTTCTGCCTCCATTTCCCAGGGGATGCTTTA GGCGGGAAAGTCAGAGTTTCTGCCTCCATTT | 1 |

TABLE 2-continued

Synthetic Promoters 1-40

| Name | Sequence | SEQ ID NO |
|---|---|---|
| Synthetic Promoter 2 | CCCGTTTCCAGCCGAAACGTAGCCGTTTCGTACTCGAGCTTTG GCGCATCCGTTTCCCGAATTCCCGAAACGTTCCTTTGGCGCTG CCCTACTGACACTGCCTGCGTTTCCAGCCGAAACGTAGCCGTT TCGTACTCGAGCTTTGGCGCATCCGTTTCCCGAATTCCCGAAA CGTTCCTTTGGCGC | 2 |
| Synthetic Promoter 3 | CCCGTTTCCAGCCGAAACGTAGCCGTTTCGTACTCGAGCTTTG GCGCATCCGTTTCCCGAATTCCCGAAACGTTCCTTTGGCGCTG CCCTACTGACACTGCCTGCGTTTCCAGCCGAAACGTAGCCGTT TCGTACTCGAGCTTTGGCGCATCCGTTTCCCGAATTCCCGAAA CGTTCCTTTGGCGCGGCGCGCCAGACGCTAGCGGGGGGCTATA AAAGGGGTGGGGGCGTTCGTCCTCACTCTAGATCTGCGATCT AAGTAAGCTTGATATCGCGGCCGCCCCTGGACACCCTTGGAAG CAAATCCCCTGCAGGCCCGTTTCCAGCCGAAACGTAGCCGTTT CGTACTCGAGCTTTGGCGCATCCGTTTCCCGAATTCCCGAAAC GTTCCTTTGGCGCTGCCCTACTGACACTGCCTGCGTTTCCAGCC GAAACGTAGCCGTTTCGTACTCGAGCTTTGGCGCATCCGTTTC CCGAATTCCCGAAACGTTCCTTTGGCGC | 3 |
| Synthetic Promoter 4 | CCGGTGACTCAGTAGCGGTGACTCAGAATCGATGACTCAGAC AGTGACTAAGTACTATGAGTCAGGTCGAATGAGTCAGCGAGT GACTCAATGGTCCATGACTCACGAATTCCTGCCCTACTGACAC TGCCTGCCGGTGACTCAGTAGCGGTGACTCAGAATCGATGACT CAGACAGTGACTAAGTACTATGAGTCAGGTCGAATGAGTCAG CGAGTGACTCAATGGTCCATGACTCAGAATATCCGC | 4 |
| Synthetic Promoter 5 | CCGGTGACTCAGTAGCGGTGACTCAGAATCGATGACTCAGAC AGTGACTAAGTACTATGAGTCAGGTCGAATGAGTCAGCGAGT GACTCAATGGTCCATGACTCACGAATTCCTGCCCTACTGACAC TGCCTGCCGGTGACTCAGTAGCGGTGACTCAGAATCGATGACT CAGACAGTGACTAAGTACTATGAGTCAGGTCGAATGAGTCAG CGAGTGACTCAATGGTCCATGACTCAGAATATCCGCGGCTTGG AAGCAAATCCCCTGCAGGCCGGTGACTCAGTAGCGGTGACTC AGAATCGATGACTCAGACAGTGACTAAGTACTATGAGTCAGG TCGAATGAGTCAGCGAGTGACTCAATGGTCCATGACTCACGAA TTCCTGCCCTACTGACACTGCCTGCCGGTGACTCAGTAGCGGT GACTCAGAATCGATGACTCAGACAGTGACTAAGTACTATGAGT CAGGTCGAATGAGTCAGCGAGTGACTCAATGGTCCATGACTCA GAATATCCGC | 5 |
| Synthetic Promoter 6 | TCCACACGTGCAAGCCGAGCACGTGGCTCATCACCACGAGTCA GACAACCACGTGCTCACTGACCACGTGCCTGTCGGCCACGTGT GAGTCCACACGTGCATCCCGAGCACGTGGCTCCGAATTCCTGC CCTACTGACACTGCCTGCCGTCCACACGTGCAAGCCGAGCACG TGGCTCATCACCACGAGTCAGACAACCACGTGCTCACTGACCA CGTGCCTGTCGGCCACGTGTGAGTCCACACGTGCATCCCGAGC ACGTGGCTCCGAATATCCGC | 6 |
| Synthetic Promoter 7 | CGTACGTGCGGCAGCCCGGACGTGCGCCATCTGCGTGAGGAC GCGCGTGACAACTCGTACGTGCGGCGTCCCGGACGTGCGCCG AGTGCGTGAGTCCGCGCGTGACACCGAATTCCTGCCCTACTGA CACTGCCTGCCGCGTACGTGCGGCAGCCCGGACGTGCGCCATC TGCGTGAGGACGCGCGTGACAACTCGTACGTGCGGCGTCCCG GACGTGCGCCGAGTGCGTGAGTCCGCGCGTGACACCGAATAT CCGC | 7 |
| Synthetic Promoter 8 | CTCATTTCAAAAAAGCCCCATTTAAGAGTATCCTCATTTCAGA TTGACTATTTGGTAAACTATATTTGGCAATGCACGTCGTATTTT GCAATGGCTGAGCTCATTTCAAAAATCCCCCATTTAAGAGTCG AATTCCTGCCCTACTGACACTGCCTGCCGCTCATTTCAAAAAA GCCCCATTTAAGAGTATCTATTTGGTAAGACCTCATTTCAGATT ACTGTATTTTGCAATGGCTGTCATATTTGGCAATGCACGAGCC CATTTAAGAGTTCCCTCATTTCAAAAACGAATATCCGC | 8 |
| Synthetic Promoter 9 | CCGCGAGGAGGCAGAGCTGACCACTAGATGGCAGTAATCTGG CCACCAGAGGGCGCGACTCGCCACTAGGTGGCGCACTTGGCC ACCAGGGGCGCCAGTCCCGCGAGGAGGCAGGAGTGGCCACC AGAGGGCGCCGAATTCCTGCCCTACTGACACTGCCTGCCGTCG CCACTAGGTGGCGCAGCTGGCCACCAGGGGGCGCCAGACCCG CGAGGAGGCAGACTTGACCACTAGATGGCAGTAGAGTGGCCA CCAGGGGGCGCCATCCTCGCCACTAGGTGGCGCCGAATATCCG C | 9 |

TABLE 2-continued

Synthetic Promoters 1-40

| Name | Sequence | SEQ ID NO |
|---|---|---|
| Synthetic Promoter 10 | CGACCATCTGGTAGCCGAACATCTGTTATCCGACCATCTGTTG ACCCACCTGCCCGACTCCAGCTGCTCGGTCCGACCATCTGGTG AGCCACCTGCCCGTCCCGACCATCTGTTCGAATTCCTGCCCTA CTGACACTGCCTGCCGCCACCTGCCCGAGCCCAGCTGCTCGAT CCGACCATCTGGTGACCGAACATCTGTTACTCCAGCTGCTCGG TCCCACCTGCCCGGAGCCAGCTGCTCGTCCCGACCATCTGGTC GAATATCCGC | 10 |
| Synthetic Promoter 11 | CTGATTGGCCAAAGCCTGATTGGCCAAATCCTGATTGGCCAAG ACCTGATTGGCCAAACTCTGATTGGCCAAGTCTCTGATTGGCC AAGGAGCTGATTGGCCAATCCCTGATTGGCCAACGAATTCCTG CCCTACTGACACTGCCTGCCGCTGATTGGCCAAAGCCTGATTG GCCAAATCCTGATTGGCCAAGACCTGATTGGCCAAACTCTGAT TGGCCAAGTCCTGATTGGCCAAGAGCTGATTGGCCAATCCCTG ATTGGCCAACGAATATCCGC | 11 |
| Synthetic Promoter 12 | AAACAGGAAGTTCGTAGCCCAACCGGAAGTATCAACCGGAAG TAGACGACCGGAAGTAACTGACCGGAAGTAGTCGACCGGAAG TGGAGAAACAGGAAGTTCGTTCCCCAACCGGAAGTCGAATTC CTGCCCTACTGACACTGCCTGCCGGACCGGAAGTAAGCAACCG GAAGTAATCGACCGGAAGTGGACAAACAGGAAGTTCGTACTC CAACCGGAAGTGTCAACCGGAAGTAGAGGACCGGAAGTATCC GACCGGAAGTGCGAATATCCGC | 12 |
| Synthetic Promoter 13 | GGCCCAGGGGATGCTTTAGGCGAGCGGCCCAGGGGATGCTTT AGGCGATCGGCCCAGGGGATGCTTTAGGCGGACGGCCCAGGG GATGCTTTAGGCGACTGGCCCAGGGGATGCTTTAGGCGGTCGA ATTCCTGCCCTACTGACACTGCCTGCCGGGCCCAGGGGATGCT TTAGGCGAGCGGCCCAGGGGATGCTTTAGGCGATCGGCCCAG GGGATGCTTTAGGCGGACGGCCAGGGGATGCTTTAGGCGGT CGGCCCAGGGGATGCTTTAGGCGCGAATATCCGC | 13 |
| Synthetic Promoter 14 | CGGTTGCCATGGCAACCGAGCCGGTTTCCATGGAAACAAATCA AGTTACTAGGCAAAAGGACCGGTTGCCATGGCAACCGACTAA GTTACTAGGCAAAAGGAGCGGTTTCCATGGAAACAATCCCGG TTGCCATGGCAACCGCGAATTCCTGCCCTACTGACACTGCCTG CCGAAGTTACTAGGCAAAAGAGCCGGTTGCCATGGCAACCGA TCCGGTTTCCATGGAAACAAGACCGGTTGCCATGGCAACCGAC TAAGTTACTAGGCAAAAGGTCCGGTTTCCATGGAAACAATCCG AATATCCGC | 14 |
| Synthetic Promoter 15 | CCCAGGGGATGCTTTAGGCGGGAAAGTCAGAGTTTCTGCCTCC ATTTCCCAGGGGATGCTTTAGGCGGGAAAGTCAGAGTTTCTGC CTCCATTTGTCATGCATCTCAATTACCCAGGGGATGCTTTAGG CGGGAAAGTCAGAGTTTCTGCCTCCATTTGGCCTGCAGG CCCAGGGGATGCTTTAGGCGGGAAAGTCAGAGTTTCTGCCTCC ATTTCCCAGGGGATGCTTTAGGCGGGAAAGTCAGAGTTTCTGC CTCCATTTGTCATGCATCTCAATTACCCAGGGGATGCTTTAGG CGGGAAAGTCAGAGTTTCTGCCTCCATTTCCCAGGGGATGCTT TAGGCGGGAAAGTCAGAGTTTCTGCCTCCATTT | 15 |
| Synthetic Promoter 16 | TAGGGTGGGCGTGGCAGCCGGGGCGGGGCATCTAGGGCGGGG CCGACGGGGGGCGGGGCCACTTAGGGTGGGCGTGGCGTCCGG GGCGGGGCGAGTAGGGCGGGGCCTCCGGGGGGCGGGGCCCGA ATTCTGCCCTACTGACACTGCCTGCCGTAGGGTGGGCGTGGCA GCCGGGGCGGGGCATCTAGGGCGGGGCCGACGGGGGGCGGG GCCACTTAGGGTGGGCGTGGCGTCCGGGGCGGGGCGAGTAGG GCGGGGCCTCCGGGGGGCGGGGCCCGAATATCCGC | 16 |
| Synthetic Promoter 17 | CGGGTGACGTCAACGGAGCGGGCTGACGTAAACGGATCTGAC GTCAGACCAATGACGTCACGACTCGGGTGACGTCAACGGGTC GGGCTGACGTAAACGGGAGTGACGTCATCCCAATGACGTCAC GCGAATTCTGCCCTACTGACACTGCCTGCCGCGGGTGACGTCA ACGGAGCGGGCTGACGTAAACGGATCTGACGTCAGACCAATG ACGTCACGACTCGGGTGACGTCAACGGGTCGGGCTGACGTAA ACGGGAGTGACGTCATCCCAATGACGTCACGCGAATATCCGC | 17 |

TABLE 2-continued

Synthetic Promoters 1-40

| Name | Sequence | SEQ ID NO |
|---|---|---|
| Synthetic Promoter 18 | CGGGTGACGTCAACGGAGCGGGCTGACGTAAACGGATCTGAC GTCAGACCAATGACGTCACGACTCGGGTGACGTCAACGGGTC GGGCTGACGTAAACGGGAGTGACGTCATCCCAATGACGTCAC GCGAATTCTGCCCTACTGACACTGCCTGCCGCGGGTGACGTCA ACGGAGCGGGCTGACGTAAACGGATCTGACGTCAGACCAATG ACGTCACGACTCGGGTGACGTCAACGGGTCGGGCTGACGTAA ACGGGAGTGACGTCATCCCAATGACGTCACGCGAATATCCGC | 18 |
| Synthetic Promoter 19 | TACGCGCGAAAACTGAGCGCGCCAAAATCGCTGAGCGCGAAA CGGACGGGGCGGGAAGACTTACGCGCGAAAACTGGTCGCGCC AAAGAGGCTGAGCGCGAAACGTCCGGGGCGGGAAGCGAATTC TGCCCTACTGACACTGCCTGCCGTACGCGCGAAAACTGAGCGC GCCAAAATCGCTGAGCGCGAAACGGACGGGGCGGGAAGACTT ACGCGCGAAAACTGGTCGCGCCAAAGAGGCTGAGCGCGAAAC GTCCGGGGCGGGAAGCGAATATCCGC | 18 |
| Synthetic Promoter 20 | TCTGATGCAATAGCGGTATGATGCAAGGAATCAGATTGTGAA ATGTGACATTGTGAAATAACTTCTGATGCAATGTCGGTATGAT GCAAGGAGAGAGATTGTGAAATGTTCCATTGTGAAATACGAA TTCTGCCCTACTGACACTGCCTGCCGTCTGATGCAATAGCGGT ATGATGCAAGGAATCAGATTGTGAAATGTGACATTGTGAAAT AACTTCTGATGCAATGTCGGTATGATGCAAGGAGAGAGATTGT GAAATGTTCCATTGTGAAATACGAATATCCGC | 20 |
| Synthetic Promoter 21 | TCAGCCAATCAGAGAGCGAGCCAATCAGAATCCCAGCCAATC AGAGACTGGGCCAATCAGAAACTTCAGCCAATCAGAGGTCGA GCCAATCAGAGAGCCAGCCAATCAGATCCTGGGCCAATCAGA ACGAATTCTGCCCTACTGACACTGCCTGCCGTCAGCCAATCAG AGAGCGAGCCAATCAGAATCCCAGCCAATCAGAGACTGGGCC AATCAGAAACTTCAGCCAATCAGAGGTCGAGCCAATCAGAGA GCCAGCCAATCAGATCCTGGGCCAATCAGAACGAATATCCGC | 21 |
| Synthetic Promoter 22 | AGCCGCACGTGACAGCAGCCGCACGTGACATCCACCCACGTG CGACCACCCACGTGCACTAGCCGCACGTGACCACAGCCGCAC GTGACGAGCACCCACGTGCTCCCACCCACGTGCCGAATTCTGC CCTACTGACACTGCCTGCCGAGCCGCACGTGACAGCAGCCGCA CGTGACATCCACCCACGTGCGACCACCCACGTGCACTAGCCGC ACGTGACCATCAGCCGCACGTGACGAGCACCCACGTGCTCCCA CCCACGTGCCGAATATCCGC | 22 |
| Synthetic Promoter 23 | GACCACGTGGAAGCGACCACGTGGAATCCGCCACGTGCGCGA CCGCCACGTGCGCACTAGACCACGTGGTCGTCAGACCACGTGG TCGAGAAAACACGTGGTTCCAAAACACGTGGTCGAATTCTGCC CTACTGACACTGCCTGCCGGACCACGTGGAAGCGACCACGTG GAATCCGCCACGTGCGCGACCGCCACGTGCGCACTAGACCAC GTGGTCGTCAGACCACGTGGTCGAGAAAACACGTGGTTCCAA AACACGTGGTCGAATATCCGCG | 23 |
| Synthetic Promoter 24 | TAGCCTGGGGCCGAGCTAGCCTGGGGCCGATCACCGCCTGAG GGGAGACACCGCCTGAGGGGAACTTGCCCTGGGGCCGTCTGC CCTGGGGCCGAGTTGCCCTAGGGCATTCCTTGCCCTAGGGCAT CGAATTCTGCCCTACTGACACTGCCTGCCGTAGCCTGGGGCCG AGCTAGCCTGGGGCCGATCACCGCCTGAGGGGAGACACCGCC TGAGGGGAACTTGCCCTGGGGCCGTCTGCCCTGGGGCCGAGTT GCCCTAGGGCATTCCTTGCCCTAGGGCATCGAATATCCGC | 24 |
| Synthetic Promoter 25 | GGGAATTCCCAGCGGGAATTCCCATCGGGGACTTTCCAGACGG GGACTTTCCAACTGGGAATTCCCGTCGGGAATTCCCGAGGGGG ACTTTCCATCCGGGGACTTTCCACGAATTCTGCCCTACTGACA CTGCCTGCCGGGGAATTCCCAGCGGGAATTCCCATCGGGGACT TTCCAGACGGGGACTTTCCAACTGGGAATTCCCGTCGGGAATT CCCGAGGGGGACTTTCCATCCGGGGACTTTCCACGAATATCCG C | 25 |
| Synthetic Promoter 26 | AGCGCATTTCCCGGAAATGATATCTATTCCAGGAACTGACTAT TCCAGGAACTACTGCATTTCCCGGAAATGATGTCGCATTTCCC GGAAATGATGAGTATTCCAGGAACTTCCTATTCCAGGAACTCG AATTCTGCCCTACTGACACTGCCTGCCGGCATTTCCCGGAAAT GATAGCGCATTTCCCGGAAATGATACTATTCCAGGAACTACTG CATTTCCCGGAAATGATGTCGCATTTCCCGGAAATGATGAGTA TTCCAGGAACTTCCTATTCCAGGAACTCGAATATCCG | 26 |

TABLE 2-continued

Synthetic Promoters 1-40

| Name | Sequence | SEQ ID NO |
|---|---|---|
| Synthetic Promoter 27 | ATGCGTGGGCGTAGCATGCGTGGGCGTATCCGCGGCGGGGGC GGAGGACCGCGGCGGGGGCGGAGACTAATGCGGGGGCGGAG TCAATGCGGGGGCGGAGAGGGGCGGGGGCGGGGCCTCCGGGC GGGGGCGGGGCCCGAATTCTGCCCTACTGACACTGCCTGCCGA TGCGTGGGCGTACATGCGTGGGCGTATCCGCGGCGGGGGCGG AGGCCGCGGCGGGGGCGGAGCTAATGCGGGGGCGGAGTCAAT GCGGGGGCGGAGAGGGGCGGGGGCGGGGCCTCCGGGCGGGG GCGGGGCCCGAATATCCGC | 27 |
| Synthetic Promoter 28 | GCGCCAAAGGAACGTTTCGGGAATTCGGGAAACGGATGCGCC AAAGCTCGAGTACGAAACGGCTACGTTTCGGCTGGAAACGCA GGCAGTGTCAGTAGGGCAGCGCCAAAGGAACGTTTCGGGAAT TCGGGAAACGGATGCGCCAAAGCTCGAGTACGAAACGGCTAC GTTTCGGCTGGAAACGGG | 28 |
| Synthetic Promoter 29 | GCGCCAAAGGAACGTTTCGGGAATTCGGGAAACGGATGCGCC AAAGCTCGAGTACGAAACGGCTACGTTTCGGCTGGAAACGCA GGCAGTGTCAGTAGGGCAGCGCCAAAGGAACGTTTCGGGAAT TCGGGAAACGGATGCGCCAAAGCTCGAGTACGAAACGGCTAC GTTTCGGCTGGAAACGCAGGCAGTGTCAGTAGGGCAGCGCCA AAGGAACGTTTCGGGAATTCGGGAAACGGATGCGCCAAAGCT CGAGTACGAAACGGCTACGTTTCGGCTGGAAACGCAGGCAGT GTCAGTAGGGCAGCGCCAAAGGAACGTTTCGGGAATTCGGGA AACGGATGCGCCAAAGCTCGAGTACGAAACGGCTACGTTTCG GCTGGAAACGGG | 29 |
| Synthetic Promoter 30 | GCGGATATTCGGCGCCACCTAGTGGCGAGGATGGCGCCCCCTG GTGGCCACTCTACTGCCATCTAGTGGTCAAGTCTGCCTCCTCG CGGGTCTGGCGCCCCTGGTGGCCAGCTGCGCCACCTAGTGGC GACGGCAGGCAGTGTCAGTAGGGCAGGAATTCGGCGCCCTCT GGTGGCCACTCCTGCCTCCTCGCGGGACTGGCGCCCCCTGGTG GCCAAGTGCGCCACCTAGTGGCGAGTCGCGCCCTCTGGTGGCC AGATTACTGCCATCTAGTGGTCAGCTCTGCCTCCTCGCGG | 30 |
| Synthetic Promoter 31 | GCGGATATTCGACCAGATGGTCGGGACGAGCAGCTGGCTCCG GGCAGGTGGGACCGAGCAGCTGGAGTAACAGATGTTCGGTCA CCAGATGGTCGGATCGAGCAGCTGGGCTCGGGCAGGTGGCGG CAGGCAGTGTCAGTAGGGCAGGAATTCGAACAGATGGTCGGG ACGGGCAGGTGGCTCACCAGATGGTCGGACCGAGCAGCTGGA GTCGGGCAGGTGGGTCAACAGATGGTCGGATAACAGATGTTC GGCTACCAGATGGTCG | 31 |
| Synthetic Promoter 32 | GACCACGTGGAAAGCGACCACGTGGAAATCGACCACGTGGAA GACGACCACGTGGAAACTGACCACGTGGAAGTCGACCACGTG GAAGAGGACCACGTGGAATCCGACCACGTGGAAGAATTCTGC CCTACTGACACTGCCTGCCGGACCACGTGGAAAGCGACCACGT GGAAATCGACCACGTGGAAGACGACCACGTGGAAACTGACCA CGTGGAAGTCGACCACGTGGAAGAGGACCACGTGGAATCCGA CCACGTGGAACGAATATCCGC | 32 |
| Synthetic Promoter 33 | TCCGCCACGTGCGCGACGACTCCGCCACGTGCGCGACGAGTCCGCC ACGTGCGCGACTCCTCCGCCACGTGCGCGACCGAATTCTGCCC TACTGACACTGCCTGCCGTCCGCCACGTGCGCGACGACTCCGC CACGTGCGCGACACTTCCGCCACGTGCGCGACGTCTCCGCCAC GTGCGCGACGAGTCCGCCACGTGCGCGACTCCTCCGCCACGTG CGCGACCGAATATCCGC | 33 |
| Synthetic Promoter 34 | AGACCACGTGGTCAGCAGACCACGTGGTCATCAGACCACGTG GTCGACAGACCACGTGGTCACTAGACCACGTGGTCGTCAGACC ACGTGGTCGAGAGACCACGTGGTCTCCAGACCACGTGGTCCG AATTCTGCCCTACTGACACTGCCTGCCGAGACCACGTGGTCAG CAGACCACGTGGTCATCAGACCACGTGGTCGACAGACCACGT GGTCACTAGACCACGTGGTCGTCAGACCACGTGGTCGAGAGA CCACGTGGTCTCCAGACCACGTGGTCCGAATATCCGC | 34 |
| Synthetic Promoter 35 | AAAACACGTGGTAGCAAAACACGTGGTATCAAAACACGTGGT GACAAAACACGTGGTACTAAAACACGTGGTGTCAAAACACGT GGTGAGAAAACACGTGGTTCCAAAACACGTGGTCGAATTCTG CCCTACTGACACTGCCTGCCGAAAACACGTGGTAGCAAAACA CGTGGTATCAAAACACGTGGTGACAAAACACGTGGTACTAAA ACACGTGGTGTCAAAACACGTGGTGAGAAAACACGTGGTTCC AAAACACGTGGTCGAATATCCGC | 35 |

TABLE 2-continued

Synthetic Promoters 1-40

| Name | Sequence | SEQ ID NO |
|---|---|---|
| Synthetic Promoter 36 | GTCCGCCACGTGCGCGACAGTCCGCCACGTGCGCGACTGGTCC GCCACGTGCGCGACCGTCCGCCACGTGCGCGACCGGTCCGCCA CGTGCGCGACCGTCCGCCACGTGCGCGACGTGTCCGCCACGTG CGCGCC | 36 |
| Synthetic Promoter 37 | TTCCGCCACGTGGCGGAAGTTCCGCCACGTGGCGGAATTCCGC CACGTGGCGGAAATTCCGCCACGTGGCGGAATTCCGCCACGTG GCGGAATTTCCGCCACGTGGCGGAATTCCGCCACGTGGCGGA ACC | 37 |
| Synthetic Promoter 38 | GCCACGTGAGCGCCACGTGATCGCCACGTGGACGCCACGTGA CTGCCACGTGAGTGCCACGTGGTCGCCACGTGGATGCCACGTG GCTGCCACGTG | 38 |
| Synthetic Promoter 39 | GCGGATATTCGACCACGTGTTTTGGAACCACGTGTTTTCTCGA CCACGTGGTCTGACGACCACGTGGTCTAGTGCGCACGTGGCGG TCGCGCACGTGGCGGATTCCACGTGGTCGCTTCCACGTGGTCC GGCAGGCAGTGTCAGTAGGGCAGAATTCGACCACGTGTTTTGG AACCACGTGTTTTCTCGACCACGTGGTCTGACGACCACGTGGT CTAGTGCGCACGTGGCGGTCGCGCACGTGGCGGATTCCACGTG GTCGCTTCCACGTGGTCC | 39 |
| Synthetic Promoter 40 | GGCCGCCCTGCACCTGCAGGGACCACGTGGAAGCGACCACGT GGAATCCGCCACGTGCGCGACCGCCACGTGCGCACTAGACCA CGTGGTCGTCAGACCACGTGGTCGAGAAAACACGTGGTTCCA AAACACGTGGTCGAATTCTGCCCTACTGACACTGCCTGCCGGA CCACGTGGAAGCGACCACGTGGAATCCGCCACGTGCGCGACC GCCACGTGCGCACTAGACCACGTGGTCGTCAGACCACGTGGTC GAGAAAACACGTGGTTCCAAAACACGTGGTCGAATATCCGCG GCGCGCCAGACGTGCAGGGACCACGTGGAAGCGACCACGTGG AATCCGCCACGTGCGCGACCGCCACGTGCGCACTAGACCACGT GGTCGTCAGACCACGTGGTCGAGAAAACACGTGGTTCCAAAA CACGTGGTCGAATTCTGCCCTACTGACACTGCCTGCCGGACCA CGTGGAAGCGACCACGTGGAATCCGCCACGTGCGCGACCGCC ACGTGCGCACTAGACCACGTGGTCGTCAGACCACGTGGTCGA GAAAACACGTGGTTCCAAAACACGTGGTCGAATATCCGCGGC GCGCCAGAC | 40 |

Example 2. Synthetic Promoter Activity and Specificity—Synthetic Promoters 41-49

Reporter constructs were created by placing the coding sequence of mKate2 under the control of selected promoters from the library (synthetic promoters 41-49). The reporter constructs were transfected into different cell lines as listed in Table 3. P119 are negative control cells and p153 are mKate2 positive cells expressing mKate2 under the strong hUbC promoter.

Figure 8:
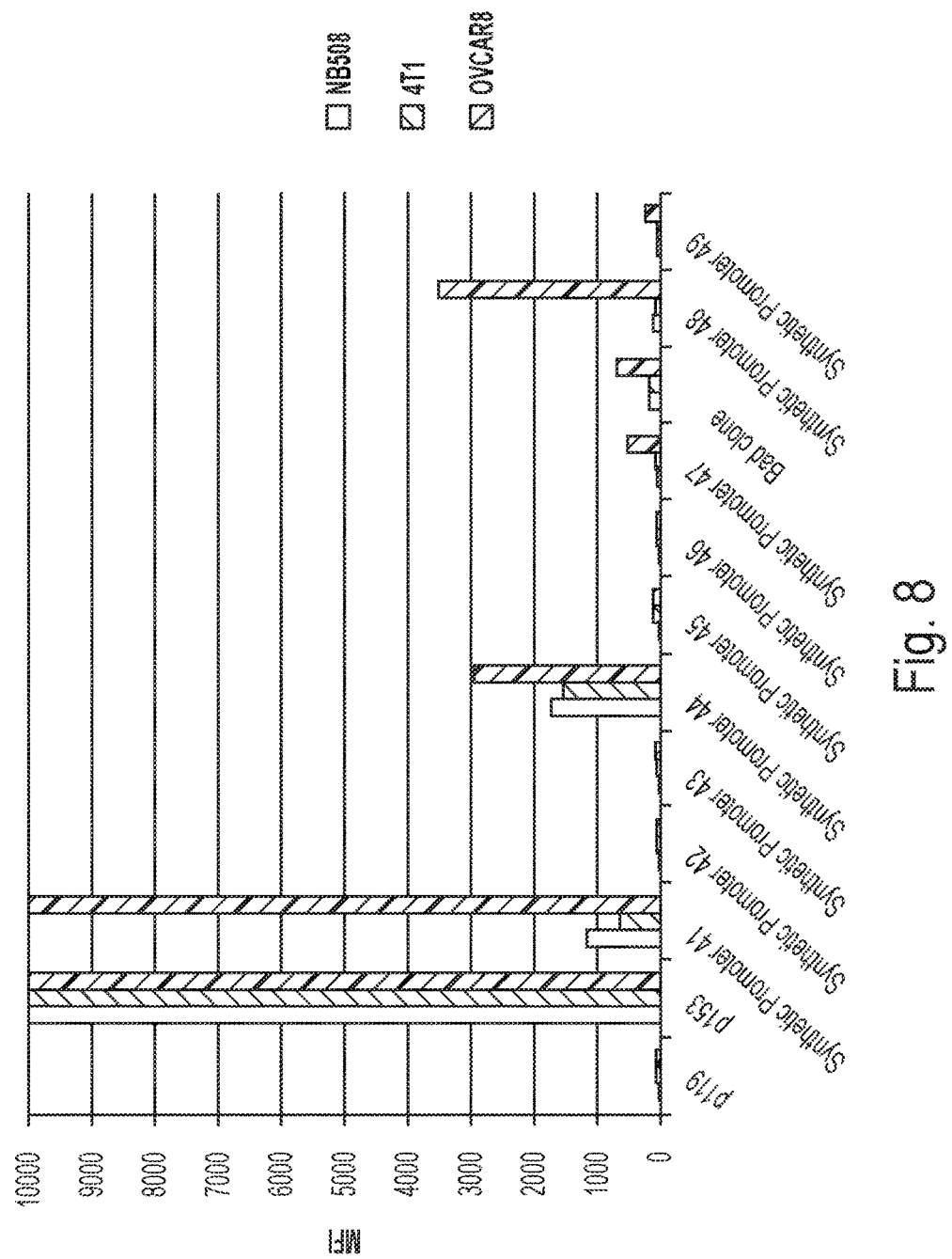
FIG. 8 is a graph showing the activities of synthetic promoters in three different cell lines: NB508, 4T1, and OVCAR8.

The expression of mKate2 indicates the activity of a synthetic promoter in each cell line. The results were provided in FIG. 8 and Table 2. Synthetic promoters 41 and 44 were found to be more active than other synthetic promoters tested in tumor cell lines. Interestingly, both synthetic promoter 41 and 44 have binding motifs for tumor-specific TFs, including CREB, EGR1, SP1 and E2F1. The activities of another set of synthetic promoters were tested in different cell lines, as indicated in Table 3.

TABLE 3

Synthetic Promoter Activity in Different Cell Lines

|  | NB508 AVRG mKate2 | 4T1 AVRG mKate2 | OVCAR8 AVRG mKate2 |
|---|---|---|---|
| p119 | 35 | 56 | 50 |
| p153 | 21200 | 14200 | 79800 |
| Synthetic Promoter 41 | 1203 | 677 | 13400 |
| Synthetic Promoter 42 | 39 | 60 | 73 |
| Synthetic Promoter 43 | 42 | 62 | 93 |
| Synthetic Promoter 44 | 1743 | 1555 | 2956 |
| Synthetic Promoter 45 | 42 | 59 | 137 |
| Synthetic Promoter 46 | 39 | 54 | 75 |
| Synthetic Promoter 47 | 72 | 82 | 507 |
| Synthetic Promoter 48 | 139 | 110 | 3553 |
| Synthetic Promoter 49 | 53 | 64 | 246 |

TABLE 4

Synthetic Promoters 41-49

| Name | Sequence | SEQ ID NO. |
| --- | --- | --- |
| Synthetic Promoter 41 | GACGCCATGACGCATGACGCCATGACGCCATGACGCCA TGACGCCATGACGCCATGACGCATGACGCCATGACGCC ATGACGCCATTACGCCAT | 41 |
| Synthetic Promoter 42 | GGGGGTCCAGCGGGGGTCCATCGGGGGTCCGACGGGGG TCCACTGGGGGTCCAGTGGGGGTCCGTCGGGGGTCCGAT GGGGGTCCGCTGGGGGTCC | 42 |
| Synthetic Promoter 43 | AGTGGGGTAGCAGTGGGTATCAGTGGGGTGACAGTGGG GTACTAGTGGGGTAGTAGTGGGGTGTCAGTGGGGTGAT AGTGGGGTGCTAGTGGGGT | 43 |
| Synthetic Promoter 44 | GTGCCCGCGTAATCCCGCCCGCGTAGACCCGCCCGCGTA ACTCCGCCCGCGTAAGTCCGCCCGCGTAGTCCCGCCCGC GTAGATCCGCCCGCGTA | 44 |
| Synthetic Promoter 45 | GAGACATAGAGACATAGAGACATAGAGACATAGAGACA TAGAGACATAGAGACATAGAGACATAGAGACATAGAGA CATAGAGACATAGAGACATA | 45 |
| Synthetic Promoter 46 | CACTGGGTCACGGGGTCACGGGGTCACGGGGTCACGGG GTCACGGGGTCACGGGGTCACGGGGTCACGGGGTCACG GGGTCACGGGGT | 46 |
| Synthetic Promoter 47 | GGGAATGAGGGAATGAGGGAATGAGGGAATGAGGGAA TGAGGGAATGAGGGAATGAGGGAATGAGGGAATGTGGG AATGTGGGAATGTGGGAATGT | 47 |
| Synthetic Promoter 48 | GAAGGCAGGAAGGCAGGAAGGCAGGAAGGCAGGAAGG CAGGAAGGCAGGAAGGCAGGAAGGCAGGAAGGCAGGA AGGCAGGAAGGCAGGAAGGCAG | 48 |
| Synthetic Promoter 49 | GGGCCAAATGGATCGGGCCAAATGGGACGGGGCAAATG GACTGGGCAAATGGAGTGGGGCAAATGGGTCGGGCAAA TGGGATGGGGCAAATGG | 49 |

Example 3. MDA-MB-453-Specific Promoter Expression

Figure 9:
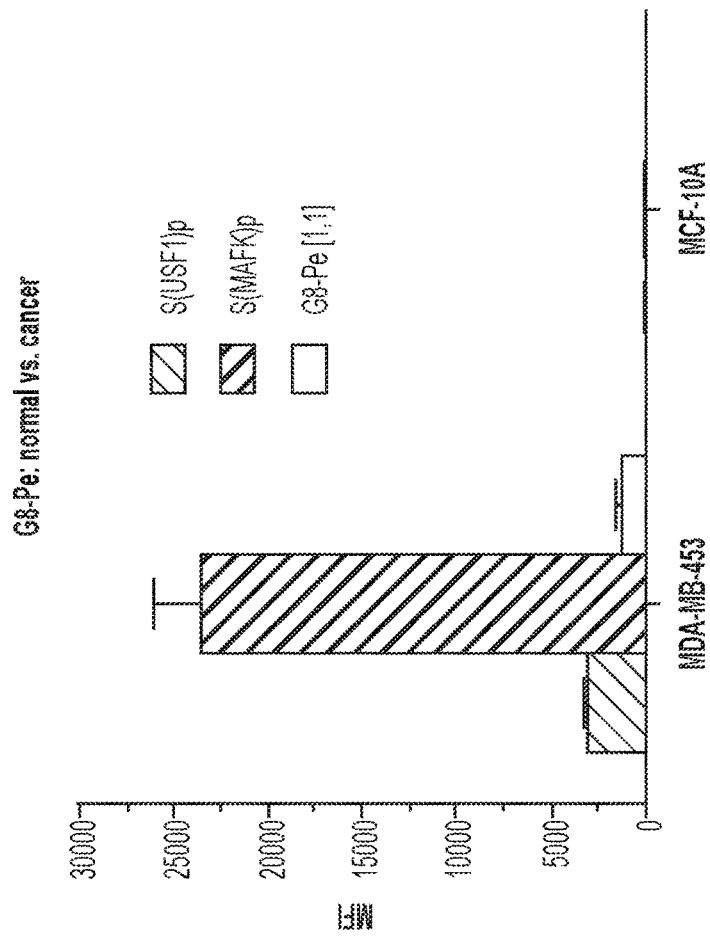
FIG. 9 is a graph showing the activities of synthetic promoters in two different cell lines: 10A and MDA.

Two synthetic promoters, S(USF1)p and S(MAFK)p, were designed to specifically target the MDA-MB-453 breast cancer cell line, but not the MCF-10A non-tumorigenic mammary epithelial cell line. mKate2 outputs generated by each promoter individually were compared to a control (G8-Pe) in both cell lines. S(USF1)p and S(MAFK)p generated a high output only in MDA-MB-453 cells (FIG. 9) (see also Nissim, L. et al. *Cell* 2017; 171: 1138-1150 is incorporated herein by reference).

S(USF1)p
(SEQ ID NO: 12266)
CCACGTGCAGACCACGTGCTCGCCACGTGCGACCCACGTGCCTACCACGT

GCACTCCACGTGCTGCCCACGTGCGTACCACGTGCG

S(MAFK)p
(SEQ ID NO: 12268)
TGCTGAGTCAGCAAGATGCTGAGTCAGCATCGTGCTGAGTCAGCAGACTG

CTGAGTCAGCACTATGCTGAGTCAGCAACTTGCTGAGTCAGCATGCTGCT

GAGTCAGCAGTATGCTGAGTCAGCAG

Example 4. Synthetic Promoter Activity and Specificity

Figure 10:
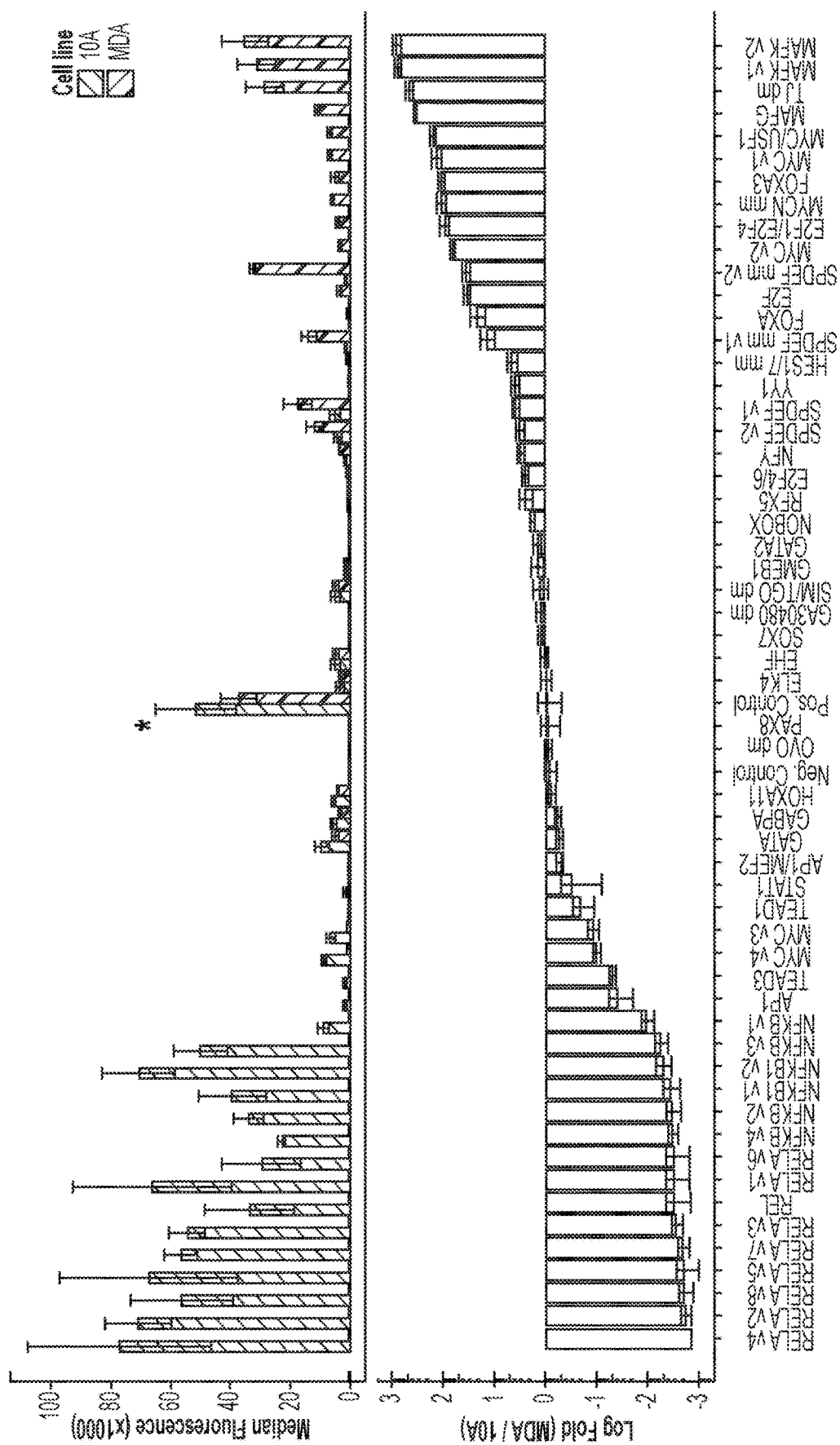
FIG. 10 is a graph showing the activities of synthetic promoters in two different cell lines: 10A and MDA.

Reporter constructs were created by placing the coding sequence of mKate2 under the control of selected promoters from the library (see FIG. 10). The reporter constructs were transfected into different cell lines: 10A (normal breast tissue cells) or MDA (cancerous breast tissue cells).

The expression of mKate2 indicates the activity of a synthetic promoter in each cell line. The results are provided in FIG. 10. A subset of the synthetic promoters was found to be more active in the tumor cell line than the other synthetic promoters tested.

Example 5

The synthetic promoter library was tested in a human induced pluripotent stem cell line (GATA6-hiPSCs) that forms a liver bud-like organoid upon doxycycline-inducible GATA6 expression (Guye, P. et al. Nature Communications, 2016, incorporated herein by reference). 2D organoids were prepared by seeding 25,000 GATA6-hiPSCs/cm$^2$ in a flat-bottom, matrigel-coated tissue-culture plate. Differentiation followed the previously described protocol (Guye, P. et al. Nature Communications, 2016) and was initiated by addition of 1000 ng/mL doxycycline (dox) for 5 days. On day 5, organoids were transduced with an equimolar mix of the synthetic promoter library and a transduction control. The viral titer was qualitatively adjusted such that <15% of the population expressed the transduction marker. Differentiation continued for a total of 16 days after which organoids were washed with PBS and dissociated with Accutase to a single cell suspension. Cells were centrifuged (3 min at 300×g) and resuspended in APEL 2 Medium (StemCell Technologies). The resuspended cells were sorted by FACS (BD FACS Aria, BD Biosciences) into an mKate positive and negative population with manually defined gates. Extraction of genomic DNA (gDNA) was done as for all other samples.

Using the gDNA from the mKate positive population, we amplified the synthetic promoters by PCR as described for the other samples with the exception that 50 cycles were necessary. The amplified promoter library and pLN490 were digested with AscI and SbfI and gel purified. The digested and purified promoters and pLN490 backbone were ligated and transformed into E. coli and selected for by ampicillin. Colonies were picked and submitted for Sanger sequencing to identify synthetic promoters that led to mKate expression in the organoids. Candidate promoters identified from Sanger sequencing were verified in triplicate. Verification was done by transducing undifferentiated GATA6-hiPSCs with a lentivirus expressing the particular promoter upstream of mKate2. Transductions were done with 2 μg/mL polybrene and qualitatively assessed to lead to mKate2 expression in more than 90% of the GATA6-hiPSCs. Organoids were differentiated as above and imaged daily for 20 days using a Leica TCS SP5 II confocal microscope. Each promoter was also expressed in GATA6-hiPSCs that were kept undifferentiated for >5 days by culturing cells in mTeSR1 without the addition of dox.

Expression of the synthetic promoter library in a liver bud-like organoid derived through GATA6 expression in hiPSCs, led to the identification of 37 different candidate promoters from a pool of 1396 mKate positive cells. Each promoter was individually verified by transduction of GATA6-hiPSCs with the particular promoter and repeating the differentiation to a liver bud-like organoid. We verified 18 of these promoters in triplicate and found 7 of them to be mKate2 positive in all samples. 2 of the promoters were only mKate2 positive in duplicate. Among these 9 promoters with mKate2 activity, 8 also had detectable activity in undifferentiated GATA6-hiPSCs (activity could be verified in triplicate for 4 promoters, duplicate for 1, and single sample only for 3 promoters). However, their activity in GATA6-hiPSCs were generally limited to clusters of with few cells, indicating that there might be subtle differences in the transcription factor profile of these undifferentiated stem cell.

The synthetic promoters with RELA, STAT_disc5, HIF1A and TP53 binding sites showed consistent behavior across all triplicates. The activity and pattern of these promoters changed between days, implying cell type-specific promoter activity. Moreover, the pattern, strength and number of cells in which the promoter was active also varied. For instance, the HIF1A promoter appeared active in large globular similar to previously identified ectoderm-derived cells (P. Guye, 2016). Moreover, the signal shows a pattern within these globular structures, indicating further cell type-specificity. The mKate2 expression appeared suddenly late in organoid development (≈day 15) and gradually disappear. As the signal faded from the putative ectoderm regions, it would begin to appear in nearby regions of the organoid that favored a flat structure.

TP53, and STAT_disc5 were both active early on during organoid development and with no apparent preference for morphologically distinct cells. TP53 was widely active in hiPSCs and the early (day 2) organoid. The frequency of mKate2 positive cells faded over time, albeit the signal remained strong in the few positive cells that remained. STAT_disc5 was not active in hiPSCs, but turned on around day 3 and peaked at day 4/5. It then gradually turned off as the organoid matured and had effectively disappeared on day 12.

RELA turned on strongly, first in a few cells around day 4, but continuously spread to a larger fraction of the cell population over the duration of the experiment. The promoter appeared to favor certain regions with a flat morphology. Moreover, several cells—based on their mKate2 fluorescence—showed a long, thin shape which is morphologically distinct from the pattern observed from other promoters.

Overall, verification of mKate2 expression from the candidate promoters also revealed heterogeneous expression of the promoters that generally required screening multiple regions of each organoid to identify an mKate positive region. This implies that morphologically similar regions might still show subtle differences in TF profiles that affects transcription from the synthetic promoter. Altogether, the replicated temporal, spatial and morphological observations indicate a non-random preference for certain cell types that appear and mature during development of a liver bud-like organoid.

The previously described method to differentiate hiPSCs to a liver bud-like organoid results in a heterogeneous and diverse cell composition within the organoid with cell lineages arising from all three different germ layers. This cell type heterogeneity made the organoid ideal as a platform to test the cell-type preference of the synthetic promoter library.

Changes in the TF profile of a specific cells is quintessential to cell differentiation and maturation, and the synthetic promoters are expected to exploit this change, thereby providing a platform for cell-type specific gene regulation. Indeed, we find that a few candidate promoters show temporal specificity towards certain morphologically distinct regions within the organoid. However, the promoter activity often differs between morphologically similar regions implying the promoters may be very sensitive towards changes in TF activity between cell types. With thorough screening and a more targeted search for specific cell populations, the synthetic promoters are a powerful tool for regulating gene networks in subpopulations of heterogeneous cell populations.

TABLE 5

Transcription Factor Binding Sites of Synthetic Promoters

| Name | Binding Site Sequence | Reverse Complement |
| --- | --- | --- |
| EOMES_EOMES_f1_HocoMoco | ATTTCGTATCCCCG | CGGGGATACGAAAT |
| LHX9_LHX2_2_SELEX\|LHX2_3 | TAATTACGCTAATTA | TAATTAGCGTAATTA |
| HOXC5_Zen_Cell_FBgn0004053_B1H | CCCTAATGA | TCATTAGGG |

TABLE 5-continued

Transcription Factor Binding Sites of Synthetic Promoters

| Name | Binding Site Sequence | Reverse Complement |
|---|---|---|
| BARHL2_MA0171.1_B1H\|NKX2-5_MA0063.1_SELEX\|ISL2_MA0248.1_B1H\|BARHL2_MA0168.1_B1H\|HMX1_Hmx_SOLEXA_FBgn0085448_B1H\|BSX_MA0214.1_B1H\|ISL2_Tup_SOLEXA_FBgn0003896_B1H\|SHOX_PRRX2_f1_HocoMoco\|SHOX_MA0250.1_B1H\|HMX1_Hmx_Cell_FBgn0085448_B1H\|ISL2_Isl2_3430_PBM\|BARHL2_MA0169.1_B1H\|HMX1_MA0192.1_B1H\|NKX2-5_4 | CAATTAA | TTAATTG |
| NKX2-5_NKX28_f1_HocoMoco | GTCCTTGAA | TTCAAGGAC |
| EN2_V$EN1_01_Transfac\|EN1_1 | CAATTAC | GTAATTG |
| NR1I3_NR1I3_f2_HocoMoco | CTGAACTTTCCTGACCCC | GGGGTCAGGAAAGTTCAG |
| MSX1_Msx1_3031_PBM\|GBX2_Gbx2_3110_PBM | CAATTAG | CTAATTG |
| GATA2_MA0536.1_ChIP-chip | AACTATCGATA | TATCGATAGTT |
| DLX2_1 | CTGAAGTAATTATTCC | GGAATAATTACTTCAG |
| VSX2_VSX1_2_SELEX\|VSX1_3 | GCTAATTAGCC | GGCTAATTAGC |
| SIX5_Six4_SOLEXA_2_FBgn0027364_B1H | ATGATACC | GGTATCAT |
| SIX5_Six4_Cell_FBgn0027364_B1H | ATTTGATAC | GTATCAAAT |
| OVOL2_1 | CCCCCGC | GCGGGGG |
| ELF1_known1 | ATAAGAGGAAAT | ATTTCCTCTTAT |
| HNF1A_HNF1B_f1_HocoMoco | GGTTAATGATTAAC | GTTAATCATTAACC |
| RXRA_known7 | GTAGGGCAAAGGTCA | TGACCTTTGCCCTAC |
| NFKB1_V$NFKB_C_Transfac\|NFKB_known5 | GGGGACTTTCCA | TGGAAAGTCCCC |
| NR5A1_ftz-f1_FlyReg_FBgn0001078_B1H | CAGTCCGAAGGTCACCGC | GCGGTGACCTTCGGACTG |
| KLF4_SRP000217_Klf4_ChIP-seq | GGCCCCACCCA | TGGGTGGGGCC |
| SOX9_SOX10_si_HocoMoco | ACAAAGA | TCTTTGT |
| DMBX1_DRGX_1_SELEX\|DRGX_1 | CTAATCTAATTAA | TTAATTAGATTAG |
| DMBX1_pTH5511_PBM\|DRGX_CRX_si_HocoMoco | CTAATCCC | GGGATTAG |
| NFYA_V$NFY_C_Transfac\|NFY_known2 | ACTAACCAATCAGA | TCTGATTGGTTAGT |
| HNF4G_Hnf4_SANGER_10_FBgn0004914_B1H | TGACCCCGCCAACAA | TTGTTGGCGGGGTCA |
| POU6F2_PO6F1_f1_HocoMoco | CATAATTTATGCA | TGCATAAATTATG |
| HOXC5_HXC6_f1_HocoMoco | AAAGTAATAAATCAT | ATGATTTATTACTTT |
| VSX2_pTH5821_PBM\|SHOX_pTH5474_PBM\|EN2_inv_SOLEXA_2_FBgn0001269_B1H\|POU3F3_pTH9216_PBM | CTAATTAAC | GTTAATTAG |
| DMRTC2_pTH3205_PBM | AACATGTATAAA | TTTTATACATGTT |
| MLX_MLX_1_SELEX\|MLXIPL_MLXIPL_1_SELEX\|MLX_MIx_1_SELEX\|MLXIPL_1\|MLX_1\|MLX_2 | ATCACGTGAT | ATCACGTGAT |
| SNAI2_wor_SOLEXA_2.5_FBgn0001983_B1H | CCACCTGC | GCAGGTGG |
| SOX1_SRP000712_Sox2_ChIP-seq\|BX088580.2_SRP000217_Oct4_ChIP-seq\|SOX1_SRP000217_Sox2_ChIP-seq | CCATTGTTATGCAAA | TTTGCATAACAATGG |
| TGIF1_MA0252.1_B1H\|TGIF1_MA0207.1_B1H\|PKNOX2_MA0227.1_B1H | CTGTCA | TGACAG |
| POU3F3_V$POU3F2_01_Transfac\|POU3F2_2 | ATGAATTAATGCAT | ATGCATTAATTCAT |

TABLE 5-continued

Transcription Factor Binding Sites of Synthetic Promoters

| Name | Binding Site Sequence | Reverse Complement |
|---|---|---|
| HOXA4_MA0228.1_B1H\|SHOX_Prrx2_3072_PBM\|DMBX1_Alx3_3418_PBM\|PROP1_Prop1_3949_PBM\|UNCX_MA0198.1_B1H\|UNCX_Odsh_Cell_FBgn0026058_B1H\|SHOX_MA0200.1_B1H\|LHX1_Lhx4_1719_PBM\|EN2_En1_3123_PBM\|LHX9_MA0209.1_B1H\|ALX1_MA0202.1_B1H\|ALX1_MA0184.1_B1H | CTAATTA | TAATTAG |
| SOX5_3 | ATTTTATTGTTCTAAA | TTTAGAACAATAAAAT |
| BHLHE40_BHLHB2_1_SELEX\|SREBF2_Srebf1_1_SELEX\|MITF_TFEB_1_SELEX\|MITF_TFE3_1_SELEX\|USF1_USF1_1_SELEX\|SREBF2_SREBF2_1_SELEX\|MITF_TFEC_1_SELEX\|BHLHE40_known3\|SREBP_known5\|SREBP_known6\|TFE3_1\|TFEB_1\|MYC_known22\|TFEC_1 | ATCACGTGAC | GTCACGTGAT |
| ZNF187_Zfp187_2626_PBM | ATTAGTAC | GTACTAAT |
| SIX2_MA0246.1_B1H\|SIX5_MA0204.1_B1H | GTATCA | TGATAC |
| GLIS3_GLIS3_1_SELEX\|GLIS3_1 | CTTCGTGGGGGTC | GACCCCCACGAAG |
| ENSG00000250096_MA0002.2_ChIP-seq\|RUNX1_9 | AAACCACAGAC | GTCTGTGGTTT |
| SOX1_SOX2_1_SELEX\|SOX2_2 | GAACAATACCATTGTTC | GAACAATGGTATTGTTC |
| LMX1A_1 | CGAATTAATTAAAAACC | GGTTTTTAATTAATTCG |
| RORB_V$RORA2_01_Transfac\|RORA_2 | ATAAGTAGGTCAA | TTGACCTACTTAT |
| HSF1_MA0486.1_ChIP-seq | AGAACCTTCTAGAAG | CTTCTAGAAGGTTCT |
| NKX6-3_V$NKX61_01_Transfac\|NKX6-1_1 | AACCAATTAAAAA | TTTTTAATTGGTT |
| ENSG00000250096_RUNX2_f1_HocoMoco | ACAAACCACAG | CTGTGGTTTGT |
| FOXD1_V$FREAC4_01_Transfac\|FOXD1_1 | CCATTGTTTACTTAAG | CTTAAGTAAACAATGG |
| DDIT3::CEBPA_1 | AGATGCAATCCCC | GGGGATTGCATCT |
| LHX1_Lhx5_2279_PBM\|LHX1_Lhx1_2240_PBM | AATTAATTA | TAATTAATT |
| TCF7L1_TCF7L1_1_SELEX\|TCF7L2_Tcf7_1_SELEX\|TCF7L1_2\|TCF7_2 | AAAGATCAAAGG | CCTTTGATCTTT |
| MEF2_known2 | AAGCTATAAATAGACT | AGTCTATTTATAGCTT |
| PAX9_PAX5_si_HocoMoco | CCTCAGCC | GGCTGAGG |
| SP9_K562_SP2_HudsonAlpha_ChIP-seq | GCCTAGAGCGGCCCC | GGGGCCGCTCTAGGC |
| SIX2_Six2_2307_PBM | GGGTATCA | TGATACCC |
| ZNF589_ZN589_f1_HocoMoco | CCCACGGTTACTGCCG | CGGCAGTAACCGTGGG |
| ETS_disc7 | GGACTACAGCTCCC | GGGAGCTGTAGTCC |
| LIN54_pTH8566_PBM | AATTCAAAT | ATTTGAATT |
| PDX1_2 | GAGTCTAATGACCCA | TGGGTCATTAGACTC |
| ESR2_1 | CAAGGTCACGGTGACCTG | CAGGTCACCGTGACCTTG |
| SOX21_1 | CTTAATTATAATTAAA | TTTAATTATAATTAAG |
| STAT_known11 | GGATTCCC | GGGAATCC |
| PRKRIR_pTH9190_PBM | ATCTCGTTTGGA | TCCAAACGAGAT |
| TCF3_3 | CGGCACCTGCC | GGCAGGTGCCG |
| TET1_pTH9605_PBM | ATCGCGTTA | TAACGCGAT |
| SPDEF_SPDEF_5_SELEX\|SPDEF_6 | ATGATCCGGGACCAC | GTGGTCCCGGATCAT |
| EBF1_MA0154.2_ChIP-seq | GTCCCCAGGGA | TCCCTGGGGAC |

TABLE 5-continued

Transcription Factor Binding Sites of Synthetic Promoters

| Name | Binding Site Sequence | Reverse Complement |
|---|---|---|
| ARID5A_1 | CTAATATTGCTAAA | TTTAGCAATATTAG |
| EBF1_COE1_f2_HocoMoco | GTCCCCAGGGAC | GTCCCTGGGGAC |
| DBX2_1 | GAATTAATTAATTAAA | TTTAATTAATTAATTC |
| IRF2_V$IRF2_01_Transfac\|IRF1_V$IRF1_01_Transfac\|IRF_known1\|IRF_known2 | GAAAAGTGAAACC | GGTTTCACTTTTC |
| SRF_MA0331.1_COMPILED | CCCAATTAGGAA | TTCCTAATTGGG |
| ELF1_ELF2_f1_HocoMoco | AGTCACTTCCTGCTA | TAGCAGGAAGTGACT |
| MYOD1_pTH5099_PBM | AACAGCTGA | TCAGCTGTT |
| ETV5_MA0076.2_ChIP-seq | CCACTTCCGGC | GCCGGAAGTGG |
| EGR3_EGR1_2_SELEX\|EGR3_EGR1_1_SELEX\|EGR1_known8\|EGR1_known9 | AATGCGTGGGCGTA | TACGCCCACGCATT |
| REST_disc2\|BCL_disc3 | ACCATGGACA | TGTCCATGGT |
| ALX1_RAX_1_SELEX\|RAX_2 | GCCAATTAAC | GTTAATTGGC |
| SPIC_SPIC_1_SELEX\|SPIC_1 | AAAAGAGGAAGTA | TACTTCCTCTTTTT |
| RORB_pTH3469_PBM | GGTGACCTA | TAGGTCACC |
| EMX2_ems_FlyReg_FBgn0000576_B1H | TGTCATAA | TTATGACA |
| SP1_disc2 | AAAGGGGC | GCCCCTTT |
| E2F7 _E2F7_f1_HocoMoco | AAAGGCGCGAAAA | TTTTCGCGCCTTT |
| FOXD1_MA0032.1_SELEX\|FOXC1_2 | GGTAAGTA | TACTTACC |
| TCF4_Tcfe2a_3865_PBM | GCACCTGC | GCAGGTGC |
| HINFP_HINFP_f1_HocoMoco | GCGCTAGCGGACGTTA | TAACGTCCGCTAGCGC |
| EGR3_Egr1_1_SELEX\|EGR1_known12 | AATTGAGTGGGCGTAG | CTACGCCCACTCAATT |
| POU1F1_2 | AATTCATAATTATACACA | TGTGTATAATTATGAATT |
| SPI1_known3 | TAACTTCCTCTTAA | TTAAGAGGAAGTTA |
| MIXL1_MIXL1_1_SELEX\|MIXL1_1 | GTTAATTAGA | TCTAATTAAC |
| GCM1_GCM1_f1_HocoMoco | AATACCCGCATGTG | CACATGCGGGTATT |
| HLTF_HLTF_f1_HocoMoco | TAGGGCTGCAAA | TTTGCAGCCCTA |
| SMAD3_2 | CAAATCCAGACATCAGA | TCTGATGTCTGGATTTG |
| SPIC_SPI1_si_HocoMoco | AAAAGAGGAAGTGAAA | TTTCACTTCCTCTTTTT |
| POU6F1_2 | GACGATAATGAGGTTGC | GCAACCTCATTATCGTC |
| NR2C2_HepG2b_TR4_UCD_ChIP-seq | AACCGCTTCCGGGTC | GACCCGGAAGCGGTT |
| PRDM4_PRDM4_1_SELEX\|PRDM4_1 | GGGGGCCTTGAAA | TTTCAAGGCCCCC |
| NEUROG1_NEUROD2_1_SELEX\|NEUROD2_1 | ACCATATGGC | GCCATATGGT |
| HOXC5_Hoxa5_3415_PBM\|MEOX2_Meox1_2310_PBM\|HOXA4_Gsh2_3990_PBM\|HOXC5_Hoxa7_3750_PBM\|VAX1_Vax1_3499_PBM\|HOXB2_Hoxa1_3425_PBM\|HOXC5_Hoxa6_1040_PBM\|HOXC5_Hoxa4_3426_PBM | GGTAATTAA | TTAATTACC |
| MYC_known13 | AACCACGTGCTC | GAGCACGTGGTT |
| POU5F1_PP5F1_do_HocoMoco | ATTTGCATAACAAAGG | CCTTTGTTATGCAAAT |

TABLE 5-continued

Transcription Factor Binding Sites of Synthetic Promoters

| Name | Binding Site Sequence | Reverse Complement |
|---|---|---|
| MYBL1_V$CMYB_01_Transfac\|MYB_1 | CCCAACGGCGGTTGGGGG | CCCCCAACCGCCGTTGGG |
| HOXC10_1 | ACGTTTTACGACTTTA | TAAAGTCGTAAAACGT |
| HOXC10_HXD10_a_HocoMoco | AATTAAAGCA | TGCTTTAATT |
| SHOX_Hbn_SOLEXA_FBgn0008636_B1H\|HOXC5_Pb_Cell_FBgn0051481_B1H\|EMX2_E5_Cell_FBgn0008646_B1H\|UNCX_Odsh_SOLEXA_FBgn0026058_B1H\|EVX2_Eve_SOLEXA_FBgn0000606_B1H\|ALX1_CG33980_SOLEXA_FBgn0053980_B1H\|LBX2_Lb1_SOLEXA_FBgn0008651_B1H\|EN2_En_Cell_FBgn0000577_B1H\|TLX3_C15_Cell_FBgn0004863_B1H | GTTAATTA | TAATTAAC |
| BHLHA15_BHLHA15_1_SELEX\|MSC_pTH5112_PBM\|OLIG2_OLIG2_2_SELEX\|NEUROG1_pTH5270_PBM\|BHLHA15_1\|OLIG2_2 | ACCATATGGT | ACCATATGGT |
| SRF_MA0083.2_ChIP-seq | CATGCCCAAATAAGGCAA | TTGCCTTATTTGGGCATG |
| TFCP2_TFCP2_2_SELEX\|TFCP2_5 | ACCGGTTTAAACCGGT | ACCGGTTTAAACCGGT |
| IRX4_1 | AATATACATGTAAAACA | TGTTTTACATGTATATT |
| RUNX_1 | AAGTCTGTGGTTAGC | GCTAACCACAGACTT |
| CREB3_1 | CGATGACGTCATCA | TGATGACGTCATCG |
| FOXO3_2 | AATTTGTTTACA | TGTAAACAAATT |
| FOSL1_K562_FOSL1_HudsonAlpha_ChIP-seq | ATGAGTCACCC | GGGTGACTCAT |
| PAX2_V$PAX2_02_Transfac\|PAX2_2 | AATAAACTC | GAGTTTATT |
| IRF_disc1\|E2F_disc4 | CAGCCAATCA | TGATTGGCTG |
| PRDM1_known1 | AGGAAGGGAAAGGA | TCCTTTCCCTTCCT |
| EGR3_MA0162.2_ChIP-seq | CCCCCGCCCCGCC | GGCGGGGCGGGGG |
| MEF2B_GM12878_MEF2A_HudsonAlpha_ChIP-seq | ATGCCAAAAATAGAA | TTCTATTTTTGGCAT |
| GFI1B_sens-2_SANGER_2.5_FBgn0051632_B1H | ATAAATCACAGCACTC | GAGTGCTGTGATTTAT |
| GFI1B_V$GFI1_01_Transfac | ACAAAATAAATCACAGCATATGCC | GGCATATGCTGTGATTTATTTTGT |
| NR3C1_disc2\|TFAP2_disc1 | GGTGAGTCAC | GTGACTCACC |
| TP63_MA0525.1_ChIP-seq | AGACATGCCCAGACATGCCC | GGGCATGTCTGGGCATGTCT |
| GFI1B_GFI1B_f1_HocoMoco | AAATCACTGCA | TGCAGTGATTT |
| ITGB2_1 | CTGACCCC | GGGGTCAG |
| ETV5_GABPA_f1_HocoMoco | CCACTTCCGGTTC | GAACCGGAAGTGG |
| CPHX_1 | ATGATCGAATCAAA | TTTGATTCGATCAT |
| MBD2_MBD2_si_HocoMoco | CCTCCGGCCCG | CGGGCCGGAGG |
| HMGA2_pTH8863_PBM | CAAATATTTG | CAAATATTTG |
| SOX15_1 | AAATCTATTGTTCACTA | TAGTGAACAATAGATTT |
| CTCF_ProgFib_CTCF_UT-A_ChIP-seq\|CTCF_GM12878_CTCF_Stanford_ChIP-seq\|CTCF_SK-N-SH_RA_UW_ChIP-seq\|CTCF_HCFaa_CTCF_UW_ChIP-seq | CGCCCCCTGGTGGCC | GGCCACCAGGGGGCG |
| TBX1_TBX20_4_SELEX\|TBX20_4 | CTTCACACCTA | TAGGTGTGAAG |
| EN2_MA0027.1_SELEX\|EN1_2 | AAGTAGTGCCC | GGGCACTACTT |
| EGR1_disc1 | CCGCCCCCGC | GCGGGGGCGG |

TABLE 5-continued

Transcription Factor Binding Sites of Synthetic Promoters

| Name | Binding Site Sequence | Reverse Complement |
|---|---|---|
| GLIS2_Glis2_1757_PBM | AGACCCCCAC | GTGGGGGTCT |
| REST_known2 | GGCGCTCTCCGTGGTGCTGAA | TTCAGCACCACGGAGAGCGCC |
| HMG20B_pTH8555_PBM | ATATATAATAA | TTATTATATAT |
| SOX11_1 | ATAAGAACAAAGGACTA | TAGTCCTTTGTTCTTAT |
| MAFA_V$VMAF_01_Transfac | AAATGCTGACTCAGCACAA | TTGTGCTGAGTCAGCATTT |
| HAND2_HAND1_si_HocoMoco | AATGCCAGACCC | GGGTCTGGCATT |
| RREB1_RREB1_si_HocoMoco | ACCCCAAACCACCCCCCCCCC | GGGGGGGGGGTGGTTTGGGGT |
| PAX4_V$PAX4_02_Transfac\|PAX4_2 | GAATAATTACC | GGTAATTATTC |
| SCRT2_CG12605_SOLEXA_5_FBgn0035481_B1H\|SCRT2_scrt_SOLEXA_2.5_1_FBgn0004880_B1H | CCACCTGTTGCAC | GTGCAACAGGTGG |
| HOXB13_pTH5808_PBM | GCCCATAAAA | TTTTATGGGC |
| SRY_SRY_2_SELEX\|SRY_6 | AACAATATTCATTGTT | AACAATGAATATTGTT |
| RORA_3 | TAAATAGGTCA | TGACCTATTTA |
| MAFK_MAFF_1_SELEX\|MAFF_1 | TTGCTGACTCAGCAA | TTGCTGAGTCAGCAA |
| RARG_RARG_do_HocoMoco | GGGGGTCACCCAGAGGTCAC | GTGACCTCTGGGTGACCCCC |
| SPDEF_Ets98B_SANGER_10_FBgn0005659_B1H | ACCCGGATC | GATCCGGGT |
| E2F_disc7 | CCGCGCCGCC | GGCGGCGCGG |
| NR3C1_known8 | GTTGCGGGTACAGAGTGTTCTAGGGAA | TTCCCTAGAACACTCTGTACCCGCAAC |
| TCF12_disc3 | AGGTGCGG | CCGCACCT |
| GATA_disc1 | CCTTATCTGC | GCAGATAAGG |
| THRB_THA_f1_HocoMoco | CTGACCTGAA | TTCAGGTCAG |
| GSC_1 | AATCGTTAATCCCTTTA | TAAAGGGATTAACGATT |
| PAX5_disc5 | GCGCGCGCGC | GCGCGCGCGC |
| NKX2-5_MA0211.1_B1H | CACTTAA | TTAAGTG |
| NR4A2_NR4A2_2_SELEX\|NR4A_known3 | TGACCTTTAAAGGTCA | TGACCTTTAAAGGTCA |
| FOXD1_V$XFD1_01_Transfac | CATGTAAATAATGC | GCATTATTTACATG |
| FOXD1_FOXC2_3_SELEX\|FOXC2_3 | TAAGTAAACAAA | TTTGTTTACTTA |
| IRX3_1 | AAAATACATGTAATACT | AGTATTACATGTATTTT |
| NOBOX_NOBOX_si_HocoMoco\|BARHL2_Barhl2_3868_PBM\|BARHL2_Barhl1_2590_PBM | ACCAATTAG | CTAATTGGT |
| SOX17_Sox17_1_SELEX\|SOX17_4 | AACAATGCAATTGTT | AACAATTGCATTGTT |
| PKNOX2_Pknox1_2364_PBM | ACCTGTCA | TGACAGGT |
| E2F4_E2F4_2_SELEX\|E2F1_E2F1_2_SELEX\|E2F_known28\|E2F_known30 | TTTGGCGCCAAA | TTTGGCGCCAAA |
| SNAI3_SNAI1_f1_HocoMoco | CCACCTGG | CCAGGTGG |

TABLE 5-continued

Transcription Factor Binding Sites of Synthetic Promoters

| Name | Binding Site Sequence | Reverse Complement |
|---|---|---|
| SREBF2_MA0595.1_ChIP-seq | ATCACCCCAC | GTGGGGTGAT |
| NR2E1_NR2E1_2_SELEX\|NR2E1_Nr2e1_2_SELEX\|NR2E1_2\|NR2E1_4 | AAGTCAATAAGTCA | TGACTTATTGACTT |
| CDX2_CDX2_f1_HocoMoco | ATTTATGG | CCATAAAT |
| ALX1_MA0180.1_B1H\|ALX1_CG33980_SOLEXA_2_10_FBgn0053980_B1H\|ALX1_CG33980_Cell_FBgn0053980_B1H | CTAATTAAA | TTTAATTAG |
| BCL11B_GM12878_BCL11A_HudsonAlpha_ChIP-seq | AAGAGGAAGTGAAAC | GTTTCACTTCCTCTT |
| TGIF2_1 | AACTAGCTGTCAATAC | GTATTGACAGCTAGTT |
| SREBF2_MA0596.1_ChIP-seq | ATCACCCCAT | ATGGGGTGAT |
| ARID3C_pTH4425_PBM | ATATTAATTAA | TTAATTAATAT |
| EGR1_disc7 | CACGCACGCA | TGCGTGCGTG |
| EN2_inv_SOLEXA_5_FBgn0001269_B1H | CTAATTAAG | CTTAATTAG |
| IRX3_Irx4_2242_PBM | AATTACAA | TTGTAATT |
| NKX2-5_V$NKX25_02_Transfac\|ISL2_Tup_Cell_FBgn0003896_B1H\|NKX2-5_2 | CAATTAAG | CTTAATTG |
| MAX_H1-hESC_MAX_UCD_ChIP-seq | AGAGCACGTGG | CCACGTGCTCT |
| ARID3C_pTH5118_PBM | CAATTAAA | TTTAATTG |
| CRX_1 | GTGGGATTAGTGA | TCACTAATCCCAC |
| GSC_GSC_1_SELEX\|GSC_2 | GCTAATCCCC | GGGGATTAGC |
| COMP1_1 | GGCCTTTTGTTGTCAATCAAAACA | TGTTTTGATTGACAACAAAAGGCC |
| ETS1_ETS1_si_HocoMoco | ACAGGAAGT | ACTTCCTGT |
| RFX5_known4 | CTGTTGCCA | TGGCAACAG |
| DLX1_pTH5506_PBM | AGTAATTAGC | GCTAATTACT |
| KIAA0415_YNL068C_830_DeBoer11 | TCATCTTTGTTTACTTTTAA | TTAAAAGTAAACAAAGATGA |
| ZBTB33_KAISO_f1_HocoMoco | CTCGCAGGAAGA | TCTTCCTGCGAG |
| T_TBX19_1_SELEX\|TBX19_1 | TTTCACACCTAGGTGTGAAA | TTTCACACCTAGGTGTGAAA |
| NEUROG1_NDF1_f1_HocoMoco | CGGCAGATGGCC | GGCCATCTGCCG |
| SP9_pTH5576_PBM | ACCGCTTC | GAAGCGGT |
| MYOD1_MA0500.1_ChIP-seq | CTGCAGCTGTC | GACAGCTGCAG |
| RORB_V$RORA1_01_Transfac\|RORA_1 | ATATCAAGGTCAT | ATGACCTTGATAT |
| RAD21_disc7 | GCCAGCAGCTGGCGC | GCGCCAGCTGCTGGC |
| POU3F3_V$BRN2_01_Transfac | GCTCATTACGAATGAC | GTCATTCGTAATGAGC |
| HNF4_known4 | ATGAACTTTGACC | GGTCAAAGTTCAT |
| PRDM1_Mv110_ChIP-seq | ACTTTCAC | GTGAAAGT |
| CTCF_CTCF_1_SELEX\|CTCF_known2 | AGCGCCACCTAGTGGTA | TACCACTAGGTGGCGCT |
| BPTF_V$FAC1_01_Transfac | ACCCACAACACATA | TATGTGTTGTGGGT |
| NFE2_NFE2_1_SELEX\|NFE2_known2 | CATGACTCATC | GATGAGTCATG |

TABLE 5-continued

Transcription Factor Binding Sites of Synthetic Promoters

| Name | Binding Site Sequence | Reverse Complement |
|---|---|---|
| HNF4_known3 | GGGGGCAAAGGTCAC | GTGACCTTTGCCCCC |
| HIF1A_2 | GCGTACGTGCGGCA | TGCCGCACGTACGC |
| BDP1_disc1 | CCCGGAGGGCTTCCTGGAGGAGG | CCTCCTCCAGGAAGCCCTCCGGG |
| PAX6_MA0069.1_SELEX\|PAX6_3 | AACTCATGCGTGAA | TTCACGCATGAGTT |
| FOXJ3_1 | AAAAAGTAAACAAACCC | GGGTTTGTTTACTTTTT |
| AP1_disc1 | ATGACGTCAC | GTGACGTCAT |
| NPAS3_HIF1A_si_HocoMoco | CCGCACGTACGC | GCGTACGTGCGG |
| CTCF_N H-A_CTCF_Broad_ChIP-seq | TAGTGCCCCCTAGTGGCCAAA | TTTGGCCACTAGGGGGCACTA |
| ATF3_known12 | GCGCTGACGTAACC | GGTTACGTCAGCGC |
| MEF2B_V$MEF2_04_Transfac\|MEF2_known5 | ACTGTTACTAAAATAGAAACT | AGTTTCTATTTTTAGTAACAGT |
| SOX7_SOX7_2_SELEX\|SOX7_3 | AAACAATGCAATTGTTT | AAACAATTGCATTGTTT |
| NFIA_NFIA_2_SELEX | ACTTGGCACC | GGTGCCAAGT |
| TATA_disc2 | ATGACGTCAT | ATGACGTCAT |
| OVOL1_ovo_SANGER_5_FBgn0003028_B1H | AGTACCGTTAT | ATAACGGTACT |
| ZIC5_Opa_SANGER_5_FBgn0003002_B1H | ATCCCCCCACCG | CGGTGGGGGGAT |
| ENSG00000250096_RUNX2_3_SELEX\|RUNX2_6 | AAACCGCAA | TTGCGGTTT |
| CUX1_7 | TAATGATGATCACTA | TAGTGATCATCATTA |
| YY1_disc5 | CTCCCCTGCCGC | GCGGCAGGGGAG |
| BATF3_BATF3_1_SELEX\|BATF_known1 | TGATGACGTCATCA | TGATGACGTCATCA |
| EBF1_disc2 | CAGCTCCCCAGGG | CCCTGGGGAGCTG |
| ZNF75C_ZNF75A_1_SELEX\|ZNF75A_1 | GCTTTTCCCACA | TGTGGGAAAAGC |
| CHD2_disc3 | CTCCTCGCCCC | GGGGCGAGGAG |
| OSR2_sob_SANGER_10_FBgn0004892_B1H | GAAACACAGTAGC | GCTACTGTGTTTC |
| NFAT5_pTH9263_PBM\|NFATC1_pTH8401_PBM\|NFATC1_pTH8315_PBM\|NFATC1_pTH9196_PBM\|NFATC1_pTH8557_PBM\|NFATC1_pTH9005_PBM\|NFATC1_pTH9192_PBM | AATGGAAAAT | ATTTTCCATT |
| SIX5_known 7 | AATAGGGTATCAATATT | AATATTGATACCCTATT |
| NKX3-1_4 | CATTTAAGTACTTAGTA | TACTAAGTACTTAAATG |
| MSC_MSC_1_SELEX\|ASCL2_Ascl2_2654_PBM\|MYOD1_MYF6_1_SELEX\|MYF6_2\|MSC_1 | AACAGCTGTT | AACAGCTGTT |
| FOXP3_FOXP3_f1_HocoMoco | AAACAAATT | AATTTGTTT |
| STAT_known17 | CATTTCCCGGAAACC | GGTTTCCGGGAAATG |
| AR_ANDR_do_HocoMoco | AAGAACATCCTGTTCC | GGAACAGGATGTTCTT |
| E2F2_E2F2_1_SELEX\|E2F3_E2F3_1_SELEX\|E2F2_2\|E2F_known24 | AAAAATGGCGCCAAAATG | CATTTTGGCGCCATTTTT |
| USF1_V$USF_02_Transfac\|MYC_known4 | AAATCACGTGATAT | ATATCACGTGATTT |
| PITX1_1 | ATTGTTAATCCCTCTAA | TTAGAGGGATTAACAAT |
| KLF4_pTH3086_PBM\|KLF4_Klf7_0974_PBM\|KLF4_pTH0977_PBM | GCCACGCCCA | TGGGCGTGGC |

TABLE 5-continued

Transcription Factor Binding Sites of Synthetic Promoters

| Name | Binding Site Sequence | Reverse Complement |
| --- | --- | --- |
| RHOXF1_7 | CGCTGTTAA | TTAACAGCG |
| LMX1A_MA0182.1_B1H | CAATAAA | TTTATTG |
| PTF1A_PTF1A_f1_HocoMoco | CAGGAAACTGAACAGCTGTCC | GGACAGCTGTTCAGTTTCCTG |
| FOXD1_V$XFD2_01_Transfac | AATATAAACATACA | TGTATGTTTATATT |
| NANOG_known1 | GGAAATGGGCCC | GGGCCCATTTCC |
| SOX9_SOX9_5_SELEX|SOX9_7 | AAACAATTGCAGTGTTT | AAACACTGCAATTGTTT |
| CUX1_6 | ACCGGTTGATCACCTGA | TCAGGTGATCAACCGGT |
| YY1_known4 | CAAGATGGC | GCCATCTTG |
| ATF1_pTH5002_PBM | TATGACGTAA | TTACGTCATA |
| UBP1_MA0145.2_ChIP-seq|TFCP2L1_1 | CCAGTTCAAACCAG | CTGGTTTGAACTGG |
| MEF2_known10 | GGCTATTTTAA | TTAAAATAGCC |
| IKZF1_V$IK2_01_Transfac|IKZF2_1 | GTATTCCCAAAC | GTTTGGGAATAC |
| NANOG_disc2 | GCCTTTGTTTTGCAA | TTGCAAAACAAAGGC |
| BACH1_V$BACH1_01_Transfac|BACH1_1 | ACGATGAGTCATGCT | AGCATGACTCATCGT |
| GATA2_V$GATA2_01_Transfac|GATA_known2 | CGCTATCCGC | GCGGATAGCG |
| MZF1_V$MZF1_02_Transfac|MZF1_2 | GGGTGAGGGGGAA | TTCCCCCTCACCC |
| OSR2_Osr1_3033_PBM|OSR2_pTH9150_PBM | ACGGTAGCA | TGCTACCGT |
| RFX8_pTH9285_PBM | CATAGCAAC | GTTGCTATG |
| ENSG00000250096_RUNX3_si_HocoMoco | AACCACAAACCCCA | TGGGGTTTGTGGTT |
| RORB_pTH3464_PBM | CTAGGTCA | TGACCTAG |
| POU2F2_known4 | ATATAATTATGCAAATTAAAAGA | TCTTTTAATTTGCATAATTATAT |
| ATF5_ATF5_si_HocoMoco | CCTTCTTCCTTA | TAAGGAAGAAGG |
| ETV5_ELK3_f1_HocoMoco | CCCAGGAAGTGC | GCACTTCCTGGG |
| MYC_known18|MYCN_2 | CGCACGTGGC | GCCACGTGCG |
| ZIC4_Zic3_1_SELEX|ZIC4_ZIC4_1_SELEX|ZIC4_1|ZIC3_4 | GACCCCCGCTGTGC | GCACAGCGGGGGTC |
| CTCF_HMEC_CTCF_Broad_ChIP-seq | ATAGCGCCCCTGGTGGCCA | TGGCCACCAGGGGCGCTAT |
| USF1_K562_USF1_HudsonAlpha_ChIP-seq | CGGCCACGTGACCC | GGGTCACGTGGCCG |
| PITX3_1 | AGGGGGATTAGCTGCC | GGCAGCTAATCCCCCT |
| LBX1_pTH5994_PBM|SHOX_UNCX_2_SELEX|LBX1_pTH5672_PBM|ALX1_pTH6195_PBM|DMBX1_Cart1_0997_PBM|HOXC5_pTH6140_PBM|DRGX_Pax6_3838_PBM|DMBX1_Arx_1738_PBM|LMX1A_LMX16_2_SELEX|VENTX_pTH5490_PBM|POU3F3_pTH9342_PBM|LBX2_Lbx2_3869_PBM|EVX2_pTH6104_PBM|ALX1_PRRX1_1_SELEX|SHOX_Prrx2_1_SELEX|LHX9_Lhx2_0953_PBM|HESX1_pTH6156_PBM|HOXD1_pTH6251_PBM|LHX9_Lhx9_3492_PBM|LBX2_pTH6404_PBM|SHOX_SHOX_1_SELEX|SHOX_Shox2_1_SELEX|SHOX_Uncx_2_SELEX|ALX1_ISX_3_SELEX|ISX_4|LMX16_3|NKX6-2_2|NKX6-2_3|PRRX1_2|PRRX2_5|SHOX_1|SHOX2_3|UNCX_3|UNCX_5 | CTAATTAA | TTAATTAG |
| HOXC5_PDX1_2_SELEX|VAX1_VAX1_1_SELEX|HOXC5_pTH6215_PBM|VAX1_VAX2_1_SELEX|PDX1_6|VAX1_2|VAX2_2 | CTAATTAC | GTAATTAG |

TABLE 5-continued

Transcription Factor Binding Sites of Synthetic Promoters

| Name | Binding Site Sequence | Reverse Complement |
| --- | --- | --- |
| PAX4_PAX4_2_SELEX\|ALX1_VSX2_1_SELEX\|PAX4_PAX4_1_SELEX\|EN2_EN1_3_SELEX\|LHX8_Lhx8_2_SELEX\|PAX4_7\|PAX4_8\|EN1_6\|LHX8_3\|VSX2_2 | CTAATTAG | CTAATTAG |
| RHOXF2_1 | GAGCATTAATTAAGGCA | TGCCTTAATTAATGCTC |
| MYC_known11 | GACCACGTGACA | TGTCACGTGGTC |
| ZIC4_Zic3_3119_PBM\|ZIC4_Zic2_2895_PBM\|ZIC4_Zic1_0991_PBM | CACAGCGGGG | CCCCGCTGTG |
| ETV5_K562_ETS1_HudsonAlpha_ChIP-seq | CCTGCTGGGAGTTGTAGTCCC | GGGACTACAACTCCCAGCAGG |
| FOXD1_Foxk1_1_SELEX\|FOXK1_3 | CGGACACAATC | GATTGTGTCCG |
| AL662830.5_exd_SOLEXA_2_FBgn0000611_B1H | ATATCAAA | TTTGATAT |
| CREB3L2_pTH5024_PBM | ACACGTGGC | GCCACGTGT |
| GATA2_Mf28_ChIP-seq | ACCCCCTTATCAGACTAT | ATAGTCTGATAAGGGGGT |
| TEF_DBP_si_HocoMoco | GTTATGTAACA | TGTTACATAAC |
| ENSG00000234254_Tgif2_3451_PBM\|PKNOX2_Pknox2_3077_PBM | ACCTGTCAAT | ATTGACAGGT |
| AL662834.13_Zbtb12_2932_PBM | ATCTAGAACA | TGTTCTAGAT |
| SRY_4 | GAATATTATAATTATA | TATAATTATAATATTC |
| DMBX1_Alx1_1_SELEX\|DMBX1_ALX3_2_SELEX\|ALX3_3\|ALX1_4 | TCTAATTAAA | TTTAATTAGA |
| DLX1_Dlx2_1_SELEX\|DLX2_3 | GCAATTAA | TTAATTGC |
| YY2_pho_SANGER_10_FBgn0002521_B1H | CAAAATGGCGGC | GCCGCCATTTTG |
| TFAP2A_Tcfap2a_2337_PBM | CCCTGAGGCA | TGCCTCAGGG |
| CR936877.3_RXRB_f1_HocoMoco | TGAGGTCACA | TGTGACCTCA |
| RBPJ_MA0085.1_COMPILED | ATCTCGTTTCCCACAG | CTGTGGGAAACGAGAT |
| ETV5_HepG2_GABP_HudsonAlpha_ChIP-seq | CCACTTCCGGTTCCG | CGGAACCGGAAGTGG |
| NKX2-5_Bap_Cell_FBgn0004862_B1H | CCACTTAAGA | TCTTAAGTGG |
| CUX1_CUX1_1_SELEX\|CUX1_8 | ATCGATAACTGATCGAT | ATCGATCAGTTATCGAT |
| DMBX1_ALX4_1_SELEX\|DMBX1_Alx1_2_SELEX\|DMBX1_Arx_1_SELEX\|SHOX_Uncx_1_SELEX\|ALX4_3\|ALX1_5\|ARX_3\|UNCX_4 | CTAATTAAATTAA | TTAATTTAATTAG |
| RELA_GM12892_N FKB_Stanford_ChIP-seq\|RELA_GM19193_NFKB_Stanford_ChIP-seq | AGGGGATTTCCAAGG | CCTTGGAAATCCCCT |
| HNF4_known1 | ACAGGGTCAAAGGTCAAGA | TCTTGACCTTTGACCCTGT |
| SHOX_UNCX_1_SELEX\|UNCX_2 | CTAATTAAATTAG | CTAATTTAATTAG |
| NKX2-6_Tin_SOLEXA_FBgn0004110_B1H\|NKX2-5_Bap_SOLEXA_FBgn0004862_B1H | CACTTAAG | CTTAAGTG |
| CDX2_cad_FlyReg_FBgn0000251_B1H | ATCATAAAA | TTTTATGAT |
| BCL_disc10 | CCTCCGCCGC | GCGGCGGAGG |
| SIX5_known 1 | AATAGGGTATCATATAT | ATATATGATACCCTATT |
| HOXC5_1 | AGTAATTAATTAATTCG | CGAATTAATTAATTACT |
| ZNF423_ZN423_a_HocoMoco | GCACCCTTGGGTGCC | GGCACCCAAGGGTGC |

TABLE 5-continued

Transcription Factor Binding Sites of Synthetic Promoters

| Name | Binding Site Sequence | Reverse Complement |
| --- | --- | --- |
| REST_disc3 | GGACAGCGCC | GGCGCTGTCC |
| IRF7_IRF7_2_SELEX\|IRF_known18 | AAAACGAAAATCGATTT | AAATCGATTTTCGTTTT |
| THRB_V$T3R_01_Transfac | GATTGAGGTCACGCCA | TGGCGTGACCTCAATC |
| POU3F3_pTH3819_PBM\|ALX1_Vsx1_1728_PBM | CTAATTATC | GATAATTAG |
| SREBP_known2 | GATCACCCCAC | GTGGGGTGATC |
| MLX_pTH2882_PBM | CACGTGATC | GATCACGTG |
| ZNF32_pTH3120_PBM | ATATATATA | TATATATAT |
| PAX9_sv_SOLEXA_5_FBgn0005561_B1H | ATTGGTGCGTGACGG | CCGTCACGCACCAAT |
| RELA_MA0101.1_SELEX\|RELA_V$CREL_01_Transfac\|REL1\|REL2 | GGAAATCCCC | GGGGATTTCC |
| CTCF_A549_CTCF_HudsonAlpha_ChIP-seq | ACAGCGCCCCTGGTGGCCAC | GTGGCCACCAGGGGGCGCTGT |
| CR936877.3_MA0512.1_ChIP-seq | CAAAGGTCAGA | TCTGACCTTTG |
| THAP1_disc1 | CCGCCATCTTGGTTAAGGCAGAGG | CCTCTGCCCTTAACCAAGATGGCGG |
| IRF7_IRF7_1_SELEX\|IRF_known17 | ACGAAAGCGAAAGT | ACTTTCGCTTTCGT |
| SP9_Sp4_1011_PBM | AGGGGGCGGG | CCCGCCCCCT |
| BX088580.2_H1-hESC_POU5F1_HudsonAlpha_ChIP-seq | ATTTGCATAACAAAGGA | TCCTTTGTTATGCAAAT |
| HOXC10_HOXC10_1_SELEX\|HOXC10_2 | CCCATAAAAA | TTTTTATGGG |
| HBP1_Hbp1_2241_PBM | GTGAATGA | TCATTCAC |
| ATF1_pTH5005_PBM | ATGACGTA | TACGTCAT |
| RFX8_pTH10021_PBM | CATAGCAACC | GGTTGCTATG |
| PAX4_V$PAX4_04_Transfac\|PAX4_4 | AAAAATTAACCCAAAATCCAACCTCACCCC | GGGGTGAGGTTGGATTTTGGGTTAATTTTT |
| RFX8_Rfxdc2_3516_PBM | CATAGCAACG | CGTTGCTATG |
| GLIS3_GLIS3_f1_HocoMoco | GTGGGGGTA | TACCCCCAC |
| PAX5_disc4 | AGAGGAAGTG | CACTTCCTCT |
| TEAD1_TEAD1_2_SELEX\|TEAD1_4 | ACATTCCTGACATTCCA | TGGAATGTCAGGAATGT |
| E2F_known17 | GTTTGGCGCGA | TCGCGCCAAAC |
| ZNF274_NT2-D1_ZNF274_UCD_ChIP-seq | TCATACTGGAGAGAA | TTCTCTCCAGTATGA |
| TFAP2A_Tcfap2a_2_SELEX\|TFAP2A_TFAP2A_2_SELEX\|TFAP2_known12\|TFAP2_known21 | CGCCTCAGGCA | TGCCTGAGGCG |
| OVOL1_OVOL1_f1_HocoMoco | ACAGTTACA | TGTAACTGT |
| ESRRG_Esrra_2190_PBM | ATGACCTTG | CAAGGTCAT |
| PAX4_3 | AATCCCCACCCC | GGGGTGGGGATT |
| IRF1_IRF1_si_HocoMoco | ACTTTCACTTTC | GAAAGTGAAAGT |
| POU2F2_known1 | ATCAATATGCAAATTCGG | CCGAAATTTGCATATTGAT |
| PAX4_V$PAX4_03_Transfac | AATCCCCACCCG | CGGGTGGGGATT |
| POU3F3_V$OCT1_02_Transfac\|POU2F2_known2 | ATGAATATGCATATA | TATATGCATATTCAT |
| ARHGEF12_1 | ATTTACGACAAATAGC | GCTATTTGTCGTAAAT |

TABLE 5-continued

Transcription Factor Binding Sites of Synthetic Promoters

| Name | Binding Site Sequence | Reverse Complement |
|---|---|---|
| EOMES_TBX21_3_SELEX\|TBX21_3 | TCACACCTTAAAGGTGTGA | TCACACCTTTAAGGTGTGA |
| MAX_MAX_1_SELEX\|MYC_known20 | CACGTGCTAACCACGTG | CACGTGGTTAGCACGTG |
| HSFY1_HSFY2_3_SELEX\|HSFY2_3 | TTCGAACCGTTCGAA | TTCGAACGGTTCGAA |
| CEBPA_HeLa-S3_CEBPB_Stanford_ChIP-seq | AGGATTGTGCAATA | TATTGCACAATCCT |
| RFX8_pTH8587_PBM | ATAGCAAC | GTTGCTAT |
| CEBPA_pTH3208_PBM | ATTACGCAAT | ATTGCGTAAT |
| FOXM1_pTH8652_PBM | AAAAACAA | TTGTTTTT |
| PDX1_1 | GAATTAATGACC | GGTCATTAATTC |
| E2F1_MA0024.2_ChIP-seq | CCTCCCGCCCG | CGGGCGGGAGG |
| ALX1_ISX_1_SELEX\|ISX_2 | TTAATCTAATTAA | TTAATTAGATTAA |
| TWIST2_pTH5033_PBM\|OLIG2_OLIG3_1_SELEX\|OLIG2_pTH5267_PBM\|OLIG2_BHLHE23_1_SELEX\|OLIG2_OLIG2_1_SELEX\|BHLHE23_1\|OLIG2_1\|OLIG3_1 | AACATATGGT | ACCATATGTT |
| GFI1B_sens_SOLEXA_5_FBgn0002573_B1H | AAATAAATCACAGCA | TGCTGTGATTTATTT |
| FOXN1_1 | AAAGCGTCGTT | AACGACGCTTT |
| SHOX_PHOX2A_1_SELEX\|PROP1_PROP1_1_SELEX\|SHOX_PHOX26_2_SELEX\|SHOX_PHOX26_1_SELEX\|PHOX2A_2\|PHOX26_2\|PHOX26_3\|PROP1_2 | TAATTAAATTA | TAATTTAATTA |
| POU2F2_known11\|POU2F2_known12 | TATGCAAATCA | TGATTTGCATA |
| ATOH7_pTH5074_PBM | AACATATGGC | GCCATATGTT |
| FOXD1_MA0546.1_ChIP-seq | AAAGTAAACA | TGTTTACTTT |
| NR2E1_pTH6281_PBM | AGAGGTCAAT | ATTGACCTCT |
| AHR_AHR_si_HocoMoco | GCACGCAAC | GTTGCGTGC |
| GATA2_V$GATA1_02_Transfac\|GATA_known4 | GTAAAGATAGGGGA | TCCCCTATCTTTAC |
| AP1_known3 | ACTGAGTCATC | GATGACTCAGT |
| STAT1_V$STAT1_03_Transfac | CGGAAATC | GATTTCCG |
| HDAC2_disc6 | AAGAAAAGAAAAAA | TTTTTTCTTTTCTT |
| SIN3A_disc7 | CCCCGGACAGCGCC | GGCGCTGTCCGGGG |
| TEF_V$HLF_01_Transfac\|TEF_V$VBP_01_Transfac\|HLF_I | ATTACGTAAC | GTTACGTAAT |
| ZEB1_GM12878_ZEB1_HudsonAlpha_ChIP-seq\|ZEB1_disc1 | CAGGTGAG | CTCACCTG |
| KLF4_KLF3_f1_HocoMoco | AGCCACACCCAGGCA | TGCCTGGGTGTGGCT |
| EP300_disc1\|RXRA_disc3 | AATGAGTCAT | ATGACTCATT |
| HNFIA_HNF1B_1_SELEX\|HNF1B_3 | GTTAATCATTAAC | GTTAATGATTAAC |
| LMX1A_CG32105_Cell_FBgn0052105_B1H | ATTAATTAG | CTAATTAAT |
| RBPJ_1 | CGTGGGAA | TTCCCACG |
| NKX6-3_Nkx6-1_2825_PBM\|NKX6-3_N_kx6-3_3446_PBM | ATTAATTAC | GTAATTAAT |
| OSR2_sob_SOLEXA_5_FBgn0004892_B1H | AAAAACAGTAGCCG | CGGCTACTGTTTTT |
| FOXP4_CG2052_SOLEXA_2.5_FBgn0039905_B1H | AAAAAAAAAAAACC | GGTTTTTTTTTTTT |
| TCF12_disc5 | CCAGCTGCCCC | GGGGCAGCTGG |

TABLE 5-continued

Transcription Factor Binding Sites of Synthetic Promoters

| Name | Binding Site Sequence | Reverse Complement |
|---|---|---|
| USF1_V$USF_C_Transfac\|MYC_known7 | CCACGTGC | GCACGTGG |
| BDP1_disc3 | CCCACAGCCTCGTC | GACGAGGCTGTGGG |
| THRB_THA_f2_HocoMoco | CTGACCTGAAGTGACCC | GGGTCACTTCAGGTCAG |
| AR_V$GR_Q6_Transfac\|NR3C1_known1 | CTAGAACACAGTGTACCCA | TGGGTACACTGTGTTCTAG |
| TEAD3_TEAD3_2_SELEX\|TEAD3_2 | ACATTCCA | TGGAATGT |
| SREBF2_pTH4327_PBM | TCACGCGA | TCGCGTGA |
| MAFK_MAFK_4_SELEX\|MAF_known9 | ATGCTGAGTCAGCGA | TCGCTGACTCAGCAT |
| ATF3_HepG2_ATF3_HudsonAlpha_ChIP-seq\|ATF3_GM12878_ATF3_HudsonAlpha_ChIP-seq\|USF1_HeLa-S3_USF2_Stanford_ChIP-seq\|ATF3_H1-hESC_ATF3_HudsonAlpha_ChIP-seq | GGTCACGTGAC | GTCACGTGACC |
| MYC_K562_CMYC_Stanford_ChIP-seq\|MYC_HepG2_CMYC_UT-A_ChIP-seq\|MYC_MYC_f1_HocoMoco | GAGCACGTGGC | GCCACGTGCTC |
| DPRX_DPRX_1_SELEX\|DPRX_1 | ACGGATTAGC | GCTAATCCGT |
| MNX1_1 | CGCCACTAATTAGTAC | GTACTAATTAGTGGCG |
| HMGA2_pTH3046_PBM | CCGCAATAAA | TTTATTGCGG |
| NRF1_disc1 | CACTGCGCATGCGCA | TGCGCATGCGCAGTG |
| PBX3_disc1 | AGCCAATGAG | CTCATTGGCT |
| TEF_TEF_2_SELEX\|NFIL3_NFIL3_1_SELEX\|NFIL3_3\|TEF_3 | TATTACATAACA | TGTTATGTAATA |
| SP1_known5 | AGGGGGCGGGCC | GGCCCGCCCCCT |
| NKX6-1_3 | AGTAATTAATTACTTC | GAAGTAATTAATTACT |
| KLF4_MA0599.1_ChIP-seq\|TATA_disc4\|SP1_known4 | GCCCCGCCCC | GGGGCGGGGC |
| NKX2-5_5 | AAATTCAAGTGGCTTA | TAAGCCACTTGAATTT |
| KLF4_luna_SOLEXA_5_FBgn0040765_B1H | AAATGGGCGTGGCC | GGCCACGCCCATTT |
| PAX9_PAX5_1_SELEX\|PAX5_known5 | CGTCACGCATGAGTGCTC | GAGCACTCATGCGTGACG |
| DLX1_Dlx2_2273_PBM\|DLX1_Dlx3_1030_PBM\|DLX1_Dlx1_1741_PBM | ATAATTGCC | GGCAATTAT |
| NAIF1_pTH8560_PBM | CTTACGCAA | TTGCGTAAG |
| NR3C1_known9 | AGGGGAGGTACACGGTGTTCTTTTGGG | CCCAAAAGAACACCGTGTACCTCCCCT |
| DOBOX4_1 | TAAATAGATACCCCATA | TATGGGGTATCTATTTA |
| ALX4_2 | CGCATTAATTAATTACC | GGTAATTAATTAATGCG |
| MTF1_1 | GGGCCGTGTGCAGA | TCTGCACACGGCCC |
| TCF12_disc2 | TGAGTAAACA | TGTTTACTCA |
| TFAP2A_MA0003.2_ChIP-seq | CATTGCCTCAGGGCA | TGCCCTGAGGCAATG |
| FOXO6_pTH3846_PBM\|FOXD1_pTH5334_PBM\|FOXD1_FOXB1_4_SELEX\|FOXB1_4 | TGTAAACAA | TTGTTTACA |
| ATF3_disc4 | CCCCGCGCCC | GGGCGCGGGG |
| SPDEF_1 | AAAATCCGGATGTAC | GTACATCCGGATTTT |
| RFX8_V$RFX1_02_Transfac\|RFX5_known2 | TAGTAGCCATGGCAACAA | TTGTTGCCATGGCTACTA |

TABLE 5-continued

Transcription Factor Binding Sites of Synthetic Promoters

| Name | Binding Site Sequence | Reverse Complement |
|---|---|---|
| MAFA_MAFA_f1_HocoMoco | CGAAGGCTGCGGGGTCAGCAC | GTGCTGACCCCGCAGCCTCG |
| IRF_disc2 | ATGACTCATA | TATGAGTCAT |
| PKNOX2_MA0498.1_ChIP-seq | AGCTGTCACTCACCT | AGGTGAGTGACAGCT |
| JUN_JUNB_f1_HocoMoco\|MYC_disc3 | ATGACTCATC | GATGAGTCAT |
| ZFP161_Zfp161_2858_PBM | CGCGCGCAC | GTGCGCGCG |
| GATA_disc4 | ATCTGATA | TATCAGAT |
| STAT2_STAT2_f1_HocoMoco | GGAAAACGAAACTGA | TCAGTTTCGTTTTCC |
| IKZF2_2 | TATAGGGATAA | TTATCCCTATA |
| MAX_Max_3864_PBM\|MAX_pTH4381_PBM\|MAX_Max_3863_PBM | ACCACGTGG | CCACGTGGT |
| HNF4G_HNF4A_3_SELEX\|HNF4_known18 | ATTGGACTTTGGACCC | GGGTCCAAAGTCCAAT |
| MAX_MA0058.2_ChIP-seq\|MYC_MA0147.2_ChIP-seq | AAGCACATGG | CCATGTGCTT |
| RFX8_HepG2_RFX5_Stanford_ChIP-seq | CTGTTGCTAGGCAGA | TCTGCCTAGCAACAG |
| ZEB1_V$AREB6_03_Transfac\|ZEB1_known3 | CTGCACCTGTGC | GCACAGGTGCAG |
| GCM1_I$GCM_01_Transfac | AAACCCGCATATT | AATATGCGGGTTT |
| CTCF_disc6 | ACCTAGTG | CACTAGGT |
| ESRRG_T-47D_ERALPHA_HudsonAlpha_ChIP-seq | CAAGGTCAGGGTGACCTGG | CCAGGTCACCCTGACCTTG |
| VTN_pTH6379_PBM | AATTAATTAG | CTAATTAATT |
| LHX3_1 | AATTAATTA | TTAATTAATT |
| IRF_known3 | CAGTTTCACTTTCCC | GGGAAAGTGAAACTG |
| GLIS2_GLIS2_1_SELEX\|GLIS2_2 | CTTCGCGGGGGTC | GACCCCCGCGAAG |
| THRB_THRB_2_SELEX\|THRB_2 | GTGACCTTAATAAGGTCAC | GTGACCTTATTAAGGTCAC |
| HOXA4_pTH5887_PBM | CCTAATGAG | CTCATTAGG |
| YY2_NT2-D1_YY1_UCD_ChIP-seq | CAAGATGGCGGCC | GGCCGCCATCTTG |
| TFAP4_TFAP4_si_HocoMoco | CCGCAGCTGGC | GCCAGCTGCGG |
| AL662830.5_GM12878_PBX3_HudsonAlpha_ChIP-seq | CTCTGATTGGCCGGC | GCCGGCCAATCAGAG |
| TATA_disc10 | CCGCGGCGGC | GCCGCCGCGG |
| SIX6_Optix_Cell_FBgn0025360_B1H\|SIX6_Optix_SOLEXA_FBgn0025360_B1H | AAGTGATA | TATCACTT |
| HNF1A_Tcf2_0913_PBM | CTGGTTAA | TTAACCAG |
| ETV5_MA0474.1_ChIP-seq\|ETV5_MA0475.1_ChIP-seq | ACAGGAAGTGG | CCACTTCCTGT |
| CEBPB_known3 | GCCTTACCAAATA | TATTTGGTAAGGC |
| SOX15_SOX15_2_SELEX\|SOX15_3 | ATCAATAACATTGAT | ATCAATGTTATTGAT |
| STAT_disc3 | AGTTTCATTTTC | GAAAATGAAACT |
| MAFB_MAFB_f1_HocoMoco | CCGTCAGCA | TGCTGACGG |
| TFAP4_V$AP4_01_Transfac\|TFAP4_1 | AGAACCAGCTGCGGTCAG | CTGACCGCAGCTGGTTCT |
| ATF7_pTH5083_PBM | AATGACGTCA | TGACGTCATT |

TABLE 5-continued

Transcription Factor Binding Sites of Synthetic Promoters

| Name | Binding Site Sequence | Reverse Complement |
| --- | --- | --- |
| SOX9_SOX10_5_SELEX\|SOX10_7 | TGAATGTTCAGTCA | TGACTGAACATTCA |
| NRF1_NRF1_f1_HocoMoco | CTGCGCATGCGC | GCGCATGCGCAG |
| BCL6B_1 | CAAATTCCTCGAAAGA | TCTTTCGAGGAATTTG |
| E2F2_1 | ATAAAGGCGCGCGAT | ATCGCGCGCCTTTAT |
| NR2C2_HeLa-53_TR4_UCD_ChIP-seq | ACCACTTCCGGGTCA | TGACCCGGAAGTGGT |
| VSX1_1 | AATTATTAATTAACTCG | CGAGTTAATTAATAATT |
| MYCN_V$NMYC_01_Transfac\|MYCN_1 | TCCCACGTGTCA | TGACACGTGGGA |
| TCF7L2_MA0237.2_ChIP-chip | ATCAAAGGAGCCGA | TCGGCTCCTTTGAT |
| MYC_disc5 | GCTGATGCAA | TTGCATCAGC |
| SOX18_SOX18_3_SELEX\|SOX18_4 | ATGAATGGAATTCAT | ATGAATTCCATTCAT |
| DLX1_DLX1_1_SELEX\|DLX1_2 | CCTAATTATC | GATAATTAGG |
| SMAD2_SMAD2_si_HocoMoco | CAGACGGACAC | GTGTCCGTCTG |
| CDX1_1 | TAAGGTAATAAAATTA | TAATTTTATTACCTTA |
| NR2C2_pTH6019_PBM | AAGGTCAA | TTGACCTT |
| NR4A_known1 | AAGGTCAC | GTGACCTT |
| RBPJ_2 | ACCGTGGGAAA | TTTCCCACGGT |
| MEOX2_MEOX2_2_SELEX\|MEOX2_2 | GTAATTACCGTAATTAA | TTAATTACGGTAATTAC |
| MYC_disc7 | AACACGTG | CACGTGTT |
| CTCF_disc5 | CCAGCAGGGGCGG | CCGCCCCTGCTGG |
| KLF4_V$AP2REP_01_Transfac\|KLF12_1 | CAGTGGG | CCCACTG |
| NR5A1_pTH5709_PBM | AAGGTCAT | ATGACCTT |
| MLXIPL_MLXPL_f1_HocoMoco | CCACGGCGGTGTCACATGC | GCATGTGACACCGCCGTGG |
| IRF_disc6 | AAGTTTCA | TGAAACTT |
| CTCF_HepG2_CTCF_Broad_ChIP-seq | ATAGCGCCCCTGGTGGC | GCCACCAGGGGCGCTAT |
| NFE2_known1 | GTGACTCAGCA | TGCTGAGTCAC |
| GATA2_V$GATA2_02_Transfac\|GATA2_V$GATA3_02_Transfac\|GATA2_V$GATA2_03_Transfac | AGAGATAAGA | TCTTATCTCT |
| CTCF_HUVEC_CTCF_UT-A_ChIP-seq | AGTGCCATCTAGTGG | CCACTAGATGGCACT |
| HIF1A_1 | CGTACGTGCGGC | GCCGCACGTACG |
| THRB_THRB_3_SELEX\|THRB_3 | GTGACCTTACATAAGGTCAC | GTGACCTTATGTAAGGTCAC |
| SRF_K562_SRF_HudsonAlpha_ChIP-seq | AGTTGCCTTATATGGTC | GACCATATAAGGCAACT |
| ARID5A_Arid5a_3770_PBM | GATAATATTGA | TCAATATTATC |
| MYB_V$VMYB_01_Transfac | AATAACGGAA | TTCCGTTATT |
| TCF4_pTH5071_PBM | AACACCTGG | CCAGGTGTT |
| TATA_disc6 | CCAATCAGAA | TTCTGATTGG |
| POU1F1_1 | ATGAATAAAT | ATTTATTCAT |
| IRX6_1 | AAAATACATGTAAAAAT | ATTTTTACATGTATTTT |

TABLE 5-continued

Transcription Factor Binding Sites of Synthetic Promoters

| Name | Binding Site Sequence | Reverse Complement |
|---|---|---|
| ALX4_1 | CCTGAGAATAATC | GATTATTCTCAGG |
| E2F3_E2F3_2_SELEX\|E2F_known25 | AAAAATGGCGCCATTTTT | AAAAATGGCGCCATTTTT |
| NR1I3_NR1I3_si_HocoMoco | AAGTTCAT | ATGAACTT |
| POU6F1_3 | AAACATAATGAGGTTGC | GCAACCTCATTATGTTT |
| NR1I2_NR1I2_si_HocoMoco | AAGTTCAC | GTGAACTT |
| SOX9_SOX9_f1_HocoMoco | AGAACAATGGG | CCCATTGTTCT |
| PLAGL1_1 | CTAGGGGCGCCCCCAA | TTGGGGGCGCCCCTAG |
| EP300_V$P300_01_Transfac\|EP300_known1 | ACAGGGAGTGAGTG | CACTCACTCCCTGT |
| IRF4_IRF4_1_SELEX\|IRF4_2 | CCGAAACCGAAACTA | TAGTTTCGGTTTCGG |
| SRF_F$MCM1_01_Transfac | TTACCTGATTAGGAAA | TTTCCTAATCAGGTAA |
| BSX_Bsx_3483_PBM | ACCCATTAA | TTAATGGGT |
| STAT3_V$STAT3_02_Transfac | GGCTTCCC | GGGAAGCC |
| FOXD1_V$HFH3_01_Transfac\|FOXI1_1 | GGATGTTTGTTTA | TAAACAAACATCC |
| AHR::ARNT::HIF1A_1 | CCGCACGCA | TGCGTGCGG |
| NKX2-8_1 | AATTTAAGTACTTAAAA | TTTTAAGTACTTAAATT |
| MEF2B_Mv88_Ch\|P-seq\|MEF2_known11 | CTATAAATAG | CTATTTATAG |
| EMX2_pTH5673_PBM\|HOXC5_PDX1_do_HocoMoco\|EVX2_Evx1_3952_PBM\|HOXA4_Hoxa2_3079_PBM\|EVX2_pTH6436_PBM\|VAX1_Vax2_3500_PBM | CTAATTACC | GGTAATTAG |
| NKX2-5_Nkx2-2_2823_PBM | GCACTTAAA | TTTAAGTGC |
| STAT3_GM12878_STAT3_Stanford_ChIP-seq | CAGGTGATTTCCGGGAAATG | CATTTCCCGGAAATCACCTG |
| MYF6_1 | CGGACACCTGTTCTTC | GAAGAACAGGTGTCCG |
| ALX1_V$CHX10_01_Transfac\|VSX2_1 | GGCTAATTAGCGAA | TTCGCTAATTAGCC |
| CEBPA_V$CEBP_01_Transfac | AACTTACCAAACA | TGTTTGGTAAGTT |
| DMBX1_ALX1_si_Hoco Moco | ATAATTGGATTA | TAATCCAATTAT |
| TAL1_known5 | AACAGATGGTCG | CGACCATCTGTT |
| FOXP4_MA0593.1_ChIP-seq | AAGTAAACAAA | TTTGTTTACTT |
| FOXD1_MA0041.1_SELEX\|FOXD3_2 | AAACAAACATTC | GAATGTTTGTTT |
| TCF7L2_LEF1_1_SELEX\|TCF7L2_known7 | AAAGATCAAAGGGTT | AACCCTTTGATCTTT |
| AR_GCR_si_HocoMoco\|AR_PRGR_f1_HocoMoco | AGAACAG | CTGTTCT |
| TAL1_known2 | GTCACCATCTGTTCGA | TCGAACAGATGGTGAC |
| NFY_known6 | CTCAGCCAATCAGCGC | GCGCTGATTGGCTGAG |
| TCF4_sc_da_SANGER_10_FBgn0000413_B1H\|TCF4_ac_da_SANGER_5_FBgn0000413_B1H | ACACCTGC | GCAGGTGT |
| DBX2_MA0174.1_B1H | TAATAAA | TTTATTA |
| TCF4_H1-hESC_TCF12_HudsonAlpha_ChIP-seq\|TCF12_disc1 | ACACCTGG | CCAGGTGT |
| ENSG00000234254_Tgif1_2342_PBM | AGCTGTCAAT | ATTGACAGCT |
| NR3C1_disc6 | CTCCCTGTCCCCTC | GAGGGGACAGGGAG |

TABLE 5-continued

Transcription Factor Binding Sites of Synthetic Promoters

| Name | Binding Site Sequence | Reverse Complement |
|---|---|---|
| STAT_known12 | GATTTCCA | TGGAAATC |
| MAFK_MA0496.1_ChIP-seq | AAATTGCTGACTCAG | CTGAGTCAGCAATTT |
| SPIC_GM12878_PU1_HudsonAlpha_ChIP-seq | AAAAAGAGGAAGTGAAACT | AGTTTCACTTCCTCTTTTT |
| HES4_HES1_f1_HocoMoco | CCGCCACGAGCCC | GGGCTCGTGGCGG |
| SNAI3_pTH2340_PBM | AGCTGTCAAA | TTTGACAGCT |
| AL662828.6_ATF6A_si_HocoMoco | CCACGTCACCAC | GTGGTGACGTGG |
| RFX5_known5 | ACCGTTGCTATGGTA | TACCATAGCAACGGT |
| ESRRG_ESRRA_2_SELEX\|ESRRG_ESRRA_5_SELEX\|ESRRA_known8 | AAGGTCATTCAAGGTCA | TGACCTTGAATGACCTT |
| MYBL2_MYBB_f1_HocoMoco | TCAACCTGCA | TGCAGGTTGA |
| NAIF1_pTH9299_PBM | TTACGCAAA | TTTGCGTAA |
| FOSL1_FOSB_f1_HocoMoco | CTGACTCATC | GATGAGTCAG |
| SPIC_MA0081.1_SELEX\|SPIB_1 | AGAGGAA | TTCCTCT |
| STAT_disc1 | TTCCAGGAAA | TTTCCTGGAA |
| LHX1_Lhx3_3431_PBM | ATTTAATTA | TAATTAAAT |
| ZBTB7C_ZBT7A_a_HocoMoco | AGCAGTGGGTCCCCAG | CTGGGGGACCCACTGCT |
| TP53_Tp53_2_SELEX\|TP53_6 | ACATGTCATAGACATGT | ACATGTCTATGACATGT |
| HSF_disc1 | GTTATGCAAC | GTTGCATAAC |
| ZNF8_1 | TCTTTGGCGTACCCTAA | TTAGGGTACGCCAAAGA |
| CDX2_CDX1_f1_HocoMoco | ACATAAAT | ATTTATGT |
| HOXB13_1 | AACCCAATAAAATTCG | CGAATTTTATTGGGTT |
| PITX2_1 | TGTAATCCCAA | TTGGGATTACA |
| PROX1_PROX1_1_SELEX\|PROX1_1 | CAAGACGCCTTA | TAAGGCGTCTTG |
| FOXM1_1 | AGATGGACT | AGTCCATCT |
| TATA_disc3 | ACCGGAAG | CTTCCGGT |
| BPTF_BPTF_si_HocoMoco | GAACACAACAAA | TTTGTTGTTC |
| ARID3C_pTH5119_PBM | TAATCAAA | TTTGATTA |
| IRF9_IRF9_1_SELEX\|IRF_known21 | AACGAAACCGAAACT | AGTTTCGGTTTCGTT |
| BARX1_BARX1_1_SELEX\|BARX1_2 | CAATTAAATACCGATTA | TAATCGGTATTTAATTG |
| FOXD1_bin_FlyReg_FBgn0045759_B1H | TAAACAAGA | TCTTGTTTA |
| HLX_1 | CCATAATTAATTACA | TGTAATTAATTATGG |
| STAT3_MA0144.2_ChIP-seq | CTTCTGGGAAA | TTTCCCAGAAG |
| HSF1_HSF1_2_SELEX\|HSF2_HSF2_1_SELEX\|HSF1_HSF4_1_SELEX\|HSFLHSF1_1_SELEX\|HSF_known4\|HSF_known5\|HSF2_2\|HSF4_1 | GAACGTTCTAGAA | TTCTAGAACGTTC |
| STAT1_K562_STAT1_Stanford_ChIP-seq | TTTCCCGGAAA | TTTCCGGGAAA |
| EGR1_disc4 | AACTACAATTCCCAGAATGCCCCGC | GCGGGGCATTCTGGGAATTGTAGTT |
| GBX_Gbx2_1_SELEX\|GBX2_GBX2_3_SELEX\|GBX2_GBX2_1_SELEX\|GBX2_2\|GBX2_4\|GBX2_5 | ACCAATTAGC | GCTAATTGGT |

TABLE 5-continued

Transcription Factor Binding Sites of Synthetic Promoters

| Name | Binding Site Sequence | Reverse Complement |
|---|---|---|
| ISL2_1 | AAATTAATTGATTTTG | CAAAATCAATTAATTT |
| TFAP4_TFAP4_2_SELEX\|TFAP4_TFAP4_1_SELEX\|TFAP4_5\|TFAP4_6 | AACAGCTGAT | ATCAGCTGTT |
| CTCF_HSMMtube_CTCF_Broad_ChIP-seq | GGCCACCAGGGGGCGCTA | TAGCGCCCCTGGTGGCC |
| BARHL1_1 | AACAACCAATTAATTC | GAATTAATTGGTTGTT |
| EOMES_pTH2659_PBM | GAGGTGTAA | TTCACACCTC |
| ZBED1_ZBED1_1_SELEX\|ZBED1_1 | CTATCGCGACATA | TATGTCGCGATAG |
| FOXJ3_MA0296.1_PBM | TCCTCTTTGTTTACAATTCA | TGAATTGTAAACAAGAGGA |
| RAD21_disc3 | ACAAGAGGGC | GCCCTCTTGT |
| RFX8_MA0509.1_ChIP-seq | GTTGCCATGGCAAC | GTTGCCATGGCAAC |
| AL662830.5_pTH6425_PBM | CACATCAA | TTGATGTG |
| IRF_disc5 | AGGAAGTGAA | TTCACTTCCT |
| SRF_disc1 | CCTTATAAGG | CCTTATAAGG |
| E2F_known10\|E2F_known11\|E2F_known13 | GCGGGAAA | TTTCCCGC |
| REST_GM12878_NRSF_HudsonAlpha_ChIP-seq | TCCATGGTGCTGAA | TTCAGCACCATGGA |
| ATF1_CREB1_f1_HocoMoco\|ATF3_known14 | GTGACGTCA | TGACGTCAC |
| PROP1_PROP1_f1_HocoMoco | GAGAAATTAATATAA | TTATATTAATTTCTC |
| ARNT2_V$ARNT_02_Transfac\|ARNT_2 | CAAAGGTCACGTGACCTTTG | CAAAGGTCACGTGACCTTTG |
| TEAD3_TEAD3_si_HocoMoco | GATATTTCTGCTCTA | TAGAGCAGAAATATC |
| BCL6_BCL6_f1_HocoMoco | AAAAGCTTTCTAGGAA | TTCCTAGAAAGCTTTT |
| E2F_disc3 | CTTTCCCGCCCCC | GGGGGCGGGAAAG |
| USF1_USF1_f1_HocoMoco\|MAX_K562_MAX_Stanford_ChIP-seq\|MITF_pTH5465_PBM\|MITF_pTH5065_PBM\|MITF_pTH5057_PBM\|MXI1_known1 | CCACGTGACC | GGTCACGTGG |
| DMBX1_ALX3_3_SELEX\|ALX3_4 | CTAATTTAATTAA | TTAATTAAATTAG |
| PLAG1_MA0163.1_B1H\|PLAG1_1 | CCCCCTTGGGCCCC | GGGGCCCAAGGGGG |
| SPI1_disc3 | AGGAGGGGCAGTG | CACTGCCCCCTCCT |
| HOXC9_MA0165.1_B1H | TCATAAA | TTTATGA |
| REST_REST_f1_HocoMoco | GGGCGCTGTCCATGGTGCTGAA | TTCAGCACCATGGACAGCGCCC |
| HOXC10_MA0594.1_ChIP-seq | GCCATAAATCA | TGATTTATGGC |
| TBPL2_Spt15_PBM | AATATAT | ATATATT |
| LHX9_LHX2_1_SELEX\|LHX2_2 | ACTAATTAAC | GTTAATTAGT |
| MAFA_NRL_1_SELEX\|NRL_1 | AATTTGCTGAC | GTCAGCAAATT |
| HNF4_disc1 | AGGTCAAAGTCCA | TGGACTTTGACCT |
| BDP1_disc2 | GGATTCGAAC | GTTCGAATCC |
| YY2_GM12891_YY1_HudsonAlpha_ChIP-seq | AAGATGGCGGC | GCCGCCATCTT |

TABLE 5-continued

Transcription Factor Binding Sites of Synthetic Promoters

| Name | Binding Site Sequence | Reverse Complement |
|---|---|---|
| BRCA1_HeLa-S3_BRCA1_Stanford_ChIP-seq | CAAATCTCGCGAGA | TCTCGCGAGATTTG |
| ATF3_known8 | CGTTGACGTCAC | GTGACGTCAACG |
| FIGLA_FIGLA_1_SELEX\|TCF4_dei_da_SANGER_5_FBgn0000413_B1H\|FIGLA_1 | AACAGGTGGT | ACCACCTGTT |
| ZIC4_ZIC1_1_SELEX\|ZIC1_3 | CACAGCGGGGGTC | GACCCCCGCTGTG |
| E2F4_E2F4_1_SELEX\|E2F_kn0wn29 | AATGGCGCCAAA | TTTGGCGCCATT |
| EVX2_Eve_Cell_FBgn0000606_B1H\|EVX2_Evx2_2645_PBM | GCTAATGA | TCATTAGC |
| ZBTB3_1 | AATCGCACTGCATTCCG | CGGAATGCAGTGCGATT |
| MLX_pTH5070_PBM | CCACGTGATC | GATCACGTGG |
| AL662830.5_Exd_Cell_FBgn0000611_B1H\|AL662830.5_Exd_SOLEXA_FBgn0000611_B1H\|AL662830.5_MA0222.1_B1H | TGTCAAAA | TTTTGACA |
| ETS_known10 | CAATACCGGAAGTGTAA | TTACACTTCCGGTATTG |
| UBP1_UBIP1_f1_HocoMoco | GCAGAGA | TCTCTGC |
| EGR3_Egr1_2580_PBM | CGCCCCCGCA | TGCGGGGGCG |
| HOXA9_1 | ACGGCCATAAAATTAAT | ATTAATTTTATGGCCGT |
| POU3F3_pTH9225_PBM | CTAATTATAC | GTATAATTAG |
| SPZ1_SPZ1_f1_HocoMoco | CCCAGGGTAACAGCCG | CGGCTGTTACCCTGGG |
| BHLHE40_pTH5060_PBM | ACACGTGCC | GGCACGTGT |
| SIX5_known6 | AATAGGGTATCAATTAT | ATAATTGATACCCTATT |
| MAF_known5 | AAGTCAGCATTTTTA | TAAAAATGCTGACTT |
| HOXC5_Hoxb8_3780_PBM\|HOXC5_Hoxa7_2668_PBM | GGCCATTAA | TTAATGGCC |
| HOXA7_2 | CGAGTTAATTAATAAGC | GCTTATTAATTAACTCG |
| ARID5A_V$MRF2_01_Transfac\|ARID56_1 | AACCACAATACCAA | TTGGTATTGTGGTT |
| TCF7L2_disc2 | ACATCAAAGG | CCTTTGATGT |
| IRF7_V$IRF7_01_Transfac\|RF_known4 | CCAACTTTCGATTCCTA | TAGGAAATCGAAAGTTGG |
| SOX30_1 | AATTCCATTGTTCAAT | ATTGAACAATGGAATT |
| PITX2_PITX1_2_SELEX\|PITX2_PITX1_1_SELEX\|PITX2_PITX3_1_SELEX\|PITX1_2\|PITX1_3\|PITX3_2 | CTTAATCCC | GGGATTAAG |
| PRDM1_disc2 | ATGACTCACC | GGTGAGTCAT |
| SMAD3_1 | AGACAGACA | TGTCTGTCT |
| ELF1_MA0026.1_SELEX | CCGGAAG | CTTCCGG |
| SOX1_Sox1_4_SELEX\|SOX1_5 | TGAATAGTCATTCA | TGAATGACTATTCA |
| FOXA_known1 | TAAATAAATATTTCA | TGAAATATTTATTTA |
| LCOR_pTH9275_PBM | ATTTTGGG | CCCAAAAT |
| DMBX1_Alx4_1_SELEX\|ALX4_4 | ATAATTAAATTAA | TTAATTTAATTAT |
| CREB3L2_Creb3l2_1_SELEX\|CREB3L2_1 | TGATGACGTGGCA | TGCCACGTCATCA |
| HOXC6_HXC8_f1_HocoMoco | GGGCATCAATCAAA | TTTGATTGATGCCC |
| BATF_disc1 | GAAATGAGTCA | TGACTCATTTC |
| DDIT3_DDIT3_f1_HocoMoco | AAATGCAATCCCC | GGGGATTGCATTT |

TABLE 5-continued

Transcription Factor Binding Sites of Synthetic Promoters

| Name | Binding Site Sequence | Reverse Complement |
| --- | --- | --- |
| CUX1_CUX2_2_SELEX\|CUX1_CUX1_3_SELEX\|CUX1_10\|CUX2_2 | TAATCGATAA | TTATCGATTA |
| ZBTB12_1 | CTAAGGTTCTAGATCAC | GTGATCTAGAACCTTAG |
| ISX_pTH6551_PBM\|ALX1_pTH6221_PBM | AATTAATTAGT | ACTAATTAATT |
| NFAT5_N FAT5_1_SELEX\|N FAT5_1 | ATGGAAAATTACAG | CTGTAATTTTCCAT |
| HNF4_known12 | CCCCCTGACCTTTGCCCTCTGCC | GGCAGAGGGCAAGGTCAGGGGG |
| TBPL2_V$TATA_C_Transfac\|TATA_known1 | CTTTTATAGA | TCTATAAAAG |
| HOXA4_Zen2_Cell_FBgn0004054_B1H | TAATTAAGA | TCTTAATTA |
| GATA_disc6 | AGCTGACT | AGTCAGCT |
| SRY_MA0084.1_SELEX\|SRY_3 | ATTGTTTAC | GTAAACAAT |
| ETV5_FEV_f1_HocoMoco | CAGGAAATAA | TTATTTCCTG |
| HOXC10_HOXD11_1_SELEX\|HOXD11_2 | GTCGTAAAAA | TTTTTACGAC |
| ZBTB7B_Zbtb7b_1054_PBM | AGCCCCCAA | TTGGGGGCT |
| ZFY_MA0146.2_ChIP-seq\|ZFX_1 | CAGGCCTCGGCCCC | GGGGCCGAGGCCTG |
| NR4A2_N R4A2_1_SELEX\|NR4A_known2 | AGGTCAAACTGTGACCT | AGGTCACAGTTTGACCT |
| GFI1B_MA0038.1_SELEX\|GFI1_3 | CAAATCACTG | CAGTGATTTG |
| ATF1_V$TAXCREB_01_Transfac\|ATF3_known4 | GGGGGTTGACGCAGA | TCTGCGTCAACCCCC |
| HOXB13_Hoxd13_2_SELEX\|HOXB13_HOXD13_2_SELEX\|HOXB13_HOXA13_2_SELEX\|HOXA13_3\|HOXD13_3\|HOXD13_5 | GCTCGTAAAAC | GTTTTACGAGC |
| HOXB13_HOXB13_2_SELEX\|HOXB13_HOXC13_2_SELEX\|HOXB13_3\|HOXC13_3 | GCTCGTAAAAA | TTTTTACGAGC |
| MYOD1_MYOD1_f1_HocoMoco | GACAGCTGC | GCAGCTGTC |
| USF1_GM12878_USF1_HudsonAlpha_ChIP-seq | CCCGCCACGTGACCC | GGGTCACGTGGCGGG |
| PKNOX2_1 | AAGCACCTGTCAATAT | ATATTGACAGGTGCTT |
| ENSG00000234254_TGIF1_f1_HocoMoco | CAGGTGACACCTGACA | TGTCAGGTGTCACCTG |
| EGR3_EGR1_f2_HocoMoco | CCGCCCCCGCA | TGCGGGGGCGG |
| IKZF1_IKZF1_f1_HocoMoco | TCTCCCAA | TTGGGAGA |
| MYBL1_V$MYB_Q6_Transfac | GCCAGTTGAC | GTCAACTGGC |
| TBX3_pTH9289_PBM\|TBX3_pTH3998_PBM | AAGGTGTCAA | TTGACACCTT |
| PAX5_MA0239.1_B1H\|OVOL1_MA0126.1_SELEX | ACTGTTACT | AGTAACAGT |
| SPZ1_V$SPZ1_01_Transfac\|SPZ1_1 | GCAGGAGGGTATGGC | GCCATACCCTCCTGC |
| PPARA_V$PPARG_01_Transfac | CGGATGACCTTTGACCCCTGA | TCAGGGGTCAAAGGTCATCCG |
| ZNF263_K562b_ZNF263_UCD_ChIP-seq | CTCCTCCCCTCCCTCCTCCC | GGGGAGGAGGGAGGGGAGGAG |
| KIAA0415_Fkh2_PBM\|FOXD1_pTH2846_PBM\|FOXJ3_Fkh1_PBM\|FOXD1_pTH6641_PBM\|FOXD1_pTH6108_PBM | ATGTAAACAA | TTGTTTACAT |
| RFX8_pTH9199_PBM\|RFX8_pTH9385_PBM\|RFX8_Rfx4_3761_PBM\|MYC_disc4 | CCATGGCAAC | GTTGCCATGG |
| OTX2_1 | GACAATTAATCCCTACA | TGTAGGGATTAATTGTC |

TABLE 5-continued

Transcription Factor Binding Sites of Synthetic Promoters

| Name | Binding Site Sequence | Reverse Complement |
|---|---|---|
| MAFK_MAFK_1_SELEX\|MAF_known6 | AAATTTGCTGAC | GTCAGCAAATTT |
| MYC_known6 | GCCACGTGAC | GTCACGTGGC |
| ELF5_1 | AAGGAAGTA | TACTTCCTT |
| SCRT2_CG12605_SANGER_10_FBgn0035481_B1H | CAACAGGTG | CACCTGTTG |
| BCL_disc7 | ACAGCTCCC | GGGAGCTGT |
| HMGA1_2 | AATGCAATTTTTGA | TCAAAAATTGCATT |
| BRCA1_GM12878_BRCA1_Stanford_ChIP-seq | AAATCTCGCGAGAAC | GTTCTCGCGAGATTT |
| TCF3_4 | CCACCTGCCGCAGG | CCTGCGGCAGGTGG |
| RARG_RARG_4_SELEX\|RARG_4 | GAGGTCAAAAGGTCAC | GTGACCTTTTGACCTC |
| NR2F2_NR2F1_2_SELEX\|HNF4_known24 | GAGGTCAAAAGGTCAA | TTGACCTTTTGACCTC |
| IRX3_Ara_SOLEXA_FBgn0015904_B1H\|IRX3_Mirr_SOLEXA_FBgn0014343_B1H\|IRX3_Caup_SOLEXA_FBgn0015919_B1H | ATAACA | TGTTAT |
| ARNT2_ARNT_f1_HocoMoco\|BHLHE40_pTH4330_PBM\|ID4_pTH5068_PBM | GCACGTGA | TCACGTGC |
| SIN3A_disc4 | ACAGCTCCT | AGGAGCTGT |
| ETS_disc9 | CGCCGCCCCGC | GCGGGGCGGCG |
| SOX1_SOX2_4_SELEX\|SOX2_5 | GAACAATAACATTGTTC | GAACAATGTTATTGTTC |
| E2F2_E2F2_f1_HocoMoco\|E2F_known21 | GGCGCGAAAC | GTTTCGCGCC |
| CUX1_V$CDPCR3HD_01_Transfac\|CUX1_5 | GATCGATCCC | GGGATCGATC |
| HOXC10_HOXA10_1_SELEX\|HOXA10_2 | ATTTTTACGACC | GGTCGTAAAAAT |
| DUX4_1 | CACCGTTGATTGGGTCG | CGACCCAATCAACGGTG |
| NR1H_2 | GGGTTACTGGCGGTCA | TGACCGCCAGTAACCC |
| SPDEF_Spdef_0905_PBM | ACATCCGGGT | ACCCGGATGT |
| ATF3_known16 | ACGATGACGTCATCGA | TCGATGACGTCATCGT |
| POU1F1_pTH4326_PBM | ATTATTAATA | TATTAATAAT |
| SIX2_pTH5690_PBM | AGGGTATCA | TGATACCCT |
| SP9_pTH0978_PBM | CCCGCCCCC | GGGGGCGGG |
| NKX2-6_tin_FlyReg_FBgn0004110_B1H | GGCCACTTGAGA | TCTCAAGTGGCC |
| E2F_disc8 | GCAGGCGCCGC | GCGGCGCCTGC |
| TCF4_MA0522.1_ChIP-seq | CACAGCTGCAG | CTGCAGCTGTG |
| HOXB6_1 | AAGGTAATTACCAATA | TATTGGTAATTACCTT |
| GATA_HUVEC_GATA2_UCD_ChIP-seq\|GATA2_MA0035.3_ChIP-seq\|GATA_known15 | ACAGATAAGAA | TTCTTATCTGT |
| FOSL2_MA0478.1_ChIP-seq\|JUN_MA0490.1_ChIP-seq | ATGAGTCATCC | GGATGACTCAT |
| DMBX1_1 | TGAACCGGATTAATGAA | TTCATTAATCCGGTTCA |
| MEOX2_MEOX2_1_SELEX\|HOXC5_Hoxd3_1_SELEX\|HOXB2_HOXB2_1_SELEX\|HOXB2_1\|HOXD3_2\|MEOX2_1 | AGTAATTAAC | GTTAATTACT |

TABLE 5-continued

Transcription Factor Binding Sites of Synthetic Promoters

| Name | Binding Site Sequence | Reverse Complement |
|---|---|---|
| TP53_Tp53_3_SELEX\|TP53_7 | AACATGCCCGGGCATGTC | GACATGCCCGGGCATGTT |
| HEY1_HEY2_2_SELEX\|HEY1_HEY2_1_SELEX\|HEY1_HEY1_1_SELEX\|NPAS2_pTH5457_PBM\|HEY1_known1\|HEY2_1\|HEY2_2 | GACACGTGCC | GGCACGTGTC |
| RFX8_pTH9223_PBM\|RFX8_pTH9226_PBM | CCTTAGCAAC | GTTGCTAAGG |
| ETV5_MA0028.1_SELEX\|ETS_known7 | CTTCCGGCTC | GAGCCGGAAG |
| GCM1_pTH8653_PBM | ATGCGGGTAC | GTACCCGCAT |
| ZNF263_MA0528.1_ChIP-seq | GGAGGAGGAGGGGAGGAGGA | TCCTCCTCCCCCTCCTCC |
| BX088580.2_GSE11329_bioOct4_ChIP-seq | TTTGCATAACAAAA | TTTTGTTATGCAAA |
| SRF_HepG2_SRF_HudsonAlpha_ChIP-seq | CATGCCCATATAAGGCAA | TTGCCTTATATGGGCATG |
| TGIF1_Achi_Cell_FBgn0033749_B1H | TGTCAAA | TTTGACA |
| BX088580.2_MA0142.1_ChIP-seq\|POU5F1_known3 | ATTTGCATAACAAAG | CTTTGTTATGCAAAT |
| SRF_known7 | CCATATATGGGC | GCCCATATATGG |
| TATA_disc7 | GAAGGAAGCGGAAGA | TCTTCCGCTTCCTTC |
| MSX1_MA0188.1_B1H | CCAATTA | TAATTGG |
| NR2C2_pTH6174_PBM\|RARG_pTH5430_PBM | AGGTCACG | CGTGACCT |
| OTP_OTX2_si_HocoMoco | CTTTAATCCCTTAAC | GTTAAGGGATTAAAG |
| TBX1_pTH3822_PBM | AGGTGTGAAGA | TCTTCACACCT |
| HDAC2_disc3 | GGTGCTGTCCGTGGTGCTGA | TCAGCACCACGGACAGCACC |
| SREBF2_SRBP2_f1_HocoMoco | CCTCACCCCACCC | GGGTGGGGTGAGG |
| SREBP_known4 | GCGATCACCCCA | TGGGGTGATCGC |
| ONECUT3_pTH8982_PBM | AATCGATAA | TTATCGATT |
| ZBTB42_ZNF238_2_SELEX\|ZBTB18_3 | CATCCAGATGTTC | GAACATCTGGATG |
| E2F4_E2F5_do_HocoMoco | CGCGCCAAAC | GTTTGGCGCG |
| TOPORS_V$LUN1_01_Transfac\|TOPORS_1 | TCCCAAAGTAGCTGGGA | TCCCAGCTACTTTGGGA |
| FOXJ3_pTH5634_PBM | GTAAACAAC | GTTGTTTAC |
| FOXD1_pTH6497_PBM\|FOXD1_pTH3043_PBM\|FOXD1_pTH6591_PBM | GTAAACAAA | TTTGTTTAC |
| RFX8_RFX3_2_SELEX\|RFX3_3 | CGTTGCTAGGCAACC | GGTTGCCTAGCAACG |
| NKX1-1_Nkx1-2_3214_PBM\|ALX1_Rax_3443_PBM | CCAATTAGC | GCTAATTGG |
| HOXC5_V$HOXA3_01_Transfac\|HOXA3_1 | CCAATTAGG | CCTAATTGG |
| NR2E1_pTH5714_PBM | AAATTGACCTCA | TGAGGTCAATTT |
| FOSL1_MA0477.1_ChIP-seq | CATGAGTCACC | GGTGACTCATG |
| LBX2_MA0231.1_B1H | TAACTA | TAGTTA |
| AHR_V$AHR_01_Transfac | CCCCGGGCTTGCGTGAGA | TCTCACGCAAGCCCGGGG |
| GMEB2_GMEB2_4_SELEX\|ATF7_V$CREBP1_01_Transfac\|ZHX1_pTH5688_PBM\|ATF2_1\|GMEB2_4 | TTACGTAA | TTACGTAA |

TABLE 5-continued

Transcription Factor Binding Sites of Synthetic Promoters

| Name | Binding Site Sequence | Reverse Complement |
|---|---|---|
| ZNF274_HepG2b_ZNF274_UCD_ChIP-seq | GGTTTCTCTCCAGTA | TACTGGAGAGAAACC |
| NFATC1_NFAC2_f1_HocoMoco | AATTTTCCA | TGGAAAATT |
| TCF4_TFE2_f2_HocoMoco | ACCAGATGGTC | GACCATCTGGT |
| ETV6_ETV6_1_SELEX\|ETV6_1 | CACTTCCGCTTCCGG | CCGGAAGCGGAAGTG |
| HOXC5_Hoxb7_3953_PBM\|HOXC5_Hoxd8_2644_PBM | GCCATTAA | TTAATGGC |
| AR_A549_GR_HudsonAlpha_ChIP-seq | GAACAGAATGTTCC | GGAACATTCTGTTC |
| EBF1_disc1 | TCCCCGGGGA | TCCCCGGGGA |
| SMAD4_SMAD4_si_HocoMoco | GGCCAGACA | TGTCTGGCC |
| ARNT2_pTH5064_PBM\|BHLHE40_HepG2_BHLHE40_HudsonAlpha_ChIP-seq | GCACGTGACC | GGTCACGTGC |
| EGR3_pTH9317_PBM\|EGR3_Zif268_PBM | CGCCCACG | CGTGGGCG |
| RFX8_V$RFX1_01_Transfac\|RFX5_known 1 | TAGTAGCCTGGCAACAA | TTGTTGCCAGGCTACTA |
| GATA2_Mv75_ChIP-seq | AGATATTATC | GATAATATCT |
| VDR_4 | GGGTCAACGAGTTCA | TGAACTCGTTGACCC |
| NR4A2_pTH3467_PBM\|NR2F2_Mv102_ChIP-seq | AAAGGTCA | TGACCTTT |
| XBP1_pTH2852_PBM | ACACGTCATC | GATGACGTGT |
| SOX2_SOX21_4_SELEX\|SRY_SRY_4_SELEX\|SOX21_5\|SRY_8 | TGAATAACATTCA | TGAATGTTATTCA |
| FOXD1_GSE15244_FoxA1_ChIP-seq | AAAGCAAACA | TGTTTGCTTT |
| HOXC5_Ftz_Cell_FBgn0001077_B1H | GTTAATGA | TCATTAAC |
| GATA2_GATA5_f1_HocoMoco | ATCTAAGTTATCTCTTA | TAAGAGATAACTTAGAT |
| E4F1_1 | GCTACGTCAC | GTGACGTAGC |
| POU3F3_MA0453.1_B1H | CTAATTTGCATA | TATGCAAATTAG |
| YY2_V$YY1_01_Transfac | GATCTCCATTTTTGGAC | GTCCAAAAATGGAGATC |
| NR3C1_disc5\|FOXA_disc3 | CCTGCTGA | TCAGCAGG |
| PAX9_V$PAX5_02_Transfac\|PAX5_known2 | AAACAGATACCTGAAGCGTGACCATACA | TGTATGGTCACGCTTCAGGTATCTGTTT |
| ZEB1_V$AREB6_01_Transfac\|ZEB1_known1 | ACACAGGTAAGTA | TACTTACCTGTGT |
| FOX06_V$FOXO4_01_Transfac\|FOXO4_1 | ATAAACAAGCC | GGCTTGTTTAT |
| SOX9_SOX10_4_SELEX\|SOX9_Sox10_3_SELEX\|SOX10_6\|SOX10_10 | ATGAATTGCAGTCAT | ATGACTGCAATTCAT |
| ZNF683_HeLa-53_PRDM1_Stanford_ChIP-seq\|PRDM_PRDM1_1_SELEX\|PRDM1_MA0508.1_ChIP-seq\|PRDM1_known2 | AGAAAGTGAAAGTGA | TCACTTTCACTTTCT |
| MEOX2_MEOX2_3_SELEX\|MEOX2_3 | CTAATCATCATTAA | TTAATGATGATTAG |
| MYB_5 | CAACGGCC | GGCCGTTG |
| CTCF_disc4 | CACTAGATGGCAGC | GCTGCCATCTAGTG |
| THRB_THRB_1_SELEX\|THRB_1 | GTGACCTTATAAGGTCAC | GTGACCTTATAAGGTCAC |
| NFYA_MA0060.2_ChIP-seq | AGAGTGCTGATTGGTCCA | TGGACCAATCAGCACTCT |
| PAX9_PAX5_f1_HocoMoco | GAGGGCAGTGAAGCGTGAC | GTCACGCTTCACTGCCCTC |

TABLE 5-continued

Transcription Factor Binding Sites of Synthetic Promoters

| Name | Binding Site Sequence | Reverse Complement |
| --- | --- | --- |
| TCF7L2_known6 | ATTTCCTTTGATCTATA | TATAGATCAAAGGAAAT |
| NFE2L2_1 | ACCGGAAGAG | CTCTTCCGGT |
| TCF4_V$E47_02_Transfac | ATTAACAGGTGTTCAC | GTGAACACCTGTTAAT |
| VDR_VDR_1_SELEX\|VDR_5 | GAGTTCATTGAGTTCA | TGAACTCAATGAACTC |
| MYBL2_MYBL2_4_SELEX\|MYBL2_4 | AACCGTTAAACGGTC | GACCGTTTAACGGTT |
| MEF2_disc3\|AP1_known5 | ATGAGTCAG | CTGACTCAT |
| MYBL1_1 | AAATTAACGGTTTTCAA | TTGAAAACCGTTAATTT |
| RORB_pTH6589_PBM | ACTGACCTCG | CGAGGTCAGT |
| POU3F3_POU2F1_2_SELEX\|POU2F2_known16 | CATGAATATTCATA | TATGAATATTCATG |
| FOXD1_FOXL1_2_SELEX\|FOXL1_5 | TGTAAATAAACAA | TTGTTTATTTACA |
| HDAC2_disc5 | AAAGTCCAG | CTGGACTTT |
| ZNF143_known1 | GATTTCCCATAATGCCTTGC | GCAAGGCATTATGGGAAATC |
| HSF1_V$HSF1_01_Transfac\|HSF2_V$HSF2_01_Transfac\|HSF_known1 | AGAATGTTCG | CGAACATTCT |
| LM02_V$LMO2COM_02_Transfac\|LMO2_2 | CAGATAGGG | CCCTATCTG |
| RREB1_MA0073.1_SELEX | CCCCAAACCACCCCCCCCC | GGGGGGGGGGTGGTTTGGGG |
| RREB1_2 | CCCCAAACCACCCCCCCCA | TGGGGGGGGGTGGTTTGGGG |
| EGR3_pTH3091_PBM | CGCCCACGCA | TGCGTGGGCG |
| SOX9_SOX10_2_SELEX\|SOX10_4 | AACAATGTTCAGTGTT | AACACTGAACATTGTT |
| FOXD1_V$HFH8_01_Transfac\|FOXF1_1 | CATATAAACAATG | CATTGTTTATATG |
| HMGA2_pTH8216_PBM | CCGGAAAAA | TTTTTCCGG |
| FOXO6_FOXO3_si_HocoMoco | AGGTAAACAAACA | TGTTTGTTTACCT |
| NKX1-2_1 | GTGCACTAATTAGTGCA | TGCACTAATTAGTGCAC |
| SMAD_2 | CTGTCTGGCTA | TAGCCAGACAG |
| TCF7L2_Tcf7_0950_PBM | AACATCAAA | TTTGATGTT |
| FOXA_known4 | GACTAAGCAAACAATGAA | TTCATTGTTTGCTTAGTC |
| MYOD1_nau_SANGER_5_FBgn0002922_B1H | AACAGCTGACGC | GCGTCAGCTGTT |
| IRX3_IRX5_1_SELEX\|IRX3_IRX2_1_SELEX\|IRX2_2\|IRX5_2 | CATGTCATGTAA | TTACATGACATG |
| TCF3_1 | ACGGCAGGTGTCCCC | GGGGACACCTGCCGT |
| YY1_disc2 | AAACATGGCG | CGCCATGTTT |
| NFATC1_NFAC1_do_HocoMoco | ATGGAAATTCCA | TGGAAATTCCAT |
| ARNT_MA0004.1_SELEX\|MYC_known10\|ARNT_3 | CACGTG | CACGTG |
| MAFB_Mafb_1_SELEX\|MAF_disc2\|MAF_known10 | AAAATGCTGACT | AGTCAGCATTTT |
| TBPL2_Tbp_pr781_PBM | ATATAAA | TTTATAT |
| E2F_known23 | ATAAGGGCGCGCGAT | ATCGCGCGCCCTTAT |
| GATA2_pTH1049_PBM | CAGATAAGG | CCTTATCTG |
| BBX_Bbx_3753_PBM | TCAATGAA | TTCATTGA |

TABLE 5-continued

Transcription Factor Binding Sites of Synthetic Promoters

| Name | Binding Site Sequence | Reverse Complement |
|---|---|---|
| SRF_SRF_do_HocoMoco | ATGCCCATATATGGA | TCCATATATGGGCAT |
| PAX8_1 | ACAGTCATGCGTGAGTTA | TAACTCACGCATGACTGT |
| CACD_1 | CAACCCCTGGGTGTGG | CCACACCCAGGGGTTG |
| ELF3_1 | TACAAGGAAGTAA | TTACTTCCTTGTA |
| LHX1_1 | CATTATTAATTAATTCG | CGAATTAATTAATAATG |
| SRF_SRF_2_SELEX\|SRF_known10 | TGACCATATATGGTCA | TGACCATATATGGTCA |
| MEF2B_V$MEF2_01_Transfac\|MEF2_known1 | AGAGTTATTTTTAGAG | CTCTAAAAATAACTCT |
| ZNF143_V$STAF_01_Transfac | GGCGCAATGCATTGTGGTAAA | TTTACCCACAATGCATTGCGCC |
| TRIM28_disc2 | AGAGAAACC | GGTTTCTCT |
| PITX2_Ptx1_SOLEXA_FBgn0020912_B1H | GGATTAAC | GTTAATCC |
| ZNF202_pTH3075_PBM | AAGGGGGGCA | TGCCCCCCTT |
| RHOXF1_2 | AGGACGCTGTAAAGGGA | TCCCTTTACAGCGTCCT |
| TFAP2A_V$AP2ALPHA_01_Transfac\|TFAP2A_V$AP2GAMMA_01_Transfac\|TFAP2_known2\|TFAP2_known3\|TFAP2_known8 | CCCCCGGGC | GCCCGGGGG |
| NKX2-5_MA0264.1_PBM | ACCACTTGAAA | TTTCAAGTGGT |
| EGR3_H1-hESC_EGR1_HudsonAlpha_ChIP-seq | CCCCGCCCCGCACC | GGTGCGGGGCGGGG |
| BARHL2_BARHL2_1_SELEX\|BARHL2_2 | ACCGTTTAAC | GTTAAACGGT |
| FOXP3_1 | GAAATGTTGTTTCAGAC | GTCTGAAACAACATTTC |
| NFKB2_N_FKB2_f1_HocoMoco | AGGGAGATTCC | GGAATCTCCCT |
| ELF1_HepG2_ELF1_HudsonAlpha_ChIP-seq | CCACTTCCGGGTTC | GAACCCGGAAGTGG |
| HMX1_Hmx2_3424_PBM\|TLX3_pTH6482_PBM | AACCAATTAA | TTAATTGGTT |
| HOXA7_3 | GTAGTAATTAATGGAA | TTCCATTAATTACTAC |
| ZNF784_ZNF784_1_SELEX\|ZNF784_1 | AGGTAGGTAC | GTACCTACCT |
| TCF4_TCF3_1_SELEX\|TCF3_7 | AACACCTGCT | AGCAGGTGTT |
| SP9_MA0516.1_ChIP-seq\|SP1_disc3 | GCCCCGCCCCTCCC | GGGAGGGGCGGGGC |
| HES4_pTH5259_PBM | GCACGTGTCGTTA | TAACGACACGTGC |
| NR2F2_pTH2193_PBM | AAAGGTCAAG | CTTGACCTTT |
| ZNF219_ZN219_f1_HocoMoco | GAGGGGGGCGGA | TCCGCCCCCTC |
| FOXO6_FOXO4_3_SELEX\|FOXO6_FOXO1_3_SELEX\|FOXO1_5\|FOXO4_5 | CGTGTGGGAAA | TTTCCCCACACG |
| CR936877.3_RXRB_1_SELEX\|CR936877.3_RXRA_3_SELEX\|CR936877.3_RXRG_3_SELEX\|CR936877.3_RXRA_1_SELEX\|CR936877.3_RXRG_1_SELEX\|CR936877.3_Rxrb_1_SELEX\|CR936877.3_Rxra_1_SELEX\|HNF4G_HNF4A_4_SELEX\|HNF4_known19\|RXRA_known10\|RXRA_known12\|RXRB_1\|RXRG_1\|RXRG_3\|RXRA_known14\|RXRB_2 | GGGGTCAAGGTCA | TGACCTTTGACCCC |
| FOXP4_MA0481.1_ChIP-seq | CAAAAGTAAACAAAG | CTTTGTTTACTTTTG |
| THAP1_MA0597.1_ChIP-seq | CTGCCCGCA | TGCGGGCAG |
| TFAP2_known5 | CCGCCCCAGGCC | GGCCTGGGGCGG |

TABLE 5-continued

Transcription Factor Binding Sites of Synthetic Promoters

| Name | Binding Site Sequence | Reverse Complement |
|---|---|---|
| EP300_disc2 | AAAGATGATGCAATA | TATTGCATCATCTTT |
| MYC_disc6 | AAGTCACGT | ACGTGACTT |
| TATA_disc5\|NRF1_disc2 | AAGCGGAA | TTCCGCTT |
| FOXO6_FOXO4_f1_HocoMoco | AATAAACAA | TTGTTTATT |
| POU6F2_POU6F2_2_SELEX\|POU6F2_2 | TTAATGAGCTAATTAA | TTAATTAGCTCATTAA |
| NKX6-3_Hgtx_Cell_FBgn0040318_B1H\|POU3F3_MA0197.1_B1H\|TLX3_C15_SOLEXA_FBgn0004863_B1H\|SHOX_Otp_Cell_FBgn0015524_B1H\|NKX1-1_Slou_Cell_FBgn0002941_B1H\|HOXC5_MA0094.2_B1H\|LMX1A_CG4328_SOLEXA_FBgn0036274_B1H\|RAX2_Repo_Cell_FBgn0011701_B1H\|LMX1A_CG32105_SOLEXA_FBgn0052105_B1H\|HOXC5_Ubx_Cell_FBgn0003944_B1H\|NKX6-3_Hgtx_SOLEXA_FBgn0040318_B1H | TAATTAAA | TTTAATTA |
| TAL1_known4 | AGCAGCTGGA | TCCAGCTGCT |
| NR3C1_known11 | CTGTTCTTTC | GAAAGAACAG |
| AR_Ar_1_SELEX\|NR3C1_known17 | CGGTACACCGTGTACCC | GGGTACACGGTGTACCG |
| MNX1_Hlxb9_3422_PBM | AAGCAATTAG | CTAATTGCTT |
| MITF_HLH30_PBM | TCACGTGA | TCACGTGA |
| NR2F2_NR2F6_1_SELEX\|NR2F2_Nr2f6_1_SELEX\|NR2F6_1\|NR2F6_4 | GAGGTCAAAAGGTCA | TGACCTTTTGACCTC |
| STAT_disc7 | CTCTCCCTTTCCC | GGGAAAGGGAGAG |
| NKX2-3_2\|NKX2-3_3 | ACCACTTGAA | TTCAAGTGGT |
| NR2F2_NR2F1_1_SELEX\|HNF4_known23 | GAGGTCAAAGGTCAA | TTGACCTTTGACCTC |
| SIX5_Mv121_ChIP-seq\|SMARC_disc2 | ACTACAACTC | GAGTTGTAGT |
| ARID3C_Arid3a_3875_PBM | CAATTAAAA | TTTTAATTG |
| HNF4_known15 | CTTCAGGGGTCAATTGA | TCAATTGACCCCTGAAG |
| NKX2-5_Vnd_Cell_FBgn0003986_B1H\|NKX2-5_MA0253.1_B1H | CACTTGAAA | TTTCAAGTG |
| ZIC4_pTH2818_PBM | CCGGGGGTC | GACCCCCGG |
| EVX1_1 | AGAACTAATTAGTGGAC | GTCCACTAATTAGTTCT |
| NKX2-5_Mw138_ChIP-seq | AATCGATA | TATCGATT |
| SOX9_SOX9_4_SELEX\|SOX9_6 | ATGAATGTGCAGTCAT | ATGACTGCACATTCAT |
| VDR_VDR_f2_HocoMoco | GGGTCAACGAGTTCAC | GTGAACTCGTTGACCC |
| FOSL1_FOSL1_f2_HocoMoco | AACGTGACTCAGCA | TGCTGAGTCACGTT |
| ZSCAN4_1 | ACGTATGTGCACATCTG | CAGATGTGCACATACGT |
| GFI1B_MA0483.1_ChIP-seq | AAATCACAGCA | TGCTGTGATTT |
| SOX12_Sox12_3957_PBM | AAGAACAATG | CATTGTTCTT |
| ZBTB14_1 | AAGCGCGCCCCG | CGGGGCGCGCTT |
| PRDM_16_V$EVI1_02_Transfac\|RUNX1_3 | AGACAAGATAA | TTATCTTGTCT |
| NFATC1_NFATC1_3_SELEX\|NFATC1_3 | TTTTCCATGGAAAA | TTTTCCATGGAAAA |
| FOXD1_FOXJ3_3_SELEX\|FOXD1_Foxj3_4_SELEX\|FOXD1_FOXJ2_3_SELEX\|FOXJ2_5\|FOXJ3_4\|FOXJ3_8 | GTAAACATAAACA | TGTTTATGTTTAC |

TABLE 5-continued

Transcription Factor Binding Sites of Synthetic Promoters

| Name | Binding Site Sequence | Reverse Complement |
|---|---|---|
| ZNF410_Zfp410_3034_PBM | CCATCCCA | TGGGATGG |
| SPIC_Sfpi1_PBM | AAGGGGAAGT | ACTTCCCCTT |
| DBX1_1 | TAATTAATTAATAATTA | TAATTATTAATTAATTA |
| USF1_MA0093.2_ChIP-seq\|USF1_HepG2_USF1_HudsonAlpha_ChIP-seq | GCCACGTGACC | GGTCACGTGGC |
| NKX3-1_MA0124.1_SELEX\|NKX3-1_2 | ATACTTA | TAAGTAT |
| NR2C2_Mv98_ChIP-seq | TCAGAGGTCA | TGACCTCTGA |
| IRX3_Caup_Cell_FBgn0015919_B1H | CAATAACA | TGTTATTG |
| LIN54_pTH9366_PBM | AATTTAAATT | AATTTAAATT |
| NR2E1::NFIC_1 | TGGCACCATGCCAA | TTGGCATGGTGCCA |
| FOXD1_MA0031.1_SELEX\|FOXD1_2 | ATGTTTAC | GTAAACAT |
| PRRX1_1 | AGTAGTTAATTAGTTAC | GTAACTAATTAACTACT |
| FOXO6_V$FOXO3_01_Transfac\|FOXO3_1 | TATGTAAACAACAA | TTGTTGTTTACATA |
| TP73_GSE18650_TP73_ChIP-seq | CATGTCGGGACATGC | GCATGTCCCGACATG |
| HNF1A_V$HNF1_C_Transfac\|HNF1_2 | AGTTAATTATTAACCAA | TTGGTTAATAATTAACT |
| SOX9_Sox10_2_SELEX\|SOX9_SOX10_3_SELEX\|SOX10_5\|SOX10_9 | ATCAATTGCAGTGAT | ATCACTGCAATTGAT |
| FOXD1_HepG2_FOXA1_HudsonAlpha_ChIP-seq | CTAAGTAAACA | TGTTTACTTAG |
| HOXC5_HX68_do_HocoMoco | GCATTAATCAA | TTGATTAATGC |
| POU4F1_PO4F2_si_HocoMoco | CAGCTCATTAATA | TATTAATGAGCTG |
| ATF3_disc3 | AACCCGGCC | GGCCGGGTT |
| LHX3_3 | ATTATTTAATTAATTAC | GTAATTAATTAAATAAT |
| ZNF274_HeLa-53_ZNF274_UCD_ChIP-seq | TTCATACTGGAGAGAAA | TTTCTCTCCAGTATGAA |
| SMAD1_MA0535.1_ChIP-chip | CAGGCGCCGCCGCCG | CGGCGGCGGCGCCTG |
| CEBPA_V$CEBP_C12_Transfac\|CEBPB_known4 | ACATTGCATAATTA | TAATTATGCAATGT |
| SOX17_GSE19026_Sox17_XENcells_ChIP-seq | AAACAATGGAA | TTCCATTGTTT |
| NFYB_MA0502.1_ChIP-seq | AAATGGACCAATCAG | CTGATTGGTCCATTT |
| NKX6-1_2 | CGAAGTAATTAATTTC | GAAATTAATTACTTCG |
| SMAD2_Smad3_3805_PBM | ATTCCAGACA | TGTCTGGAAT |
| GCM1_pTH9283_PBM | ACCCGCATGA | TCATGCGGGT |
| CEBPB_known6 | AAATTTGGCAAA | TTTGCCAAATTT |
| CEBPA_2 | ATTGCGAAA | TTTCGCAAT |
| FOX_1 | GATTGTTTATTTA | TAAATAAACAATC |
| SRF_Mcm1_PBM | CGAATAGGGA | TCCCTATTCG |
| T_byn_FlyReg_FBgn0011723_B1H | AAGTGCGA | TCGCACTT |
| CTCF_disc10 | ACCTGCAGG | CCTGCAGGT |
| TFAP2_known6 | ACCGCCTGAGGGGAT | ATCCCCTCAGGCGGT |
| HOXC11_1 | CTATTTTACGACTTTA | TAAAGTCGTAAAATAG |
| ZNF524_ZNF524_1_SELEX\|ZNF524_1 | ACCCTCGAACCC | GGGTTCGAGGGT |

TABLE 5-continued

Transcription Factor Binding Sites of Synthetic Promoters

| Name | Binding Site Sequence | Reverse Complement |
| --- | --- | --- |
| NKX2-5_pTH2842_PBM | AAGCACTTAA | TTAAGTGCTT |
| BCL_disc1 | CACTTCCGGC | GCCGGAAGTG |
| LHX8_Lhx8_3_SELEX\|LHX8_4 | TAATTGCAATCA | TGATTGCAATTA |
| PAX2_PAX2_1_SELEX\|PAX2_4 | CGTCACGCTTGACTGCTC | GAGCAGTCAAGCGTGACG |
| LHX9_ap_FlyReg_FBgn0000099_B1H | TAATAA | TTATTA |
| KLF4_Klf12_1_SELEX\|KLF12_2 | AATAAGGGCGTGGTC | GACCACGCCCTTATT |
| LHX8_LHX6_2_SELEX\|LHX6_4 | TAATTAGCGCTAATTA | TAATTAGCGCTAATTA |
| MYC_disc10 | CCCCCCGCCTC | GAGGCGGGGGG |
| RORB_RORA_2_SELEX\|RORA_7 | TAACTAGGTTAGTAGGTCA | TGACCTACTAACCTAGTTA |
| HDX_1 | AAGGCGAAATCATCGCA | TGCGATGATTTCGCCTT |
| TCF7L2_LEF1_f1_HocoMoco | ATCAAAG | CTTTGAT |
| HOXC9_Abd-B_FlyReg_FBgn0000015_B1H | TCATAAAA | TTTTATGA |
| PKNOX2_Hth_Cell_FBgn0001235_B1H\|TGIF1_Vis_Cell_FBgn0033748_B1H | TGACA | TGTCA |
| BX088580.2_POU3F4_1_SELEX\|POU3F4_POU2F3_1_SELEX\|BX088580.2_POU5F1P1_1_SELEX\|POU3F3_PO2F1_f1_HocoMoco\|POU2F2_P02F2_si_HocoMoco\|POU2F3_2\|POU3F4_2\|POU5F1_known4\|POU2F2_5 | ATTTGCATA | TATGCAAAT |
| VDR_Vdr_1_SELEX\|VDR_6 | GAGTTCATCGGGTTCA | TGAACCCGATGAACTC |
| TFAP2A_Tcfap2e_3713_PBM | CCTCAGGCGA | TCGCCTGAGG |
| CEBPG_CEBPG_si_HocoMoco | ATTTTGCAATCTG | CAGATTGCAAAAT |
| MYC_MCF-7_CMYC_UT-A_ChIP-seq | ACCACGTG | CACGTGGT |
| JUN_pTH5462_PBM\|AP1_known8 | ATGACTCAA | TTGAGTCAT |
| ZNF354C_MA0130.1_SELEX\|ZNF354C_1 | ATCCAC | GTGGAT |
| HOXC5_I$FTZ_01_Transfac | AAAGCAATTAAG | CTTAATTGCTTT |
| SHOX_Phox2b_3948_PBM\|LHX9_Ap_Cell_FBgn0000099_B1H\|LBX2_Lbl_Cell_FBgn0008651_B1H\|SHOX_Otp_3496_PBM\|ALX1_Prrx1_3442_PBM\|SHOX_Phox2a_3947_PBM\|GBX2_Gbx1_2883_PBM\|ALX1_Rx_Cell_FBgn0020617_B1H\|EN2_En2_0952_PBM\|HOXD1_Hoxd1_3448_PBM | GCTAATTA | TAATTAGC |
| JUN_pTH8562_PBM\|ATF3_JDP2_3_SELEX\|JUN_JUN_f1_HocoMoco\|ATF3_Jdp2_1_SELEX\|ATF3_Jdp2_1_SELEX\|JDP2_2\|JDP2_4\|JDP2_6 | ATGACTCAT | ATGAGTCAT |
| GCM_1 | AATGCGGGTGTG | CACACCCGCATT |
| FOXD1_V$FOXJ2_01_Transfac\|FOXJ2_1 | TTATAAATAAACATTCAA | TTGAATGTTTATTTATAA |
| SPIC_Spic_PBM | AAGCGGAAG | CTTCCGCTT |
| TBPL2_TBP_f1_HocoMoco | GAATTTATACC | GGTATAAATTC |
| FIGLA_pTH5105_PBM | ACCACCTGG | CCAGGTGGT |
| ZSCAN4_2 | TACATGTGCACATAAAA | TTTTATGTGCACATGTA |
| ZNF143_MA0088.1_COMPILED | GATTTCCCATCATGCCTTGC | GCAAGGCATGATGGGAAATC |
| ZNF333_ZN333_f1_HocoMoco | CGATAATGA | TCATTATCG |

TABLE 5-continued

Transcription Factor Binding Sites of Synthetic Promoters

| Name | Binding Site Sequence | Reverse Complement |
|---|---|---|
| SHOX_V$S8_01_Transfac | AGGTTAATTGAGTAAA | TTTACTCAATTAACCT |
| KLF4_pTH9072_PBM | CCACGCCCA | TGGGCGTGG |
| ZFY_pTH2933_PBM | TAGGCCACA | TGTGGCCTA |
| RHOXF1_RHOXF1_3_SELEX\|RHOXF1_RHOXF1_1_SELEX\|RHOXF1_3\|RHOXF1_5 | GGATAATCC | GGATTATCC |
| DPRX_DPRX_2_SELEX\|DPRX_2 | GGGATAATCCC | GGGATTATCCC |
| ENSG00000250542_pTH5459_PBM | AAACGTAG | CTACGTTT |
| SOX13_pTH3862_PBM | ATTGTTTTG | CAAAACAAT |
| SOX15_Sox15_3457_PBM | ATTGTTTTA | TAAAACAAT |
| THAP1_K562_THAP1_HudsonAlpha_ChIP-seq | CGCCATCTTGGATGAGGGCAG | CTGCCCTCATCCAAGATGGCG |
| HSF1_HSF1_f2_HocoMoco | AGAAAGTTCTAGAA | TTCTAGAACTTTCT |
| LHX9_LHX2_f1_HocoMoco | CACTTTTAATTAG | CTAATTAAAAGTG |
| MEF2B_MA0497.1_ChIP-seq | ATGCTAAAATAGAA | TTCTATTTTAGCAT |
| ATF3_known13 | CGATGACGTCA | TGACGTCATCG |
| ELF3_Elf5_1_SELEX\|ELF3_ELF5_1_SELEX\|ELF3_ELF5_2_SELEX\|ELF5_2\|ELF5_3\|ELF5_4 | ACCCGGAAGTA | TACTTCCGGGT |
| HOXC10_MA0485.1_ChIP-seq | GGCCATAAATCAC | GTGATTTATGGCC |
| ELF1_K562_ELF1_HudsonAlpha_ChIP-seq | ACCCGGAAGTG | CACTTCCGGGT |
| GBX2_GBX2_2_SELEX\|GBX2_3 | TAATTGGCCAATTA | TAATTGGCCAATTA |
| MYCN_MYCN_si_HocoMoco\|MXI1_Mv94_ChIP-seq | CCACGTGG | CCACGTGG |
| HSF_known2 | GAAACCTCTGGAA | TTCCAGAGGTTTC |
| SOX30_Sox30_2781_PBM | ATTGTTCTGC | GCAGAACAAT |
| SRF_YMR043W_831_DeBoer11 | CATTTCCGAATTGGGAACA | TGTTTCCCAATTCGGAAATG |
| NKX2-5_3 | TCAAGTGGGA | TCCCACTTGA |
| SNAI2_SNAI2_1_SELEX\|SNAI2_1 | AACAGGTGT | ACACCTGTT |
| NFKB1_V$NFKB_Q6_Transfac\|NFKB_known4 | AGGGGAATTTCCCC | GGGGAAATTCCCCT |
| DRGX_Otx1_2_SELEX\|DRGX_OTX1_2_SELEX\|OTX1_3\|OTX1_5 | CGGATTAA | TTAATCCG |
| FOXD1_FOXC2_f1_HocoMoco | GTTTGTTTTGCCAGA | TCTGGCAAAACAAAC |
| ETV5_Elk3_1_SELEX\|ETV5_GABPA_1_SELEX\|ETV5_ELK3_1_SELEX\|ETV5_ELK1_2_SELEX\|ETV5_ELK1_1_SELEX\|ETV5_ETV4_1_SELEX\|ETV5_ETV1_1_SELEX\|ETS1_V$CETS1P54_01_Transfac\|ETS_known3\|ETS_known11\|ETS_known12\|ELK3_1\|ETV1_1\|ETV4_2\|ELK3_2\|ETS_known18 | ACCGGAAGTA | TACTTCCGGT |
| LHX4_1 | CAAAGCTAATTAGTTTA | TAAACTAATTAGCTTTG |
| POU4F3_1 | AGTTATTAATGAGGTC | GACCTCATTAATAACT |
| ETS1_ETS1_3_SELEX\|ENSG00000235187_ETV3_1_SELEX\|ETV5_ERG_1_SELEX\|ETV5_ELK4_1_SELEX\|ETV5_ETV5_1_SELEX\|EN5G00000235187_ERF_1_SELEX\|ETV5_FLI1_3_SELEX\|ETV5_ERG_3_SELEX\|ETS1_ETS1_1_SELEX\|ELF1_ELF1_g_HocoMoco\|ETV5_FEV_1_SELEX\|ETV5_FLI1_1_SELEX\|ETS_disc2\|EGR1_disc2\|ELK4_2\|ERF_1\|ERG_1\|ERG_3\|ETS_known14\|ETS_known16\|ETV3_1\|ETV5_1\|FEV_2\|FLI1_1\|FLI1_3 | ACCGGAAGTG | CACTTCCGGT |

TABLE 5-continued

Transcription Factor Binding Sites of Synthetic Promoters

| Name | Binding Site Sequence | Reverse Complement |
|---|---|---|
| AP1_known10 | TGACTCA | TGAGTCA |
| TFCP2_TFCP2_f1_HocoMoco | GCCTGAACTGGCCAGA | TCTGGCCAGTTCAGGC |
| DBX2_Dbx2_3487_PBM\|DLX1_Dlx5_3419_PBM | GCAATTA | TAATTGC |
| BHLHE40_BHE41_f1_HocoMoco | ACCGGGTCACGTGCAGAAGC | GCTTCTGCACGTGACCCGGT |
| EHF_1 | AGGACCCGGAAGTAA | TTACTTCCGGGTCCT |
| NHLH2_HLH4C_SANGER_5_FBgn0011277_B1H | GGCACCAGCTGCGCC | GGCGCAGCTGGTGCC |
| HOXB2_HXA1_f1_HocoMoco | CATCCATCAA | TTGATGGATG |
| BX088580.2_POU5F1P1_2_SELEX\|POU3F4_POU2F3_2_SELEX\|POU2F3_3\|POU5F1_known5 | ATGAATATGCAA | TTGCATATTCAT |
| E2F_known15 | CGCGCC | GGCGCG |
| STAT1_Mv124_ChIP-seq | TTCCCGGAAA | TTTCCGGGAA |
| BRCA1_MA0133.1_SELEX\|BRCA1_known2 | ACAACAC | GTGTTGT |
| ETS_1 | AACCACTTCCTG | CAGGAAGTGGTT |
| IRF5_IRF5_1_SELEX\|IRF_known15 | AGTTTCGGTTTCGG | CCGAAACCGAAACT |
| IRF8_IRF8_2_SELEX\|IRF_known20 | AGTTTCGGTTTCGA | TCGAAACCGAAACT |
| CDX2_V$CDXA_02_Transfac | ATTAATA | TATTAAT |
| TAL2_TAL1_f2_HocoMoco | AACAGATGGTCGCCCAACCACTGGA | TCCAGTGGTTGGGCGACCATCTGTT |
| FOXA_disc2 | AATATTGACA | TGTCAATATT |
| SP2_disc3 | AAGGGGCGGG | CCCGCCCCTT |
| MAX_NB4_MAX_Stanford_ChIP-seq | CCACGTGATCC | GGATCACGTGG |
| ATF4_1 | CATTGCGTCAGG | CCTGACGCAATG |
| SP9_V$SP1_C16_Transfac\|SP1_known2 | GGCCCCGCCCCC | GGGGGCGGGGCC |
| HOXB13_HOXA13_4_SELEX\|HOXA13_5 | TCTCGTAAAAA | TTTTTACGAGA |
| GATA2_srp_SANGER_5_FBgn0003507_B1H | CCTTATCA | TGATAAGG |
| NEUROG1_tap_da_SANGER_5_2_FBgn0015550_B1H\|TCF4_tap_da_SANGER_5_2_FBgn0000413_B1H | CCAGATGTCA | TGACATCTGG |
| FOXO6_V$FOXO4_02_Transfac\|FOXO4_2 | AACGTAAACAACAT | ATGTTGTTTACGTT |
| GATA_known17 | ATCTTCTTATCAGTTTA | TAAACTGATAAGAAGAT |
| MYBL2_MYBL2_2_SELEX\|MYBL2_2 | ACCGTTAAAACCGTTA | TAACGGTTTTAACGGT |
| WT1_WT1_f1_HocoMoco | CCCCCGCCCCCGC | GCGGGGCGGGGG |
| SOX13_1 | AAATTATTGTTCTTAA | TTAAGAACAATAATTT |
| SNAI2_SNAI2_f1_HocoMoco | CACCTGG | CCAGGTG |
| TBX3_TBX2_1_SELEX\|MGA_MGA_3_SELEX\|MGA_3\|TBX2_1 | GGTGTGAAATTTCACACC | GGTGTGAAATTTCACACC |
| E2F8_E2F8_1_SELEX\|E2F8_1 | TTTCCCGCCAAA | TTTGGCGGGAAA |
| TCF4_nau_da_SANGER_5_FBgn0000413_B1H\|MYOD1_nau_da_SANGER_5_FBgn0002922_B1H | CACCTGTC | GACAGGTG |
| CEBPZ_CEBPZ_si_HocoMoco | AGCCAATCAGC | GCTGATTGGCT |
| ATF1_pTH5080_PBM | GTGACGTAA | TTACGTCAC |

TABLE 5-continued

Transcription Factor Binding Sites of Synthetic Promoters

| Name | Binding Site Sequence | Reverse Complement |
|---|---|---|
| ATF1_V$CREB_C14_Transfac\|ATF3_known7 | GGTGACGTAACC | GGTTACGTCACC |
| RAD21_disc8 | CACCAGGGGGCAGC | GCTGCCCCCTGGTG |
| OBOX2_1\|OBOX3_1 | ATAGTTAATCCCCCTCA | TGAGGGGGATTAACTAT |
| SRY_V$SRY_02_Transfac\|SRY_2 | GTAAACAATAGA | TCTATTGTTTAC |
| ZBTB33_disc3 | AACTCTCGCG | CGCGAGAGTT |
| HOXD12_HOXD12_2_SELEX\|HOXD12_3 | AGTCGTAAAAA | TTTTTACGACT |
| BACH1_Mv47_ChIP-seq | AAATGCTGA | TCAGCATTT |
| EN2_1 | TGCACTAATTAGTGGAA | TTCCACTAATTAGTGCA |
| SOX3_2 | AATCAATAACATTGATC | GATCAATGTTATTGATT |
| SRY_SRY_f1_HocoMoco | AAAACAAAA | TTTTGTTTT |
| ZNF281_1 | GGGGGGGGGGGGGA | TCCCCCCCCCCCCC |
| SP2_disc2 | ATTGGCCAGCGTGGCTGTCAGTCA | TGACTGACAGCCACGCTGGCCAAT |
| SP9_SP8_1_SELEX\|SP8_1 | AGTGGGCGTGGC | GCCACGCCCACT |
| SPDEF_Spdef_PBM | AAACCGGATA | TATCCGGTTT |
| ESRRA_disc3 | AAGGTGACCT | AGGTCACCTT |
| CDX2_MA0216.2_ChIP-chip | GGCCATAAAAA | TTTTTATGGCC |
| SCRT2_SCRT1_1_SELEX\|SCRT1_1 | AACCACCTGTTGCTC | GAGCAACAGGTGGTT |
| NANOGP1_pTH5685_PBM | AGCGATTAA | TTAATCGCT |
| HNF4G_Hnf4a_2640_PBM | AGGGTTCAAA | TTTGAACCCT |
| ESRRG_ESRRB_1_SELEX\|ESRRB_2 | TATGACCTTGA | TCAAGGTCATA |
| PAX6_2 | CTGACCTGGAACTC | GAGTTCCAGGTCAG |
| ESR2_Mv66_ChIP-seq | AGGTCAGGGTGACCTGGA | TCCAGGTCACCCTGACCT |
| SRF_pTH5539_PBM | CCAAATCGGG | CCCGATTTGG |
| SP9_SP3_f1_HocoMoco | CCCCGGCCCCGCCCCCCCC | GGGGGGGGGCGGGCCGGGG |
| TFAP2A_Tcfap2a_1_SELEX\|TFAP2A_TFAP2A_1_SELEX\|TFAP2_known11\|TFAP2_known20 | TGCCCCCGGGCA | TGCCCGGGGGCA |
| ETV5_ETV4_f1_HocoMoco | ACTTCCTG | CAGGAAGT |
| TFAP2_known7 | ACCGCCTCAGGCGGT | ACCGCCTGAGGCGGT |
| ETS_2 | ACTTCCTC | GAGGAAGT |
| NR2E3_NR2E3_f1_HocoMoco | AAAGTCAAAGTCA | TGACTTTGACTTT |
| PAX6_PAX6_f1_HocoMoco | TCAAGCGTGAA | TTCACGCTTGA |
| TCF7L1_1\|TCF7_1 | TATAGATCAAAGGAAAA | TTTTCCTTTGATCTATA |
| JUN_H1-hESC_CJUN_Stanford_ChIP-seq | CATTCCTGAGGGATGACTTA | TAAGTCATCCCTCAGGAATG |
| DMRTA2_pTH10777_PBM | ACTGTATCAA | TTGATACAGT |
| NR2C2_NR2C1_si_HocoMoco | CTGACCTCTGGCC | GGCCAGAGGTCAG |
| RORB_RORG_f1_HocoMoco | AAAAGTAGGTCAG | CTGACCTACTTTT |
| ESRRG_ESRRA_4_SELEX | TTCAAGGTCAA | TTGACCTTGAA |

TABLE 5-continued

Transcription Factor Binding Sites of Synthetic Promoters

| Name | Binding Site Sequence | Reverse Complement |
|---|---|---|
| TFAP4_pTH5067_PBM | ATCAGCTGG | CCAGCTGAT |
| GMEB1_pTH8671_PBM | TACGTCA | TGACGTA |
| NFE2L1_1 | CTTCCAAAATGAC | GTCATTTTGGAAG |
| RELA_V$NFKAPPAB65_01_Transfac\|RELA_MA0107.1_SELEX\|NFKB_disc1\|NFKB_known2\|NFKB_known3\|NFKB_known7\|NFKB_known9 | GGAAATTCCC | GGGAATTTCC |
| ELF3_ELF5_f1_HocoMoco | ATAAGGAAGTA | TACTTCCTTAT |
| TFAP4_HLH11_PBM | ATCAGCTGA | TCAGCTGAT |
| POU4F1_POU4F1_1_SELEX\|POU4F1_1 | ATGAATAATTAATG | CATTAATTATTCAT |
| FEV_1 | ATTTCCTG | CAGGAAAT |
| XBP1_XBP1_2_SELEX\|XBP1_4 | AATGCCACGTCATC | GATGACGTGGCATT |
| POU3F3_PO3F2_si_HocoMoco | ATTATTTATG | CATAAATAAT |
| OTX_1 | AATTAATC | GATTAATT |
| SOX9_MA0077.1_SELEX\|SOX9_SOX9_1_SELEX\|SOX9_2\|SOX9_3 | CCATTGTTC | GAACAATGG |
| SOX3_3 | CATGAATACCATTCATC | GATGAATGGTATTCATG |
| NKX1-1_1 | TCCCACTAATTAGCGCA | TGCGCTAATTAGTGGGA |
| NKX6-2_1 | GAAATAATTACC | GGTAATTATTTC |
| KLF4_KLF8_f1_HocoMoco | CACCCCCTG | CAGGGGGTG |
| ZNF423_2 | GCACCCCTGGGTGCC | GGCACCCAGGGGTGC |
| GATA2_Mw144_ChIP-seq | AGATGCTTATC | GATAAGCATCT |
| NFKB1_V$NFKAPPAB50_01_Transfac\|NFKB_known1 | GGGAATCCCC | GGGGATTCCC |
| CTCF_HEK293_CTCF_UW_ChIP-seq\|CTCF_K562_CTCF_Broad_ChIP-seq\|CTCF_HBM EC_CTCF_UW_ChIP-seq | GGCGCCCCTGGTGGCCA | TGGCCACCAGGGGCGCC |
| ALX1_VSX2_si_HocoMoco | TAATTAGCTAA | TTAGCTAATTA |
| VAX1_1 | ACGTTAATTAACCCAG | CTGGGTTAATTAACGT |
| ETV5_Etv1_PBM\|ETV5_Etv4_PBM\|ETV5_Gm5454_PBM | ACTTCCGGTC | GACCGGAAGT |
| AP1_disc3 | ATGAGTCACC | GGTGACTCAT |
| HOXA4_pTH5479_PBM | CTTAATTACC | GGTAATTAAG |
| EGR3_MA0472.1_ChIP-seq | CCCCCGCCCACGCAC | GTGCGTGGGCGGGG |
| NKX2-2_2 | AATTTTCAAGTGGTTAA | TTAACCACTTGAAAATT |
| TCF4_pTH3866_PBM\|TCF12_HTF4_f1_HocoMoco | ACACCTGCT | AGCAGGTGT |
| SPDEF_SPDEF_2_SELEX\|SPDEF_3 | ATAATCCGGGACCAC | GTGGTCCCGGATTAT |
| DLX4_1 | GTCGGTAATTATAGCGA | TCGCTATAATTACCGAC |
| AIRE_1 | ATTTAACCATTATAACCAATTAATAA | TTATTAATTGGTTATAATGGTTAAAT |
| NFAT5_NFAT5_f1_HocoMoco | CATGGAGTTTCCAC | GTGGAAACTCCATG |
| POU3F3_1 | AAAATATGCATAATAAA | TTTATTATGCATATTTT |
| MESP2_MESP1_1_SELEX\|MESP1_1 | AACACCTGTG | CACAGGTGTT |
| SIN3A_disc6 | CCGCTCAGCCGC | GCGGCTGAGCGG |

TABLE 5-continued

Transcription Factor Binding Sites of Synthetic Promoters

| Name | Binding Site Sequence | Reverse Complement |
|---|---|---|
| NKX2-8_2 | CCACTTGAG | CTCAAGTGG |
| ESRRA_disc4 | CAGGGTCAGAGCGG | CCGCTCTGACCCTG |
| RARG_Rarb_2_SELEX\|RARB_2 | AAAGGTCACCAGAGGTCA | TGACCTCTGGTGACCTTT |
| HSF2_pTH9010_PBM | ATATAGAACATTC | GAATGTTCTATAT |
| GATA2_K562b_GATA2_UCD_ChIP-seq | CCTTATCTGCCCCCCCCA | TGGGGGGGGCAGATAAGG |
| ZNF148_GSE11329_zfp281_ChIP-seq\|ZNF148_ZN148_si_HocoMoco | CCCCTCCCCCACCCC | GGGGTGGGGAGGGG |
| CEBPA_CEBPD_f1_HocoMoco | AATTGTGCAAT | ATTGCACAATT |
| HOMEZ_HOMEZ_LSELEX\|HOMEZ_2 | AAAACGATTATA | TATAATCGTTTT |
| ISL2_ISL1_f1_HocoMoco | CATTAAC | GTTAATG |
| ATF7_ATF7_1_SELEX\|ATF7_1 | CGATGACGTCATCG | CGATGACGTCATCG |
| HOXA4_HOXA2_1_SELEX\|EMX2_pTH5677_PBM\|HOXA2_2 | CCTAATTACC | GGTAATTAGG |
| CR936877.3_Rxra_2_SELEX\|RXRA_known15 | GGGTCATGACCC | GGGTCATGACCC |
| STAT_known15 | GACTTTTCTGGGA | TCCCAGAAAAGTC |
| GATA2_PBDE_GATA1_UCD_ChIP-seq | CTGGGGGGGCAGATAAG | CTTATCTGCCCCCCCCAG |
| GATA2_K562_GATA2_HudsonAlpha_ChIP-seq | CTGGTGGGGCAGATAAG | CTTATCTGCCCCACCAG |
| TRIM28_disc1 | TGAGTCATCA | TGATGACTCA |
| EWSR1::FLI1_1 | CCTTCCTTCCTTCCTTCC | GGAAGGAAGGAAGGAAGG |
| ARNT2_BMAL1_f1_HocoMoco | GGGTCACGTGTCCA | TGGACACGTGACCC |
| SP9_SP1_1_SELEX\|SP1_known8 | ACCCCGCCCCC | GGGGGCGGGGT |
| PAX9_Mv109_ChIP-seq | AGCGTGACCG | CGGTCACGCT |
| STAT4_STAT4_si_HocoMoco | CTTTTCTGGGAAA | TTTCCCAGAAAAG |
| CEBPB_known7 | AAATTGTGCAAT | ATTGCACAATTT |
| ARNT2_tgo_sima_SANGER_5_FBgn0015014_B1H | GTACGTGAC | GTCACGTAC |
| ENSG00000250096_RUNX2_1_SELEX\|ENSG00000250096_RUNX3_1_SELEX\|RUNX2_4\|RUNX3_1 | TAACCGCAAACCGCAA | TTGCGGTTTGCGGTTA |
| POU3F1_1\|POU3F4_1 | AATTAATTAATTAATTC | GAATTAATTAATTAATT |
| EP300_disc9 | CCGCTCCCAGCGGCTGC | GCAGCCGCTGGGAGCGG |
| HOXC5_Mw154_ChIP-seq | CATCAATC | GATTGATG |
| TFAP4_crp_SANGER_10_FBgn0001994_B1H | ATCAGCTGGTC | GACCAGCTGAT |
| CR936877.3_HepG2_RXRA_HudsonAlpha_ChIP-seq | CCCTGACCTTTGCCC | GGGCAAAGGTCAGGG |
| PLAG1_PLAG1_si_HocoMoco | AGAGGGGCCCTA | TAGGGCCCCTCT |
| NR2C2_K562b_TR4_UCD_ChIP-seq | AGTACTTCCGGGTCA | TGACCCGGAAGTACT |
| PAX5_pTH10794_PBM | ACGCGTGACG | CGTCACGCGT |
| E2F_disc6 | AGATTTGAAT | ATTCAAATCT |
| RUNX1_V$AML1_01_Transfac\|RUNX2_1\|RUNX1_7 | ACCACA | TGTGGT |

TABLE 5-continued

Transcription Factor Binding Sites of Synthetic Promoters

| Name | Binding Site Sequence | Reverse Complement |
| --- | --- | --- |
| SOX8_1 | TAAAGAACAATAGATAA | TTATCTATTGTTCTTTA |
| AP1_disc7 | CATGACTCAGAC | GTCTGAGTCATG |
| SOX1_MA0143.3_ChIP-seq\|SOX11_Sox4_PBM | AACAAAGG | CCTTTGTT |
| JUN_JUND_f1_HocoMoco\|JUN_HeLa-S3_CJUN_Stanford_ChIP-seq\|JUN_K562_CJUN_Stanford_ChIP-seq | GATGACTCATC | GATGAGTCATC |
| PAX3_1 | AAATTTCGTCACGGTTAAGGT | ACCTTAACCGTGACGAAATT |
| RFX8_RFX5_2_SELEX\|RFX8_RFX5_3_SELEX\|RFX5_known9 | CGTTACCATGGCAACG | CGTTGCCATGGTAACG |
| BATF_GM12878_BATF_HudsonAlpha_ChIP-seq | TCTCGATATGACTCA | TGAGTCATATCGAGA |
| NR1H_1 | TGACCGCCAGTGACCCCA | TGGGGTCACTGGCGGTCA |
| RFX8_MA0365.1_PBM,\|RFX8_YLR176C_496_DeBoer11 | GGTTGCCA | TGGCAACC |
| PTF1A_1 | GCTGTGGTTTTCCC | GGGAAAACCACAGC |
| ZNF423_V$ROAZ_01_Transfac\|ZNF423_1 | GCACCCAAGGGTGC | GCACCCTTGGGTGC |
| TFAP2A_TFAP2A_3_SELEX\|TFAP2_known13 | TGCCCCCGGGGCA | TGCCCCGGGGGCA |
| TFAP2A_HeLa-S3_AP2GAMMA_UCD_ChIP-seq | AGCCTCAGGGCATGG | CCATGCCCTGAGGCT |
| NR2F2_COT1_f1_HocoMoco | GGTCAAAGGTCA | TGACCTTTGACC |
| AHR_1 | CCCCCGGCTAGCGTGAGA | TCTCACGCTAGCCGGGGG |
| ARID5A_pTH4426_PBM | CAATATCG | CGATATTG |
| RFX8_pTH3516_PBM | CCATAGCAAC | GTTGCTATGG |
| FOXD1_V$XFD3_01_Transfac | TGAGTAAACAAAAA | TTTTTGTTTACTCA |
| GATA_disc3 | GCAGGAAATGA | TCATTTCCTGC |
| RXRA_known3 | AGAGTTCA | TGAACTCT |
| YBX1_pTH8991_PBM | TAGGATAGA | TCTATCCTA |
| TATA_disc8 | CGGAAGTCGC | GCGACTTCCG |
| SHOX2_1 | CACAATTAATTAACGCG | CGCGTTAATTAATTGTG |
| DRGX_Otx1_1_SELEX\|DRGX_OTX1_1_SELEX\|OTP_OTX2_1_SELEX\|OTX1_2\|OTX2_2\|OTX1_4 | GTTAATCCGATTAAC | GTTAATCGGATTAAC |
| SP1_known3 | AGCCTTGGGGAGGG | CCCTCCCCAAGGCT |
| DLX1_Dlx4_3488_PBM | ATAATTGC | GCAATTAT |
| DMBX1_Pax7_3783_PBM | ATAATTGG | CCAATTAT |
| POU3F2_1 | GCCATCCAAAATGAAC | GTTCATTTTGGATGGC |
| CEBPA_MA0102.3_ChIP-seq | ATTGCACAATA | TATTGTGCAAT |
| MEIS1::HOXA9_1 | TCGTAAAACTGTCA | TGACAGTTTTACGA |
| MYBL1_MYBL1_4_SELEX\|MYBL1_5 | GGCCGTTATAACCGTTA | TAACGGTTATAACGGCC |
| MSX2_2 | AAATTAATTGGTTTTG | CAAAACCAATTAATTT |
| SOX4_1 | AGAAGAACAAAGGACTA | TAGTCCTTTGTTCTTCT |
| MYC_HeLa-53_CMYC_Stanford_ChIP-seq\|MAX_K562_MAX_HudsonAlpha_ChIP-seq | CCACGTGCTC | GAGCACGTGG |

TABLE 5-continued

Transcription Factor Binding Sites of Synthetic Promoters

| Name | Binding Site Sequence | Reverse Complement |
|---|---|---|
| RXRA_known4 | GGAGTTCA | TGAACTCC |
| ZNF219_1 | CGCCCCCCCCCC | GGGGGGGGGGCG |
| PBX1_3 | ACATCAATCAAA | TTTGATTGATGT |
| BCL6B_Bcl6b_0961_PBM | GTCTTTCTAGAA | TTCTAGAAAGAC |
| GATA2_SH-SY5Y_GATA2_UCD_ChIP-seq | CAGATAAGAA | TTCTTATCTG |
| HMX1_HMX2_1_SELEX\|HMX2_2 | ACCAATTAAAA | TTTTAATTGGT |
| HOXA4_2 | CAAGTTAATTAATAATC | GATTATTAATTAACTTG |
| HNF1A_Tcf1_2666_PBM | CCTGGTTAA | TTAACCAGG |
| ZBTB14_2 | CCGCGCGC | GCGCGCGG |
| OBOX6_1 | AAAAACGGATTATTG | CAATAATCCGTTTTT |
| CTCF_disc3 | ACTAGAGGG | CCCTCTAGT |
| ENSG00000234254_TG\|F1_si_HocoMoco | CTGTCAC | GTGACAG |
| SOX9_SOX9_6_SELEX\|SOX9_8 | AATCAATTTCAGTGATT | AATCACTGAAATTGATT |
| PKNOX2_Meis2_1_SELEX\|PKNOX2_MEIS1_1_SELEX\|PKNOX2_Meis3_1_SELEX\|MEIS1_4\|MEIS2_3\|MEIS3_4 | CTGTCAA | TTGACAG |
| TFAP2A_TFAP2C_5_SELEX\|TFAP2A_Tcfap2a_3_SELEX\|TFAP2A_TFAP2B_3_SELEX\|TFAP2A_TFAP2A_6_SELEX\|TFAP2A_TFAP2C_3_SELEX\|TFAP26_4\|TFAP2_known16\|TFAP2_known18\|TFAP2_known22 | TGCCCTCAGGGCA | TGCCCTGAGGGCA |
| SIX6_Six6_2267_PBM | GGTATCA | TGATACC |
| ALX1_A1_SOLEXA_FBgn0000061_B1H | CGCTAATTA | TAATTAGCG |
| FOXO6_MA0480.1_ChIP-seq | TCCTGTTTACA | TGTAAACAGGA |
| NFATC2_1 | TGGAAAA | TTTTCCA |
| FOXP1_1 | ATAAAAACAACACAAATAA | TTATTTGTGTTGTTTTTAT |
| EN2_en_SOLEXA_2_FBgn0000577_B1H | CTAATTAAGA | TCTTAATTAG |
| E2F2_E2F2_2_SELEX\|E2F2_3 | AATTTTGGCGCCAAAATG | CATTTTGGCGCCAAAATT |
| HINFP_HINFP1_1_SELEX\|HINFP_2 | CAACGTCCGCGG | CCGCGGACGTTG |
| USF1_GM12878_USF2_Stanford_ChIP-seq | CCGGGCCACGTGACC | GGTCACGTGGCCCGG |
| ETV5_pTH6345_PBM\|ETV5_pTH6450_PBM\|EP300_disc4 | ACTTCCGG | CCGGAAGT |
| CCNT2_disc2 | CCCCACCCCC | GGGGGTGGGG |
| HOXA6_1 | AAGGTAATTACCTAAT | ATTAGGTAATTACCTT |
| SMARCC1_HeLa-S3_BAF155_Stanford_ChIP-seq | GATGAGTCACCCCCC | GGGGGGTGACTCATC |
| ISX_1 | ACGACTAATTAGGAGT | ACTCCTAATTAGTCGT |
| HINFP_H\|NFP1_3_SELEX\|HINFP_4 | GCGGACGTTCAACGTCCGC | GCGGACGTTGAACGTCCGC |
| ATF1_V$CREB_02_Transfac\|ATF3_known3 | CGGGTGACGTCC | GGACGTCACCCG |
| ZNF384_ZN384_f1_HocoMoco | CCGATTTTTCC | GGAAAAATCGG |
| FOXD1_pTH3802_PBM | AATGTAAACATA | TATGTTTACATT |
| E2F_known2\|E2F_known3\|E2F_known4\|E2F_known5\|E2F_known6\|E2F_known8\|E2F_known12\|E2F_known14 | GCGCGAAA | TTTCGCGC |

TABLE 5-continued

Transcription Factor Binding Sites of Synthetic Promoters

| Name | Binding Site Sequence | Reverse Complement |
|---|---|---|
| KLF15_KLF15_a_HocoMoco | GCCCCCACCTCCCCGCC | GGCGGGGAGGTGGGGGC |
| REST_HeLa-S3_NRSF_HudsonAlpha_ChIP-seq | AGCACCATGGACAGCG | CGCTGTCCATGGTGCT |
| DDIT3::CEBPA_2 | AGATGCAATCCC | GGGATTGCATCT |
| REST_K562_NRSF_HudsonAlpha_ChIP-seq | CTGTCCATGGTGCTGA | TCAGCACCATGGACAG |
| HOXD12_HOXD12_3_SELEX\|HOXC10_HOXC11_3_SELEX\|HOXC10_HOXC11_1_SELEX\|HOXC11_2\|HOXC11_4 | ATTTTACGACC | GGTCGTAAAAT |
| POU3F3_V$OCT1_04_Transfac | TCTTTTAATTTGCATAATCATAA | TTATGATTATGCAAATTAAAAGA |
| CTCF_disc9 | GCCCACTAGAGGGCAC | GTGCCCTCTAGTGGGC |
| CEBPA_V$CEBP_C_Transfac\|CEBPB_known5 | GGTATTTGGCAATGCACA | TGTGCATTGCCAAATACC |
| HNF4_known11 | GGGGCA | TGCCCC |
| FOXD1_FOXI1_1_SELEX\|FOXD1_Foxg1_3_SELEX\|FOXD1_Foxk1_2_SELEX\|FOXD1_bin_SANGER_5_FBgn0045759_B1H\|FOXO6_FOXO6_2_SELEX\|FOXD1_FOXD3_2_SELEX\|FOXD1_FOXL1_1_SELEX\|FOXD1_FOXD2_2_SELEX\|FOXO6_FOXO4_2_SELEX\|KIAA0415_MA0297.1_PBM,\|FOXP3_FOXP3_1_SELEX\|FOXD2_2\|FOXD3_4\|FOXI1_3\|FOXL1_4\|FOXO4_4\|FOXO6_2\|FOXP3_2\|FOXG1_5\|FOXK1_4 | GTAAACA | TGTTTAC |
| ZIC4_V$ZIC1_01_Transfac\|ZIC4_ZIC3_f1_HocoMoco\|ZIC4_V$Z1C3_01_Transfac\|ZIC1_1\|ZIC3_1 | GACCACCCA | TGGGTGGTC |
| SIX5_known5 | ATAAATGACACCTATCA | TGATAGGTGTCATTTAT |
| ZIC4_V$Z1C2_01_Transfac\|ZIC4_ZIC1_f1_HocoMoco\|ZIC4_ZIC2_f1_HocoMoco\|ZIC2_1 | GACCACCCC | GGGGTGGTC |
| TFAP2_known1 | CGCCCGCCGGCG | CGCCGGCGGGCG |
| TEF_TEF_f1_HocoMoco | CATTTACATAAACA | TGTTTATGTAAATG |
| HOXA7_pTH6498_PBM | AAGTAATTACT | AGTAATTACTT |
| AR1D3A_2 | GAATTTTAATTAAACCC | GGGTTTAATTAAAATTC |
| STAT6_MA0520.1_ChIP-seq | ATTTCTCAGGAAATG | CATTTCCTGAGAAAT |
| HIC1_2 | GAGGGGTGCCCGCAGGCC | GGCCTGCGGGCACCCCTC |
| IRF_known6 | AAGTGAA | TTCACTT |
| HOXC5_I$DFD_01_Transfac | ACCAAGTAATTCCTAG | CTAGGAATTACTTGGT |
| TCF4_pTH5101_PBM | CACACCTGG | CCAGGTGTG |
| SP9_SP2_si_HocoMoco | GAGGGGGGCGGGCTAA | TTAGCCCGCCCCCCTC |
| THRB_THRA_1_SELEX\|THRA_1 | GTGACCTCATAAGGTCAC | GTGACCTTATGAGGTCAC |
| GBX1_1 | TACACTAATTAGTGGCA | TGCCACTAATTAGTGTA |
| BPTF_1 | AACCACAACACATA | TATGTGTTGTGGTT |
| SIX2_So_Cell_FBgn0003460_B1H | AATGATA | TATCATT |
| STAT6_V$STAT6_02_Transfac\|STAT_known14 | AGGAAGTC | GACTTCCT |
| ELF3_MA0598.1_ChIP-seq | CAGGAAGG | CCTTCCTG |
| PRDM1_PRDM1_a_HocoMoco | GAAAGTGAAAGTGA | TCACTTTCACTTTC |

TABLE 5-continued

Transcription Factor Binding Sites of Synthetic Promoters

| Name | Binding Site Sequence | Reverse Complement |
| --- | --- | --- |
| DBP_1 | AGCAAAC | GTTTGCT |
| FOXA_disc4 | AAATTCCT | AGGAATTT |
| ZEB1_V$DELTAEF1_01_Transfac | TCTCACCTGAA | TTCAGGTGAGA |
| CTCF_HUVEC_CTCF_Broad_ChIP-seq | CCCGGCGCCCCCTGGTGGCCG | CGGCCACCAGGGGGCGCCGGG |
| AR_AR_2_SELEX\|NR3C1_known16 | GGGAACACGGTGTACCC | GGGTACACCGTGTTCCC |
| ZNF384_1 | GAAAAAATC | GATTTTTTC |
| MSX1_MSX2_1_SELEX\|MSX1_MSX1_1_SELEX\|MSX1_Msx3_1_SELEX\|MSX1_3\|MSX2_3\|MSX2_5 | GCAATTAAAAACCAATTA | TAATTGGTTTTTAATTGC |
| NFIA_MA0161.1_High-throughput\|NFIC_4 | TGCCAA | TTGGCA |
| ATFLCREM_f1_HocoMoco | CACTGACGTCA | TGACGTCAGTG |
| HIC1_1 | CCCCGGGCACCCGGG | CCCGGGTGCCCGGGG |
| POU6F1_pTH6519_PBM | ATTAATTAAT | ATTAATTAAT |
| POU3F3_V$OCT1_03_Transfac\|POU2F2_known3 | ACCTCATTACGAG | CTCGTAATGAGGT |
| PAX9_Poxm_SOLEXA_5_FBgn0003129_B1H | CAAAAGCAATCAACCGTGA | TCACGGTTGATTGCTTTTG |
| RFX8_Rfx3_3961_PBM\|RFX8_pTH9278_PBM\|RFX8_pTH9194_PBM\|RFX8_pTH9269_PBM | CGTTGCTAAG | CTTAGCAACG |
| ELF2_1 | GTGACCTACTTCCTGGCA | TGCCAGGAAGTAGGTCAC |
| ETV5_MA0062.2_ChIP-seq\|ETS_known9 | CCGGAAGTGGC | GCCACTTCCGG |
| POU2F2_POU2F2_2_SELEX\|POU2F2_3 | CATGCATATGCAAA | TTTGCATATGCATG |
| EOMES_TBX21_4_SELEX\|TBX21_4 | GGTGTGATATCACACC | GGTGTGATATCACACC |
| NHLH2_V$HEN1_01_Transfac | GAGGGGCGCAGCTGCGCCCCAA | TTGGGGCGCAGCTGCGCCCCTC |
| NR2F2_NR2F6_a_HocoMoco | AGGACAAAGTTCACTTGA | TCAAGTGAACTTTGTCCT |
| E2F1_E2F1_4_SELEX | AAATGGCGCCATTT | AAATGGCGCCATTT |
| MAFK_HepG2_MAFF_Stanford_ChIP-seq | TGCTGACTCAGCAAA | TTTGCTGAGTCAGCA |
| PPARA_PPARG_si_HocoMoco\|NR2F2_COT1_si_HocoMoco | CAAAGGTCA | TGACCTTTG |
| IRX3_pTH6408_PBM | ATTACAAG | CTTGTAAT |
| ENSG00000187728_pTH5087_PBM | AACATATGG | CCATATGTT |
| CEBPD_1 | AATTGCGTCACT | AGTGACGCAATT |
| RELA_SRP001843_p65_Input_LPSstim_ChIP-seq\|RELA_TF65_f2_HocoMoco\|NFKB1_MA0105.3_ChIP-seq | GGGAAATTCCC | GGGAATTTCCC |
| RFX8_pTH9249_PBM | CCCTGGCAAC | GTTGCCAGGG |
| STAT_disc2\|BCL_disc2 | AATGACTCAT | ATGAGTCATT |
| SREBP_disc1 | CGTCGCCATGGCAAC | GTTGCCATGGCGACG |
| SPI1_known2 | ACTTCCT | AGGAAGT |
| GLIS1_GLIS1_1_SELEX\|GLIS1_1 | AGACCCCCACGAAGC | GCTTCGTGGGGGTCT |
| NFAT_1 | ATTTTTCCTCTG | CAGAGGAAAAAT |

TABLE 5-continued

Transcription Factor Binding Sites of Synthetic Promoters

| Name | Binding Site Sequence | Reverse Complement |
|---|---|---|
| HMX1_HMX1_1_SELEX\|H MX1_2 | AGCAATTAAAA | TTTTAATTGCT |
| HOXB5_1 | ACGGTAATTAGCTCAT | ATGAGCTAATTACCGT |
| CDC5L_V$CDC5_01_Transfac\|CDC5L1 | GATTTAACATAA | TTATGTTAAATC |
| MEF2B_Mv90_ChIP-seq | AAAATAGC | GCTATTTT |
| USF1_A549_USF1_HudsonAlpha_ChIP-seq | CCCGGTCACGTGACC | GGTCACGTGACCGGG |
| POU2F2_POU2F2_1_SELEX\|POU2F2_2 | AATTTGCATAT | ATATGCAAATT |
| MECP2_pTH3054_PBM | AATGACACTA | TAGTGTCATT |
| LHX8_Lhx8_2247_PBM | CCAATCAGC | GCTGATTGG |
| HOXA1_1\|HOXA5_3 | ACGGTAATTAGCTCAG | CTGAGCTAATTACCGT |
| MSX1_Dr_SOLEXA_FBgn0000492_B1H\|HOXC5_Ubx_FlyReg_FBgn0003944_B1H | CAATTA | TAATTG |
| GATA2_V$GATA1_05_Transfac\|GATA_known8 | GCAGATAACA | TGTTATCTGC |
| CEBPG_pTH5257_PBM | GATTGCGTAA | TTACGCAATC |
| SMARC_disc1 | CTGAGTCACC | GGTGACTCAG |
| XBP1_2 | ATTAAATGACACGTCATCTTTCAG | CTGAAAGATGACGTGTCATTTAAT |
| VAX2_1 | GTCTTAATTAGTGCAC | GTGCACTAATTAAGAC |
| NFIL3_V$E4BP4_01_Transfac\|NFIL3_1 | CGTTACATAACG | CGTTATGTAACG |
| FOXD1_V$FREAC2_01_Transfac\|FOXF2_1 | CAAACGTAAACAATCC | GGATTGTTTACGTTTG |
| ENO1_ENOA_si_HocoMoco | CACCACGTGGGCA | TGCCCACGTGGTG |
| ZBTB42_V$RP58_01_Transfac\|ZBTB18_1 | GAAACATCTGGA | TCCAGATGTTTC |
| IKZF1_V$IK3_01_Transfac\|IKZF3_1 | GGTATTCCCAGTA | TACTGGGAATACC |
| THAP1_disc2 | AACATGGCGG | CCGCCATGTT |
| SRF_Srf_3509_PBM | CCAAATTTGG | CCAAATTTGG |
| FOXA_disc5 | AAAGGTCAA | TTGACCTTT |
| NR4A2_NR4A2_si_HocoMoco\|NR4A2_NR4A1_f1_HocoMoco | AAAGGTCAC | GTGACCTTT |
| HES1_1 | AAGCCTCGTGGCCAG | CTGGCCACGAGGCTT |
| REST_disc5 | CAGCACCCCGG | CCGGGGTGCTG |
| TCF12_known1 | CAGCTGGC | GCCAGCTG |
| CTCFL_K562_CTCFL_HudsonAlpha_ChIP-seq | CCGCCAGGGGGCGCC | GGCGCCCCTGGCGG |
| CTCF_HeLa-S3_CTCF_UW_ChIP-seq | CCACCAGGGGCGCCG | CCGGCGCCCCTGGTGG |
| IRX3_pTH5976_PBM | AAACATGTACT | AGTACATGTTT |
| HOXC10_Hoxa11_2_SELEX\|HOXA11_3 | ATTTTATGGCC | GGCCATAAAAT |
| FOXO6_pTH8995_PBM | TTGTAAACAA | TTGTTTACAA |
| ALX1_3 | CGCATTAATTAATTGGC | GCCAATTAATTAATGCG |
| ZNF274_K562b_ZNF274_UCD_ChIP-seq | CCAGTATGAATTCTC | GAGAATTCATACTGG |
| BACH1_Mv46_ChIP-seq\|MAFK_MAFK_si_HocoMoco\|MAF_disc1 | TGACTCAGCA | TGCTGAGTCA |
| HOXC5_HXA7_f1_HocoMoco | AATCAATAGATTGGA | TCCAATCTATTGATT |

TABLE 5-continued

Transcription Factor Binding Sites of Synthetic Promoters

| Name | Binding Site Sequence | Reverse Complement |
| --- | --- | --- |
| ZFHX3_pTH6494_PBM | ACTAATTAG | CTAATTAGT |
| NR2F2_pTH5882_PBM | AGAGGTCAC | GTGACCTCT |
| CR936877.3_usp_SANGER_5_FBgn0003964_B1H | AGAGGTCAA | TTGACCTCT |
| STAT_known1 | TTCCCGGAA | TTCCGGGAA |
| IRX3_Irx2_0900_PBM | ATTACATGA | TCATGTAAT |
| EGR3_K562_EGR1_HudsonAlpha_ChIP-seq | CCCCCCCCCCGCCCACGCA | TGCGTGGGCGGGGGGGGGG |
| MEF2B_MEF26_1_SELEX\|MEF2B_1 | GCTATAAATAGC | GCTATTTATAGC |
| HAND2_Hand_da_SANGER_5_FBgn0032209_B1H\|TCF4_Hand_da_SANGER_5_FBgn0000413_B1H | CACATGGCC | GGCCATGTG |
| HOXC10_HXD9_f1_HocoMoco | AGTTTTATTG | CAATAAAACT |
| ETV5_ELK4_f1_HocoMoco | CACCGGAAGTA | TACTTCCGGTG |
| JUN_K562_JUND_Stanford_ChIP-seq | GATGACGTCACCCC | GGGGTGACGTCATC |
| MTF1_MTF1_1_SELEX\|MTF1_3 | GTGCCGTGTGCAAA | TTTGCACACGGCAC |
| ZBTB7A_disc1 | AGCGCCCCT | AGGGGGCGCT |
| FOXD1_Foxj1_3125_PBM | AATAAACAAACA | TGTTTGTTTATT |
| USF1_K562_USF2_Stanford_ChIP-seq\|USF1_HepG2_USF2_Stanford_ChIP-seq | GGGTCACGTGACC | GGTCACGTGACCC |
| PKNOX2_Hth_SOLEXA_FBgn0001235_B1H\|TG\|F1_Vis_SOLEXA_FBgn0033748_B1H\|TG\|F1_Achi_SOLEXA_FBgn0033749_B1H | TGTCAA | TTGACA |
| KLF4_CG12029_SOLEXA_5_FBgn0035454_B1H | CCAGCCACACCCACC | GGTGGGTGTGGCTGG |
| TP53_3 | AGACAAGTCC | GGACTTGTCT |
| GATA2_V$GATA1_01_Transfac\|GATA_known1 | CCCTATCACG | CGTGATAGGG |
| HIVEP3_ZEP1_f1_HocoMoco | GGGGATTTCCCA | TGGGAAATCCCC |
| CDX_1 | TACAAACAAAGTAATAAA | TTTATTACTTTGTTTGTA |
| NFIC_1 | CACCTGTTCAATTTGGCACGGAGCCAACA | TGTTGGCTCCGTGCCAAATTGAACAGGTG |
| POU3F3_pTH9381_PBM | ATAATGCATA | TATGCATTAT |
| E2F2_pTH9195_PBM\|E2F2_pTH9291_PBM\|E2F3_pTH9382_PBM | TTGGCGCCAA | TTGGCGCCAA |
| PRRX2_3 | AAAGCTAATTAGCGAAA | TTTCGCTAATTAGCTTT |
| STAT6_STAT6_do_HocoMoco | AAATTCCTGGGAA | TTCCCAGGAATTT |
| EGR3_EGR2_si_HocoMoco | CCGCCCACGCC | GGCGTGGGCGG |
| NR6A1_NR6A1_do_HocoMoco | AAGTTCAAGGTCA | TGACCTTGAACTT |
| TAL1_disc1 | CCTTATCTGCCCCCACCAG | CTGGTGGGGCAGATAAGG |
| ARID5A_ARI5B_f1_HocoMoco | CACAATACTAACC | GGTTAGTATTGTG |
| FOXD1_FoxI1_2809_PBM | AATGTAAACA | TGTTTACATT |
| FOXD1_Foxc1_1_SELEX\|FOXD1_FOXC2_2_SELEX\|FOXC2_2\|FOXC1_6 | GTAAATAAACA | TGTTTATTTAC |
| RAR_1 | AAGGACAGG | CCTGTCCTT |

TABLE 5-continued

Transcription Factor Binding Sites of Synthetic Promoters

| Name | Binding Site Sequence | Reverse Complement |
|---|---|---|
| STAT4_V$STAT4_01_Transfac | AAGAAATC | GATTTCTT |
| PRDM1_disc1 | AGTGAAAGTG | CACTTTCACT |
| STAT5B_V$STAT5A_04_Transfac | AAGAAATG | CATTTCTT |
| TEAD1_1 | CATTCC | GGAATG |
| NR3C1_known13 | ATAAGAACACCCTGTACCCGCC | GGCGGGTACAGGGTGTTCTTAT |
| ZNF713_ZNF713_1_SELEX\|ZNF713_1 | TAGAAAATGCCACGAA | TTCGTGGCATTTTCTA |
| EGR3_EGR4_1_SELEX\|EGR4_2 | AAATGCGTGGGCGTAA | TTACGCCCACGCATTT |
| HNF1A_HNF1A_f1_HocoMoco | GGTTAATAATTAACC | GGTTAATTATTAACC |
| NFIC_3 | TCTTGGCAAGTATCCAA | TTGGATACTTGCCAAGA |
| SP1_disc1 | ACCCCCCTTCTGATTGGCTGA | TCAGCCAATCAGAAGGGGGGT |
| EGR3_EGR4_2_SELEX | AAATGCGTGGGCGTAT | ATACGCCCACGCATTT |
| MEF2B_MEF2C_f1_HocoMoco | TCTATTTATAGAA | TTCTATAAATAGA |
| CACD_2 | CCACACCC | GGGTGTGG |
| ELF1_disc3 | CCCCGGCCTCCGC | GCGGAGGCCGGGG |
| NR3C1_known5 | AGAACAGA | TCTGTTCT |
| PTF1A_Fer3_da_SANGER_5_FBgn0037937_B1H\|TCF4_Fer3_da_SANGER_5_FBgn0000413_B1H | CAGCTGTTAC | GTAACAGCTG |
| BHLHE40_disc1 | AGTCACGTGA | TCACGTGACT |
| HERPUD1_1 | CAGTTGCTAGGCAACGG | CCCGTTGCCTAGCAACTG |
| HBP1_1 | ACTATGAATGAATGAT | ATCATTCATTCATAGT |
| REST_disc8 | CCTCGGACAGCTGC | GCAGCTGTCCGAGG |
| SOX11_Sox11_2266_PBM | ATTGTTCTC | GAGAACAAT |
| JUN_H1-hESCJUND_HudsonAlpha_ChIP-seq | ATGACTCACCC | GGGTGAGTCAT |
| MNT_MNT_1_SELEX\|MNT_1 | ACCACGTGCC | GGCACGTGGT |
| TFAP4_3 | ACCAGCTGTG | CACAGCTGGT |
| OSR2_bowl_SANGER_5_FBgn0004893_B1H | CCAGTAGC | GCTACTGG |
| HOXB13_HXD13_f1_HocoMoco | TCCCTAATAAA | TTTATTAGGGA |
| SPIC_GM12891_PU1_HudsonAlpha_ChIP-seq | AAAGAGGAAGTGAAACTAG | CTAGTTTCACTTCCTCTTT |
| RELA_GM18951_NFKB_Stanford_ChIP-seq | GGGGATTTCCA | TGGAAATCCCC |
| NKX2-8_3 | CCACTTGAA | TTCAAGTGG |
| TCF4_sage_da_SANGER_5_FBgn0000413_B1H | AAAACACCTGT | ACAGGTGTTTT |
| ATF7_V$CREBP1_Q2_Transfac\|ATF2_2 | AGTTACGTCACC | GGTGACGTAACT |
| AR_GCR_do_HocoMoco | CCGGGACAGTCTGTTCTC | GAGAACAGACTGTCCCGG |
| OVOL1_I$OVO_01_Transfac | GTGACTGTTACTATA | TATAGTAACAGTCAC |
| CTCF_WERI-Rb-1_CTCF_UW_ChIP-seq\|CTCF_GM12873_CTCF_UW_ChIP-seq\|CTCF_GM12864_CTCF_UW_ChIP- | CCACCAGGGGCGCC | GGCGCCCCTGGTGG |

TABLE 5-continued

Transcription Factor Binding Sites of Synthetic Promoters

| Name | Binding Site Sequence | Reverse Complement |
|---|---|---|
| seq\|CTCF_Gliobla_CTCF_UT-A_ChIP-seq\|CTCF_T-47D_CTCF_HudsonAlpha_ChIP-seq\|CTCF_AG04450_CTCF_UW_ChIP-seq | | |
| OLIG2_pTH5164_PBM | CCATATGGTAC | GTACCATATGG |
| KLF4_KLF6_si_HocoMoco | CCGCCCCC | GGGGGCGG |
| RORB_pTH6612_PBM | ACTGACCTCT | AGAGGTCAGT |
| EOMES_EOMES_1_SELEX\|EOMES_2 | AAGGTGTGAAAAT | ATTTTCACACCTT |
| SOX9_SOX8_3_SELEX\|SOX8_4 | GAACAATTGCAGTGTTC | GAACACTGCAATTGTTC |
| ESRRG_Esrra_2_SELEX\|ESRRG_ESRRA_1_SELEX\|ESRRA_known7\|ESRRA_known11 | ATGACCTTGAA | TTCAAGGTCAT |
| SOX9_SOX9_7_SELEX\|SOX9_9 | AATGAATTGCAGTCATT | AATGACTGCAATTCATT |
| VDR_3 | AAACGGTTCAGGAAGTTCATC | GATGAACTTCCTGAACCGTTT |
| POU6F2_POU6F2_1_SELEX\|POU6F1_Pou6f1_1731_PBM\|POU6F1_Pou6f1_3733_PBM\|POU6F2_1 | AGCTCATTAT | ATAATGAGCT |
| RAD21_disc10 | CCAGGGGCAG | CTGCCCCTGG |
| IRF7_IRF7_f1_HocoMoco | GAAAGTGAAA | TTTCACTTTC |
| HOXC5_zen_FlyReg_FBgn0004053_B1H | AATTTTAATG | CATTAAAATT |
| PATZ1_V$MAZR_01_Transfac\|PATZ1_1 | GGGGGGGGGGCCA | TGGCCCCCCCCCC |
| FOXO3_3 | TGTAAACA | TGTTTACA |
| HOXC10_HXA10_f1_HocoMoco | GATGATTTATGA | TCATAAATCATC |
| YY1_disc4 | GCAGCCGGCGCCGCC | GGCGGCGCCGGCTGC |
| SOX7_SOX7_1_SELEX\|SOX7_2 | AACAATGAACATTGTT | AACAATGTTCATTGTT |
| MITF_pTH5072_PBM\|BACH1_Mv45_ChIP-seq\|ATF3_Mv41_ChIP-seq | CACGTGAC | GTCACGTG |
| HNF4G_HNF4A_2_SELEX\|HNF4_known17 | AATGGACTTTGACCCC | GGGGTCAAAGTCCATT |
| BARX2_1 | TAAGTAATTAGTTATA | TATAACTAATTACTTA |
| PAX3_PAX7_1_SELEX\|PAX3_PAX7_2_SELEX\|PAX3_PAX3_1_SELEX\|PAX3_3\|PAX7_2\|PAX7_3 | TAATCGATTA | TAATCGATTA |
| LHX9_pTH5812_PBM | CTAATTAGTA | TACTAATTAG |
| MYBL2_MYBL2_1_SELEX\|MYBL2_1 | AACCGTTAACCGTT | AACGGTTAACGGTT |
| FOSL1_FOS_si_HocoMoco | GACCAATCAGAA | TTCTGATTGGTC |
| EMX2_Emx2_3420_PBM | CTAATTAGC | GCTAATTAG |
| CTCF_disc7 | CCACCAGGGG | CCCCTGGTGG |
| SIX6_MA0199.1_B1H | TATCA | TGATA |
| TEAD4_TEAD4_f1_HocoMoco | AAAAATAGCCCT | AGGGCTATTTTT |
| SOX_1 | CTCTTTGTTACGA | TCGTAACAAAGAG |
| C11orf9_pTH8554_PBM | CCGTACCACC | GGTGGTACGG |
| TBX5_2 | TAACACCTCA | TGAGGTGTTA |
| SP9_V$SP1_01_Transfac\|SP1_known1 | ACCCCGCCCC | GGGGCGGGGT |

TABLE 5-continued

Transcription Factor Binding Sites of Synthetic Promoters

| Name | Binding Site Sequence | Reverse Complement |
| --- | --- | --- |
| OSR1_1 | TTTTACAGTAGCAAAA | TTTTGCTACTGTAAAA |
| ETV5_pnt_SANGER_5_FBgn0003118_B1H\|ETV5_Ets21c_SANGER_5_FBgn0005660_B1H | ACCGGAAAT | ATTTCCGGT |
| AP3_1 | AATTTAGA | TCTAAATT |
| SIX2_So_SOLEXA_FBgn0003460_B1H | ATATGATA | TATCATAT |
| FOXD1_FOXD3_1_SELEX\|FOXD3_3 | AGTAAATATTAACT | AGTTAATATTTACT |
| PAX5_disc2 | CAAGCGTGAC | GTCACGCTTG |
| NR2F2_MA0017.1_COMPILED\|HNF4_known2\|HNF4_known13 | AGGTTCAAAGGTCA | TGACCTTTGAACCT |
| NFIC_2 | TCTTGGCAAGAAGCCAAA | TTTGGCTTCTTGCCAAGA |
| MAX_MXL3_PBM\|CLOCK::ARNTL1 | ACACGTGG | CCACGTGT |
| NPAS2_Clk_cyc_SANGER_5_FBgn0023076_B1H\|ARNT2_Clk_cyc_SANGER_5_FBgn0023094_B1H | ACACGTGA | TCACGTGT |
| BCL_disc6 | GGGAAAGCCC | GGGCTTTCCC |
| MLX1P_pTH5466_PBM | ACACGTGC | GCACGTGT |
| MYC_known16 | ACCACGTGGTC | GACCACGTGGT |
| FOXD1_MA0148.3_ChIP-seq | CAAAGTAAACATGGA | TCCATGTTTACTTTG |
| EN2_EN2_1_SELEX\|EN2_2 | GTTAATTGGA | TCCAATTAAC |
| FOXD1_MA0047.2_ChIP-seq\|FOXA_known6 | CCTAAGTAAACA | TGTTTACTTAGG |
| MEF2B_MA0052.2_ChIP-seq | AGCTAAAAATAGCAT | ATGCTATTTTTAGCT |
| RBPJ_I$SUH_01_Transfac | ACTGTGGGAAACG | CGTTTCCCACAGT |
| PAX8_2 | ACTCACGCAATACTG | CAGTATTGCGTGAGT |
| CEBPG_1 | CTCATTTCAAAAA | TTTTTGAAATGAG |
| MEIS3_1 | AATTACCTGTCAATAC | GTATTGACAGGTAATT |
| AR_pTH5924_PBM | ATGTTCCCA | TGGGAACAT |
| NKX6-3_1 | CAAAGTAATTAATTATC | GATAATTAATTACTTTG |
| FEZF2_CG31670_SANGER_5_FBgn0031375_B1H | AAATGAGCAAC | GTTGCTCATTT |
| TWIST2_twi_da_SANGER_5_FBgn0003900_B1H\|TCF4_twi_da_SANGER_5_FBgn0000413_B1H | AACATCTGGT | ACCAGATGTT |
| MYBL1_MYBL1_3_SELEX\|MYBL1_4 | AAAACCGTTAA | TTAACGGTTTT |
| MYB_2 | CTCAACTGGC | GCCAGTTGAG |
| TP73_Tp73_1_SELEX\|TP73_1 | GACATGTCCAGACATGTC | GACATGTCTGGACATGTC |
| JUN_GM12878_JUND_Stanford_ChIP-seq | AGTTTCGATATGAGTCATC | GATGACTCATATCGAAACT |
| HOXB13_HOXA13_1_SELEX\|HOXB13_HOXB13_1_SELEX\|HOXA13_2\|HOXB13_2 | CCAATAAAAC | GTTTTATTGG |
| HOXB13_HOXC13_1_SELEX\|HOXB13_HOXA13_3_SELEX\|HOXB13_Hoxd13_1_SELEX\|HOXB13_HOXD13_1_SELEX\|HOXA13_4\|HOXC13_2\|HOXD13_2\|HOXD13_4 | CCAATAAAAA | TTTTTATTGG |
| IRX3_Irx5_2385_PBM | AATTACATG | CATGTAATT |
| NFKB_disc4 | AAAGTCCCC | GGGGACTTT |

TABLE 5-continued

Transcription Factor Binding Sites of Synthetic Promoters

| Name | Binding Site Sequence | Reverse Complement |
|---|---|---|
| POU3F3_V$OCT1_C16_Transfac | CTGATTTGCATATTC | GAATATGCAAATCAG |
| TEAD1_TEAD1_1_SELEX\|TEAD4_TEAD4_1_SELEX\|TEAD1_3\|TEAD4_1 | ATGGAATGTG | CACATTCCAT |
| ZNF589_1 | CCAGGGTATCAGCCG | CGGCTGATACCCTGG |
| NANOG_disc3 | CCACAGCAGG | CCTGCTGTGG |
| FOXD1_FOXD3_f1_HocoMoco | AAACAAACA | TGTTTGTTT |
| CTCF_AG09319_CTCF_UW_ChIP-seq | GCCACCAGAGGGCGC | GCGCCCTCTGGTGGC |
| CEBPB_disc2 | AGCCAATCA | TGATTGGCT |
| CUX1_V$CLOX_01_Transfac\|CUX1_V$CDP_02_Transfac\|CUX1_2 | AAATAATCGATATA | TATATCGATTATTTT |
| MEIS1_pTH6524_PBM | AAATGACAGCTC | GAGCTGTCATTT |
| BARHL2_Barhl1_3_SELEX\|BARHL1_4 | CATTTAGCAGCAATTA | TAATTGCTGCTAAATG |
| HOXC9_1 | ATAATTAATGACCTCC | GGAGGTCATTAATTAT |
| BHLHE40_known1 | CCGTCACGTGACCA | TGGTCACGTGACGG |
| PBX3_PBX3_f2_HocoMoco | CCAGCCAATCAGAG | CTCTGATTGGCTGG |
| RFX8_GM12878_RFX5_Stanford_ChIP-seq | CCTAGCAACAGGTGA | TCACCTGTTGCTAGG |
| TCF4_HLH4C_da_SANGER_5_FBgn0000413_B1H\|NHLH2_HLH4C_da_SANGER_5_FBgn0011277_B1H | AAAAACACCTGCGCC | GGCGCAGGTGTTTTT |
| MAX_HUVEC_MAX_Stanford_ChIP-seq | GGCCACGTGACCC | GGGTCACGTGGCC |
| NR5A1_MA0505.1_ChIP-seq | AAGTTCAAGGTCAGC | GCTGACCTTGAACTT |
| SP9_pTH5422_PBM | GTACCCTA | TAGGGTAC |
| ATOH7_ato_da_SANGER_5_3_FBgn0010433_B1H\|TCF4_ato_da_SANGER_5_3_FBgn0000413_B1H | CCACCTGCC | GGCAGGTGG |
| EN1_3 | GCATTAATTAGTTCGC | GCGAACTAATTAATGC |
| CIC_Cic_3454_PBM | AGTCAGCAAA | TTTGCTGACT |
| MSX1_MSX1_3_SELEX\|MSX1_5 | CCAATTAG | CTAATTGG |
| CTCF_Fibrobl_CTCF_UT-A_ChIP-seq | CGGCCACCAGGGGC | GCCCCCTGGTGGCCG |
| NHLH2_V$HEN1_02_Transfac\|NHLH1_1 | AGGGGACGCAGCTGCGCCCCCT | AGGGGGCGCAGCTGCGTCCCCT |
| SOX13_V$SOX5_01_Transfac\|SOX5_1 | GTATTGTTAA | TTAACAATAC |
| USF1_V$USF_01_Transfac\|MYC_known3 | AGATCACGTGATCT | AGATCACGTGATCT |
| SOX15_SOX15_a_HocoMoco | AACAATG | CATTGTT |
| IRF4_GM12878_IRF4_HudsonAlpha_ChIP-seq | AATGTGGAAATGAGTCAG | CTGACTCATTTCCACATT |
| NKX2-5_NKX25_f1_HocoMoco\|NKX2-5_V$NKX25_01_Transfac\|NKX2-5_1 | CACTTGA | TCAAGTG |
| SOX13_Sox13_1718_PBM | GAACAATA | TATTGTTC |
| ZKSCAN1_pTH2280_PBM | ATGTGCACAT | ATGTGCACAT |
| VENTX_VENTX_1_SELEX\|VENTX_1 | ACCGATTAG | CTAATCGGT |
| MYC_K562_CMYC_UT-A_ChIP-seq | GCCACGTGGCC | GGCCACGTGGC |
| UNCX_1 | CATAATTAATTAACGCG | CGCGTTAATTAATTATG |

TABLE 5-continued

Transcription Factor Binding Sites of Synthetic Promoters

| Name | Binding Site Sequence | Reverse Complement |
| --- | --- | --- |
| SREBF2_SRBP1_f2_HocoMoco | CTCACCCCACC | GGTGGGGTGAG |
| NR2E1_dsf_SANGER_5_FBgn0015381_B1H\|NR2E1_tll_NAR_FBgn0003720_B1H\|NR2E1_MA0459.1_B1H | AAAAGTCAAA | TTTGACTTTT |
| HNF1A_Tcf1_2666_PBM\|HMBOX1_Hmbox1_2674_PBM | CTAGTTAA | TTAACTAG |
| CXXC1_CXXC1_si_HocoMoco | CGTTGGC | GCCAACG |
| PAX6_V$PAX6_01_Transfac\|PAX6_1 | AATTTTCACGCATGAGTCAC | GTGAACTCATGCGTGAAAATT |
| NR2F2_pTH6747_PBM | AGGGGTCA | TGACCCCT |
| STAT3_HeLa-S3_STAT3_Stanford_ChIP-seq | CATTTCCCGGAAG | CTTCCGGGAAATG |
| ATF3_known1 | CTCTGACGTCACCC | GGGTGACGTCAGAG |
| TCF7L2_known2 | CTTTGA | TCAAAG |
| T_MA0009.1_SELEX\|T_2 | CTAGGTGTGAA | TTCACACCTAG |
| FOXD1_FOXJ2_f1_HocoMoco | TAAATAAACA | TGTTTATTTA |
| FOSL1_HeLa-S3_CFOS_Stanford_ChIP-seq | GATGACTCACACA | TGTGTGAGTCATC |
| NFATC1_NFAC4_a_HocoMoco | AAATTTTCCT | AGGAAAATTT |
| TFAP2A_Tcfap2c_2912_PBM | CGCCCGAGGC | GCCTCGGGCG |
| SOX2_1 | CCTTTGTTATGCAAA | TTTGCATAACAAAGG |
| TBX1_TBX1_1_SELEX\|TBX1_1 | AGGTGTGAAAAAGGTGTGA | TCACACCTTTTTCACACCT |
| BHLHE40_known2 | GGAAGAGTCACGTGACCAATAC | GTATTGGTCACGTGACTCTTCC |
| EGR3_V$NGF1C_01_Transfac\|EGR4_1 | ATGCGTGGGCGG | CCGCCCACGCAT |
| ATOH7_ato_da_SANGER_5_2_FBgn0010433_B1H\|TCF4_ato_da_SANGER_5_2_FBgn0000413_B1H\|OLIG2_Oli_da_SANGER_5_3_FBgn0032651_B1H\|TCF4_Oli_da_SANGER_5_3_FBgn0000413_B1H | ACATCTGTC | GACAGATGT |
| REST_U87_N_RSF_HudsonAlpha_ChIP-seq | ACCATGGACAGCGCC | GGCGCTGTCCATGGT |
| RXRA_known6 | AAAGGTCAAAGGTCAAC | GTTGACCTTTGACCTTT |
| ETV6_ETV7_si_HocoMoco | GCCACAGGAAGTAACAC | GTGTTACTTCCTGTGGC |
| TCF4_Oli_da_SANGER_5_1_FBgn0000413_B1H\|OLIG2_Oli_da_SANGER_5_1_FBgn0032651_B1H | CACCATATGGC | GCCATATGGTG |
| RUNX2_3 | ACCACAA | TTTGTGGT |
| STAT_disc6 | AGGCAGGAA | TTCCTGCCT |
| NR5A1_NR5A2_f1_HocoMoco | TGGCCTTGAA | TTCAAGGCCA |
| NKX2-6_MA0247.2_ChIP-chip | CCACTTGAAA | TTTCAAGTGG |
| ZFY_ZFX_a_HocoMoco | GCCGAGGCCTGGGGCCCCC | GGGGGCCCCAGGCCTCGGC |

TABLE 5-continued

Transcription Factor Binding Sites of Synthetic Promoters

| Name | Binding Site Sequence | Reverse Complement |
|---|---|---|
| CTCF_SAEC_CTCF_UW_ChIP-seq\|CTCF_HPF_CTCF_UW_ChIP-seq | CCACCAGGGGGCG | CGCCCCCTGGTGG |
| NHLH1_2 | ATGGGGCGCAGCTGCGCCCCTC | GAGGGGCGCAGCTGCGCCCCAT |
| E2F6_K562_E2F6_HudsonAlpha_ChIP-seq | CTTCCCGCCCC | GGGGCGGGAAG |
| CTCF_H1-hESC_CTCF_Broad_ChIP-seq\|CTCF_MCF-7_CTCF_UT-A_ChIP-seq\|CTCF_N_HEK_CTCF_Broad_ChIP-seq\|CTCF_H1-hESC_CTCF_HudsonAlpha_ChIP-seq\|CTCF_GM12874_CTCF_UW_ChIP-seq\|CTCF_GM12872_CTCF_UW_ChIP-seq\|CTCF_Caco-2_CTCF_UW_ChIP-seq\|CTCF_GM12865_CTCF_UW_ChIP-seq\|CTCF_HA-sp_CTCF_UW_ChIP-seq\|CTCF_K562_CTCF_UT-A_ChIP-seq\|CTCF_GM12875_CTCF_UW_ChIP-seq\|CTCF_AoAF_CTCF_UW_ChIP-seq\|CTCF_K562_CTCF_UW_ChIP-seq\|CTCF_HRE_CTCF_UW_ChIP-seq\|CTCF_BJ_CTCF_UW_ChIP-seq\|SMC3_disc1 | GCCACCAGGGGCGC | GCGCCCCTGGTGGC |
| POU3F3_V$OCT1_05_Transfac\|POU2F2_known5 | AATATGCAAATTAT | ATAATTTGCATATT |
| GMEB2_pTH9211_PBM | TACGTAA | TTACGTA |
| ESR2_HepG2_ERRA_Stanford_ChIP-seq | GGCCCAAGGTCACA | TGTGACCTTGGGCC |
| DLX1_DLX3_do_HocoMoco | GATAATTACA | TGTAATTATC |
| REST_disc7 | ACAGCGTC | GACGCTGT |
| POU1F1_POU1F1_2_SELEX\|POU1F1_5 | AATATGCAAATTAG | CTAATTTGCATATT |
| NR6A1_V$GCNF_01_Transfac\|N_R6A1_1 | CTCAAGTTCAAGTTCAC | GGTGAACTTGAACTTGAG |
| FOXD1_FOXC2_1_SELEX\|FOXD1_FOXC1_2_SELEX\|FOXC1_4\|FOXC2_1 | TGTAAATATTGACA | TGTCAATATTTACA |
| JUN_MA0488.1_ChIP-seq | AAGATGATGTCAT | ATGACATCATCTT |
| ZIC2_2\|Z1C3_2 | ACCCCCCCGGGGGGG | CCCCCCCGGGGGGGT |
| GATA2_pnr_SANGER_5_FBgn0003117_B1H | CAGATAA | TTATCTG |
| MEF2_disc1 | TGCTAAAAATAGCAA | TTGCTATTTTTAGCA |
| MEF2B_GM12878_MEF2C_HudsonAlpha_ChIP-seq | ATGCCAAAATAGCA | TGCTATTTTGGCAT |
| BARHL2_BARHL2_3_SELEX\|BARHL2_4 | CATTTAACACCAATTA | TAATTGGTGTTAAATG |
| RFX8_RFX2_1_SELEX\|RFX8_RFX5_1_SELEX\|RFX8_RFX3_1_SELEX\|RFX8_RFX4_1_SELEX\|RFX2_1\|RFX3_2\|RFX5_known6\|RFX5_known8 | CGTTGCCATGGCAACG | CGTTGCCATGGCAACG |
| RFX8_Rfx3_1_SELEX\|RFX8_Rfx2_1_SELEX\|RFX8_YLR176C_1478_DeBoer11\|RFX2_3\|RFX3_4 | CGTTGCCATGGCAACC | GGTTGCCATGGCAACG |
| ZEB1_V$AREB6_04_Transfac\|ZEB1_known4 | CTGAAACAG | CTGTTTCAG |
| GSX2_1 | AGGTTAATTAGCTGAT | ATCAGCTAATTAACCT |
| STAT5B_STA5B_f1_HocoMoco | AATTCCCAGAAAA | TTTTCTGGGAATT |
| GATA2_GATA3_2_SELEX\|GATA_known20 | AGATAAGG | CCTTATCT |
| GATA2_GATA3_1_SELEX\|GATA2_GATA5_1_SELEX\|GATA2_MA0037.2_ChIP-seq\|GATA2_GATA4_1_SELEX\|GATA_known19\|GATA_known21\|GATA_known22 | AGATAAGA | TCTTATCT |
| CTCF_Osteobl_CTCF_Broad_ChIP-seq | AGCGCCCCTGGTGGCA | TGGCCACCAGGGGCGCT |

TABLE 5-continued

Transcription Factor Binding Sites of Synthetic Promoters

| Name | Binding Site Sequence | Reverse Complement |
|---|---|---|
| RORB_RORA_f1_HocoMoco | AAAACTAGGTCA | TGACCTAGTTTT |
| GATA_disc5 | AGCCAAACC | GGTTTGGCT |
| CACBP_1 | CCCACCCTC | GAGGGTGGG |
| STAT_known16 | CTTCCTGGAA | TTCCAGGAAG |
| IRF8_IRF8_si_HocoMoco | CAGTTTCAGTTTCTC | GAGAAACTGAAACTG |
| HOXD12_HOXD12_1_SELEX\|HOXD12_HOXC12_1_SELEX\|HOXD12_HOXD12_4_SELEX\|HOXC12_21HOXD12_2 | GTAATAAAA | TTTTATTAC |
| HOXB13_Hoxd13_2356_PBM\|HOXB13_Hoxa13_3126_PBM | CTCATAAAA | TTTTATGAG |
| AIRE_2 | GGTTATTAATTGGTTATATTGGTTA | TAACCAATATAACCAATTAATAACC |
| SMC3_disc4 | CTGGTGGC | GCCACCAG |
| MYC_known1 | CGACCACGTGGTCA | TGACCACGTGGTCG |
| BHLHE40_BHLHB3_1_SELEX\|BHLHE41_1 | GGCACGTGAC | GTCACGTGCC |
| FOXD1_I$CROC_01_Transfac | AAAAATAAATATAAGG | CCTTATATTTATTTTT |
| TBX3_pTH9182_PBM1TBX3_pTH9244_PBM | GAGGTGTCAA | TTGACACCTC |
| CEBPA_V$CEBPB_01_Transfac\|CEBPB_known1 | ACATTGCACAATCT | AGATTGTGCAATGT |
| MAX_dm_Max_SANGER_10_FBgn0017578_B1H | ACCACGTGTC | GACACGTGGT |
| FOSL1_HUVEC_CFOS_UCD_ChIP-seq | ATGACTCACTC | GAGTGAGTCAT |
| SOX11_Sox4_2941_PBM | AGAACAATG | CATTGTTCT |
| GLI_1 | CCTGGGTGGTCC | GGACCACCCAGG |
| STAT1_V$STAT1_01_Transfac\|STAT_known2 | CCCCATTTCCCGGAAATCACC | GGTGATTTCCGGGAAATGGGG |
| HOXC10_Hoxa9_2622_PBM | GCCATAAA | TTTATGGC |
| GMEB2_GMEB2_1_SELEX\|GMEB2_1 | GTACGTAA | TTACGTAC |
| ESR2_ESR1_do_HocoMoco | AGGTCACGGTGACCTGGG | CCCAGGTCACCGTGACCT |
| HOXA4_GSX1_1_SELEX1GSX1_1 | CCTAATTAAA | TTTAATTAGG |
| PITX2_Pitx1_2312_PBM\|DMBX1_Dmbx1_2277_PBM | GGGGATTAA | TTAATCCCC |
| RORB_pTH6142_PBM\|NR2F2_Nr2f2_2192_PBM\|NR2F2_pTH3811_PBM\|RARG_Rara_1051_PBM | GAGGTCAC | GTGACCTC |
| NR2C2_pTH3466_PBM | GAGGTCAA | TTGACCTC |
| ETV5_HEK293b_ELK4_UCD_ChIP-seq | CCACTTCCGG | CCGGAAGTGG |
| CREB3L2_CREB3L1_6_SELEX\|CREB3L2_CREB3L1_4_SELEX\|CREB3L2_CREB3L1_1_SELEX\|CREB3L1_1\|CREB3L1_4 | ATGCCACGTCATCA | TGATGACGTGGCAT |
| ATF5_Atf4_1_SELEX\|ATF4_3 | AGGATGATGCAATC | GATTGCATCATCCT |
| FOXO6_FOXO1_si_HocoMoco | AAAAGTAAACAAACC | GGTTTGTTTACTTTT |
| ONECUT3_HNF6_f1_HocoMoco | AAAAAATCAATAAA | TTTATTGATTTTTT |
| BACH1_V$BACH2_01_Transfac\|BACH2_1 | CGTGAGTCATC | GATGACTCACG |
| HOXA10_1 | TAGGTAATAAAATTCA | TGAATTTTATTACCTA |
| TFAP2A_AP2C_f1_HocoMoco | GCCCCAGGC | GCCTGGGGC |
| CRX_2 | AGGCTAATCCCCAACG | CGTTGGGGATTAGCCT |

TABLE 5-continued

Transcription Factor Binding Sites of Synthetic Promoters

| Name | Binding Site Sequence | Reverse Complement |
|---|---|---|
| HOXD13_1 | AGAATTTTATTGGTAG | CTACCAATAAAATTCT |
| HIF1A::ARNT_1 | GCACGTCC | GGACGTGC |
| SOX2_SOX21_1_SELEX\|SOX21_2 | AACAATGGTAGTGTT | AACACTACCATTGTT |
| ZNF350_ZN350_f1_HocoMoco | ACGGGGCGCAGGGATTTGTTGCCC | GGGCAACAAATCCCTGCGCCCCGT |
| HOXC5_ftz_FlyReg_FBgn0001077_B1H | GGCAATTA | TAATTGCC |
| YY1_disc3 | CGCCGCCGCC | GGCGGCGGCG |
| TFAP4_V$AP4_C15_Transfac\|TFAP4_V$AP4_C16_Transfac\|TFAP4_2 | ACCAGCTGAG | CTCAGCTGGT |
| TFAP2A_AP2B_f1_HocoMoco | GCCCCGGGC | GCCCGGGGC |
| ZNF350_1 | AAAGGGCTGCGGCCC | GGGCCGCAGCCCTTT |
| LCOR_pTH9220_PBM | AATTTTGGCA | TGCCAAAATT |
| YBX1_YBOX1_f2_HocoMoco | GGCCAATCCCC | GGGGATTGGCC |
| JUN_K562_JUNB_UChicago_ChIP-seq | AAGGATGAGTCACCG | CGGTGACTCATCCTT |
| USF1_H1-hESC_USF2_Stanford_ChIP-seq | CGCGGTCACGTGACCC | GGGTCACGTGACCGCG |
| DMRTA1_1 | AAATTGTTACATT | AATGTAACAATTT |
| LCOR_pTH8649_PBM | AATTTTGGCT | AGCCAAAATT |
| IKZF1_V$LYF1_01_Transfac\|IKZF1_2 | TCTCCCAAA | TTTGGGAGA |
| SPIC_K562_PU1_HudsonAlpha_ChIP-seq\|SPIC_SRP005406_SPI1_ChIP-seq | AAAAAGAGGAAGTGG | CCACTTCCTCTTTTT |
| CTCF_MA0139.1_ChIP-seq\|CTCF_CTCF_f2_HocoMoco\|CTCF_known1 | TAGCGCCCCTGGTGGCCA | TGGCCACCAGGGGGCGCTA |
| ZBTB6_ZBTB6_si_HocoMoco | AGATGATAGAGCC | GGCTCTATCATCT |
| POU4F1_pTH8341_PBM | ATATGCAT | ATGCATAT |
| GATA2_MA0036.2_ChIP-seq | ACAGATAAGAATCT | AGATTCTTATCTGT |
| ESR2_Mv67_ChIP-seq | CCAAGGTCAC | GTGACCTTGG |
| NFIL3_pTH3041_PBM | ACGTAATA | TATTACGT |
| ASCL2_1 | CAGGAGCAGCTGCTGAG | CTCAGCAGCTGCTCCTG |
| RFX5_disc1 | CCCTAGCAAC | GTTGCTAGGG |
| RFX8_RFX3_f1_HocoMoco | GGTTGCCATGGTAA | TTACCATGGCAACC |
| GBX2_Unpg_Cell_FBgn0015561_B1H | CTTAATTA | TAATTAAG |
| TLX3_TLX1_J2_HocoMoco | CCTTGGCAACTTGCCAG | CTGGCAAGTTGCCAAGG |
| CUX1_CUX1_f1_HocoMoco | AGGGGGATCGATGG | CCATCGATCCCCCT |
| GATA2_Gata3_1024_PBM | CTTATCTCTA | TAGAGATAAG |
| KLF4_MA0493.1_ChIP-seq | GGCCACACCCA | TGGGTGTGGCC |
| EVX2_EVX1_1_SELEX\|EVX2_EVX2_1_SELEX\|EVX1_2\|EVX2_2 | GCTAATTACC | GGTAATTAGC |
| OSR2_1 | ATGTACAGTAGCAAAG | CTTTGCTACTGTACAT |
| FOXD1_Mv69_ChIP-seq | CTAAGTAAACAAG | CTTGTTTACTTAG |
| NKX2-5_pTH5945_PBM | AACCACTTAAG | CTTAAGTGGTT |

TABLE 5-continued

Transcription Factor Binding Sites of Synthetic Promoters

| Name | Binding Site Sequence | Reverse Complement |
| --- | --- | --- |
| LHX6_1 | GAGCGTTAATTAATGTA | TACATTAATTAACGCTC |
| NFKB1_NFKB1_f1_HocoMoco\|NFKB_known8 | GGGGAATCCCC | GGGGATTCCCC |
| MXI1_Mv93_ChIP-seq | GGTTGCCATGGCGAC | GTCGCCATGGCAACC |
| RARG_Rarg_3_SELEX\|RARG_9 | AAGGTCACGAAAGGTCA | TGACCTTTCGTGACCTT |
| HOXA3_2 | GTTAATTACCTCCA | TGGAGGTAATTAAC |
| MYOD1_Myf6_3824_PBM | ACACCTGTC | GACAGGTGT |
| HNF4G_HNF4A_6_SELEX\|HNF4_known21 | GGGTCAAAGGTCAA | TTGACCTTTGGACCC |
| RELA_GM10847_NFKB_Stanford_ChIP-seq | AGGGGATTTCCCAG | CTGGGAAATCCCCT |
| TATA_known4 | GTATAAA | TTTATAC |
| FOXD1_FOXK1_1_SELEX\|FOXK1_2 | ATTGTGTCCG | CGGACACAAT |
| ATF5_pTH1014_PBM | AGTTACGTAATTG | CAATTACGTAACT |
| ZBTB7C_ZBTB7C_1_SELEX\|ZBTB7B_ZBTB76_1_SELEX\|ZBTB7A_known4\|ZBTB7C_1 | GCGACCACCGAA | TTCGGTGGTCGC |
| RARG_Rarg_1_SELEX\|RARG_7 | AAGGTCAAAGGTCAA | TTGACCTTTGACCTT |
| SOX10_2 | ACAAAG | CTTTGT |
| FOXO6_FOXO4_1_SELEX\|FOXO6_FOXO1_2_SELEX\|FOXO6_FOXO3_1_SELEX\|FOXO6_FOXO6_1_SELEX\|FOXO1_4\|FOXO3_4\|FOXO4_3\|FOXO6_1 | GTAAACATGTTTAC | GTAAACATGTTTAC |
| BCL_disc9 | CTGCACCCGCTGCC | GGCAGCGGGTGCAG |
| HDAC2_disc1 | CAGATAAGGC | GCCTTATCTG |
| USF2_MA0526.1_ChIP-seq | GGTCACATGAC | GTCATGTGACC |
| FOSL1_pTH5108_PBM\|ATF3_pTH5018_PBM | ACGTCATC | GATGACGT |
| ESRRG_ERR_SANGER_5_FBgn0035849_B1H\|ESRRG_pTH3841_PBM\|NR5A1_pTH3468_PBM\|NR5A1_Mw160_ChIP-seq\|NR5A1_1 | CAAGGTCA | TGACCTTG |
| AHR_2 | CTTGCGTGAGA | TCTCACGCAAG |
| E2F3_E2F2_1022_PBM | ACGCGCCAAA | TTTGGCGCGT |
| PAX6_4 | GTCAATTAATTAATCA | TGATTAATTAATTGAC |
| HES4_pTH5059_PBM\|HES7_pTH5260_PBM | GACGCGTGCC | GGCACGCGTC |
| BARX1_BARX1_2_SELEX\|BARX1_3 | CTAATTGC | GCAATTAG |
| HESX1_HESX1_f1_HocoMoco | AGGCCACGTGCCGGAT | ATCCGGCACGTGGCCT |
| SRF_V$SRF_C16_Transfac\|SRF_known2 | GGCCATATAAGGAC | GTCCTTATATGGCC |
| ZNF410_ZNF410_1_SELEX\|ZNF410_2 | GAGTATTATGGGATGGA | TCCATCCCATAATACTC |
| NKX3-1_3 | ATCCTTAAGTGGTTAAG | CTTAACCACTTAAGGAT |
| ETS_known4 | ACAGGAAGTGATTGC | GCAATCACTTCCTGT |
| NR4A2_NR4A2_3_SELEX\|NR4A_known4 | TGACCTTTAAA | TTTAAAGGTCA |
| HOXC10_HOXC11_4_SELEX\|HOXC10_HOXC11_2_SELEX\|HOXC11_3\|HOXC11_5 | AGCAATAAAAA | TTTTTATTGCT |
| TBX1_TBX1_2_SELEX\|TBX1_TBX20_2_SELEX\|TBX22_TBX15_1_SELEX\|TBX15_1\|TBX1_2\|TBX20_2 | AGGTGTGAAATTCACACCT | AGGTGTGAATTTCACACCT |

TABLE 5-continued

Transcription Factor Binding Sites of Synthetic Promoters

| Name | Binding Site Sequence | Reverse Complement |
|---|---|---|
| BCL_disc5 | CTGATAAG | CTTATCAG |
| POU2F2_MA0507.1_ChIP-seq | ATATGCAAATGAA | TTCATTTGCATAT |
| IRX3_Irx3_0920_PBM | ATCATGTAAT | ATTACATGAT |
| MYB_6 | AAAATAACGGTTTCCAT | ATGGAAACCGTTATTTT |
| POU3F3_GM12891_POU2F2_HudsonAlpha_ChIP-seq\|POU3F3_GM12891_OCT2_HudsonAlpha_ChIP-seq | ATATGCAAATGAG | CTCATTTGCATAT |
| GSC_GSC2_1_SELEX\|GSC2_1 | CCTAATCCGC | GCGGATTAGG |
| SRF_known5 | CATCTCCTTATATGG | CCATATAAGGAGATG |
| LHX1_pTH6478_PBM | CTAATTACGC | GCGTAATTAG |
| AR_NR3C2_1_SELEX\|NR3C2_1 | GGGAACACAATGTTCCC | GGGAACATTGTGTTCCC |
| KLF4_MA0039.2_ChIP-seq\|KLF4_1 | GCCCCACCCA | TGGGTGGGGC |
| LIN54_pTH8399_PBM | ATTCAAAT | ATTTGAAT |
| BCL6_SRP001843_Bc16_IgG_LPSstim_ChIP-seq | AGGAGAGAAGGGGAA GGGAAGAAAGGGAGA | TCTCCCTTTCTTCCCTTCC CCTTCTCTCCT |
| RREB1_V$RREB1_01_Transfac\|RREB1_1 | CCCCAAACCACCCC | GGGGTGGTTTGGGG |
| SOX7_1 | AATAAAGAACAATAGAA TTTCA | TGAAATTCTATTGTTCTT TATT |
| HIC1_5 | ATGCCAACC | GGTTGGCAT |
| BSX_1 | CAGGTAATTACCTCAG | CTGAGGTAATTACCTG |
| AP1_disc8 | AAGGAAATGA | TCATTTCCTT |
| POU3F3_POU3F3_1_SELEX\|POU3F3_2 | AAATTAGCATAAT | ATTATGCTAATTT |
| SRF_known8 | TTCCATATATGGAA | TTCCATATATGGAA |
| PURA_PURA_f1_HocoMoco | CCCTGCCCCCCCCTTCC | GGAAGGGGGGGCAG GG |
| HMX2_1\|HMX3_2 | ACAAGCAATTAAAGAAT | ATTCTTTAATTGCTTGT |
| SCRT2_SCRT2_1_SELEX\|SCRT2_1 | ATGCAACAGGTGG | CCACCTGTTGCAT |
| C11orf9_pTH8654_PBM\|C11orf9_pTH9310_PBM | TGGTACCA | TGGTACCA |
| SOX9_SOX8_7_SELEX\|SOX9_SOX8_2_SELEX\|SOX8_3\|SOX8_8 | ATGAATTGCAGTC | GACTGCAATTCAT |
| SETDB1_disc2 | GCGCACGCGC | GCGCGTGCGC |
| PBX3_disc3 | AGTGACAGGCCCGCCG GCCAA | TTGGCCGGCGGGCCTGT CACT |
| E2F6_MA0471.1_ChIP-seq\|E2F4_MA0470.1_ChIP-seq | CCTTCCCGCCC | GGGCGGGAAGG |
| ATF3_JDP2_4_SELEX\|ATF3_Jdp2_2_SELEX\|XBP1_XBP1_1_SELEX\|ATF3_JDP2_2_SELEX\|JDP2_3\|JDP2_5\|JDP2_7\|XBP1_3 | GATGACGTCATC | GATGACGTCATC |
| HOXC5_HXB6_f1_HocoMoco | AATGATTGATGCA | TGCATCAATCATT |
| KLF14_KLF14_1_SELEX\|KLF14_1 | AAGGGGGCGTGGCC | GGCCACGCCCCCTT |
| FOXK1_1 | AAAATGTAAACAAACAG | CTGTTTGTTTACATTTT |
| HOXC10_Hoxc10_1_SELEX\|HOXC10_5 | GTCATAAAAA | TTTTTATGAC |
| YY1_pho1_SOLEXA_5_FBgn0035997_B1H | AACAAATGGCGGCC | GGCCGCCATTTGTT |
| ESR2_V$ER_C16_Transfac\|ESRRA_known1 | ACAGGTCACTGTGACCT GA | TCAGGTCACAGTGACCT GT |

TABLE 5-continued

Transcription Factor Binding Sites of Synthetic Promoters

| Name | Binding Site Sequence | Reverse Complement |
|---|---|---|
| RARG_Rara_1_SELEX\|RARA_8 | AAAGGTCAAGAGAGGTCA | TGACCTCTCTTGACCTTT |
| EGR1_known5 | CCGCCCACGCA | TGCGTGGGCGG |
| CENPB_CENPB_1_SELEX\|CENPB_1 | CCCGCATACAACGAA | TTCGTTGTATGCGGG |
| BATF_disc2 | AAGTTTCAC | GTGAAACTT |
| TCF4_Fer1_da_SANGER_10_FBgn0000413_B1H\|PTF1A_Fer1_da_SANGER_10_FBgn0037475_B1H | AACACCTGTCA | TGACAGGTGTT |
| IRF_disc3 | AAGTGAAAGTGAAAG | CTTTCACTTTCACTT |
| MNT_pTH4588_PBM | GCACGTGCA | TGCACGTGC |
| RXRA_disc5 | AGAGGGCG | CGCCCTCT |
| POU3F3_POU2F1_1_SELEX\|POU2F2_known15 | AATATGCAAATT | AATTTGCATATT |
| PBX3_disc2 | CTGTCACTCA | TGAGTGACAG |
| RELA_GM12891_NFKB_Stanford_ChIP-seq | CTGGGAAATCCCCTA | TAGGGGATTTCCCAG |
| NR2C2_disc1 | TGACCCGGAA | TTCCGGGTCA |
| CUX1_CUX2_1_SELEX\|CUX2_1 | ATCGATAAAATTATCGAT | ATCGATAATTTTATCGAT |
| ZNF143_ZN143_si_HocoMoco | GCAAGGCATTCTGGGAAGTGTA | TACACTTCCCAGAATGCCTTGC |
| MSX1_Dr_Cell_FBgn0000492_B1H | GACCAATTA | TAATTGGTC |
| ATF3_K562_ATF3_Harvard_ChIP-seq | GGTGACGTGA | TCACGTCACC |
| MYC_known12 | CACGTGC | GCACGTG |
| SP2_disc1 | AGCCAATGGGA | TCCCATTGGCT |
| ETV5_HeLa-53_GABP_HudsonAlpha_ChIP-seq | GAACCGGAAGTGGC | GCCACTTCCGGTTC |
| NFY_disc1 | ACCAGCCAATCAGAG | CTCTGATTGGCTGGT |
| TFAP4_4 | ACCAGCTGC | GCAGCTGGT |
| PAX9_GM12891_PAX5C20_HudsonAlpha_ChIP-seq | CAGCCAAGCGTGACC | GGTCACGCTTGGCTG |
| FOXO6_V$FOXO1_01_Transfac\|FOXO1_1 | CATAAACAAA | TTTGTTTATG |
| SPI1_known1 | AGAGGAAG | CTTCCTCT |
| BARX1_BARX2_si_HocoMoco | CAATTAATGA | TCATTAATTG |
| MAX_MAX_2_SELEX\|MYC_known21 | ACCACGTGCT | AGCACGTGGT |
| HSF1_HepG2_HSF1_Stanford_ChIP-seq | GGGATTCGAACCCGGAC | GTCCCGGGTTCGAATCCC |
| RELA_GM18526_NFKB_Stanford_ChIP-seq | AAGGGGATTTCCAAA | TTTGGAAATCCCCTT |
| STAT_known13 | CATTTCTA | TAGAAATG |
| VDR_VDR_f1_HocoMoco\|RARG_RARA_f1_HocoMoco\|RARG_RARGJ1_HocoMoco\|RORB_pTH5508_PBM | GAGGTCA | TGACCTC |
| RELA_GM18505_NFKB_Stanford_ChIP-seq | AAGGGGATTTCCAAG | CTTGGAAATCCCCTT |
| FOXP4_FOXP2_si_HocoMoco | AGTAAACAA | TTGTTTACT |
| CTCF_AG10803_CTCF_UW_ChIP-seq | GCCACTAGAGGGC | GCCCTCTAGTGGC |
| NFATC1_NFAC3_f1_HocoMoco | AGTTTTCCA | TGGAAAACT |
| HOXA4_GSX2_1_SELEX\|GSX2_2\|HOXB5_2 | ACTAATTAAA | TTTAATTAGT |

TABLE 5-continued

Transcription Factor Binding Sites of Synthetic Promoters

| Name | Binding Site Sequence | Reverse Complement |
|---|---|---|
| HOXC5_HOXB5_1_SELEX | ACTAATTAAG | CTTAATTAGT |
| TP73_GSE15704_TP73_vehicle_ChIP-seq | GGACATGCCCAGGCATGCC | GGCATGCCTGGGCATGTCC |
| FOXJ1_2 | AAAGTAAACAAAAATT | AATTTTTGTTTACTTT |
| ZNF740_Zfp740_0925_PBM | CCCCCCCACG | CGTGGGGGGG |
| ZNF740_pTH2857_PBM | CCCCCCCACA | TGTGGGGGGG |
| YY2_pho_FlyReg_FBgn0002521_B1H | GAAGCCATAACGGC | GCCGTTATGGCTTC |
| FOXD1_FOXB1_2_SELEX\|FOXB1_2 | TATGTAAATATTGACATA | TATGTCAATATTTACATA |
| E2F_known16\|E2F_known20 | CGCGCCAAA | TTTGGCGCG |
| ENSG00000250096_RUNX3_2_SELEX\|ENSG00000250096_RUNX3_4_SELEX\|RUNX3_2\|RUNX3_4 | AAACCGCAAA | TTTGCGGTTT |
| RFX8_MA0600.1_ChIP-seq | CCGCGGTTGCCATGGCAAC | GTTGCCATGGCAACCGCGG |
| KLF4_CG12029_SANGER_10_FBgn0035454_B1H | GCCACACCCAC | GTGGGTGTGGC |
| XBP1_pTH5019_PBM | ACACGTCAC | GTGACGTGT |
| HMX1_HMX3_1_SELEX\|HMX3_3 | AGCAATTAACA | TGTTAATTGCT |
| NRF1_known1 | CGCATGCGCA | TGCGCATGCG |
| AP1_disc10 | CCCGCCCCC | GGGGGCGGG |
| USF2_USF2_f1_HocoMoco | GCCCACGTGAC | GTCACGTGGGC |
| NFE2_N_F2L2_si_HocoMoco | CATGACTCAGCA | TGCTGAGTCATG |
| ETV4_1 | ACATCCT | AGGATGT |
| CR936877.3_RXRGJ1_HocoMoco | GGTCAAAGGTCAC | GTGACCTTTGACC |
| REST_disc1 | GTCCATGGTGCTGAA | TTCAGCACCATGGAC |
| ZBTB1_pTH2366_PBM | GTCCCGCAAC | GTTGCGGGAC |
| OVOL1_ovo_SOLEXA_5_FBgn0003028_B1H | AGTACCGTTATTTG | CAAATAACGGTACT |
| PAX9_PAX9_1_SELEX\|PAX9_PAX1_1_SELEX\|PAX1_2\|PAX9_1 | CGTCACGCATGACTGCA | TGCAGTCATGCGTGACG |
| STAT2_K562_STAT2_Stanford_ChIP-seq | GAAAATGAAACTGAA | TTCAGTTTCATTTTC |
| PTEN_1 | CCCCAAGTGAAGG | CCTTCACTTGGGG |
| RARG_RARG_3_SELEX\|RARG_3 | AAGGTCACCAGAGGTCA | TGACCTCTGGTGACCTT |
| TFAP2A_TFAP2C_2_SELEX\|TFAP2A_TFAP2C_6_SELEX\|TFAP2A_TFAP26_2_SELEX\|TFAP26_3\|TFAP2_known15\|TFAP2_known19 | AGCCTCAGGCA | TGCCTGAGGCT |
| LBX2_LBX2_1_SELEX\|LBX2_2 | CTCGACCTAATTA | TAATTAGGTCGAG |
| PAX9_pTH8679_PBM | CAGTCAAGCG | CGCTTGACTG |
| NR3C1_known10 | CCCCCAAGAACACCATGTCCCCCCCCC | GGGGGGGGGACATGGTGTTCTTGGGGG |
| GFI16_1 | TAAATCACTGCA | TGCAGTGATTTA |
| FOXD1_Foxg1_2_SELEX\|FOXG1_4 | CCGGACACAATC | GATTGTGTCCGG |
| DMBX1_ARX_1_SELEX\|DMBX1_CART1_1_SELEX\|ARX_2\|ALX1_6 | TTAATTAAATTAA | TTAATTTAATTAA |

TABLE 5-continued

Transcription Factor Binding Sites of Synthetic Promoters

| Name | Binding Site Sequence | Reverse Complement |
|---|---|---|
| REST_MA0138.2_ChIP-seq\|REST_PANC-1_NRSF_HudsonAlpha_ChIP-seq\|REST_known4 | GGCGCTGTCCATGGTGCTGAA | TTCAGCACCATGGACAGCGCC |
| RFX8_HeLa-S3_RFX5_Stanford_ChIP-seq | CCTAGCAACAGATGA | TCATCTGTTGCTAGG |
| SIX5_Six4_SOLEXA_FBgn0027364_B1H | AATTGATA | TATCAATT |
| TP63_P63_si_HocoMoco | GAGACATGTCC | GGACATGTCTC |
| HINFP_MA0131.1_SELEX\|HINFP_1 | GCGGACGTTA | TAACGTCCGC |
| MITF_MITF_f1_HocoMoco | ATCACATGAC | GTCATGTGAT |
| PAX9_V$PAX5_01_Transfac\|PAX5_known1 | GGGGCGGCTACGCATCATTGCGCCTCGA | TCGAGGCGCAATGATGCGTAGCCGCCCC |
| NR3C1_known12 | TCGTGCTCA | TGAGCACGA |
| BHLHE40_Blhb2_2_SELEX | AGCACGTGAC | GTCACGTGCT |
| FOXD1_T-47D_FOXA1_HudsonAlpha_ChIP-seq | CTGAGTAAACA | TGTTTACTCAG |
| LMO2_1 HMX1_Hmx1_3423_PBM | CGCCAGGTGCAG AAGCAATTAA | CTGCACCTGGCG TTAATTGCTT |
| BHLHE40_disc2 | CAGCAGCCGCCGGCGCG | CGCGCCGGCGGCTGCTG |
| IRX2_1 | AATTTTACATGTATTTA | TAAATACATGTAAAATT |
| ESR2_pTH6055_PBM | CAGGTCAA | TTGACCTG |
| TCF4_pTH4580_PBM | GAACACCTGC | GCAGGTGTTC |
| HOXC5_I$UBX_01_Transfac | ACGAAGCCATTAAGCCCTC | GAGGGCTTAATGGCTTCGT |
| STAT_known10 | GATTTCCC | GGGAAATC |
| EGR3_EGR3_1_SELEX\|EGR3_EGR2_2_SELEX\|EGR1_known11\|EGR3_2 | AGTGCGTGGGCGTAG | CTACGCCCACGCACT |
| E2F3_E2F3_3_SELEX\|E2F_known26 | AATTTTGGCGCCAAAACT | AGTTTTGGCGCCAAAAT T |
| IRF6_1 | ACTTTGGTTTCGATCAG | CTGATCGAAACCAAAGT |
| NFATC1_NFATC1_1_SELEX\|NFATC1_1 | AATGGAAAATTATTTTCCCT | AGGGAAAATAATTTTCCATT |
| NROB1_NROB1_si_HocoMoco | GCGTGGGAGA | TCTCCCACGC |
| HIC1_HIC1_si_HocoMoco | GGGCAACCC | GGGTTGCCC |
| TCF4_net_da_SANGER_10_FBgn0000413_B1H\|ATOH8_net_da_SANGER_10_FBgn0002931_B1H\|SCRT1_CG17181_SANGER_5_FBgn0035144_B1H | ACAGGTGGT | ACCACCTGT |
| CREB3L1_CREB3_2_SELEX\|CREB3_2 | GTGCCACGTCATCA | TGATGACGTGGCAC |
| CEBPA_pTH5250_PBM | ATTGCGTAA | TTACGCAAT |
| TBX3_TBX2_f1_HocoMoco | GTCGCTTCTCACACCTCTGATGGCA | TGCCATCAGAGGTGTGAGAAGCGAC |
| NR3C1_known14 | GGGAACATTATGTCCTAA | TTAGGACATAATGTTCCC |
| XBP1_V$XBP1_01_Transfac\|XBP1_1 | ATAGGACACGTCATCAT | ATGATGACGTGTCCTAT |
| ESR2_pTH3510_PBM | GAGGTCATGC | GCATGACCTC |

TABLE 5-continued

Transcription Factor Binding Sites of Synthetic Promoters

| Name | Binding Site Sequence | Reverse Complement |
|---|---|---|
| TEAD1_TEAD1_f1_HocoMoco | CACATTCCTGCGCC | GGCGCAGGAATGTG |
| EMX2_EMX1_2_SELEX\|EMX2_E MX2_2_SELEX\|EMX1_2\|EMX2_3 | TAATTAGCTAATTA | TAATTAGCTAATTA |
| YY2_YY2_1_SELEX\|YY2_1 | GTCCGCCATTA | TAATGGCGGAC |
| NKX2-5_vnd_FlyReg_FBgn0003986_B1H | GCACTTGAGC | GCTCAAGTGC |
| ESR2_MA0258.2_ChIP-seq\|ESRRA_disc1 | AGGTCACCCTGACCT | AGGTCAGGGTGACCT |
| EGR3_pTH5337_PBM | ATGCGTGGG | CCCACGCAT |
| GATA2_Gata6_3769_PBM\|GATA2_GATA2_si_HocoMoco\|HMGN3_disc2 | CAGATAAG | CTTATCTG |
| POU1F1_POU1F1_1_SELEX\|POU1F1_4 | CATTAATTATGCATGAG | CTCATGCATAATTAATG |
| YY2_H1-hESC_YY1_HudsonAlpha_ChIP-seq | CAAGATGGCGGCCCC | GGGGCCGCCATCTTG |
| HNF1A_HNF1B_2_SELEX\|HNF1A_HNF1A_1_SELEX\|HNF1A_4\|HNF1B_4 | AGTTAATCATTAACT | AGTTAATGATTAACT |
| FOSL1_HepG2_FOSL2_HudsonAlpha_ChIP-seq | CAGGATGAGTCACC | GGTGACTCATCCTG |
| IRF6_Irf6_3803_PBM | GACCGAAACC | GGTTTCGGTC |
| MSX1_Msx3_3206_PBM\|MSX1_Msx2_3449_PBM\|NOBOX_MA0125.1_SELEX\|NOBOX_1 | ACCAATTA | TAATTGGT |
| NKX2-5_Ceh-22_PBM\|ISL2_ISL2_1_SELEX\|ISL2_2 | GCACTTAA | TTAAGTGC |
| FOXD1_MA0042.1_SELEX\|FOXI1_2 | AAACAAACATCC | GGATGTTTGTTT |
| TFAP2E_1 | ATCGCCTCAGGCAAT | ATTGCCTGAGGCGAT |
| ARID3C_ARI3A_f1_HocoMoco | AATTAAA | TTTAATT |
| CUX1_V$CDPCR3_01_Transfac\|CUX1_4 | CACCAATATGTATGG | CCATACATATTGGTG |
| MYC_known14 | GACCACGTGGTC | GACCACGTGGTC |
| TBX3_SRP001585_Tbx2_ChIP-seq | AAACTACAATTCCCAGAATGC | GCATTCTGGGAATTGTAGTTT |
| POU3F2_4 | CAAACTAATTAATTATC | GATAATTAATTAGTTTG |
| USF1_pTH5265_PBM | ACCACGTGAT | ATCACGTGGT |
| HES4_dpn_SANGER_10_FBgn0010109_B1H | GGCACGTGCCA | TGGCACGTGCC |
| MYBL1_Mybl1_1717_PBM | TAACGGTCA | TGACCGTTA |
| KIAA0415_pTH9655_PBM | ATTGTAAACAA | TTTGTTTACAAT |
| TCF4_MA0521.1_ChIP-seq | AACAGCTGCAG | CTGCAGCTGTT |
| ETV5_HeLa-53_ELK4_UCD_ChIP-seq | CACTTCCGGCC | GGCCGGAAGTG |
| NKX2-5_Vnd_SOLEXA_FBgn0003986_B1H\|NKX-6_Tin_Cell_FBgn0004110_B1H | CACTTGAG | CTCAAGTG |
| SOX18_SOX18_1_SELEX\|SOX18_2 | AACAATGAAATTGTT | AACAATTTCATTGTT |
| TCF7L2_known5 | AATCCCTTTGATCTATC | GATAGATCAAAGGGATT |
| HNF4G_HNF4A_1_SELEX\|HNF4_known16 | GAGTCCAAAGTCCATC | GATGGACTTTGGACTC |
| GMEB2_GME B2_3_SELEX\|GMEB2_3 | TACGTAACTGACGTA | TACGTCAGTTACGTA |
| HOXC5_Hoxd3_1742_PBM\|HOXC10_Hoxc10_2779_PBM | GTCATTAA | TTAATGAC |

TABLE 5-continued

Transcription Factor Binding Sites of Synthetic Promoters

| Name | Binding Site Sequence | Reverse Complement |
| --- | --- | --- |
| ATF7_Creb5_1_SELEX\|CREB5_1 | AATGACGTCACC | GGTGACGTCATT |
| CR936877.3_I$CF1_02_Transfac\|CR936877.3_I$CF1_01_Transfac | CGTGACCCC | GGGGTCACG |
| VDR_2 | CCCGGTGAACCC | GGGTTCACCGGG |
| GATA2_GATA3_si_HocoMoco | CTTATCTC | GAGATAAG |
| LHX1_MA0135.1_SELEX\|LHX3_2 | AAATTAATTAATC | GATTAATTAATTT |
| GMEB1_pTH9026_PBM\|GMEB1_pTH8745_PBM | CGTACGTCA | TGACGTACG |
| SMAD4_1 | AGGTGGCTGCCCCAC | GTGGGGCAGCCACCT |
| ETS_disc8 | AACGGAAG | CTTCCGTT |
| FUBP1_FUBP1_f1_HocoMoco | AAAAAAACACAA | TTGTGTTTTTTT |
| ZNF143_GM12878_ZNF143_Stanford_ChIP-seq | CTGGGAATTGTAGTC | GACTACAATTCCCAG |
| NKX3-1_V$NKX3A_01_Transfac\|NKX3-1_1 | AAATAAGTATAT | ATATACTTATTT |
| NR2E1_pTH2936_PBM | AAAGTCAATT | AATTGACTTT |
| ZBTB7A_known1 | AGGGCCCCC | GGGGGCCCT |
| MSX1_2 | GAATTAATTAGTTGCA | TGCAACTAATTAATTC |
| HOXD10_1 | AATGCAATAAAATTTAT | ATAAATTTTATTGCATT |
| ETS_disc6 | AAATCTCGCG | CGCGAGATTT |
| TFAP2_known4 | CCCTCCGCCTGGGGC | GCCCCCAGGCGGAGGG |
| TBX20_pTH9340_PBM | AGGTGTCA | TGACACCT |
| FOXJ3_YIL131C_2002_DeBoer11 | ATGTAAACAAGC | GCTTGTTTACAT |
| SOX1_SOX2_3_SELEX\|SOX2_4 | CATCAATAACATTGATC | GATCAATGTTATTGATG |
| CTCF_GM12878_CTCF_UW_ChIP-seq | GCCACCAGGGGCGCCA | TGGCGCCCCTGGTGGC |
| GATA2_GATA1_si_HocoMoco | ACAGATAAGG | CCTTATCTGT |
| RAD21_disc2 | CCACTAGA | TCTAGTGG |
| GATA2_K562_GATA2_UChicago_ChIP-seq | ACAGATAAGA | TCTTATCTGT |
| NKX2-1_2 | CCCTCAAGAGCC | GGCTCTTGAGGG |
| SNAI2_wor_SANGER_2.5_FBgn0001983_B1H\|ASCL2_I_1_sc_da_SANGER_5_FBgn0002561_B1H\|TCF4_ase_da_SANGER_10_FBgn0000413_B1H\|TCF4_I_1_sc_da_SANGER_5_FBgn0000413_B1H | CACCTGC | GCAGGTG |
| HOXB7_1 | GTAGTAATTAATGCAA | TTGCATTAATTACTAC |
| POU5F1_disc2 | ATGAATATGC | GCATATTCAT |
| FOXD1_FOXG1_1_SELEX\|FOXG1_1 | ATAAACAATTGTAAACA | TGTTTACAATTGTTTAT |
| HAND1_2 | ATGCCAGACC | GGTCTGGCAT |
| AR_pTH1739_PBM | TAGGAACATA | TATGTTCCTA |
| FOXP4_CG16899_SANGER_5_FBgn0037735_B1H | GATAAACAA | TTGTTTATC |
| HNF1_3 | ACTGTTAATTATTAACCA | TGGTTAATAATTAACAGT |
| SREBF2_pTH0914_PBM | ATCACGCGAT | ATCGCGTGAT |
| IRF_known13 | CAAAATCGAAACTAA | TTAGTTTCGATTTTG |

TABLE 5-continued

Transcription Factor Binding Sites of Synthetic Promoters

| Name | Binding Site Sequence | Reverse Complement |
| --- | --- | --- |
| TCF4_ITF2_f1_HocoMoco | CCAGGTGCA | TGCACCTGG |
| NFKB_disc3 | AAATCCCTC | GAGGGGATTT |
| OSR2_Osr2_1727_PBM | AACGGTAGCA | TGCTACCGTT |
| NR1H3_NR1H4_f1_HocoMoco | AGGGTCAATGACCT | AGGTCATTGACCCT |
| IRF_known5 | AAAATGAAACTG | CAGTTTCATTTT |
| HMGA2_pTH9279_PBM | AGAAAAAT | ATTTTTCT |
| EGR3_EGR2_1_SELEX\|EGR1_known10 | ACGCCCACGCA | TGCGTGGGCGT |
| NR2E1_pTH5561_PBM | AATTGACAT | ATGTCAATT |
| PITX2_2 | GATGATTAATCCCTTCA | TGAAGGGATTAATCATC |
| POU3F3_pTH9365_PBM | ATAATGAA | TTCATTAT |
| TCF4_HLH54F_da_SANGER_5_FBgn0000413_B1H\|MSC_HLH54F_da_SANGER_5_FBgn0022740_B1H | AACACCTGTTG | CAACAGGTGTT |
| HBP1_HBP1_f1_HocoMoco | ACTCATTGA | TCAATGAGT |
| HNF4G_Hnf4_SANGER_5_FBgn0004914_B1H\|NR2F2_NR2F1_3_SELEX\|HNF4_known25 | GGGGTCAA | TTGACCCC |
| TFAP2B_1 | ATGCCCTAGGGCAA | TTGCCCTAGGGCAT |
| CR936877.3_pTH2861_PBM\|CR936877.3_pTH2880_PBM\|NR2F2_pTH5516_PBM | GGGGTCAC | GTGACCCC |
| AFP_1 | ATTAACTACAC | GTGTAGTTAAT |
| OLIG2_Oli_da_SANGER_5_2_FBgn0032651_B1H\|TCF4_Oli_da_SANGER_5_2_FBgn0000413_B1H | ACCGCACCATCTGTC | GACAGATGGTGCGGT |
| NFATC1_NFAC1_si_HocoMoco | AATTTTCCATTG | CAATGGAAAATT |
| ETV5_V$ELK1_02_Transfac\|ETS_known2 | CCAACCGGAAGTCC | GGACTTCCGGTTGG |
| TCF4_tap_da_SANGER_5_FBgn0000413_B1H\|NEUROG1_tap_da_SANGER_5_FBgn0015550_B1H | CCATATGTCAC | GTGACATATGG |
| GFI1_2 | CGAAATCACGGCC | GGCCGTGATTTCG |
| NKX2-5_MA0122.1_SELEX\|N KX3-2_1 | TCCACTTAA | TTAAGTGGA |
| MXI1_HeLa-S3_MXI1_Stanford_ChIP-seq | CACGTGGTTCC | GGAACCACGTG |
| EVX2_1 | AACGCTAATTAGCGGTG | CACCGCTAATTAGCGTT |
| ETV5_MA0098.2_ChIP-seq | CCCACTTCCTGTCTC | GAGACAGGAAGTGGG |
| RXRA_disc2 | CGGCCACCAGGGGCGCCGGA | TCCGGCGCCCCTGGTGGCCG |
| MEIS1::HOXA9_2 | CCATAAAACTGTCA | TGACAGTTTTATGG |
| IRX3_Irx6_2623_PBM | ATTACAA | TTGTAAT |
| SOX13_MA0515.1_ChIP-seq | AAAACAATGG | CCATTGTTTT |
| OBOX5_1 | GAAATTTAATCCCTCTA | TAGAGGGATTAAATTTC |
| ZNF410_1 | TATTATGGGATGGATAA | TTATCCATCCCATAATA |
| GATA_known18 | CAATTCTTATCTCTATA | TATAGAGATAAGAATTG |
| MITF_Mitf_SANGER_5_FBgn0263112_B1H | CACGTGA | TCACGTG |

TABLE 5-continued

Transcription Factor Binding Sites of Synthetic Promoters

| Name | Binding Site Sequence | Reverse Complement |
|---|---|---|
| SCXA_CG33557_da_SANGER_5_FBgn0053557_B1H\|TCF4_CG33557_da_SANGER_5_FBgn0000413_B1H | CCAGATGGCACGGACACAACA | TGTTGTGTCCGTGCCATCTGG |
| SMC3_disc3 | CCAGGGGCGC | GCGCCCCTGG |
| ALX1_PRRX1_3_SELEX\|PROP1_PROP1_2_SELEX\|PROP1_31PRRX1_4 | TAATCTAATTA | TAATTAGATTA |
| ZBTB42_ZN238_a_HocoMoco | GCGAAACATCTGGA | TCCAGATGTTTCGC |
| MAX_Max_Mnt_SANGER_5_FBgn0017578_B1H\|MYC_known17 | CACGTGG | CCACGTG |
| MTF1_MTF1_f1_HocoMoco | AGTGCCGTGTGCAAAAC | GTTTTGCACACGGCACT |
| PAX2_PAX2_si_HocoMoco | GCATGAC | GTCATGC |
| SIX5_known4 | ATAAGTGATACCCTATC | GATAGGGTATCACTTAT |
| NOBOX_pTH5791_PBM | ACCAATTAAG | CTTAATTGGT |
| BSX_pTH6569_PBM\|ESX1_ESX1_1_SELEX\|GBX2_Gbx1_1_SELEX\|ESX1_ESX1_2_SELEX\|ESX1_2\|ESX1_3\|GBX1_3 | ACCAATTAAC | GTTAATTGGT |
| TCF4_amos_da_SANGER_10_FBgn0000413_B1H\|ATOH7_amos_da_SANGER_10_FBgn0003270_B1H | ACCATCTGCCG | CGGCAGATGGT |
| SP9_SP4_f1_HocoMoco | CGGCCCCGCCCCCCCCTGGCCCC | GGGGCCAGGGGGGGGCGGGGCCG |
| NPAS3_EPAS1_si_HocoMoco | CCCACGTACGCAC | GTGCGTACGTGGG |
| ESRRG_ERR2_f1_HocoMoco\|NR5A1_STF1_f1_HocoMoco\|ESRRG_ERR1_f1_HocoMoco\|ESRRG_ERR3_f1_HocoMoco\|NR5A1_2 | TCAAGGTCA | TGACCTTGA |
| DOBOX5_1 | GATAATTAATCCCTTCC | GGAAGGGATTAATTATC |
| HOXC6_Hoxc8_3429_PBM | GGCAATTAA | TTAATTGCC |
| NFE2_NFE2_f2_HocoMoco | AGCATGACTCAGCA | TGCTGAGTCATGCT |
| MYC_known15 | AACCACGTGA | TCACGTGGTT |
| MXI1_disc2 | AACCACGTGG | CCACGTGGTT |
| ELF3_Elf3_PBM | ACCCGGAAAT | ATTTCCGGGT |
| RORB_MA0072.1_SELEX\|RORA_5 | TATAAGTAGGTCAA | TTGACCTACTTATA |
| ARNT2_pTH5159_PBM | ATTCATGTGC | GCACATGAAT |
| KLF4_KLF1_f1_HocoMoco | CAGGGTGTGGC | GCCACACCCTG |
| HOXA4_zen2_SOLEXA_2_FBgn0004054_B1H | GTCATTAAGA | TCTTAATGAC |
| RARA_1 | CAGGTGACCTTTGAGA | TCTCAAAGGTCACCTG |
| NRF1_disc3 | CCCCGCCCGC | GCGGGCGGGG |
| FOXD1_Foxg1_1_SELEX\|FOXG1_3 | ATAAACAAGTGTAAACA | TGTTTACACTTGTTTAT |
| GCM1_pTH9386_PBM\|GCM1_pTH9259_PBM\|GCM1_pTH8361_PBM | ACCCGCAT | ATGCGGGT |
| SP9_Sp1_SOLEXA_2.5_FBgn0020378_B1H | AAGTGGGCGTGGCC | GGCCACGCCCACTT |
| SIN3A_disc5 | CAGCACCAGG | CCTGGTGCTG |
| POU3F3_GM12878_OCT2_HudsonAlpha_ChIP-seq\|POU3F3_GM12878_POU2F2_HudsonAlpha_ChIP-seq\|NANOG_disc1\|TATA_disc9 | ATATGCAAAT | ATTTGCATAT |
| E2F6_E2F6_f1_HocoMoco | CCTTCCCGCCCA | TGGGCGGGAAGG |

TABLE 5-continued

Transcription Factor Binding Sites of Synthetic Promoters

| Name | Binding Site Sequence | Reverse Complement |
|---|---|---|
| NR2F2_COT2_f1_HocoMoco\|RXRA_disc1 | CAAAGGTCAA | TTGACCTTTG |
| NR4A2_NR4A3_f1_HocoMoco | CAAAGGTCAG | CTGACCTTTG |
| JUN_MA0489.1_ChIP-seq | AGGAGATGACTCAT | ATGAGTCATCTCCT |
| HOXC5_Ipf1_3815_PBM | CTAATGGC | GCCATTAG |
| ENSG00000250096_RUNX2_2_SELEX\|ENSG00000250096_RUNX3_3_SELEX\|RUNX2_5\|RUNX3_3 | TAACCGCAAAAACCGCAA | TTGCGGTTTTTGCGGTTA |
| JUN_K562_JUND_UChicago_ChIP-seq | AAGTATGAGTCATCA | TGATGACTCATACTT |
| WT1_1 | CCCTCCCCC | GGGGGAGGG |
| HNF1A_3 | ATTTTAGTTAACTAAGG | CCTTAGTTAACTAAAAT |
| DRGX_MA0467.1_ChIP-seq | AAGAGGATTAG | CTAATCCTCTT |
| FOSL1_K562_CFOS_UChicago_ChIP-seq | GAGGATGAGTCACCA | TGGTGACTCATCCTC |
| MYB_V$VMYB_02_Transfac | GCCGTTAGA | TCTAACGGC |
| AR_NR3C1_1_SELEX\|NR3C1_known18 | GGGAACATTATGTACCC | GGGTACATAATGTTCCC |
| HOXA5_1 | TGCCAACTCCCCCATTAGTGCTCGACTCCA | TGGAGTCGAGCACTAATGGGGGAGTTGGCA |
| OBOX5_2 | AAGAGGGATTAATTATC | GATAATTAATCCCTCTT |
| PHOX2A_1 | CAGCATTAATTAGTAG | CTACTAATTAATGCTG |
| SOX17_Sox17_2837_PBM | AGGATGAAT | ATTCATCCT |
| ALX1_CG33980_SOLEXA_2_0_FBgn0053980_B1H | CTTAATTAGC | GCTAATTAAG |
| FOXD1_Mw164_ChIP-seq | CTGTTTAC | GTAAACAG |
| GATA_known16 | CTTTATTTCTTATCTCTAAAAA | TTTTTAGAGATAAGAAATAAAG |
| FOSL2_FOSL2_f1_HocoMoco | ATGACTCATCC | GGATGAGTCAT |
| GATA_known7 | AGATAAGGCCT | AGGCCTTATCT |
| NFE2_K562_NFE2_Stanford_ChIP-seq | AAAATTGCTGAGTCATG | CATGACTCAGCAATTTT |
| MYF_1 | CAGCAGCTGCTG | CAGCAGCTGCTG |
| ZEB1_Mv136_ChIP-seq | CACACACCTG | CAGGTGTGTG |
| RORB_MA0071.1_SELEX\|RORA_4 | ATCAAGGTCA | TGACCTTGAT |
| ZBTB33_MA0527.1_ChIP-seq | CAGATCTCGCGAGAG | CTCTCGCGAGATCTG |
| ZEB1_ZEB1_do_HocoMoco\|SNAI2_esg_SANGER_2.5_FBgn0001981_B1H | ACAGGTG | CACCTGT |
| CTCF_HeLa-S3_CTCF_UT-A_ChIP-seq | GCCACCAGGGGCAC | GTGCCCCTGGTGGC |
| AL662830.5_PBX1_do_HocoMoco | AATTTGATTGATGGG | CCCATCAATCAAATT |
| BRCA1_known1 | CAACAGAA | TTCTGTTG |
| NKX2-5_Nkx2-9_3082_PBM | AGCACTTAAG | CTTAAGTGCT |
| HOXD3_1 | AGGTTAATTAACTCAA | TTGAGTTAATTAACCT |
| DMRTA2_pTH9188_PBM | AATGTATCAAT | ATTGATACATT |
| TP53_Tp53_1_SELEX\|TP53_5 | ACATGTCCATGGACATGT | ACATGTCCATGGACATGT |
| MITF_TFEB_f1_HocoMoco | CACGTGACC | GGTCACGTG |
| POU3F3_pTH9256_PBM\|POU3F3_pTH9297_PBM | ATAATTCATA | TATGAATTAT |

TABLE 5-continued

Transcription Factor Binding Sites of Synthetic Promoters

| Name | Binding Site Sequence | Reverse Complement |
|---|---|---|
| ZKSCAN3_ZNF306_1_SELEX\|ZKSCAN3_1 | TCGAGGCTAGACCA | TGGTCTAGCCTCGA |
| REST_HTB-11_NRSF_HudsonAlpha_ChIP-seq\|REST_HepG2_NRSF_HudsonAlpha_ChIP-seq | TCAGCACCATGGACA | TGTCCATGGTGCTGA |
| SOX1_Sox1_2631_PBM | AAAGATGAAT | ATTCATCTTT |
| NPAS2_pTH5056_PBM | GCCACGTGGC | GCCACGTGGC |
| SOX9_SOX8_8_SELEX\|SOX8_9 | AATCAATTGCAGTGATT | AATCACTGCAATTGATT |
| GCM1_GCM1_3_SELEX\|GCM1_4 | CATGCGGGTAC | GTACCCGCATG |
| HES4_I$HAIRY_01_Transfac | ATGGCGCGTGCCGC | GCGGCACGCGCCAT |
| EN2_EN1_1_SELEX\|EN2_EN2_2_SELEX\|EN1_4\|EN2_3 | CCCAATTAGC | GCTAATTGGG |
| ZNF628_1 | CAAGGTTGGTTGC | GCAACCAACCTTG |
| CTCF_AG04449_CTCF_UW_ChIP-seq | CCACCAGGGGCGCCG | CGGCGCCCCTGGTGG |
| SIX5_disc4 | AAAACTACAA | TTGTAGTTTT |
| FOXD1_fkh_NAR_FBgn0000659_B1H\|FOXD1_Mf15_ChIP-seq\|FOXD1_MA0446.1_B1H | TGTTTGCTTAA | TTAAGCAAACA |
| DMRT3_1 | AAAATGTATCAAATT | AATTTGATACATTTT |
| NRF1_MA0506.1_ChIP-seq | GCGCCTGCGCA | TGCGCAGGCGC |
| SCRT2_scrt_SANGER_2.5_FBgn0004880_B1H | ACCACCTGTTG | CAACAGGTGGT |
| UBP1_pTH8565_PBM | AACCGGTTA | TAACCGGTT |
| ETV6_ETV6_2_SELEX\|ETV6_2 | AGCGGAAGTG | CACTTCCGCT |
| FOXA_known3 | ATAAACAAACAGA | TCTGTTTGTTTAT |
| FOXD1_FOXJ3_si_HocoMoco | AAAAAATAAACAA | TTGTTTATTTTT |
| HMBOX1_HM BOX1_1_SELEX\|HMBOX1_2 | ACTAGTTAAC | GTTAACTAGT |
| FOXD1_MA0458.1_B1H\|FOXD1_slp1_NAR_FBgn0003430_B1H | AATGTAAACAA | TTGTTTACATT |
| SOX9_SOX8_5_SELEX\|SOX8_6 | TGAATGTGCAGTCA | TGACTGCACATTCA |
| NFY_known1 | GTGATTGGTTA | TAACCAATCAC |
| JUN_HepG2_JUND_Stanford_ChIP-seq | AAGGTGACGTCATCA | TGATGACGTCACCTT |
| HES4_h_SANGER_5_FBgn0001168_B1H | GGCACGCGCC | GGCGCGTGCC |
| JUN_V$VJUN_01_Transfac | CCGATGACGTCATCCC | GGGATGACGTCATCGG |
| AHR::ARNT_1 | GGGCACGCAACCCTTA | TAAGGGTTGCGTGCCC |
| NFY_known4 | CAGCCAATGAG | CTCATTGGCTG |
| TCF4_V$E47_01_Transfac | CCGGCAGGTGTCCGC | GCGGACACCTGCCGG |
| AP1_known7 | CCCCTTGAGTCA | TGACTCAAGGGG |
| MAFK_MA0495.1_ChIP-seq | AAAAATTGCTGACTCAGC | GCTGAGTCAGCAATTTT |
| KLF4_luna_SANGER_5_FBgn0040765_B1H | GGCAACGCCC | GGGCGTTGCC |
| MAFB_Mafb_2914_PBM | AAATTGCTGACGT | ACGTCAGCAATTT |
| IRF4_IRF4_si_HocoMoco | AAAAAAGAAAATGAAA | TTTCATTTTCTTTTTT |
| HLTF_1 | AACCTTATAT | ATATAAGGTT |
| NHLH2_MA0048.1_SELEX\|NHLH1_3 | ACGCAGCTGCGC | GCGCAGCTGCGT |

TABLE 5-continued

Transcription Factor Binding Sites of Synthetic Promoters

| Name | Binding Site Sequence | Reverse Complement |
|---|---|---|
| ARID3C_I$DRI_01_Transfac | TATTAATCGA | TCGATTAATA |
| HES4_MA0449.1_B1H\|HES5_pTH5450_PBM\|TCFL5_pTH4576_PBM\|HES4_h_NAR_FBgn0001168_B1H | GGCACGTGCC | GGCACGTGCC |
| POU2F2_known7 | AAATATGCAAATCAC | GTGATTTGCATATTT |
| AR_V$GRE_C_Transfac\|NR3C1_known2 | CAGAACAGATTGTACC | GGTACAATCTGTTCTG |
| LBX2_MA0232.1_B1H\|GBX2_Exex_SOLEXA_FBgn0041156_B1H\|DLX1_DII_SOLEXA_FBgn0000157_B1H | TAATTA | TAATTA |
| FOXD1_FOXJ3_U_HocoMoco | TAAACAAAACAA | TTGTTTTGTTTA |
| YY1_known6 | GATGGC | GCCATC |
| HIVEP3_ZEP2_si_HocoMoco | GGGGTTTCCCTACC | GGTAGGGAAACCCC |
| ATF1_V$CREB_01_Transfac\|ATF3_known2\|ATF2_3\|ATF3_known15 | TGACGTCA | TGACGTCA |
| HNF4_disc2 | AAGTCCAGT | ACTGGACTT |
| HLX_H2.0_SOLEXA_FBgn0001170_B1H | TTAATAAA | TTTATTAA |
| CR936877.3_RXRG_2_SELEX\|CR936877.3_RXRA_4_SELEX\|RXRA_known13\|RXRG_2 | GAGGTCATGACCCC | GGGGTCATGACCTC |
| PLAG1_PLAG1_f1_HocoMoco | CCCCTCCTGATGCCCCC | GGGGGCATCAGGAGGGG |
| TBPL2_V$TBP_01_Transfac\|TATA_known3 | TATAAATA | TATTTATA |
| SREBF2_V$SREBP1_01_Transfac\|SREBP_known1 | GATCACGTGAC | GTCACGTGATC |
| FOXD1_FOXG1_2_SELEX\|FOXG1_2 | ACGGACACAATG | CATTGTGTCCGT |
| GMEB2_pTH3084_PBM\|GMEB1_pTH9298_PBM\|GMEB1_pTH9282_PBM | GTACGTCA | TGACGTAC |
| NR2F2_2 | CTCGTGACCTTTGAGA | TCTCAAAGGTCACGAG |
| BATF_disc3 | AAATGACTGG | CCAGTCATTT |
| GATA2_V$GATA1_04_Transfac\|GATA_known6 | ATCAGATAAGGGG | CCCCTTATCTGAT |
| FOSL1_pTH5077_PBM | TGATGACGCAA | TTGCGTCATCA |
| GATA_known13 | AGATAG | CTATCT |
| RELA_GM19099_NFKB_Stanford_ChIP-seq | AGGGGATTTCCAA | TTGGAAATCCCCT |
| NFE2_disc4 | CCGCTGACTCC | GGAGTCAGCGG |
| MAFA_MAF_f1_HocoMoco | GTCAGCAA | TTGCTGAC |
| ALX1_Isx_3445_PBM | CAATTAGC | GCTAATTG |
| E2F1_V$E2F_03_Transfac\|E2F_known9 | TTTCGCGCCAAA | TTTGGCGCGAAA |
| ATF1_V$CREB_Q2_Transfac\|ATF3_known6 | CCTTACGTCACC | GGTGACGTAAGG |
| RORB_Hr46_SANGER_5_FBgn0000448_B1H | AAGTAGGTCA | TGACCTACTT |
| FOXD1_FOXC1_1_SELEX\|FOXC1_3 | AAGTAAATAAACA | TGTTTATTTACTT |
| FOXJ1_1 | ATGTGTTTGTTTA | TAAACAAACACAT |
| SOX9_SOX9_3_SELEX\|SOX9_5 | ATCAATGTGCAGTGAT | ATCACTGCACATTGAT |
| HOXB9_1 | CGAATTTTATGGCTCC | GGAGCCATAAAATTCG |

TABLE 5-continued

Transcription Factor Binding Sites of Synthetic Promoters

| Name | Binding Site Sequence | Reverse Complement |
|---|---|---|
| TBX3_TBX5_1_SELEX\|TBX3_pTH3973_PBM\|TBX3_TBX5_si HocoMoco\|TBX22_TBX15_2_SELEX\|MGA_MGA_1_SELEX \|TBX1_TBX1_3_SELEX\|TBX3_pTH9336_PBM\|TBX3_pTH3775_PBM\|TBX3_TBX4_1_SELEX\|MGA_1\|TBX15_2\|TBX1_3\| TBX4_1\|TBX5_4 | AGGTGTGA | TCACACCT |
| CDX2_2 | AAATTTTATTACCGTT | AACGGTAATAAAATTT |
| HNF1A_V$HNF1_01_Transfac | GGTTAATGATTACCA | TGGTAATCATTAACC |
| CEBPA_CEBPE_f1_HocoMoco | AAGATTGCGCAA | TTGCGCAATCTT |
| OTP_1 | CCAATTAATTAATTACG | CGTAATTAATTAATTGG |
| HOXC5_Antp_FlyReg_FBgn0000095_B1H | AATTAT | ATAATT |
| ZNF263_T-REx-HEK293_ZNF263_UCD_ChIP-seq | CCTCTCCCTCCTCCC | GGGAGGAGGGAGAGG |
| RELA_REL_do_HocoMoco | GGGAAATCCCCA | TGGGGATTTCCC |
| RELB_RELB_si_HocoMoco | GGGAAATCCCCC | GGGGGATTTCCC |
| SHOX_PhdP_SOLEXA_FBgn0025334_B1H\|SHOX_PhdP_Cell FBgn0025334_B1H | AATTAA | TTAATT |
| BCL6_MA0463.1_ChIP-seq | TGCTTTCTAGGAAA | TTTCCTAGAAAGCA |
| HOXC5_MA0132.1_SELEX\|PDX1_3 | AATTAG | CTAATT |
| PAX5_Poxn_SOLEXA_5_FBgn0003130_B1H | AGCGTGACG | CGTCACGCT |
| SOX18_1 | TTCAATTGTTCTAAAA | TTTTAGAACAATTGAA |
| ESRRA_disc2 | AGCCCAAGGTCAC | GTGACCTTGGGCT |
| YY1_disc1 | GCCGCCATCTTGGGTGC GGGCAA | TTGCCCGCACCCAAGAT GGCGGC |
| HOXA13_1 | AAACCTCGTAAAATTT | AAATTTTACGAGGTTT |
| HOXC10_Hoxd9_1_SELEX\|HOXD9_1 | CCCATAAAA | TTTTATGGG |
| BARHL2_BARHL2_2_SELEX\|BARHL2_3 | AGCAATTAAC | GTTAATTGCT |
| NR2F2_Mv104_ChIP-seq\|NR2C2_disc2 | ACCTTTGACC | GGTCAAAGGT |
| DMRT2_pTH9261_PBM | AATTGATACA | TGTATCAATT |
| ATF1_ATF1_si_HocoMoco | CTGACGTCAC | GTGACGTCAG |
| DMRTC2_pTH9215_PBM\|DMRT1_pTH9197_PBM\|DMRTA 2_pTH9198_PBM | AATGTATCAA | TTGATACATT |
| HNF1_4 | AGCAGTTAATAATTAAC CATA | TATGGTTAATTATTAACT GCT |
| MEOX2_MEOX1_1_SELEX\|MEOX1_2 | GCTAATTAAC | GTTAATTAGC |
| NKX2-4_1\|NKX2-1_3 | AATTTCAAGTGGCTTA | TAAGCCACTTGAAATT |
| HOXC8_1 | ACGTTAATTACCCCAA | TTGGGGTAATTAACGT |
| CTCF_disc2 | ACCAGGGGGCG | CGCCCCCTGGT |
| GATA2_K562b_GATA1_UCD_ChIP-seq | GCAGATAAGGA | TCCTTATCTGC |
| HOMEZ_1 | AAAACATCGTTTTTAAG | CTTAAAAACGATGTTTT |
| AHR::ARNT_2 | GGGGATCGCGTGACAA CCC | GGGTTGTCACGCGATCC CC |
| HOXC4_1 | CGAATTAATTAACAATA | TATTGTTAATTAATTCG |
| GMEB1_Gmeb1_1745_PBM\|GMEB1_pTH8318_PBM | TGACGTACA | TGTACGTCA |

TABLE 5-continued

Transcription Factor Binding Sites of Synthetic Promoters

| Name | Binding Site Sequence | Reverse Complement |
|---|---|---|
| ETV5_GM12878_ETS1_HudsonAlpha_ChIP-seq | GAACTACAATTCCCAGAAGGC | GCCTTCTGGGAATTGTAGTTC |
| POU3F3_PO3F1_f1_HocoMoco | CATTGTAATGCAAA | TTTGCATTACAATG |
| LHX1_LHX3_f1_HocoMoco | AAAATTAATTAAT | ATTAATTAATTTT |
| RXRA_known8 | AGGTCACGGAGAGGTCA | TGACCTCTCCGTGACCT |
| OBOX1_1 | GTAGTTAATCCCCTTAA | TTAAGGGGATTAACTAC |
| NR3C1_known7 | CCACGAAGAACACCATGTCCCCACCCC | GGGGTGGGGACATGGTGTTCTTCGTGG |
| KLF14_KLF13_1_SELEX|KLF13_1 | ATGCCACGCCCCTTTTG | CAAAAGGGGCGTGGCAT |
| NHLH2_HLH4C_da_SANGER_5_4_FBgn0011277_B1H|TCF4_HLH4C_da_SANGER_5_4_FBgn0000413_B1H | CCACCTGAGCCC | GGGCTCAGGTGG |
| NR3C1_known4 | AGAACACCCTGTACC | GGTACAGGGTGTTCT |
| MEIS1_MEIS3_1_SELEX|ME153_2 | CCTGTCAA | TTGACAGG |
| PRDM16_V$EVI1_01_Transfac|RUNX1_2 | AGATAAGATAAGATAA | TTATCTTATCTTATCT |
| FOXD1_FOXB1_1_SELEX|FOXB1_1 | GAATGACACAGCGA | TCGCTGTGTCATTC |
| POU3F3_MA0254.1_DNaseI | TATGCA | TGCATA |
| FOSL1_MA0476.1_ChIP-seq | AATGAGTCACA | TGTGACTCATT |
| E2F1_E2F1_3_SELEX | TTTTGGCGCCAAAA | TTTTGGCGCCAAAA |
| BARHL2_CG11085_Cell_FBgn0030408_B1H|BSX_Bsh_Cell_FBgn0000529_B1H | CCAATTAAA | TTTAATTGG |
| ALX1_CG9876_Cell_FBgn0034821_B1H|SHOX_Pph13_Cell_FBgn0023489_B1H | ACTAATTA | TAATTAGT |
| FOXH1_MA0479.1_ChIP-seq | TCCAATCCACA | TGTGGATTGGA |
| GATA2_V$GATA6_01_Transfac|GATA_known9 | AAAGATAAGC | GCTTATCTTT |
| DMRT2_1 | ACAATGTATCAATTTG | CAAATTGATACATTGT |
| DMRTC2_pTH9250_PBM|DMRTA2_pTH9300_PBM | AATGTATC | GATACATT |
| YY2_V$YY1_02_Transfac|YY1_known2 | AGCAGCCAAGATGGCCGCGG | CCGCGGCCATCTTGGCTGCT |
| AC226150.2_pTH5972_PBM | CTTGTCAA | TTGACAAG |
| TBPL2_Mv129_ChIP-seq | TATGCAAATA | TATTTGCATA |
| NHLH2_NHLH1_2_SELEX|NHLH2_NHLH1_1_SELEX|NHLH1_4|NHLH1_5 | CGCAGCTGCG | CGCAGCTGCG |
| PAX9_MA0014.2_ChIP-seq | GAGGGCAGCCAAGCGTGAC | GTCACGCTTGGCTGCCCTC |
| ENSG00000250811_tgo_sim_SANGER_5_F Bgn0004666_61H|ARNT2_tgo_trh_SANGER_5_FBgn0015014_B1H|ARNT2_tgo_sim_SANGER_5_FBgn0015014_B1H | GGTCACGTAC | GTACGTGACC |
| ETS_known1 | AAAACAGGAAGTACGT | ACGTACTTCCTGTTTT |
| NR2E3_pTH5877_PBM | GAGATCAA | TTGATCTC |
| HNF4_known5|PPARA_4|HNF4_known6|HNF4_known7 | GGGTCAAAGGTCA | TGACCTTTGACCC |
| FOXL1_3 | ACCTTTGTTTACATTTA | TAAATGTAAACAAAGGT |
| HINFP_H|NFP1_2_SELEX|HINFP_3 | GCGGACGTTGCAACGTCCGC | GCGGACGTTGCAACGTCCGC |

TABLE 5-continued

Transcription Factor Binding Sites of Synthetic Promoters

| Name | Binding Site Sequence | Reverse Complement |
|---|---|---|
| CCNT2_disc1 | CTGGGGGGGGCAGATAAGGCA | TGCCTTATCTGCCCCCCCCAG |
| SP9_CG5669_SOLEXA_5_FBgn0039169_B1H | AGTGGGCGGGGCCAA | TTGGCCCCGCCCACT |
| NFYA_MA0313.1_COMPILED | ACCAA | TTGGT |
| TEF_HLF_1_SELEX\|HLF_3 | CATTACGTAACC | GGTTACGTAATG |
| SIX6_Six3_1732_PBM | GTATCAC | GTGATAC |
| TEF_DBP_1_SELEX\|DBP_2 | CATTACGTAACA | TGTTACGTAATG |
| SPI1_disc2\|BCL_disc4\|PAX5_disc3\|RXRA_disc4 | GGAAGTGAAA | TTTCACTTCC |
| PAX5_pTH8981_PBM | ACCGTGACCAC | GTGGTCACGGT |
| E2F_known19 | GCCCGTTTCGCGCCAA | TTGGCGCGAAACGGGC |
| CTCFL_disc1 | CAGGGGGCGC | GCGCCCCTG |
| MEF2B_MEF2A_f1_HocoMoco | GCTATAAATAGAAC | GTTCTATTTATAGC |
| POU2F2_known13 | TACTGATTATGCATATTTTAA | TTAAAATATGCATAATCAGTA |
| ZNF35_Zfp105_2634_PBM | CAATAAACAA | TTGTTTATTG |
| POU3F3_V$TST1_01_Transfac\|CCDC6_1 | GAGGAATTAAAATAC | GTATTTTAATTCCTC |
| ARID5A_pTH5121_PBM | GCAATATCGA | TCGATATTGC |
| MAFK_pTH5098_PBM | AATTGCTGAC | GTCAGCAATT |
| NFKB2_NFKB2_1_SELEX\|NFKB1_NFKB1_1_SELEX\|NFKB_known10\|NFKB_known11 | AGGGGAATCCCCT | AGGGGATTCCCCT |
| TLX3_Tlx2_3498_PBM\|DBX2_pTH6051_PBM\|LHX1_Lim3_Cell_FBgn0002023_B1H\|DBX2_Dbx1_3486_PBM\|EN2_en_FlyReg_FBgn0000577_B1H | ATTAATTA | TAATTAAT |
| NPAS2_CLOCK_1_SELEX\|CLOCK_1 | AACACGTGTT | AACACGTGTT |
| ATF1_V$TAXCREB_02_Transfac\|ATF3_known5 | ATGACGCATACCCCC | GGGGGTATGCGTCAT |
| JUN_kay_Jra_SANGER_5_FBgn0001291_B1H\|JUN_MA0491.1_ChIP-seq | GATGAGTCACC | GGTGACTCATC |
| E2F4_K562b_E2F4_UCD_ChIP-seq | GGCGGGAAATTGGAA | TTCCAATTTCCCGCC |
| BARHL2_BARHL2_4_SELEX\|BARHL2_Barhl1_1_SELEX\|BARHL2_5\|BARHL1_2 | ACCGTTTAGC | GCTAAACGGT |
| DMRTC2_1 | CAACAATGTAACAA | TTGTTACATTGTTG |
| RARG_RARA_3_SELEX\|RARA_4 | AGGTCATGCAAAGGTCA | TGACCTTTGCATGACCT |
| FOXA_known2 | AAAAACAAACA | TGTTTGTTTTT |
| NFIL3_MA0025.1_SELEX | ACGTTACATAA | TTATGTAACGT |
| POU3F3_V$OCT1_06_Transfac\|POU2F2_known6 | CAAAATGACATGCA | TGCATGTCATTTTG |
| TFCP2_3 | CCAGCTCAAACCAGC | GCTGGTTTGAGCTGG |
| GCM1_1 | AATGATGCGGGTACGA | TCGTACCCGCATCATT |
| HNF4_disc4 | AGCAAACAG | CTGTTTGCT |
| ARNT2_tgo_tai_SANGER_5_FBgn0015014_B1H\|BHLHE40_BHE40_f2_HocoMoco | GCACGTGAC | GTCACGTGC |
| STAT3_MCF10A-Er-Src_STAT3_Harvard#Weissman_ChIP-seq\|STAT3_MCF10A-Er-Src_STAT3_Stanford_ChIP-seq | CACTTCCGGGAAATG | CATTTCCCGGAAGTG |

TABLE 5-continued

Transcription Factor Binding Sites of Synthetic Promoters

| Name | Binding Site Sequence | Reverse Complement |
| --- | --- | --- |
| TBX3_TBX3_f1_HocoMoco | AGGTAGAGAATTAGGTGATAAAAA | TTTTTATCACCTAATTCTCTACCT |
| SREBF2_V$SREBP1_02_Transfac | GTGGGGTGATA | TATCACCCCAC |
| HOXC10_Hoxd11_3873_PBM\|HOXC10_Hoxd10_2368_PBM | GTCATAAA | TTTATGAC |
| CR936877.3_Rxra_1035_PBM | AGGGGTCACG | CGTGACCCCT |
| EOMES_Eomes_0921_PBM\|EOMES_TBR1_1_SELEX\|TBR1_1 | AGGTGTGAAA | TTTCACACCT |
| PAX9_PAX8_f1_HocoMoco | CCCGCTTCAGTGAC | GTCACTGAAGCGGG |
| CTCF_disc8 | CCACAGGCAGGTGC | GCACCTGCCTGTGG |
| ESR2_ESR2_si_HocoMoco | AGGTCAC | GTGACCT |
| POU3F3_POU3F2_2_SELEX\|POU3F3_POU3F1_1_SELEX\|POU3F1_2\|POU3F2_6 | TAATTTGCATAA | TTATGCAAATTA |
| CEBPA_pTH5253_PBM | TTGCGAAA | TTTCGCAA |
| TEAD3_TEAD3_1_SELEX\|TEAD3_1 | ACATTCCTCGCATTCCA | TGGAATGCGAGGAATGT |
| HOXC5_Antp_Cell_FBgn0000095_B1H\|EMX2_Ems_Cell_FBgn0000576_B1H\|HOXG_Antp_SOLEXA_FBgn0000095_B1H\|HOXC5_Ubx_SOLEXA_FBgn0003944_B1H | TCATTAAA | TTTAATGA |
| SMC3_disc2 | ACCAGCAGG | CCTGCTGGT |
| SOX11_SOX4_f1_HocoMoco | CGCTTTGTTCTC | GAGAACAAAGCG |
| RARG_RARA_1_SELEX\|RARA_2 | AAAGGTCATTTGAGGTCA | TGACCTCAAATGACCTTT |
| GATA2_MA0482.1_ChIP-seq | GGGAGATAAGA | TCTTATCTCCC |
| MYOD1_MYOG_f1_HocoMoco | GCAGCAGCTGTCA | TGACAGCTGCTGC |
| FOXO1_2 | AATGTAAACAACAC | GTGTTGTTTACATT |
| NFAT_2 | AATTTTCCAC | GTGGAAAATT |
| ZNF143_disc3 | ACTACAACTCCCAGCAGC | GCCTGCTGGGAGTTGTAGT |
| AR_MCR_f1_HocoMoco | AAGAACAGGTTGTTGTA | TACAACAACCTGTTCTT |
| TEF_Hlf_1_SELEX\|HLF_4 | GATTACGTAACC | GGTTACGTAATC |
| EVX2_pTH6287_PBM | ACTAATTACC | GGTAATTAGT |
| MZF1_MA0056.1_SELEX\|MZF1_3 | TCCCCA | TGGGGA |
| RFX8_RFX1_f1_HocoMoco | GTTGCCAGGGAA | TTCCCTGGCAAC |
| ZNF143_ZNF143_1_SELEX\|ZNF143_known2 | CAATGCATTGTGGGTA | TACCCACAATGCATTG |
| AP1_disc2 | GCCAATCAGA | TCTGATTGGC |
| BHLHA15_dimm_da_SANGER_5_FBgn0023091_B1H\|TCF4_dimm_da_SANGER_5_FBgn0000413_B1H | ACCATATGGCG | CGCCATATGGT |
| NR3C1_known3 | AGAACATCATGTACT | AGTACATGATGTTCT |
| GATA_known12 | GGATA | TATCC |
| FOXD1_V$_FOXD3_01_Transfac\|FOXD3_1 | AAACAAACAATC | GATTGTTTGTTT |
| EGR1_known7 | AATGCGGGGCGGA | TCCGCCCCGCATT |
| CR936877.3_RXRA_f1_HocoMoco\|PPARA_PPARA_f2_HocoMoco\|NR2C2_NR2C2_a_HocoMoco | AGGTCAAAGGTCA | TGACCTTTGACCT |

TABLE 5-continued

Transcription Factor Binding Sites of Synthetic Promoters

| Name | Binding Site Sequence | Reverse Complement |
|---|---|---|
| FOXO6_FOXO3_3_SELEX\|FOXO3_6 | GTGTGGGAAA | TTTCCCCACAC |
| ENSG00000187728_Tcf21_1_SELEX\|TCF21_1 | ACAACAGCTGTTGC | GCAACAGCTGTTGT |
| REST_known3 | GCGCTGTCCGTGGTGCTGA | TCAGCACCACGGACAGCGC |
| RARG_Rara_3_SELEX\|RARA_10 | AAGGTCAAAGGTCA | TGACCTTTTGACCTT |
| BHLHE40_Bhlhb2_1_SELEX\|MITF_pTH2885_PBM\|BHLHE40_BHLHE41_1_SELEX\|ARNT2_ARNTL_LSELEX\|MYC_disc1\|ATF3_disc1\|NFE2_disc2\|SIRT6_disc1\|ARNTL_1\|BHLHE41_2\|BHLHE40_known4 | GTCACGTGAC | GTCACGTGAC |
| HOXA3_3 | ACTAATTACCTCAA | TTGAGGTAATTAGT |
| LMX1A_Lmx1a_2238_PBM\|LMX1A_LMX1B_1_SELEX\|LMX1A_LMX1A_1_SELEX\|LHX1_Lhx4_1_SELEX\|HOXA1_pTH5486_PBM\|SHOX_Uncx4_PBM\|HOXB2_pTH5491_PBM\|LMX1A_2\|LMX16_2\|LHX4_2 | TTAATTAA | TTAATTAA |
| SOX1_SOX2_f1_HocoMoco | ATTTGCATAACAATGG | CCATTGTTATGCAAAT |
| IRF5_IRF5_f1_HocoMoco | TAAAGGAAAGCCAAAAGTGA | TCACTTTTGGCTTTCCTTTA |
| IRF_known12 | ATAAACCGAAACCAA | TTGGTTTCGGTTTAT |
| SRF_H1-hESC_SRF_HudsonAlpha_ChIP-seq | CCATATAAGGCAAA | TTTGCCTTATATGG |
| ATF3_known11 | ATGACG | CGTCAT |
| MYOG_1 | CAGCTGCC | GGCAGCTG |
| LHX8_pTH6556_PBM | GTAATCAA | TTGATTAC |
| FOXO6_foxo_SANGER_10_FBgn0038197_B1H | TCGTAAACA | TGTTTACGA |
| PRRX2_1 | AGGTTAATTGGTTAAA | TTTAACCAATTAACCT |
| SOX3_1 | AAACAATGACATTGTTT | AAACAATGTCATTGTTT |
| CTCF_GM12878_CTCF_Broad_ChIP-seq | GCCCCCTGGTGGCCA | TGGCCACCAGGGGGC |
| IRX3_2 | AATATACATGTAATATT | AATATTACATGTATATT |
| SIX5_disc3 | AAACTACATTTCCCA | TGGGAAATGTAGTTT |
| NFIA_NFIB_1_SELEX\|NFIB_1 | CTGGCACTGTGCCAA | TTGGCACAGTGCCAG |
| HOXC9_I$ABDB_01_Transfac | GCGTTTATGGCGAC | GTCGCCATAAACGC |
| TFAP2_disc2 | CATGCCCTGGGGCCA | TGGCCCCAGGGCATG |
| IRF2_IRF2_f1_HocoMoco | GGAAAGTGAAAGCA | TGCTTTCACTTTCC |
| STAT4_MA0518.1_ChIP-seq | CCATTTCCTGGAAA | TTTCCAGGAAATGG |
| HOXC10_HOXC10_3_SELEX\|HOXC10_4 | ATTTTACGAC | GTCGTAAAAT |
| PBX3_known1 | CTACCATCAATC | GATTGATGGTAG |
| POU2F2_disc2 | CCCCCTCACCTGC | GCAGGTGAGGGGG |
| CTCF_HMF_CTCF_UW_ChIP-seq | CCACCAGAGGG | CCCTCTGGTGG |
| ZNF143_V$STAF_02_Transfac | ATTTCCCATCATGCCTTGCGA | TCGCAAGGCATGATGGGAAAT |
| TCF3_5 | CACCTGCC | GGCAGGTG |
| RARG_RARA_2_SELEX\|RARA_3 | CATTGACCTTTTGACCTC | GAGGTCAAAGGTCAATG |
| NFIA_NFIX_3_SELEX | AGTGCCAAT | ATTGGCACT |

TABLE 5-continued

Transcription Factor Binding Sites of Synthetic Promoters

| Name | Binding Site Sequence | Reverse Complement |
|---|---|---|
| NFIA_NFIX_2_SELEX | CGTGCCAAG | CTTGGCACG |
| SIN3A_disc1 | TCAGCACCACGGACA | TGTCCGTGGTGCTGA |
| ZSCAN16_ZNF435_1_SELEX\|ZSCAN16_1 | AGGTGTTCTGTTAACACT | AGTGTTAACAGAACACCT |
| EP300_disc7 | ATGACACA | TGTGTCAT |
| ZNF652_Zfp652_1_SELEX\|ZNF652_1 | AGAAAGGGTTAAT | ATTAACCCTTTCT |
| ARID3C_retn_SANGER_5_FBgn0004795_B1H | AATCAAAA | TTTTGATT |
| HOXD11_1 | AGGATTTTACGACCTTA | TAAGGTCGTAAAATCCT |
| AR_MA0007.2_ChIP-seq | AAGAACAGAATGTTC | GAACATTCTGTTCTT |
| ZBTB7B_ZBT7B_si_HocoMoco | CGGAGAGGGGGAGGGGGGGGC | GCCCCCCCCTCCCCCTCCG |
| TCF7L2_known3 | AACATCAAGG | CCTTTGATGTT |
| HOXB3_1 | TCCAACTAATTAGCTCA | TGAGCTAATTAGTTGGA |
| POU1F1_PIT1_f1_HocoMoco | ATATATTCATGAG | CTCATGAATATAT |
| PAX6_PAX6_1_SELEX\|PAX6_5 | TGTGCAGTCATGCGTGAAA | TTTCACGCATGACTGCACA |
| TFDP1_TFDP1_f1_HocoMoco | AAATGGCGGGAAAC | GTTTCCCGCCATTT |
| NKX2-5_Nkx2-4_3074_PBM\|NKX2-5_V$NKX22_01_Transfac\|NKX3-1_Nkx3-1_2923_PBM\|NKX2-5_Nkx2-6_3437_PBM\|NKX2-2_1 | AACCACTTAA | TTAAGTGGTT |
| HEY1_HEY2_f1_HocoMoco | GGGGGCACGTGGCATTA | TAATGCCACGTGCCCCC |
| E2F7_E2F7_1_SELEX\|E2F7_1 | TTTTCCCGCCAAAA | TTTTGGCGGGAAAA |
| IKZF2_3 | ATAAGGAAAAA | TTTTTCCTTAT |
| TCF7L1_TF7L2_f1_HocoMoco | AAGATCAAAGGG | CCCTTTGATCTT |
| STAT1_Mv125_ChIP-seq | AAACGAAACT | AGTTTCGTTT |
| GCM1_GCM1_1_SELEX\|GCM1_2 | CATGCGGGTA | TACCCGCATG |
| SOX17_3 | ATAAACAATTAATCA | TGATTAATTGTTTAT |
| ONECUT3_ONEC2_si_HocoMoco | AAAAAAAATCAATAACAAGAC | GTCTTGTTATTGATTTTTTT |
| NR2C2_Hr78_SANGER_5_FBgn0015239_B1H\|CR936877.3_H1-hESC_RXRA_HudsonAlpha_ChIP-seq | AGAGGTCA | TGACCTCT |
| HNF1A_1 | GGTTAATAATTAAC | GTTAATTATTAACC |
| NFE2_MA0150.2_ChIP-seq | CAGCATGACTCAGCA | TGCTGAGTCATGCTG |
| HMGA1_1 | AATTTCC | GGAAATT |
| T_V$BRACH_01_Transfac\|T_1 | AATTTCACACCTAGGTGTGACTAG | CTAGTCACACCTAGGTGTGAAATT |
| FOXD1_pTH8896_PBM\|FOXD1_YCR065W_570_DeBoer11\|FOXD1_MA0317.1_PBM,\|FOXD3_pTH9057_PBM | ATAAACAA | TTGTTTAT |
| SIX5_known 2 | AAAAATGATACCCCATC | GATGGGGTATCATTTTT |

TABLE 5-continued

Transcription Factor Binding Sites of Synthetic Promoters

| Name | Binding Site Sequence | Reverse Complement |
|---|---|---|
| EN2_MA0229.1_B1H\|EN2_Inv_Cell_FBgn0001269_B1H | TAATTAGA | TCTAATTA |
| RUNX2_2 | AAACCACA | TGTGGTTT |
| MEOX2_Btn_Cell_FBgn0014949_B1H\|HOXC5_Dfd_SOLEXA_FBgn0000439_B1H\|HOXC5_Zen_SOLEXA_F_Bgn0004053_B1H\|HOXC5_Dfd_Cell_FBgn0000439_B1H | CTTAATGA | TCATTAAG |
| MEF2_known9 | ATGCTAAAAATAGATTG | CAATCTATTTTTAGCAT |
| SP100_1 | ATTTTACGGAAAAT | ATTTTCCGTAAAAT |
| NKX2-5_NKX22_si_HocoMoco | AAACCACTTAAA | TTTAAGTGGTTT |
| MZF1_V$MZF1_01_Transfac\|MZF1_1 | AGTGGGGA | TCCCCACT |
| TLX3_V$NCX_01_Transfac\|TLX2_1 | CCAATTACCG | CGGTAATTGG |
| GATA2_GATA4_a_HocoMoco | ACAGATAAC | GTTATCTGT |
| CDX2_1 | AAAGTTTTATTGCC | GGCAATAAAACTTT |
| AR_AR_1_SELEX\|NR3C1_known15 | AGGTACACGGTGTACCC | GGGTACACCGTGTACCT |
| ZEB1_MA0103.2_ChIP-seq | CAGGTGAGG | CCTCACCTG |
| NKX3-1_NKX31_si_HocoMoco | AATAAGTATATAA | TTATATACTTATT |
| HOXC12_1 | GAAATTTTACGACCTAA | TTAGGTCGTAAAATTTC |
| SP9_SP3_1_SELEX\|KLF14_KLF16_1_SELEX\|KLF16_1\|SP1_known9 | GCCACGCCCCC | GGGGGCGTGGC |
| RFX8_RFX2_2_SELEX\|RFX8_RFX4_2_SELEX\|RFX8_Rfx2_2_SELEX\|RFX2_2\|RFX5_known7\|RFX2_4 | CGTTGCCTAGCAACG | CGTTGCTAGGCAACG |
| GRHL1_GRHL1_1_SELEX\|GRHL1_1 | AACCGGTTAAACCGGTT | AACCGGTTTAACCGGTT |
| BARX1_pTH6449_PBM\|BARX1_Barx2_3447_PBM\|HMX1_Hmx3_3490_PBM | AGCAATTAA | TTAATTGCT |
| PKNOX2_hth_SOLEXA_2_FBgn0001235_B1H | CTGTCAAA | TTTGACAG |
| CDX2_CDX2_1_SELEX\|CDX2_CDX1_1_SELEX\|CDX1_2\|CDX2_3 | GCAATAAAA | TTTTATTGC |
| PRDM16_V$EVI1_06_Transfac\|RUNX1_1 | ACAAGATAA | TTATCTTGT |
| ZIC4_ZIC3_1_SELEX\|ZIC3_3 | GACCCCCGCTGCGC | GCGCAGCGGGGGTC |
| NFY_known3 | ATCAGCCAATCAGAGC | GCTCTGATTGGCTGAT |
| BX088580.2_SRP000712_Oct4_ChIP-seq\|POU5F1_disc1\|POU5F1_known2 | ATTTGCATAACAATG | CATTGTTATGCAAAT |
| ESR2_ESR1_1_SELEX\|ESRRA_known6 | AAGGTCACGGTGACCTG | CAGGTCACCGTGACCTT |
| SOX2_SOX21_2_SELEX\|SOX9_SOX8_1_SELEX\|SOX9_SOX9_2_SELEX\|SOX21_3\|SOX8_2\|SOX9_4 | AACAATGTGCAGTGTT | AACACTGCACATTGTT |
| PTF1A_Fer2_da_SANGER_5_FBgn0038402_B1H\|TCF4_Fer2_da_SANGER_5_F_Bgn0000413_B1H | CCAGCTGACG | CGTCAGCTGG |
| RORB_RORA_1_SELEX\|RORA_6 | CAAAGGTCAAATTGAGGTCA | TGACCTCAATTTGACCTTTG |
| YY2_GM12892_YY1_HudsonAlpha_ChIP-seq | AAGATGGCGGCCGCC | GGCGGCCGCCATCTT |
| SPIC_Sfpi1_1034_PBM\|SP11_disc1 | AAGAGGAAGT | ACTTCCTCTT |
| ARID3C_MA0151.1_SELEX\|ARID3A_1 | ATTAAA | TTTAAT |
| NOBOX_Og2x_3719_PBM | GCCAATTAA | TTAATTGGC |
| ELF1_disc2 | CGCTTCCGGC | GCCGGAAGCG |

TABLE 5-continued

Transcription Factor Binding Sites of Synthetic Promoters

| Name | Binding Site Sequence | Reverse Complement |
|---|---|---|
| PKNOX1_1 | AAAGACCTGTCAATCC | GGATTGACAGGTCTTT |
| NHLH2_pTH3037_PBM | CACAGCTGCG | CGCAGCTGTG |
| NR2C2_disc3 | ACCCCGGA | TCCGGGGT |
| HOXB8_1 | ACCGGCAATTAATAAA | TTTATTAATTGCCGGT |
| NR2C2_NR2C2_1_SELEX\|NR2F2_NR2F6_2_SELEX\|NR2F2_NR2F6_3_SELEX\|NR2F2_Nr2f6_2_SELEX\|NR2C2_known1\|NR2F6_2\|NR2F6_3\|NR2F6_5 | GAGGTCAAAGGTCA | TGACCTTTGACCTC |
| TBX1_TBX1_4_SELEX | TCTCACACCTCTGAGGTGTGAAA | TTTCACACCTCAGAGGTGTGAGA |
| TBPL2_V$TATA_01_Transfac\|TATA_known2\|TATA_known5 | CCCCGCCTTTTATAC | GTATAAAAGGCGGGG |
| NR2C2_Mv97_ChIP-seq | AAGTGCTTCCGGGTC | GACCCGGAAGCACTT |
| SOX11_SOX4_1_SELEX\|SOX4_2 | AACACTGCAATTGTTC | GAACAATTGCAGTGTT |
| TFAP2A_AP2D_a_HocoMoco | ACGCGCCTCGGGCG | CGCCCGAGGCGCGT |
| SOX9_SOX10_1_SELEX\|SOX9_SOX8_6_SELEX\|SOX10_3\|SOX8_7 | AACAATTGCAGTGTT | AACACTGCAATTGTT |
| ZIC4_MA0118.1_SELEX | GACCCCCCA | TGGGGGGTC |
| MAFK_HepG2_MAFK_Stanford_ChIP-seq | TGCTGACTCAGCA | TGCTGAGTCAGCA |
| BRCA1_BRCA1_f1_HocoMoco | CAACCCAAA | TTTGGGTTG |
| MGA_MGA_2_SELEX\|MGA_2 | AGGTGTGAAGTCACACCT | AGGTGTGACTTCACACCT |
| LHX9_1 | CCCATTAATTAATCACC | GGTGATTAATTAATGGG |
| SOX13_SOX5_a_HocoMoco | TAACAATA | TATTGTTA |
| LMX1A_CG4328_Cell_FBgn0036274_B1H | ATTTATTG | CAATAAAT |
| FOXD1_V$FREAC3_01_Transfac\|FOXC1_1 | GGTAAGTAAATAAACA | TGTTTATTTACTTACC |
| SOX1_Sox1_3_SELEX\|SOX2_SOX21_3_SELEX\|SOX1_SOX14_3_SELEX\|SRY_SRY_3_SELEX\|SOX14_4\|SOX21_4\|SRY_7\|SOX1_4 | TCAATAACATTGA | TCAATGTTATTGA |
| STAT3_V$STAT3_01_Transfac\|STAT3_V$STAT3_01_Transfac\|STAT_known3 | AATCATTTCCGGGAAATGCCA | TGGCATTTCCCGGAAATGATT |
| TFAP2_known9 | ATTCCCTGAGGGGAA | TTCCCCTCAGGGAAT |
| HOXC10_Hoxc10_2_SELEX\|HOXC10_HOXC10_2_SELEX\|HOXC10_3\|HOXC10_6 | GTAATAAAA | TTTTTATTAC |
| KLF4_KLF4_f2_HocoMoco | GCCCCGCCCA | TGGGCGGGGC |
| T_3 | TCACACCTAGGTGTGA | TCACACCTAGGTGTGA |
| EBF1_EBF1_1_SELEX\|EBF1_known4 | ATTCCCAAGGGAAT | ATTCCCTTGGGAAT |
| STAT1_HeLa-S3_STAT1_Stanford_ChIP-seq | ATGGGATTTCCGGGAAATGGG | CCCATTTCCCGGAAATCCCAT |
| HOXD1_1 | TAAACTAATTAGCTGTA | TACAGCTAATTAGTTTA |
| BARX1_1 | AAAGTAATTAGTGAAT | ATTCACTAATTACTTT |
| ZBTB33_disc2 | CTCGCGGGACC | GGTCCCGCGAG |
| GATA2_GATA6_f2_HocoMoco | AAGATAA | TTATCTT |
| MEF2B_Mf26_ChIP-seq | CTAAAAATAA | TTATTTTTAG |

TABLE 5-continued

Transcription Factor Binding Sites of Synthetic Promoters

| Name | Binding Site Sequence | Reverse Complement |
|---|---|---|
| HESX1_HESX1_2_SELEX\|HESX1_2 | CTAATTGGCAATTAA | TTAATTGCCAATTAG |
| DLX5_1 | CAGAGCTAATTACCCC | GGGGTAATTAGCTCTG |
| ELF1_Eip74EF_FlyReg_FBgn0000567_B1H\|EP300_disc10 | AACAGGAAGT | ACTTCCTGTT |
| PKNOX2_PKNX1_si_HocoMoco | AGCTTGATTGATG | CATCAATCAAGCT |
| MEF2B_MEF2D_1_SELEX\|MEF2D_1 | ACTATAAATAGA | TCTATTTATAGT |
| JUN_pTH4337_PBM | ATGACGCAA | TTGCGTCAT |
| DLX1_DLX6_1_SELEX\|DLX1_DLX4_1_SELEX\|DLX1_DLX2_1_SELEX\|DLX1_DLX3_1_SELEX\|DLX1_Dlx1_1_SELEX\|DLX2_2\|DLX3_2\|DLX4_2\|DLX6_1\|DLX1_3 | CCAATTAC | GTAATTGG |
| MEOX1_1 | CTGAGGTAATTACCTC | GAGGTAATTACCTCAG |
| POU1F1_pTH3818_PBM | ATAATTAATA | TATTAATTAT |
| ELF3_ELF3_f1_HocoMoco | ATTTCCTGTTTGCC | GGCAAACAGGAAAT |
| SPDEF_SPDEF_6_SELEX\|SPDEF_7 | GCAGAAAGAAGTAACA | TGTTACTTCTTTCTGC |
| EP300_disc6 | ATTACATCA | TGATGTAAT |
| POU2F2_disc1 | ATGCAAAT | ATTTGCAT |
| FOXD1_FOXI1_2_SELEX\|FOXI1_4 | ATGTTTACGGTAAACAA | TTGTTTACCGTAAACAT |
| ZBTB3_Zbtb3_1048_PBM | AATGCAGTG | CACTGCATT |
| FOXD1_FOXD2_1_SELEX\|FOXD2_1 | AAAAAATATTTACT | AGTAAATATTTTTT |
| PPARA_MA0066.1_SELEX\|RXRA_known5 | AGTAGGTCACCGTGACCTAC | GTAGGTCACGGTGACCTACT |
| HOXC13_1 | AAAGCTCGTAAAATTT | AAATTTTACGAGCTTT |
| ALX1_pTH6636_PBM | ATTGTACAAT | ATTGTACAAT |
| CDX2_Cdx2_4272_PBM | GGCAATAAA | TTTATTGCC |
| GMEB2_pTH9219_PBM | CTTACGTCA | TGACGTAAG |
| NFE2L1_NF2L1_f1_HocoMoco | AATGACT | AGTCATT |
| ESRRG_SRP000217_Esrrb_ChIP-seq | AGGTCAAGGTCACCC | GGGTGACCTTGACCT |
| C13orf38-SOHLH2_pTH5058_PBM | AGCCCGTGCG | CGCACGGGCT |
| GATA_known14 | CTGGTGGGACAGATAAG | CTTATCTGTCCCCACCAG |
| ATOH7_cato_da_SANGER_10_FBgn0024249_B1H\|TCF4_cato_da_SANGER_10_FBgn0000413_B1H | CACAGCTGAC | GTCAGCTGTG |
| MYC_known8 | CGCGCGTGGC | GCCACGCGCG |
| MLL_pTH7031_PBM | GGGGGCGTAA | TTACGCCCCC |
| HOXC5_Scr_Cell_FBgn0003339_B1H | CGTTAATGA | TCATTAACG |
| E2F_known7 | CCGCCAAA | TTTGGCGG |
| SOX18_SOX18_2_SELEX\|SOX18_3 | ATCAATGCAATTGAT | ATCAATTGCATTGAT |
| MAFBA_SANGER_5_FBgn0000964_B1H | GCTGAGTCAGCA | TGCTGACTCAGC |
| HSF_known3 | ATTCTAGAAATTTCTCC | GGAGAAATTTCTAGAAT |
| JUN_HUVEC_CJUN_Stanford_ChIP-seq | AAAGGGATGACTCAT | ATGAGTCATCCCTTT |
| AP1_disc5 | ACTCACCAC | GTGGTGAGT |
| CXXC1_pTH7032_PBM | CCGCTAA | TTAGCGG |

TABLE 5-continued

Transcription Factor Binding Sites of Synthetic Promoters

| Name | Binding Site Sequence | Reverse Complement |
| --- | --- | --- |
| MYOD1_2 | ACCACCTGTC | GACAGGTGGT |
| HNF4G_HNF4G_f1_HocoMoco | GGCCAAAGTCCA | TGGACTTTGGCC |
| KDM2B_pTH9191_PBM | GCGTAAATA | TATTTACGC |
| SOX12_1 | GTTTAGAACAATTA | TAATTGTTCTAAAC |
| MYOD1_HLH1_PBM | CAGCTGTC | GACAGCTG |
| BRCA1_disc1\|ZBTB33_disc1\|ETS_disc3\|CHD2_disc1\|NR3C1_disc3 | TCTCGCGAGA | TCTCGCGAGA |
| MAZ_1 | CCCTCCCC | GGGGAGGG |
| RARG_Rarg_2_SELEX\|RARG_8 | AAGGTCATCTAAAGGTCA | TGACCTTTAGATGACCTT |
| ETS_disc1 | AACTACAACTCCCA | TGGGAGTTGTAGTT |
| TFAP2A_AP2A_U_HocoMoco | GCCTCAGGC | GCCTGAGGC |
| ZBTB16_1 | GAACAGATCAAACTTTAGCTTCAATACAA | TTGTATTGAAGCTAAAGTTTGATCTGTTC |
| EGR3_sr_SOLEXA_5_FBgn0003499_B1H\|EGR3_sr_SANGER_5_FBgn0003499_B1H | CCCCGCCCACGCAC | GTGCGTGGGCGGGG |
| HNF4_known10 | AGTTCA | TGAACT |
| GLIS2_1 | CTGTGGGGGTCGATA | TATCGACCCCCACAG |
| CTCF_AG09309_CTCF_UW_ChIP-seq | CACCAGGGGGCGCCAG | CTGGCGCCCCTGGTG |
| EN2_EN1_4_SELEX\|EN1_7 | TAATTAAGCAATTA | TAATTGCTTAATTA |
| SMARCC1_HeLa-S3_BAF170_Stanford_ChIP-seq | GCCTGCTGGGAGTTGTAGTCC | GGACTACAACTCCCAGCAGGC |
| NFE2_V$NFE2_01_Transfac\|MAF_known2\|NFE2L2_3 | ATGACTCAGCA | TGCTGAGTCAT |
| FOXD1_V$FREAC7_01_Transfac\|FOXL1_1 | ATCTTGTTTATGTATA | TATACATAAACAAGAT |
| MEF2B_V$MEF2_02_Transfac\|MEF2_known3 | AGGTGCTATTTTTAGCACCGGA | TCCGGTGCTAAAAATAGCACCT |
| MAFB_Mafb_2_SELEX\|MAF_known11 | AATGCTGACTCAGCACA | TGTGCTGAGTCAGCATT |
| STAT3_STAT3_si_HocoMoco\|STAT3_SRP000217_Stat3_ChIP-seq | CTTCCAGGAAG | CTTCCTGGAAG |
| TEF_HLF_si_HocoMoco | CTGTTACGTAATC | GATTACGTAACAG |
| HSFY1_HSFY2_1_SELEX\|HSFY2_1 | TTCGAAACGTTCGAA | TTCGAACGTTTCGAA |
| SOX15_SOX15_1_SELEX\|SOX1_Sox1_1_SELEX\|SRY_SRY_1_SELEX\|SOX15_2\|SRY_5\|SOX1_2 | AACAATAACATTGTT | AACAATGTTATTGTT |
| NKX3-1_Nkx3-1_2923_PBM | AGCCACTTAA | TTAAGTGGCT |
| ZBTB4_ZBTB4_si_HocoMoco | CCCACCTGCCATCTAGG | CCTAGATGGCAGGTGGG |
| ZBTB6_V$Z1D_01_Transfac\|ZBTB6_1 | CGGCTCTATCATC | GATGATAGAGCCG |
| POU3F3_POU3F3_3_SELEX | ATGAATATTCAT | ATGAATATTCAT |
| GLI1_GLI2_1_SELEX\|GLI2_1 | CGTCGTGGGTGGTC | GACCACCCACGACG |
| NR3C1_known6 | CGCACAAGAACACAATGTACCCTCCCG | CGGGAGGGTACATTGTGTTCTTGTGCG |
| NKX2-3_1 | CATTAAGTACTTAAAG | CTTTAAGTACTTAATG |
| NOBOX_pTH6448_PBM | CTTAATTGGC | GCCAATTAAG |

TABLE 5-continued

Transcription Factor Binding Sites of Synthetic Promoters

| Name | Binding Site Sequence | Reverse Complement |
|---|---|---|
| AP1_disc4 | AGTCATACTGAAA | TTTCAGTATGACT |
| POU3F3_4 | ATGAATATTCAA | TTGAATATTCAT |
| ELF1_Eip74EF_SANGER_5_FBgn0000567_B1H\|ELF3_Elf3_3_876_PBM\|ELF3_Elf5_PBM\|ELF3_Ehf_3056_PBM\|ELF1_Mv63_ChIP-seq\|ELF3_Ehf_PBM\|ELF1_disc1 | ACCCGGAAGT | ACTTCCGGGT |
| NFE2L2_2 | CATGACTCAGCAG | CTGCTGAGTCATG |
| RORB_Hr46_FlyReg_FBgn0000448_B1H | AATTGGGTCA | TGACCCAATT |
| NR1H_3 | GGGGTCAGTAGAGGTCA | TGACCTCTACTGACCCC |
| SOX18_Sox18_3506_PBM\|SOX9_Sox8_1733_PBM\|SOX1_Sox14_2677_PBM\|SOX3_pTH3087_PBM\|SOX7_Sox7_3460_PBM | AAAACAAT | ATTGTTTT |
| STAT_known7 | CATTTCCG | CGGAAATG |
| IRX3_MA0233.1_B1H | AAACA | TGTTT |
| PAX5_disc1 | GGGGGCAGCCAAGCGTGAC | GTCACGCTTGGCTGCCCCC |
| FOXD1_FOXA3_f1_HocoMoco HNF4G_Hnf4a_1_SELEX\|HNF4G_HNF4A_5_SELEX\|HNF4_known20\|HNF4_known22 | GCAAAGCAAACAA ATTGGACTTTGACCCC | TTGTTTGCTTTGC GGGGTCAAAGTCCAAT |
| ZNF263_pTH2682_PBM | GGGAGCAC | GTGCTCCC |
| HES7_HE57_1_SELEX\|HES7_1 | TGGCACGTGCCA | TGGCACGTGCCA |
| RARG_Rarb_3_SELEX\|RARG_RARA_6_SELEX\|RARA_7\|RARB_3 | AGGTCAACTAAAGGTCA | TGACCTTTAGTTGACCT |
| VENTX_VENTX_2_SELEX\|VENTX_2 | CGCTAATCGGAAAACGATTAG | CTAATCGTTTTCCGATTAGCG |
| GTF2I_1 | AGAGGGAGG | CCTCCCTCT |
| TCF4_da_SANGER_10_FBgn0000413_B1H | CGCAGGTGTGC | GCACACCTGCG |
| SOX1_Sox21_3417_PBM\|SOX9_pTH1729_PBM | ATTGTTTTC | GAAAACAAT |
| E2F3_E2F3_3752_PBM | ATTGGCGCGC | GCGCGCCAAT |
| IRF_known11 | CAGTTTCGGTTCTC | GAGAACCGAAACTG |
| HOXD12_1 | AAGATTTTACGACCTTG | CAAGGTCGTAAAATCTT |
| GLI1_GLI2_2_SELEX\|GL12_2 | CAGTGTGGTCGC | GCGACCACACTG |
| NKX2-5_Bapx1_2343_PBM\|NKX2-5_pTH6327_PBM\|NKX2-5_Nkx2-3_3435_PBM\|NKX3-1_5\|NKX3-2_3\|NKX3-1_6 | ACCACTTAA | TTAAGTGGT |
| HMX1_1 | ACAAGCAATTAATGAAT | ATTCATTAATTGCTTGT |
| THRB_THB_do_HocoMoco | GAGGTCAGGTCAGGTCA | TGACCTGACCTGACCTC |
| HIC1_3 | ACTATGCCAACCTACC | GGTAGGTTGGCATAGT |
| PITX2_PITX2_si_HocoMoco | TGGGATTAAA | TTTAATCCCA |
| JUN_HeLa-S3_JUND_Stanford_ChIP-seq | AAGAATGAGTCATCA | TGATGACTCATTCTT |
| HMX1_VSHMX1_01_Transfac\|HMX3_1 | CAAGTGCGTG | CACGCACTTG |
| PRDM16_EVI1_f1_HocoMoco | AAGATAAGATAAGATA | TATCTTATCTTATCTT |
| HOXB2_HXB1_f1_HocoMoco | CCATCCATCA | TGATGGATGG |
| E2F4_HeLa-S3_E2F4_UCD_ChIP-seq | GGCGGGAAATTTGAA | TTCAAATTTCCCGCC |

TABLE 5-continued

Transcription Factor Binding Sites of Synthetic Promoters

| Name | Binding Site Sequence | Reverse Complement |
|---|---|---|
| AP1_known1 | ACTGAGTCACC | GGTGACTCAGT |
| IKZF1_V$IK1_01_Transfac\|IKZF1_1 | ACTTGGGAATACC | GGTATTCCCAAGT |
| RARG_RARG_1_SELEX\|RARG_1 | GAGGTCAAAAGGTCACA | TGTGACCTTTTGACCTC |
| PAX9_GM12878_PAX5C20_HudsonAlpha_ChIP-seq\|PAX9_GM12892_PAX5C20_HudsonAlpha_ChIP-seq\|PAX9_GM12878_PAX5N19_HudsonAlpha_ChIP-seq\|PAX9_Mv108_ChIP-seq | GCAGCCAAGCGTGAC | GTCACGCTTGGCTGC |
| GSC_Gsc_2327_PBM | GCTAATCCC | GGGATTAGC |
| HOXC6_pTH6164_PBM | AATAATTATA | TATAATTATT |
| REST_disc4 | GCACCAGGGACAGC | GCTGTCCCTGGTGC |
| POU2F2_4 | TATGAATATTCAAA | TTTGAATATTCATA |
| PKNOX2_MEIS2_do_HocoMoco | TGACAGCTGTCAA | TTGACAGCTGTCA |
| HSFY1_HSFY2_2_SELEX\|HSFY2_2 | CGTTCGAAA | TTTCGAACG |
| NR2F2_V$ARP1_01_Transfac\|NR2F2_1 | AGGGGTCAAGGGTTCA | TGAACCCTTGACCCCT |
| CTCF_HUVEC_CTCF_UW_ChIP-seq | CTCCGGCGCCCCTGGTGGC | GCCACCAGGGGCGCCGGAG |
| POU2F2_known9 | AATTAGCATAGA | TCTATGCTAATT |
| CTCF_HepG2_CTCF_UT-A_ChIP-seq | AGTGCCACCTAGTGG | CCACTAGGTGGCACT |
| CTCF_GM06990_CTCF_UW_ChIP-seq | CTCGGCGCCCCTGGTGGCC | GGCCACCAGGGGCGCCCGAG |
| PITX2_pTH5644_PBM | AGGGATTAA | TTAATCCCT |
| RXRA_known1 | CGGGTGACCTTTGACCCCTGA | TCAGGGGTCAAAGGTCACCCG |
| HOXD12_pTH6533_PBM\|CDX2_pTH6515_PBM\|CDX2_pTH5553_PBM\|HOXC5_Hoxc6_3954_PBM\|NKX6-1_4\|N KX6-1_5\|NKX6-1_6 | GTAATTAA | TTAATTAC |
| NR1I2_NR1I2_U_HocoMoco | CTGAACTTTTTTGACCTCA | TGAGGTCAAAAAAGTTCAG |
| MEOX2_Meox2_1_SELEX\|MEOX2_4 | GTAATTAC | GTAATTAC |
| TEF_TEF_1_SELEX\|TEF_Dbp_1_SELEX\|TEF_DBP_2_SELEX\|DBP_3\|DBP_4\|TEF_2 | TATTACGTAACA | TGTTACGTAATA |
| IRF2_MA0051.1_SELEX\|IRF_known10 | GGAAAGCGAAACCAAAAC | GTTTTGGTTTCGCTTTCC |
| NEUROG1_NEUROG2_2_SELEX\|NEUROG1_NEUROG2_1_SELEX\|NEUROG2_1\|NEUROG2_2 | AACATATGTC | GACATATGTT |
| AR_MA0113.2_ChIP-seq\|NR3C1_disc1 | AGAACAGAATGTTCT | AGAACATTCTGTTCT |
| GBX2_1 | AATCGCTAATTAGCGCT | AGCGCTAATTAGCGATT |
| E2F3_pTH9221_PBM | TACGCGCGTA | TACGCGCGTA |
| ATOH7_Atoh1_1_SELEX\|OLIG2_OLIG1_1_SELEX\|ATOH1_1\|OLIG1_1 | AACATATGTT | AACATATGTT |
| ARNT2_V$ARNT_01_Transfac\|ARNT_1 | GCGGGCACGTGACAAC | GTTGTCACGTGCCCGC |
| ETS1_ETS1_2_SELEX\|ETS_known15 | ACCGGAAGTACATCCGGT | ACCGGATGTACTTCCGGT |
| DM BX1_Gsc_Cell_FBgn0010323_B1H | ATTAATCC | GGATTAAT |

TABLE 5-continued

Transcription Factor Binding Sites of Synthetic Promoters

| Name | Binding Site Sequence | Reverse Complement |
|---|---|---|
| CTCF_N_HDF-Ad_CTCF_Broad_ChIP-seq | GCCACCAGATGGCACTA | TAGTGCCATCTGGTGGC |
| GATA_known10 | AGATAAAGGGA | TCCCTTTTATCT |
| LHX8_Lhx6_3432_PBM | GCTGATTAC | GTAATCAGC |
| MEF2_known7 | CGGTTTAAAAATAACC | GGTTATTTTTAAACCG |
| ONECUT1_1 | AAAAATCAATAA | TTATTGATTTTT |
| HOXB13_HXA13_f1_HocoMoco | CCAATAAAACC | GGTTTTATTGG |
| ETS1_ETS1_4_SELEX\|ETS_known17 | ACCGGAAGTACATCCGGC | GCCGGATGTACTTCCGGT |
| SOX1_pTH2677_PBM | CATTGTTA | TAACAATG |
| SOX13_SOX13_f1_HocoMoco | CATTGTTC | GAACAATG |
| FOXD1_HCM1_2157_PBM | GGTAAACAA | TTGTTTACC |
| AHR::ARNT_3 | CACGCA | TGCGTG |
| INSM1_INSM1_f1_HocoMoco | TGCCCCCTGACA | TGTCAGGGGCA |
| NFKB_disc2 | GAAATCCCCAGC | GCTGGGGATTTC |
| HNF1B_1 | GTTAAATATTAA | TTAATATTTAAC |
| SOX9_V$SOX9_B1_Transfac\|SOX9_1 | TAAGAACAATGGGA | TCCCATTGTTCTTA |
| ZNF148_Zfp281_0973_PBM | CCACCCCCCC | GGGGGGGTGG |
| HOXA2_1\|PDX1_4 | AAGGTAATTAGCTCAT | ATGAGCTAATTACCTT |
| NKX2-5_NKX21_f1_HocoMoco | AGCACTTGAG | CTCAAGTGCT |
| SRF_GM12878_SRF_HudsonAlpha_ChIP-seq | CCATGGCCAAATAAGGCAA | TTGCCTTATTTGGCCATGG |
| ZBTB7A_disc2 | AAGGGGCG | CGCCCCTT |
| GCM1_GCM1_2_SELEX\|GCM1_3 | ATGCGGGTACCCGCAT | ATGCGGGTACCCGCAT |
| TAL1_known3 | GAGACCATCTGTTCCC | GGGAACAGATGGTCTC |
| ZIC5_MA0456.1_B1H\|ZIC5_opa_NAR_FBgn0003002_B1H | CAGCGGGGGGTC | GACCCCCGCTG |
| ELF3_ELF3_2_SELEX\|ELF3_3 | AACCCGGAAGTAA | TTACTTCCGGGTT |
| ZBTB49_ZBTB49_1_SELEX\|ZBTB49_1 | TGACGTGCCAGGCGAAA | TTTCGCCTGGCACGTCA |
| TEF_MA0043.1_SELEX\|HLF_2 | GGTTACGCAATA | TATTGCGTAACC |
| FOXD1_V$HFH1_01_Transfac\|FOXD1_FOXQ1_f1_HocoMoco\|FOXQ1_1 | AAATAAACAATA | TATTGTTTATTT |
| TEF_pTH3831_PBM\|TEF_pTH5078_PBM\|NFIL3_pTH5082_PBM | TATTACGTAA | TTACGTAATA |
| STAT1_MA0137.3_ChIP-seq | TTTCCAGGAAA | TTTCCTGGAAA |
| NFE2L1_V$TCF11_01_Transfac | CGGCCAAAATGAC | GTCATTTTGGCCG |
| RFX8_RFX2_f1_HocoMoco | TGTTGCTAGGGAA | TTCCCTAGCAACA |
| TCF4_ato_da_SANGER_10_FBgn0000413_B1H\|ATOH7_ato_da_SANGER_10_FBgn0010433_B1H | CCACCTGTCAC | GTGACAGGTGG |
| KLF14_pTH2353_PBM | ACCGTTAT | ATAACGGT |
| AP1_known4 | ACTTAGTCACT | AGTGACTAAGT |
| ETV5_FLI1_f1_HocoMoco | GCCACAGGAAGTGAGGA | TCCTCACTTCCTGTGGC |

TABLE 5-continued

Transcription Factor Binding Sites of Synthetic Promoters

| Name | Binding Site Sequence | Reverse Complement |
|---|---|---|
| CEBPA_V$CEBPA_01_Transfac\|CEBPA_1 | ATATTGCAAAATCA | TGATTTTGCAATAT |
| PPARA_PPARG_f1_HocoMoco | AAGTAGGTCAAAGGTCAC | GTGACCTTTGACCTACTT |
| MEF2_known8 | AGGGTTATTTTTAGAG | CTCTAAAAATAACCCT |
| MTF1_2 | GGGCCGTGTGCAAAAA | TTTTTGCACACGGCCC |
| SIX5_known3 | AAAAGTGATACCCCATT | AATGGGGTATCACTTTT |
| NKX3-2_2 | CATAACCACTTAACAAC | GTTGTTAAGTGGTTATG |
| E2F1_E2F1_1_SELEX\|E2F_known27 | ATTGGCGCCAAA | TTTGGCGCCAAT |
| POU3F3_V$POU3F2_02_Transfac\|POU3F2_3 | ATTAACATAA | TTATGTTAAT |
| AL662830.5_exd_FlyReg_FBgn0000611_B1H | TAAAACAAAA | TTTTGTTTTA |
| DUX4_MA0468.1_ChIP-seq | TAATTTAATCA | TGATTAAATTA |
| FOXD1_FOX13_2_SELEX\|FOXD1_Foxj3_2_SELEX\|FOXD1_FOXJ2_1_SELEX\|FOXJ2_3\|FOXJ3_3\|FOXJ3_6 | GTAAACAATAAACA | TGTTTATTGTTTAC |
| HNF1B_2 | ACGGCTAGTTAACAGCT | AGCTGTTAACTAGCCGT |
| TCF12_disc4 | AACCGAAA | TTTCGGTT |
| ARID3C_pTH9384_PBM\|ARID3C_pTH5169_PBM\|ARID3C_pTH9214_PBM\|ARID3B_pTH5117_PBM | TAATTAAAA | TTTTAATTA |
| ESX1_1 | ATCCATTAATTAATTGA | TCAATTAATTAATGGAT |
| SPDEF_SPDEF_1_SELEX\|SPDEF_SPDEF_4_SELEX\|SPDEF_2\|SPDEF_5 | ACCCGGATGTA | TACATCCGGGT |
| TBX5_1 | AAAGGTGTCAAA | TTTGACACCTTT |
| CEBPA_CEBPB_f1_HocoMoco | ATTGCACAAC | GTTGTGCAAT |
| MAX_V$MAX_01_Transfac\|MYC_known2 | AAACCACGTGGTTT | AAACCACGTGGTTT |
| POU1F1_3 | GACTTAATTAATTAATC | GATTAATTAATTAAGTC |
| CTCF_GM12878_CTCF_UT-A_ChIP-seq\|CTCF_HRPEpiC_CTCF_UW_ChIP-seq | CACCAGGGGCG | CGCCCCTGGTG |
| CEBPA_CEBPA_do_HocoMoco | ATTGCACAAT | ATTGTGCAAT |
| STAT5B_V$STAT5A_01_Transfac\|STAT_known4 | GAATTCCAGGAAATA | TATTTCCTGGAATTC |
| T_BRAC_si_HocoMoco | ACATAGTGACACCTAGGTGTGAAAT | ATTTCACACCTAGGTGTCACTATGT |
| RARG_RARA_f2_HocoMoco | AGGTCACCGAGAGGTCA | TGACCTCTCGGTGACCT |
| ZSCAN10_pTH1292_PBM | AGGAAGTGCAA | TTGCACTTCCT |
| CEBPA_pTH5166_PBM | ATTACGTAAT | ATTACGTAAT |
| EGR1_disc5 | ACCGCCCA | TGGGCGGT |
| RELA_SRP001843_p65_Input_ChIP-seq | AGAGGAGAGGAGAAGAGGAGGGAGGAAGAG | CTCTTCCTCCCTCCTCTTCTCCTCTCCTCT |
| SIX5_disc1\|ZNF143_disc2 | ACTACAATTC | GAATTGTAGT |
| ZBTB33_known 1 | TTAGCAGGAA | TTCCTGCTAA |

TABLE 5-continued

Transcription Factor Binding Sites of Synthetic Promoters

| Name | Binding Site Sequence | Reverse Complement |
|---|---|---|
| BARX1_Barx1_2877_PBM\|BARHL2_BARHL2_5_SELEX\|BARHL2_Barhl1_2_SELEX\|BARHL2_6\|BARHL1_3 | AGCAATTAGC | GCTAATTGCT |
| SPZ1_2 | AGGGTAACAGC | GCTGTTACCCT |
| OTX1_1 | ATAAATTAATCCCCTCC | GGAGGGGATTAATTTAT |
| HMGA2_HMGA2_f1_HocoMoco | AATAATCGCGAATAT | ATATTCGCGATTATT |
| TFAP2A_MA0524.1_ChIP-seq | CATGGCCCCAGGGCA | TGCCCTGGGGCCATG |
| SP9_pTH4998_PBM | GGGGGCGGA | TCCGCCCCC |
| EN2_En2_1_SELEX\|EMX2_EMX2_1_SELEX\|HOXC5_HOXD8_1_SELEX\|DMBX1_ALX3_1_SELEX\|NOTO_NOTO_1_SELEX\|EMX2_EMX1_1_SELEX\|ALX3_2\|EMX1_1\|EMX2_2\|EN2_4\|HOXD8_2\|NOTO_1 | GCTAATTAGC | GCTAATTAGC |
| POU6F2_POU6F2_3_SELEX\|POU6F2_3 | GCTAATTAGA | TCTAATTAGC |
| ZNF143_disc4 | CCAGCGCCCGC | GCGGGCGCTGG |
| POU3F3_POU3F1_2_SELEX\|POU3F1_3 | ATGCATAATTTA | TAAATTATGCAT |
| HOXA5_2 | AATTAGTG | CACTAATT |
| PAX1_1 | ATATCTAGAGCGGAACGG | CCGTTCCGCTCTAGATAT |
| ATF3_disc2 | GGCGCGCGGCGGTGACGTGAC | GTCACGTCACCGCCGCGCGCC |
| PAX4_V$PAX4_01_Transfac\|PAX4_1 | GGCGGTCATGCGTGCGCGACC | GGTCGCGCACGCATGACCGCC |
| AL662830.5_V$PBX1_01_Transfac\|PBX1_1 | ATCAATCAA | TTGATTGAT |
| LHX8_1 | ACCCCTAATTAGCGGTG | CACCGCTAATTAGGGGT |
| RHOXF1_RHOXF1_2_SELEX\|RHOXF1_4 | ATAATCCC | GGGATTAT |
| E2F1_HeLa-53_E2F1_UCD_ChIP-seq | CCGCGCGCCCTCCCC | GGGGAGGGCGCGCGG |
| DLX1_DLX2_f1_HocoMoco | ATAATTAT | ATAATTAT |
| HIC1_4 | GTGCCAGCCTATGCCAAC | GTTGGCATAGGCTGGCAC |
| TBX1_TBX20_3_SELEX\|TBX20_3 | CTTTCACACCTTTTC | GAAAAGGTGTGAAAG |
| HSF2_HSF2_si_HocoMoco | AGAATGTTCTAGAA | TTCTAGAACATTCT |
| CTCF_disc1 | ACCACTAGATGGCACTATTGCA | TGCAATAGTGCCATCTAGTGGT |
| HNF4_disc5 | ACAAAGGGC | GCCCTTTGT |
| FOXD1_pTH9116_PBM | ATGTAAACAAA | TTTGTTTACAT |
| DLX1_DLX5_1_SELEX\|DLX5_2 | ATAATTAC | GTAATTAT |
| POU3F3_Oct-1_PBM\|HOXC5_Dfd_FlyReg_FBgn0000439_B1H | ATAATTAA | TTAATTAT |
| VSX2_VSX1_1_SELEX\|HOXA4_1\|VSX1_2 | ATAATTAG | CTAATTAT |
| DLX3_1 | GTCGGTAATTATCGCGA | TCGCGATAATTACCGAC |
| PAX2_3 | AGTCACGC | GCGTGACT |
| SOX1_SOX2_5_SELEX\|SOX2_6 | TATCAATAACATTGATA | TATCAATGTTATTGATA |
| SOX9_SOX8_4_SELEX\|SOX8_5 | CATCAATTGCAGTGATC | GATCACTGCAATTGATG |
| PAX2_MA0067.1_SELEX | AGTCACGG | CCGTGACT |

TABLE 5-continued

Transcription Factor Binding Sites of Synthetic Promoters

| Name | Binding Site Sequence | Reverse Complement |
|---|---|---|
| ESRRA_known5 | TATTCAAGGTCATGCGA | TCGCATGACCTTGAATA |
| NFATC1_NFATC1_2_SELEX\|NFATC1_2 | TTTCCATAATGGAAA | TTTCCATTATGGAAA |
| SMAD_1 | AGACACCAC | GTGGTGTCT |
| FOXD1_FOXB1_3_SELEX\|FOXD1_FOXC1_3_SELEX\|FOXB1_3\|FOXC1_5 | ATATTTACATA | TATGTAAATAT |
| SRF_V$SRF_C_Transfac\|SRF_known3 | CTGGCCATATATGGC | GCCATATATGGCCAG |
| TCF4_TCF4_1_SELEX\|TCF4_1 | AGCAGGTGCG | CGCACCTGCT |
| EGR1_disc6 | CCCCGGCCTCC | GGAGGCCGGGG |
| RAD21_disc9 | ACTAGACGAGATG | CATCTCGTCTAGT |
| SMAD1_SMAD1_si_HocoMoco | AGCCTGTCTGCC | GGCAGACAGGCT |
| IRF_known8 | CTTTCACTTTC | GAAAGTGAAAG |
| GMEB1_1 | CCATCGTACGTACACTC | GAGTGTACGTACGATGG |
| DMBX1_V$CART1_01_Transfac\|ALX1_1 | AACTAATTACCATTATCG | CGATAATGGTAATTAGTT |
| CREB3L2_CrebA_SANGER_5_FBgn0004396_B1H | GATTACGTGGCA | TGCCACGTAATC |
| HOXA7_1 | AGATTGG | CCAATCT |
| FOXD1_FOXF2_f1_HocoMoco | AAAAGTAAACA | TGTTTACTTTT |
| EOMES_TBX21_6_SELEX\|TBX21_6 | TCACACCTAAAAGGTGTGA | TCACACCTTTTAGGTGTGA |
| ATF3_known9 | CGATGACGTCAGAG | CTCTGACGTCATCG |
| IRX3_MA0210.1_B1H\|IRX3_MA0217.1_B1H | TAACA | TGTTA |
| USF1_H1-hESC_USF1_HudsonAlpha_ChIP-seq | CGCGGCCACGTGACC | GGTCACGTGGCCGCG |
| FOXD1_MA0030.1_SELEX\|FOXF2_2 | ATTGTTTACGTTTG | CAAACGTAAACAAT |
| RHOXF1_1 | AAGACGCTGTAAAGCGA | TCGCTTTACAGCGTCTT |
| GATA2_srp_FlyReg_FBgn0003507_B1H | ATCAACCGATAG | CTATCGGTTGAT |
| ATF7_pTH5081_PBM | GATGACGTCA | TGACGTCATC |
| MEF2_disc2 | AGGAAATGA | TCATTTCCT |
| FOXP4_CG2052_SANGER_2.5_FBgn0039905_B1H | AAAACCAAAAAAT | ATTTTTTGGTTTT |
| TFCP2_1 | CTGGGTTGTGC | GCACAACCCAG |
| SOX13_MA0087.1_SELEX\|SOX5_2 | AAACAAT | ATTGTTT |
| PITX2_Pitx3_3497_PBM\|DRGX_Crx_3485_PBM\|OTX2_Oc_SOLEXA_FBgn0004102_B1H\|RHOXF1_RHOXF1_4_SELEX\|CRX_pTH10716_PBM\|OTP_Otx2_3441_PBM\|PITX2_Pitx2_2274_PBM\|PITX2_PITX1_3_SELEX\|DRGX_Otx1_2325_PBM\|RHOXF1_6\|PITX1_4 | GGGATTAA | TTAATCCC |
| SHOX_MA0075.1_SELEX\|PRRX2_2 | AATTA | TAATT |
| ATF3_Jundm2_0911_PBM\|ATF1_Atf1_3026_PBM\|ATF3_pTH5464_PBM | GATGACGTAA | TTACGTCATC |
| ETV7_1 | CAGGAAGTAG | CTACTTCCTG |
| RARG_RARG_6_SELEX\|RARG_6 | AAGGTCAACAGAGGTCA | TGACCTCTGTTGACCTT |

TABLE 5-continued

Transcription Factor Binding Sites of Synthetic Promoters

| Name | Binding Site Sequence | Reverse Complement |
|---|---|---|
| EGR1_known3 | GTCGCCCCCAC | GTGGGGGCGAC |
| CDX2_V$CDXA_01_Transfac | ATTTATG | CATAAAT |
| E2F1_V$E2F_01_Transfac\|E2F_known1 | CAGTTTTCGCGCGTA | TACGCGCGAAAACTG |
| RELA_GM15510_NFKB_Stanford_ChIP-seq | AGGGGATTTCCAGG | CCTGGAAATCCCCT |
| SRY_V$SRY_01_Transfac\|SRY_1 | AAACAAA | TTTGTTT |
| ESRRG_MA0141.2_ChIP-seq | AGGTCAAGGTCA | TGACCTTGACCT |
| HOXC5_HXA5_si_HocoMoco\|HOXC5_HX67_si_HocoMoco | CATTAATCAA | TTGATTAATG |
| MAF_known1 | AGGCAACTTCCCTCTA | TAGAGGGAAGTTGCCT |
| YY2_K562_YY1_HudsonAlpha_ChIP-seq | ACCCAAGATGGCGGC | GCCGCCATCTTGGGT |
| PPARA_PPARA_f1_HocoMoco\|NR5A1_ftz-f1_SANGER_5_FBgn0001078_B1H\|NR2F2_svp_SANGER_5_FBgn0003651_B1H | AAGGTCA | TGACCTT |
| AP1_known6 | GAATGAGTCAGCA | TGCTGACTCATTC |
| CDX2_MA0465.1_ChIP-seq | AAGCCATAAAA | TTTTATGGCTT |
| MAFB_MA0117.1_SELEX\|MAF_known3 | GCGTCAGC | GCTGACGC |
| NFE2L1::MAFG_2 | CATGAC | GTCATG |
| HOXC5_Hoxa3_2783_PBM | AGGTCATTAA | TTAATGACCT |
| PPARA_PPARD_f1_HocoMoco | TAGGACAAAGGTCA | TGACCTTTGTCCTA |
| YY2_pho_SOLEXA_5_FBgn0002521_B1H | ACCAAAATGGCGGCC | GGCCGCCATTTTGGT |
| HNF4_known9 | GGGGCAAAGTTCAA | TTGAACTTTGCCCC |
| ELF3_ELF3_1_SELEX\|ELF3_EHF_1_SELEX\|EHF_2\|ELF3_2 | AACCCGGAAGTA | TACTTCCGGGTT |
| ELF1_ELF1_1_SELEX\|ELF1_ELF1_2_SELEX\|ELF1_ELF4_1_SELEX\|ELF1_known2\|ELF1_known3\|ELF4_1 | AACCCGGAAGTG | CACTTCCGGGTT |
| MYOD1_MYF6_f1_HocoMoco\|TFCP2_2 | CAGCTGC | GCAGCTG |
| SOX17_MA0078.1_SELEX\|SOX17_2 | CTCATTGTC | GACAATGAG |
| MAFK_K562_MAFK_Stanford_ChIP-seq | AATTGCTGACTCAGC | GCTGAGTCAGCAATT |
| ZNF740_1 | CAAGTGGGGGGGGGG | CCCCCCCCCCACTTG |
| MAX_MAX_f1_HocoMoco | ACCACGTGGCT | AGCCACGTGGT |
| PKNOX2_Pknox2_1_SELEX\|PKNOX2_Meis3_2_SELEX\|PKNOX2_Meis2_2_SELEX\|PKNOX2_PKNOX1_1_SELEX\|PKNOX2_PKNOX2_1_SELEX\|MEIS1_MEIS3_2_SELEX\|MEIS3_3\|MEIS2_4\|MEIS3_5\|PKNOX1_2\|PKNOX2_2\|PKNOX2_3 | TGACACCTGTCA | TGACAGGTGTCA |
| E2F6_HeLa-S3_E2F6_UCD_ChIP-seq\|E2F6_K562b_E2F6_UCD_ChIP-seq | GGGGCGGGAAA | TTTCCCGCCCC |
| NFKB_known6 | GGCGGGAAATTCCCC | GGGGAATTTCCCCGCC |
| RAX_1 | GTGCGCTAATTAGTCA | TGACTAATTAGCGCAC |
| PAX2_V$PAX2_01_Transfac | CCTCGTCACGCATGATGGC | GCCATCATGCGTGACGAGG |
| MYC_disc2 | ACCACGTGGCC | GGCCACGTGGT |
| PAX2_1 | CCTCGTCACGCATGATGGA | TCCATCATGCGTGACGAGG |
| E2F2_E2F2_3_SELEX\|E2F2_4 | AAAATGGCGCCATTTT | AAAATGGCGCCATTTT |

TABLE 5-continued

Transcription Factor Binding Sites of Synthetic Promoters

| Name | Binding Site Sequence | Reverse Complement |
| --- | --- | --- |
| SOX9_Sox10_1_SELEX\|SOX11_Sox11_1_SELEX\|SOX10_8\|SOX11_2 | AACAATTTCAGTGTT | AACACTGAAATTGTT |
| GATA2_T-47D_GATA3_HudsonAlpha_ChIP-seq | ACAGATTCTTATCTG | CAGATAAGAATCTGT |
| PKNOX2_MEIS1_f2_HocoMoco | CATAAAACTGTCA | TGACAGTTTTATG |
| SIX6_Six6_2267_PBM | GAATGATATCC | GGATATCATTC |
| E2F3_pTH9288_PBM | AGCGCGCGCG | CGCGCGCGCT |
| ESRRA_known2 | AGATCAAGGTCATA | TATGACCTTGATCT |
| TCF7L2_I$TCF_1_Transfac | AAGATCAAAGG | CCTTTGATCTT |
| JUN_pTH3064_PBM | TGACTCAA | TTGAGTCA |
| ESRRG_ECC-1_ERALPHA_HudsonAlpha_ChIP-seq | AGGTCACCGTGACCT | AGGTCACGGTGACCT |
| ID4_ID4_1_SELEX\|ID4_1 | GACAGGTGTA | TACACCTGTC |
| ZSCAN4_ZSCAN4_1_SELEX\|ZSCAN4_3 | TGCACACACTGAAAA | TTTTCAGTGTGTGCA |
| TFAP2_known10 | ATTGCCTGAGGCGAA | TTCGCCTCAGGCAAT |
| ESR2_ESR2_do_HocoMoco | AGGTCACCGTGACCC | GGGTCACGGTGACCT |
| SIX2_Six1_0935_PBM\|SIX6_pTH5928_PBM | ATGATACCCC | GGGGTATCAT |
| RARG_RARG_2_SELEX\|RARG_2 | AAGGTCAACTAAAGGTCA | TGACCTTTAGTTGACCTT |
| TBX1_TBX20_1_SELEX\|TBX1_TBX20_5_SELEX\|TBX20_1\|TBX20_5 | AGGTGTGAAGGTGTGA | TCACACCTTCACACCT |
| BARHL2_BARHL2_6_SELEX\|BARHL2_7 | CAATTAGCACCAATTA | TAATTGGTGCTAATTG |
| HNF4_known14 | AGGCCAAAGGTCA | TGACCTTTGGCCT |
| NR1H4_1 | CAAGGTCATTAACC | GGTTAATGACCTTG |
| NHLH2_HLH4C_da_SANGER_5_3_FBgn0011277_B1H\|TCF4_HLH4C_da_SANGER_5_3_FBgn0000413_B1H | CACCTGCTCC | GGAGCAGGTG |
| LMX1B_1 | AGTTTTTAATTAATTTG | CAAATTAATTAAAAACT |
| TCF7L2_known1 | CCTTTGAA | TTCAAAGG |
| HNF1A_2 | ACTTAGTTAACTAAAAA | TTTTTAGTTAACTAAGT |
| E2F_disc1\|HEY1_disc1 | GGTGACGTCA | TGACGTCACC |
| FOXD1_Foxj3_0982_PBM\|FOXD1_pTH6549_PBM | TGTAAACAA | TTTGTTTACA |
| EGR3_EGR3_f1_HocoMoco | ACACCCACTCT | AGAGTGGGTGT |
| SP1_pTH5421_PBM | CATGCAGC | GCTGCATG |
| AL662830.5_PBX2_f1_HocoMoco | CCATCAATCAATTTA | TAAATTGATTGATGG |
| IRX3_Mirr_Cell_F_Bgn0014343_B1H | AAAAAACA | TGTTTTTT |
| REST_disc6 | ACAGCGCT | AGCGCTGT |
| EOMES_1 | AATTTCACACCTTTTA | TAAAAGGTGTGAAATT |
| HF1H36_1 | GCCCCTCCCCCACC | GGTGGGGAGGGGC |
| NR1D2_NR1D1_f1_HocoMoco | AAAAGTAGGTCAGA | TCTGACCTACTTTT |
| BCL_disc8 | CCCCGCTGCCCGGC | GCCGGGCAGCGGGG |
| S_N3A_disc3 | ACCATGGACAG | CTGTCCATGGT |
| EOMES_EOMES_2_SELEX\|EOMES_3 | TCACACCTTAGAAGGTGTGA | TCACACCTTCTAAGGTGTGA |

TABLE 5-continued

Transcription Factor Binding Sites of Synthetic Promoters

| Name | Binding Site Sequence | Reverse Complement |
|---|---|---|
| HDAC2_disc4 | CGCGCGCGCG | CGCGCGCGCG |
| ARX_1 | GTCCATTAATTAATGGA | TCCATTAATTAATGGAC |
| HOXC10_Hoxc9_2367_PBM\|MNX1_MNX1_1_SELEX\|MNX1_2 | GGTAATTAAA | TTTAATTACC |
| LCOR_pTH8558_PBM | AATTTTGGG | CCCAAAATT |
| HOXB2_HOXA1_1_SELEX\|HOXA1_2 | GGTAATTAAC | GTTAATTACC |
| ZNF35_1 | AACAAACAACAAGAG | CTCTTGTTGTTTGTT |
| CEBPG_CEBPG_2_SELEX\|CEBPA_pTH5460_PBM\|CEBPA_CEBPB_1_SELEX\|CEBPA_CEBPB_2_SELEX\|CEBPG_CEBPG_1_SELEX\|CEBPA_Cebpb_1_SELEX\|CEBPA_CEBPE_1_SELEX\|CEBPA_CEBPD_1_SELEX\|CEBPB_disc1\|CEBPB_known8\|CEBPB_known9\|CEBPD_2\|CEBPE_1\|CEBPG_2\|CEBPG_3\|CEBPB_known 10 | ATTGCGCAAT | ATTGCGCAAT |
| YY1_phol_SANGER_5_FBgn0035997_B1H\|TATA_disc1 | CAAGATGGCG | CGCCATCTTG |
| HOXD12_HOXC12_2_SELEX\|HOXC12_3 | GGTCGTAAAAA | TTTTTACGACC |
| STAT5B_V$STAT5A_02_Transfac\|STAT_known6 | CTCTAGGAAACGCAATTCTGGGAA | TTCCCAGAATTGCGTTTCCTAGAG |
| TCF3_6 | ATCCACAGGTGCGAAAA | TTTTCGCACCTGTGGAT |
| MEF2B_MEF2A_1_SELEX\|MEF2_known12 | TCTAAAATAGA | TCTATTTTAGA |
| BATF_BATF_si_HocoMoco | ATGAGTCATA | TATGACTCAT |
| DMBX1_MA0190.1_B1H\|OTX2_MA0234.1_B1H | GGATTA | TAATCC |
| NPAS2_gce_Clk_SANGER_5_FBgn0023076_B1H\|MYCN_MA0104.3_ChIP-seq | CACGTGGC | GCCACGTG |
| FOXD1_FOXF1_f1_HocoMoco | AAAATAAACAT | ATGTTTATTTT |
| EGR3_pTH2820_PBM | CCGCCCACGC | GCGTGGGCGG |
| GLI1_GLI3_si_HocoMoco\|GLI1_GSE11062_Gli3_ChIP-seq | CTGGGTGGTCC | GGACCACCCAG |
| EP300_disc5 | AAAGAGGAAGTGAAA | TTTCACTTCCTCTTT |
| IRX3_Irx3_1_SELEX\|IRX3_3 | CTACATGACAAA | TTTGTCATGTAG |
| AL662830.5_Pbx1_3203_PBM | CCCATCAAA | TTTGATGGG |
| HAND1_1 | AATGCCAGACGCCATT | AATGGCGTCTGGCATT |
| E2F_known18 | GTTTGGCGCGAA | TTCGCGCCAAAC |
| MXI1_disc1 | CCGTCGCCATGGCAAC | GTTGCCATGGCGACGG |
| NR1H2_NR1H2_f1_HocoMoco | CGTTGACCTTTGACCTTTA | TAAAGGTCAAAGGTCAACG |
| SMAD2_SMAD3_1_SELEX\|SMAD3_3 | CGTCTAGACA | TGTCTAGACG |
| SP9_SP4_1_SELEX\|SP4_2 | AAAGGGGGCGTGGCTTA | TAAGCCACGCCCCCTTT |
| TAL1_known1 | CCGACCATCTGTTCAG | CTGAACAGATGGTCGG |
| BARHL2_pTH6503_PBM | AACCAATTAATAT | ATATTAATTGGTT |

TABLE 5-continued

Transcription Factor Binding Sites of Synthetic Promoters

| Name | Binding Site Sequence | Reverse Complement |
|---|---|---|
| GBX2_Unpg_SOLEXA_FBgn0015561_B1H\|MEOX2_Btn_SOLEXA_FBgn0014949_B1H\|SHOX_CG11294_SOLEXA_FBgn0030058_B1H\|EN2_En_SOLEXA_FBgn0000577_B1H\|VSX2_MA0181.1_B1H\|LHX1_Lim3_SOLEXA_FBgn0002023_B1H\|SHOX_MA0172.1_B1H\|HLX_Hlx1_2350_PBM\|LBX2_Lbe_SOLEXA_FBgn0011278_B1H\|HOXA4_MA0257.1_B1H\|HOXC6_MA0230.1_B1H\|LHX9_Ap_SOLEXA_FBgn0000099_B1H\|RAX2_Repo_SOLEXA_FBgn0011701_B1H\|SHOX_Otp_SOLEXA_FBgn0015524_B1H\|EMX2_E5_SOLEXA_FBgn0008646_B1H\|HOXC5_MA0238.1_B1H\|EN2_MA0220.1_B1H\|SHOX_Pph13_SOLEXA_FBgn0023489_B1H\|ALX1_CG9876_SOLEXA_FBgn0034821_B1H\|ALX1_AI_Cell_FBgn0000061_B1H\|HOXA4_Zen2_SOLEXA_FBgn0004054_B1H\|ALX1_MA0208.1_B1H\|ALX1_MA0179.1_B1H\|TLX3_MA0170.1_B1H\|LHX1_Lim1_SOLEXA_FBgn0026411_B1H\|HOXC5_MA0206.1_B1H\|SHOX_Hbn_Cell_F Bgn0008636_B1H\|NKX1-1_MA0245.1_B1H\|HOXC5_Pb_SOLEXA_FBgn0051481_B1H\|HOXC5_Ftz_SOLEXA_FBgn0001077_B1H\|HLX_MA0448.1_B1H\|ALX1_Rx_SOLEXA_FBgn0020617_B1H\|RAX2_MA0240.1_B1H\|NKX6-3_MA0191.1_B1H\|LHX1_MA0195.1_B1H\|SHOX_MA0457.1_B1H\|ALX1_CG32532_Cell_FBgn0052532_B1H\|VSX2_CG4136_Cell_FBgn0029775_B1H\|HOXC6_Lab_Cell_FBgn0002522_B1H\|LMX1A_Lmx1b_3433_PBM\|VSX2_CG4136_SOLEXA_FBgn0029775_B1H\|HOXC6_Lab_SOLEXA_FBgn0002522_B1H\|EMX2_MA0189.1_B1H\|NKX1-1_Slou_SOLEXA_FBgn0002941_B1H\|LHX1_MA0194.1_B1H\|ALX1_CG32532_SOLEXA_FBgn0052532_B1H\|SHOX_CG11294_Cell_FBgn0030058_B1H\|SHOX_MA0226.1_B1H\|LHX1_Lim1_Cell_FBgn0026411_B1H\|GBX2_MA0251.1_B1H\|EMX2_Ems_SOLEXA_FBgn0000576_B1H\|HLX_H2.0_Cell_FBgn0001170_B1H\|SHOX_MA0236.1_B1H\|LMX1A_MA0178.1_B1H | TAATTAA | TTAATTA |
| BX088580.2_POU3F4_2_SELEX\|POU3F4_3 | TAATTTATGCA | TGCATAAATTA |
| ZNF263_disc1 | CCTCCTCCCC | GGGGAGGAGG |
| HOXC10_Hoxd9_3_SELEX\|HOXD9_3 | GTCGTAAAA | TTTTACGAC |
| LM02_V$LMO2COM_01_Transfac | CAGCACCTGGCG | CGCCAGGTGCTG |
| BACH1_BACH1_si_HocoMoco | ACCATGACTCAGCA | TGCTGAGTCATGGT |
| NFE2_disc3 | CACGTGGCCC | GGGCCACGTG |
| SP9_CG5669_SANGER_10_FBgn0039169_B1H | AGGGGGCGGGGCCAA | TTGGCCCCGCCCCCT |
| OTP_OTX2_2_SELEX\|OTX2_3 | AGGATTAA | TTAATCCT |
| DRGX_OTX1_f1_HocoMoco | AGGATTAG | CTAATCCT |
| MYC_known9 | CAAGTAACACGTGACACTTG | CAAGTGTCACGTGTTACTTG |
| IRF_disc4 | AGGGGGCGGGGCCAG | CTGGCCCCGCCCCCT |
| ATF3_ATF3_f1_HocoMoco | GTGACGCCA | TGGCGTCAC |
| HES5_HES5_1_SELEX\|HES5_1 | CGGCACGTGCCA | TGGCACGTGCCG |
| HES5_HES5_2_SELEX | CGGCACGTGCCG | CGGCACGTGCCG |
| MYC_known5 | TACCACGTGTCA | TGACACGTGGTA |
| BARHL2_1 | AAAAACCAATTAAGAA | TTCTTAATTGGTTTTT |
| SOX17_1 | AACAAT | ATTGTT |
| MEF2B_MEF2D_f1_HocoMoco | GCTAAAAATAGC | GCTATTTTTAGC |
| IRF5_IRF5_2_SELEX\|IRF_known16 | AACCGAAACCA | TGGTTTCGGTT |
| RFX5_disc2 | AGCCAATCAG | CTGATTGGCT |

TABLE 5-continued

Transcription Factor Binding Sites of Synthetic Promoters

| Name | Binding Site Sequence | Reverse Complement |
|---|---|---|
| CEBPA_V$CEBPB_02_Transfac\|CEBPB_known2 | ATATTGCACAACTC | GAGTTGTGCAATAT |
| TP53_4 | ACATGCCCGGGCATGTCCGG | CCGGACATGCCCGGCATGT |
| REST_H1-hESC_NRSF_HudsonAlpha_ChIP-seq | AGCACCATGGACAGC | GCTGTCCATGGTGCT |
| MYOD1_3 | CCGAAGCAGGTGGCGAAG | CTTCGCCACCTGCTTCGG |
| ZNF740_Zfp740_1_SELEX\|ZNF740_ZNF740_1_SELEX\|ZNF740_ZNF740_2_SELEX\|ZNF740_2\|ZNF740_3\|ZNF740_4 | CCCCCCCCAC | GTGGGGGGGG |
| NOBOX_2 | CGCGCTAATTAGGTATC | GATACCTAATTAGCGCG |
| ZBTB7C_ZBTB7A_1_SELEX\|ZBTB7A_known3 | GGCGACCACCGA | TCGGTGGTCGCC |
| MYBL1_MA0100.2_ChIP-seq | CCAACTGCCA | TGGCAGTTGG |
| GFI1_1 | AAAAAATAAATCACAGCATATGCC | GGCATATGCTGTGATTTATTTTTT |
| KLF7_1 | ATAGGGGCGGGGTCGA | TCGACCCCGCCCCTAT |
| POU2F2_known10 | GATTTGCATA | TATGCAAATC |
| MYOD1_1 | CAACAGGTGGTG | CACCACCTGTTG |
| ALX1_PRRX1_f1_HocoMoco | CAGATTA | TAATCTG |
| CTCF_HMEC_CTCF_UW_ChIP-seq | CCACCAGGGGCGCCAG | CTGGCGCCCCTGGTGG |
| TCF7L2_Lef1_3504_PBM\|TCF7L1_Tcf7l2_3461_PBM | AGATCAAAGG | CCTTTGATCT |
| ZBTB7C_K562_ZBTB7A_HudsonAlpha_ChIP-seq | CCGAGACCCCTGCCC | GGGCAGGGGTCTCGG |
| TBX5_3 | AAGGTGTGAG | CTCACACCTT |
| TATA_known6 | TATTTATATATAAAGA | TCTTTATATATAAATA |
| EOMES_TBX21_5_SELEX\|TBX3_pTH3751_PBM\|TBX1_pTH3777_PBM\|EOMES_TBX21_2_SELEX\|TBX21_2\|TBX21_5 | AAGGTGTGAA | TTCACACCTT |
| OLIG2_BHLHE22_1_SELEX\|BHLHE22_1 | AAACATATGTTT | AAACATATGTTT |
| HOXA11_1 | ATGTTTTACGACTTTA | TAAAGTCGTAAAACAT |
| ETV5_ERG_2_SELEX\|ETV5_FLI1_4_SELEX\|ETV5_FLI1_2_SELEX\|ETV5_ERG_4_SELEX\|ERG_2\|ERG_4\|FLI1_2\|FLI1_4 | ACCGGAAATCCGGT | ACCGGATTTCCGGT |
| ESRRG_Esrra_1_SELEX\|ESRRA_known10 | TAGGTCAGTCAAGGTCA | TGACCTTGACTGACCTA |
| FOXD1_Foxj3_1_SELEX\|FOXJ3_5 | ACGGACACAAT | ATTGTGTCCGT |
| IRF1_MA0050.2_ChIP-seq | AAAGTGAAAGTGAAAGTAAAA | TTTTACTTTCACTTTCACTTT |
| SOX1_1 | AATCAATTCAATAATT | AATTATTGAATTGATT |
| CDC5L_CDC5L_si_HocoMoco | ATTATGTTAAATCAC | GTGATTTAACATAAT |
| SIX5_disc2\|ZNF143_disc1 | GGGAATTGTA | TACAATTCCC |
| GATA_known11 | AGATAAG | CTTATCT |
| HNF4G_Mv81_ChIP-seq\|HNF4G_MA0114.2_ChIP-seq | CTGGACTTTGGACTC | GAGTCCAAAGTCCAG |
| HOXC10_Hoxa10_2318_PBM\|HOXC10_Hoxa11_2218_PBM | GGTCATAAA | TTTATGACC |
| DMRTC2_pTH9387_PBM | AAATGTAA | TTACATTT |

TABLE 5-continued

Transcription Factor Binding Sites of Synthetic Promoters

| Name | Binding Site Sequence | Reverse Complement |
|---|---|---|
| FOXO6_FOXO1_1_SELEX\|FOXP4_pTH5656_PBM\|FOXD1_FOXJ3_1_SELEX\|FOXP4_pTH1288_PBM\|FOXD1_Foxj3_3_SELEX\|FOXD1_Foxk1_2323_PBM\|FOXD1_pTH5501_PBM\|FOXD1_Foxa2_2830_PBM\|FOXO6_FOXO3_2_SELEX\|KIAA0415_FKH2_4517_PBM\|FOXD1_pTH6638_PBM\|FOXO6_pTH3749_PBM\|FOXD1_pTH6729_PBM\|FOXD1_pTH6734_PBM1 FOXD1_slp2_SANGER_5_FBgn0004567_B1H\|FOXD1_FOXJ2_2_SELEX\|FOXJ2_4\|FOXJ3_2\|FOXO1_3\|FOXO3_5\|FOXJ37 | GTAAACAA | TTGTTTAC |
| LBX2_1 | TCGCATTAATTAATGCA | TGCATTAATTAATGCGA |
| YY2_GM12878_YY1_HudsonAlpha_ChIP-seq | CAAGATGGCGGCCGC | GCGGCCGCCATCTTG |
| GATA2_V$GATA1_06_Transfac | ATAGATAAGA | TCTTATCTAT |
| MYC_known19 | CCCGACCACGTGGTCA | TGACCACGTGGTCGGG |
| REST_V%NRSF_01_Transfac\|REST_known1 | GGCGCTGTCCGTGGTGCTGAA | TTCAGCACCACGGACAGCGCC |
| SP9_Sp1_SANGER_5_FBgn0020378_B1H | GCCACGCCCAC | GTGGGCGTGGC |
| NR3C1_disc4 | AACCAAGATGGCGGC | GCCGCCATCTTGGTT |
| EGR1_known6 | CAGATGCCGCCCACGCATTATTC | GAATAATGCGTGGGCGGCATCTG |
| PKNOX2_V$ME1S1_01_Transfac\|MEIS1_1 | CAGTGACAGGTC | GACCTGTCACTG |
| ZNF524_ZNF524_2_SELEX\|ZNF524_2 | CTCGAACCCGTGCC | GGCACGGGTTCGAG |
| SMAD4_Med_FlyReg_FBgn0011655_B1H | ATTGCCCGCCGC | GCGGCGGGCAAT |
| E2F3_MA0469.1_ChIP-seq | CTCCCGCCCCCACTC | GAGTGGGGGCGGGAG |
| POU3F3_V$OCT1_07_Transfac | AATTAGCATACA | TGTATGCTAATT |
| IRF4_1 | CGTATCGAAACCAAA | TTTGGTTTCGATACG |
| MYC_disc8 | ACCGCGTG | CACGCGGT |
| CUX1_CUX1_2_SELEX\|CUX1_9 | ATCGATAACCTGATCGAT | ATCGATCAGGTTATCGAT |
| ETS_known8 | CGGAAG | CTTCCG |
| SOX13_Sox5_3459_PBM | AGAACAAT | ATTGTTCT |
| NR1D2_Eip75B_SANGER_5_FBgn0000568_B1H | TATGTGGGTCA | TGACCCACATA |
| KLF4_CG9895_SANGER_10_FBgn0034810_B1H | AATGGGCGTGGC | GCCACGCCCATT |
| HEY1_Hey_SANGER_5_FBgn0027788_B1H | CAGCCGACACGTGCCCC | GGGGCACGTGTCGGCTG |
| PKNOX2_Meis1_2335_PBM | AGCTGTCAA | TTGACAGCT |
| CTCF_HSMM_CTCF_Broad_ChIP-seq | CCACCAGAGGGCGCTATA | TATAGCGCCCTCTGGTG |
| DMRT2_pTH9189_PBM | TAATACATTA | TAATGTATTA |
| MEIS1_3 | AAAGACCTGTCAATAC | GTATTGACAGGTCTTT |
| TGIF1_2 | ACGCAGCTGTCAATATC | GATATTGACAGCTGCGT |
| HSF2_1 | AGAATATTCG | CGAATATTCT |
| HNF4G_MA0484.1_ChIP-seq | AGAGTCCAAAGTCCA | TGGACTTTGGACTCT |
| FOXA_known7 | AAAAGTAAACAAGAC | GTCTTGTTTACTTTTT |
| NR2C2_MA0504.1_ChIP-seq | AGGGGTCAGAGGTCA | TGACCTCTGACCCCT |

TABLE 5-continued

Transcription Factor Binding Sites of Synthetic Promoters

| Name | Binding Site Sequence | Reverse Complement |
| --- | --- | --- |
| AR_PRGR_do_HocoMoco | AGAACAGTCTGTA | TACAGACTGTTCT |
| AIRE_AIRE_f2_HocoMoco | ATTGGTTATATTGGTTAA | TTAACCAATATAACCAAT |
| DLX1_1 | ATTAATTACCTCAG | CTGAGGTAATTAAT |
| PAX5_known4 | AGAGCACTGAAGCGTAACCG | CGGTTACGCTTCAGTGCTCT |
| PROP1_1 | CGAATTAATTAAGAAAC | GTTTCTTAATTAATTCG |
| SOX14_1 | GATAATTATAATTAGC | GCTAATTATAATTATC |
| ETV5_Elk3_PBM\|ETV5_Elk4_PBM\|ELF1_Elf2_PBM\|ETV5_FIi1_PBM\|ENSG00000235187_Etv3_PBM\|ETV5_Erg_PBM\|ETV6_Etv6_PBM\|ENSG00000235187_Gm4881_PBM\|ETV5_Elk1_PBM\|ETV5_Gabpa_2829_PBM\|ELF1_Elf4_PBM\|ETV5_Ets1_PBM | AACCGGAAGT | ACTTCCGGTT |
| DMRT1_1 | GCAACAATGTATCAA | TTGATACATTGTTGC |
| ARNT2_dys_tgo_SANGER_5_FBgn0015014_B1H\|NPAS4_dys_tgo_SANGER_5_FBgn0039411_B1H | AAATCGTGACT | AGTCACGATTT |
| NFYA_NFYA_f1_HocoMoco\|NFYB_NFYB_f1_HocoMoco | CAGCCAATCAGAG | CTCTGATTGGCTG |
| DMRTA2_1 | GACACTGTAACAAA | TTTTGTTACAGTGTC |
| FOXA_disc1\|HDAC2_disc2 | TAAGTAAACA | TGTTTACTTA |
| BBX_1 | CACTTCATTGAATTA | TAATTCAATGAAGTG |
| HOXC6_1 | CAAATTAATTAATAAA | TTTTATTAATTAATTTG |
| ETS_disc4 | AACCGGAAGC | GCTTCCGGTT |
| ALX1_PRRX1_2_SELEX\|ALX1_ISX_2_SELEX\|MSX1_Msx3_2_SELEX\|DMBX1_Alx4_1744_PBM\|LHX9_LHX9_1_SELEX\|RAX2_RAXL1_1_SELEX\|SHOX_pTH5805_PBM\|MSX1_MSX2_2_SELEX\|DMBX1_Cart1_1275_PBM\|BSX_BSX_1_SELEX\|SHOX_Shox2_2641_PBM\|MSX1_MSX1_2_SELEX\|SHOX_PRRX2_1_SELEX\|SHOX_SHOX2_1_SELEX\|ALX1_Vsx1_1_SELEX\|SHOX_pTH5666_PBM\|BSX_2\|ISX_3\|LHX9_2\|MSX1_4\|MSX2_4\|MSX2_6\|PRRX1_3\|PRRX2_4\|RAX2_1\|SHOX2_2\|VSX1_4 | CCAATTAA | TTAATTGG |
| STAT_known8\|STAT_known9 | TATTTCCA | TGGAAATA |
| MYB_4 | CAACTGCCA | TGGCAGTTG |
| CR936877.3_MA0016.1_SELEX | CCGTGACCCC | GGGGTCACGG |
| RAD21_disc6 | GCCACCCTCTGGTGGCC | GGCCACCAGAGGGTGGC |
| ONECUT3_MA0235.1_B1H | AAATCAA | TTGATTT |
| NKX2-1_1 | ACACTTGAGT | ACTCAAGTGT |
| POU2F2_known14 | ATGTATTAATTAAGTA | TACTTAATTAATACAT |
| SCRT1_CG17181_SOLEXA_5_FBgn0035144_B1H | AACCACCTGTTGACC | GGTCAACAGGTGGTT |
| ENSG00000234254_V$TGIF_01_Transfac\|TGIF1_1 | AGCTGTCAGAA | TTCTGACAGCT |
| MITF_TFE3_f1_HocoMoco | CCACATGACC | GGTCATGTGG |
| AR_ECC-1_GR_HudsonAlpha_ChIP-seq | AGGGAACAGAATGTTCTGGGC | GCCCAGAACATTCTGTTCCCT |
| TEF_1 | ATGTTAACATAA | TTATGTTAACAT |
| HIC1_HIC2_1_SELEX\|HIC2_1 | ATGCCCACC | GGTGGGCAT |
| IRX5_1 | AATTTTACATGTATATA | TATATACATGTAAAATT |

TABLE 5-continued

Transcription Factor Binding Sites of Synthetic Promoters

| Name | Binding Site Sequence | Reverse Complement |
|---|---|---|
| ETV5_Gabpa_PBM1ETV5_ELK1_f1_HocoMoco\|ETV5_Ets97D_SANGER_10_FBgn0004510_B1H\|ETV5_Etv5_PBM\|ELK4_1 | ACCGGAAGT | ACTTCCGGT |
| HOXC10_Hoxd9_2_SELEX\|HOXD9_2 | GCAATAAAAA | TTTTTATTGC |
| SIX5_Six4_2860_PBM | ATGATACCC | GGGTATCAT |
| HOXC5_PDX1_1_SELEX\|PDX1_5 | GTAATTAACGGTAATTAA | TTAATTACCGTTAATTAC |
| MYC_disc9 | CGCCCACGTC | GACGTGGGCG |
| MYOD1_MA0545.1_ChIP-seq | GAACAGCTGTC | GACAGCTGTTC |
| PITX2_Ptx1_Cell_FBgn0020912_B1H\|DMBX1_Gsc_SOLEXA_FBgn0010323_B1H\|PITX2_MA0201.1_B1H\|OTX2_Oc_Cell FBgn0004102_B1H | GGATTAA | TTAATCC |
| FOXD1_pTH2673_PBM\|FOXD1_pTH3796_PBM\|FOXD1_pTH2808_PBM | TATGTAAACA | TGTTTACATA |
| GZF1_1 | TATAGACGCGCA | TGCGCGTCTATA |
| NFY_known5 | CCTTAGCCAATCA | TGATTGGCTAAGG |
| ZBTB14_3 | TCAGGCGCGCGCGCCA | TGGCGCGCGCGCCTGA |
| HOXC10_HXA9_f1_HocoMoco | TCATAAAACTGTCA | TGACAGTTTTATGA |
| TCF7L2_TCF7_f1_HocoMoco | AGAACAAAGCGC | GCGCTTTGTTCT |
| CREB3L1_CREB3_1_SELEX | CGGTGACGTCATCA | TGATGACGTCACCG |
| DMRT1_pTH9446_PBM | TGTATCAA | TTGATACA |
| LBX2_Lbe_Cell_FBgn0011278_B1H | GTTAACTA | TAGTTAAC |
| POU2F2_known8 | CTCATTTGCATAC | GTATGCAAATGAG |
| ZSCAN26_1 | TTATGTACTAATAA | TTATTAGTACATAA |
| MTF1_Mtf1_2377_PBM | CGTGCGCAA | TTGCGCACG |
| POU3F3_POU3F3_2_SELEX\|POU3F3_3 | ATGCATAAATTA | TAATTTATGCAT |
| MZF1_MA0057.1_SELEX\|MZF1_4 | GGAGGGGAA | TTCCCCCTCC |
| BHLHE40_MA0464.1_ChIP-seq | CTCACGTGCAC | GTGCACGTGAG |
| NHLH2_HEN1_si_HocoMoco | AGGGACGCAGCTGCTCCCCA | TGGGGAGCAGCTGCGTCCCT |
| LHX8_Lhx6_2272_PBM | CTAATCAA | TTGATTAG |
| ARID3C_ARI3A_do_HocoMoco | AATTAATCGAAATCAAATTAAA | TTTAATTTGATTTCGATTAATT |
| JDP2_1 | ACGATGACGTCATCGG | CCGATGACGTCATCGT |
| MAX_HeLa-S3_MAX_Stanford_ChIP-seq\|MYC_NB4_CMYC_Stanford_ChIP-seq | AGCACGTGGCC | GGCCACGTGCT |
| TEAD2_1 | CCGCCGC | GCGGCGG |
| YY2_YY2_2_SELEX\|YY2_2 | AAAATGGCGGT | ACCGCCATTTT |
| AHR_tgo_ss_SANGER_5_FBgn0003513_B1H\|ARNT2_tgo_ss_SANGER_5_FBgn0015014_B1H | GTCACGCA | TGCGTGAC |
| LHX8_LHX6_3_SELEX\|LHX6_5 | TGATTGCAATCA | TGATTGCAATCA |

TABLE 5-continued

Transcription Factor Binding Sites of Synthetic Promoters

| Name | Binding Site Sequence | Reverse Complement |
|---|---|---|
| EMX2_MA0219.1_B1H\|HOXC5_MA0166.1_B1H\|MEOX2_MA0215.1_B1H\|BSX_Bsh_SOLEXA_FBgn0000529_B1H\|HOXC5_MA0203.1_B1H\|HOXC5_MA0225.1_B1H\|HOXC5_Scr_SOLEXA_FBgn0003339_B1H\|HOXC5_Hoxc5_2630_PBM\|HOXC5_MA0186.1_B1H | TCATTAA | TTAATGA |
| TCF12_disc6 | ATTCCAGGC | GCCTGGAAT |
| VDR_1 | GGGTCAAGGGGGTGA | TCACCCCCTTGACCC |
| RAD21_disc5 | CGCTGCCCTCTGC | GCAGAGGGCAGCG |
| TP73_GSE15704_TP73_rapamycin_ChIP-seq\|TP53_MA0106.2_ChIP-seq | ACATGCCCAGACATG | CATGTCTGGGCATGT |
| YY1_known5 | AAAATGGCGGC | GCCGCCATTTT |
| NFIA_NFIA_1_SELEX\|NFIA_NFIX_LSELEX\|NFIA_1\|NFIX_1 | TTGGCACCGTGCCAA | TTGGCACGGTGCCAA |
| MEF2B_V$RSRFC4_01_Transfac | AAGCTATAAATAGAAT | ATTCTATTTATAGCTT |
| NANOG_disc4 | TGCATATCAA | TTGATATGCA |
| EVX2_eve_FlyReg_FBgn0000606_B1H | AAATAATTAACG | CGTTAATTATTT |
| HOXD8_1 | TAATTAATTAATGGCTA | TAGCCATTAATTAATTA |
| GTF2A_1 | GGTCCTTTTATA | TATAAAAGGACC |
| JUN_MA0492.1_ChIP-seq | AAAGATGATGTCATC | GATGACATCATCTTT |
| ETV5_H1-hESC_GABP_HudsonAlpha_ChIP-seq | AACCGGAAGTG | CACTTCCGGTT |
| GATA2_Mw145_ChIP-seq | TCTTATCA | TGATAAGA |
| ARNT2_ss_tgo_SANGER_10_FBgn0015014_B1H\|AHR_ss_tgo_SANGER_10_FBgn0003513_B1H | CATTGCGTGAC | GTCACGCAATG |
| NFE2L1:: MAFG_1 | CATAATTGCTGAGTCATTTTAG | CTAAAATGACTCAGCAATTATG |
| MEF2_known6 | CGGTTTAAAAATAACCCA | TGGGTTATTTTTAAACCG |
| ELF1_I$E74A_01_Transfac | CCTCACTTCCGGGTTCG | CGAACCCGGAAGTGAGG |
| NKX2-5_Titf1_1722_PBM | CCACTTAA | TTAAGTGG |
| EBF1_known3 | ACCCAAGGGA | TCCCTTGGGT |
| POU3F3_V$OCT1_01_Transfac | CCGAAATTTGCATATTGAA | TTCAATATGCAAATTTCGG |
| RARG_RARB_a_HocoMoco | GAGGTCAGGGC | GCCCTGACCTC |
| SP4_1 | GAGAAGGGGCGGGACC | GGTCCCGCCCCCTTCTC |
| PPARA_2 | CCTGACCCCAATGACCCGA | TCGGGTCATTGGGGTCAGG |
| HOXB4_1 | CGCGTTAATTAATTACC | GGTAATTAATTAACGCG |
| TCF4_TCF4_2_SELEX\|TCF4_2 | CACACCTGCA | TGCAGGTGTG |
| MYOD1_V$MYOD_Q6_Transfac | AGCACCTGTC | GACAGGTGCT |
| PHOX2B_1 | CCTATTAATTAATTCCG | CGGAATTAATTAATAGG |
| MEIS1_2 | AAGGAGCTGTCAATAC | GTATTGACAGCTCCTT |
| ETV5_ETV2_1_SELEX\|ETV2_1 | AACCGGAAATA | TATTTCCGGTT |
| FOXM1_FOXM1_f1_HocoMoco | AAAACAAACAAC | GTTGTTTGTTTT |

TABLE 5-continued

Transcription Factor Binding Sites of Synthetic Promoters

| Name | Binding Site Sequence | Reverse Complement |
| --- | --- | --- |
| HNF4G_Mv82_ChIP-seq | AGTCCA | TGGACT |
| BHLHA15_pTH4582_PBM | ACATATGG | CCATATGT |
| EBF1_V$OLF1_01_Transfac\|EBF1_known1 | ACAACCTCCCTGGGGAGTTGTG | CACAACTCCCCAGGGAGGTTGT |
| DMBX1_DMBX1_1_SELEX\|DMBX1_2 | GCGGATTAAC | GTTAATCCGC |
| LBX2_LBX2_2_SELEX\|HESX1_HESX1_1_SELEX\|NKX1-1_Nkx1-1_3856_PBM\|HESX1_1\|LBX2_3 | GCCAATTAGC | GCTAATTGGC |
| REST_disc9 | GCACCTCGCACAGC | GCTGTGCGAGGTGC |
| YY2_YY1_1_SELEX\|YY1_known7 | ATAATGGCGGC | GCCGCCATTAT |
| MECP2_M_ECP2_f1_HocoMoco | CCCGGAG | CTCCGGG |
| MAFK_Mafk_3106_PBM | ATTTTGCTGA | TCAGCAAAAT |
| TAL1_disc2 | AGATAAGAG | CTCTTATCT |
| TWIST2_TWST1_f1_HocoMoco | ACCCAGGTGG | CCACCTGGGT |
| YY1_known1 | GAACACCATTTTGAAC | GTTCAAAATGGTGTTC |
| NR2E3_MA0164.1_SELEX\|NR2E3_1 | AAGCTTG | CAAGCTT |
| EOMES_TBR1_2_SELEX\|TBX3_TBX2_2_SELEX\|TBR1_2\|TBX2_2 | AAGGTGTGAAA | TTTCACACCTT |
| LHX6_2 | AACCGCTAATTAGTGGA | TCCACTAATTAGCGGTT |
| ASCL2_Ascl2_1_SELEX\|ASCL2_2 | AGCAGCTGCT | AGCAGCTGCT |
| MYB_3 | AGGGCCAGTTG | CAACTGGCCCT |
| GATA2_Gata5_3768_PBM | AGAGATAAG | CTTATCTCT |
| AP1_known9 | ATGACTCA | TGAGTCAT |
| SP9_SP1_f2_HocoMoco | CCGGCCCCGCCCCCTCCCC | GGGGAGGGGGCGGGGCCGG |
| RARG_RARA_4_SELEX\|RARA_5 | AGGGTCAAAGGTCA | TGACCTTTGACCCT |
| ZFHX2_pTH5642_PBM\|NOTO_pTH6268_PBM | GTTAATTAAC | GTTAATTAAC |
| UBP1_SRP000217_Tcfc2p11_ChIP-seq\|UBP1_SRP000217_Tcfcp2l1_ChIP-seq | CCGGTTCAAACCGGTTCTGGC | GCCAGAACCGGTTTGAACCGG |
| ESRRG_ESRRG_1_SELEX\|ESRRG_1 | AAGGTCATTTCAAGGTCA | TGACCTTGAAATGACCTT |
| CDX2_Cdx1_2245_PBM | GGTAATAAA | TTTATTACC |
| FOXO6_V$FOXO1_02_Transfac | AACGTAAACAACAC | GTGTTGTTTACGTT |
| MAFK_MAFG_si_HocoMoco | AGTCATG | CATGACT |
| MAZ_MAZ_f1_HocoMoco | CCCTCCCTCCCCCCCC | GGGGGGGGAGGGAGGG |
| TCF3_2 | AATAACAGGTGTTCAC | GTGAACACCTGTTATT |
| FOXO6_FOXO6_3_SELEX\|FOXO6_3 | GTCGTGTGGGAAA | TTTCCCACACGAC |
| ESRRG_ESRRG_2_SELEX\|ESRRG_2 | AAGGTCAGTCAAGGTCA | TGACCTTGACTGACCTT |
| SIN3A_disc2 | GGCCACGTGA | TCACGTGGCC |
| SOX7_SOX7_3_SELEX\|SOX7_4 | CATGACTGAAATTCATC | GATGAATTTCAGTCATG |
| TBPL2_MA0386.1_PBM\|TBPL2_YER148W_798_DeBoer11 | ATCGAATATATATATCTAGTC | GACTAGATATATATATTCGAT |

TABLE 5-continued

Transcription Factor Binding Sites of Synthetic Promoters

| Name | Binding Site Sequence | Reverse Complement |
| --- | --- | --- |
| HOXC5_V$HOX13_01_Transfac | TGCCAACTTCCCCATTA | TGGAGGCGACCACTAAT |
| | GTGGTCGCCTCCA | GGGGAAGTTGGCA |
| EMX2_1 | ACCACTAATTAGTGGAC | GTCCACTAATTAGTGGT |
| ATF3_Mv43_ChIP-seq\|TCF7L2_disc1 | ATGAGTCATC | GATGACTCAT |
| NR1H4_3 | AGGGTTAATAAA | TTTATTAACCCT |
| RAD21_disc4 | ACCTGGTGGC | GCCACCAGGT |
| CBFB_PEBB_f1_HocoMoco | CAAACCACAGA | TCTGTGGTTTG |
| STAT_disc5 | AAATTCCTG | CAGGAATTT |
| HNF4G_VSHNF4_01_B_Transfac | GGGGTCAAAGGTCAC | GTGACCTTTGACCCC |
| NKX2-5_MA0503.1_ChIP-seq | AGCCACTCAAG | CTTGAGTGGCT |
| TFCP2_VSCP2_01_Transfac | CTGGGTAGAGC | GCTCTACCCAG |
| GRHIA_GRHL1_2_SELEX\|TFCP2_TFCP2_1_SELEX\|GRHL1_2\|TFCP2_4 | AAACCGGTTT | AAACCGGTTT |
| NANOGP1_NANOG_f1_HocoMoco | CCATTAAA | TTTAATGG |
| NKX2-5_Nkx2-5_3436_PBM | GCCACTTAAA | TTTAAGTGGC |
| NKX2-5_NKX32_f1_HocoMoco | AGTTAAGTGGA | TCCACTTAACT |
| PAX4_5 | GAAAAATTTCCAATACTCCACTCCCCCCCC | GGGGGGGGAGTGGAGTATTGGAAATTTTC |
| NR2F2_NR2F1_4_SELEX\|HNF4_known26 | CAAAGGTCAAGGG | CCCTTGACCTTTG |
| HNF1_1 | GGTTAATAATTACCA | TGGTAATTATTAACC |
| THRB_THB_f1_HocoMoco | GGTCAGGTCA | TGACCTGACC |
| IRF8_IRF8_1_SELEX\|RF_known19 | ACGAAACCGAAACT | AGTTTCGGTTTCGT |
| ONECUT3_ONECUT3_1_SELEX\|ONECUT3_1 | AAAAAATCAATAAT | ATTATTGATTTTTT |
| GLIS3_lmd_SANGER_5_FBgn0039039_B1H | ACGACCCCCACAG | CTGTGGGGGTCGT |
| E4F1_E4F1_f1_HocoMoco | CGTGACGTC | GACGTCACG |
| SOX10_1 | CTTTGTC | GACAAAG |
| ETV5_ETS2_f1_HocoMoco | CCACTTCCCGC | GCGGGAAGTGG |
| CHD2_disc2\|E2F_disc5 | AAAGGCGC | GCGCCTTT |
| LHX5_1 | AGTATTTAATTAATTCG | CGAATTAATTAAATACT |
| NR1H4_2 | AGGTCATTAACCC | GGGTTAATGACCT |
| YY1_known3 | AGATGGCCG | CGGCCATCT |
| ETV5_K562_GABP_HudsonAlpha_ChIP-seq | CACTTCCGGTTCC | GGAACCGGAAGTG |
| CUX1_V$CDP_01_Transfac\|CUX1_1 | ATCGATTATTGG | CCAATAATCGAT |
| PLAGL1_Plagl1_0972_PBM | GGGGCCCCCC | GGGGGGCCCC |
| HOXC10_Hoxa11_1_SELEX\|HOXA11_2 | AATTTTACGACC | GGTCGTAAAATT |
| SMAD1_Mad_FlyReg_FBgn0011648_B1H | CGGCCGACGC | GCGTCGGCCG |
| CTCF_HCPEpiC_CTCF_UW_ChIP-seq\|CTCF_HepG2_CTCF_UW_ChIP-seq | CGCCCCCTGGTGGC | GCCACCAGGGGCG |
| IRX3_Ara_Cell_FBgn0015904_B1H | AAATAACA | TGTTATTT |

TABLE 5-continued

Transcription Factor Binding Sites of Synthetic Promoters

| Name | Binding Site Sequence | Reverse Complement |
|---|---|---|
| FOXO6_pTH3731_PBM\|FOXO6_pTH3477_PBM | TCGTAAACAA | TTGTTTACGA |
| GFI1B_GFI1_f1_HocoMoco | AAATCACAGC | GCTGTGATTT |
| PKNOX2_MEIS2_1_SELEX\|MEIS2_1 | TTGACAGCTGTCAA | TTGACAGCTGTCAA |
| RFX8_MA0510.1_ChIP-seq | CTCCCTGGCAACAGC | GCTGTTGCCAGGGAG |
| NRF1_NRF1_1_SELEX\|NRF1_known2 | TGCGCATGCGCA | TGCGCATGCGCA |
| PLAGL1_PLAL1_si_HocoMoco | CGGGGGGCCC | GGGCCCCCCG |
| IRF3_IRF3_1_SELEX\|IRF_known14 | CAGTTTCGGTTTCCGTTTCCC | GGGAAACGGAAACCGAAACTG |
| AL662830.5_MA0070.1_SELEX\|PBX1_4 | CCATCAATCAAA | TTTGATTGATGG |
| IRF_known9 | GAAAGCGAAACC | GGTTTCGCTTTC |
| SETDB1_disc1 | CGGGGCATTCTGGGAATGTAGTCC | GGACTACAATTCCCAGAATGCCCCG |
| GLIS3_lmd_SOLEXA_5_FBgn0039039_B1H | CAGACCCCCCACAGA | TCTGTGGGGGGTCTG |
| PRDM1_Mv112_ChIP-seq | AAAGTGATA | TATCACTTT |
| LHX9_LHX9_2_SELEX\|LHX9_3 | TAATTGCCAATTA | TAATTGGCAATTA |
| HNF4G_HNF4A_f1_HocoMoco | AGGCCAAAGTCCA | TGGACTTTGGCCT |
| TP53_V$P53_02_Transfac\|TP53_2 | AGACATGCCT | AGGCATGTCT |
| POU6F2_V$POU6F1_01_Transfac\|POU6F1_1 | ATAAATTATGC | GCATAATTTAT |
| GATA2_V$GATA3_01_Transfac\|GATA_known3 | CCCTATCTC | GAGATAGGG |
| ESRRG_MA0592.1_ChIP-seq | CCAAGGTCACA | TGTGACCTTGG |
| HMGN3_disc1 | CGCTGACTCA | TGAGTCAGCG |
| RXRA_known9 | ATTAAGGGGTCACGACA | TGTCGTGACCCCTTAAT |
| AP1_disc9 | ACTCATGC | GCATGAGT |
| NFIL3_NFIL3_si_HocoMoco | ATGCATTACATAAC | GTTATGTAATGCAT |
| SOX17_SOX17_f2_HocoMoco | CAACAATCTTCATTGTCC | GGACAATGAAGATTGTTG |
| SRF_SRF_1_SELEX\|SRF_known9 | ACCATATATGGC | GCCATATATGGT |
| MYBL1_MYBL1_2_SELEX\|MYBL1_3 | ACCGTTAACGGT | ACCGTTAACGGT |
| TFE_1 | TCACATGA | TCATGTGA |
| SREBF2_pTH5161_PBM | ATCACGCGA | TCGCGTGAT |
| PAX3_V$PAX3_01_Transfac\|PAX3_2 | TCGTCACGCTTCA | TGAAGCGTGACGA |
| PRDM16_MA0029.1_SELEX\|RUNX1_8 | AAGATAAGATAACA | TGTTATCTTATCTT |
| NFE2_disc1 | ATGACTCAGC | GCTGAGTCAT |
| SRF_pTH10822_PBM | CATATAAGG | CCTTATATG |
| RBPJ_SUH_f1_HocoMoco | CGTGGGAAA | TTTCCCACG |
| MSX1_MSX2_f1_HocoMoco | ACAATTA | TAATTGT |
| MAFK_MAFG_1_SELEX\|MAFG_1 | AAATTGCTGAGTCAGCATATT | AATATGCTGACTCAGCAATT |
| FOXD1_V$FOXJ2_02_Transfac\|FOXJ2_2 | AAAAATATTATTAT | ATAATAATATTTTT |
| RUNX1_RUNX1_f1_HocoMoco | TAACCACAAA | TTTGTGGTTA |

TABLE 5-continued

Transcription Factor Binding Sites of Synthetic Promoters

| Name | Binding Site Sequence | Reverse Complement |
|---|---|---|
| ETS1_V$CETS1P54_02_Transfac | CCACCGGAAATTA | TAATTTCCGGTGG |
| RFX5_known3 | AGTTACTAGGCAAA | TTTGCCTAGTAACT |
| HOXC5_MA0256.1_B1H\|EVX2_MA0221.1_B1H | CTAATGA | TCATTAG |
| ESRRG_ESRRA_3_SELEX\|ESRRG_ESRRA_6_SELEX\|ESRRA_known9 | CAAGGTCATTTCAAGGTCA | TGACCTTGAAATGACCTTG |
| TFAP2A_TFAP2C_1_SELEX\|TFAP2A_TFAP2C_4_SELEX\|TFAP2A_TFAP26_1_SELEX\|TFAP26_21TFAP2_known14\|TFAP2_known17 | TGCCCCAGGGCA | TGCCCTGGGGCA |
| SOX15_SOX15_3_SELEX\|SOX1_SOX2_2_SELEX\|SOX1_SOX14_2_SELEX\|SOX1_SOX2_6_SELEX\|SOX1_Sox1_2_SELEX\|SOX14_3\|SOX15_4\|SOX2_3\|SOX2_7\|SOX1_3 | ATGAATAACATTCAT | ATGAATGTTATTCAT |
| POU3F3_pTH9290_PBM | AATTTGCATA | TATGCAAATT |
| MLX_Mio_bigmax_SANGER_5_FBgn0039509_B1H | ATCACGTG | CACGTGAT |
| CDX2_Cad_Cell_FBgn0000251_B1H\|HOXB13_pTH6143_PBM\|CDX2_Cad_SOLEXA_FBgn0000251_B1H | TAATAAAA | TTTTATTA |
| INSM1_MA0155.1_COMPILED\|INSM1_1 | CGCCCCTGACA | TGTCAGGGGCG |
| MYBL1_Myb_1047_PBM | TAACGGTCAA | TTGACCGTTA |
| ARNT2_ARNT2_si_HocoMoco | GCCTCCCACGCC | GGCGTGGGAGGC |
| GATA2_V$GATA3_03_Transfac | AAAGATCTTA | TAAGATCTTT |
| CEBPA_HepG2_CEBPB_Stanford_ChIP-seq | ATTGTGCAATC | GATTGCACAAT |
| YY2_MA0095.2_ChIP-seq\|YY2_TYY1_J2_HocoMoco | CAAGATGGCGGC | GCCGCCATCTTG |
| CEBPA_MA0466.1_ChIP-seq | ATTGTGCAATA | TATTGCACAAT |
| ZBTB7A_known2 | AAGCCCCCCAAAAAT | ATTTTTGGGGGCTT |
| MEF2B_V$MEF2_03_Transfac\|MEF2_known4 | TGTGGTTCTAAAATAGAACAA | TTGTTCTATTTTAGAACCACA |
| EGR1_known4 | CCCGCCCCGCCCC | GGGGCGGGGCGGG |
| GATA1_GATAe_SANGER_5_FBgn0038391_B1H | CTTATCA | TGATAAG |
| PAX2_PAX2_f1_HocoMoco | GTTCAGTCATGCGTGACA | TGTCACGCATGACTGAAC |
| PAX4_6 | GTGGGCTAATTAGTTCA | TGAACTAATTAGCCCAC |
| ARNT2_tgo_cyc_SANGER_5_FBgn0023094_B1H\|BHLHE40_Bhlhb2_1274_PBM\|ARNT2_tgo_cyc_SANGER_5_FBgn0015014_B1H | GTCACGTGA | TCACGTGAC |
| EN2_EN1_2_SELEX\|EN1_5 | TAATTGACCAATTA | TAATTGGTCAATTA |
| NR5A2_1 | CTGACCTTGAAC | GTTCAAGGTCAG |
| YY2_YY2_3_SELEX | ATGGCGGCATGG | CCATGCCGCCAT |
| MAFK_MAFK_3_SELEX\|MAF_known8 | AAAATTGCTGAC | GTCAGCAATTTT |
| ZBTB42_ZNF238_1_SELEX\|ZBTB18_2 | AATCCAGATGTTG | CAACATCTGGATT |
| TA L2_TAL1_f1_Hoco Moco | GAACAGATGGTC | GACCATCTGTTC |
| CPEB1_CPEB1_1_SELEX\|CPEB1_1 | AATAAAAA | TTTTTATT |
| TCF7L2_pan_FlyReg_FBgn0085432_B1H\|TCF7L1_Tcf3_3787_PBM | CTTTGATC | GATCAAAG |
| ETS_known6 | ACCGGAAGTGCA | TGCACTTCCGGT |
| TCF7L1_MA0523.1_ChIP-seq | AAAGATCAAGGAA | TTCCTTGATCTTT |

TABLE 5-continued

Transcription Factor Binding Sites of Synthetic Promoters

| Name | Binding Site Sequence | Reverse Complement |
|---|---|---|
| ETV5_ETV5_f1_HocoMoco | GACAGGAAGTAAC | GTTACTTCCTGTC |
| ETV5_ERG_f1_HocoMoco | ACCGGAAATCC | GGATTTCCGGT |
| MZF1_MZF1_f1_HocoMoco | GGTGGGGAA | TTCCCCACC |
| RUNX_2 | ACGTTTGTGGTTAGC | GCTAACCACAAACGT |
| PBX1_5 | TCACCCATCAATAATCA | TGATTATTGATGGGTGA |
| EGR3_EGR4_f1_HocoMoco | GCCCTGCCGCC | GGCGGCAGGGC |
| POU3F3_POU3F2_1_SELEX\|POU3F2_5 | TAATTTATGCATA | TATGCATAAATTA |
| LHX2_1 | GTTCACTAATTAGTTTA | TAAACTAATTAGTGAAC |
| MYOD1_V$MYOD_01_Transfac | CAACACCTGTCC | GGACAGGTGTTG |
| GATA2_Mv73_ChIP-seq | CTGGTGGGGCAGATAAGGA | TCCTTATCTGCCCCACCAG |
| TCF4_GM12878_TCF12_HudsonAlpha_ChIP-seq | ACAGCTGCTGC | GCAGCAGCTGT |
| TCF7L2_known4 | CATCAAAGGG | CCCTTTGATG |
| HNF4_known8 | AAAGTCCAA | TTGGACTTT |
| FOXO6_N$DAF16_01_Transfac | GTGTTGTTTACAAC | GTTGTAAACAACAC |
| HMBOX1_1 | GAAAACTAGTTAACATC | GATGTTAACTAGTTTTC |
| CTCF_NHEK_CTCF_UW_ChIP-seq | CCACCAGGGGCGC | GCGCCCCTGGTGG |
| ALX1_2 | CGAATTAATTAATCACC | GGTGATTAATTAATTCG |
| ELF1_MA0473.1_ChIP-seq | CACTTCCTGGTTC | GAACCAGGAAGTG |
| EOMES_TBX21_1_SELEX\|TBX21_1 | GGTGTGAATTCACACC | GGTGTGAATTCACACC |
| AL662828.6_V$ATF6_01_Transfac\|ATF6_1 | CCACGTCA | TGACGTGG |
| ATF3_pTH2684_PBM | ACGTCATCA | TGATGACGT |
| E2F_known22 | GCGCCAAA | TTTGGCGC |
| POU5F1_known1 | ATTGTCATGCTAATG | CATTAGCATGACAAT |
| ELF1_GM12878_ELF1_HudsonAlpha_ChIP-seq | CCACTTCCGGGTTCG | CGAACCCGGAAGTGG |
| MAF_known4 | AAATTTGCTGACTTAGC | GCTAAGTCAGCAAATTT |
| HEY1_disc2 | GCCCCGCTGCCGCCGC | GCGGCGGCAGCGGGGC |
| FOXD1_HepG2_FOXA2_HudsonAlpha_ChIP-seq | CTCTGTTTACTTTGC | GCAAAGTAAACAGAG |
| HNF1A_MA0046.1_COMPILED | GGTAATTATTAACC | GGTTAATAATTACC |
| HMGA2_HMGA1J1_HocoMoco | AAAATAC | GTATTTT |
| SOX18_SOX18_f1_HocoMoco | GAACCCATTGTTCTTTTC | GGAAAAGAACAATGGGTTC |
| SRF_known6 | ATGGCCATATAAGGAGATG | CATCTCCTTATATGGCCAT |
| TGIF2LY_TGIF2LX_1_SELEX\|ENSG00000234254_TGIF1_1_SELEX\|ENSG00000234254_TGIF2_1_SELEX\|TGIF1_3\|TGIF2LX_1\|TGIF2_2 | TGACAGCTGTCA | TGACAGCTGTCA |
| GFI1B_sens_SANGER_10_FBgn0002573_B1H | AAATCACGGC | GCCGTGATTT |
| SIX5_Mv123_ChIP-seq\|ETS_disc5 | ACAACTCC | GGAGTTGT |
| RFX8_H1-hESC_RFX5_Stanford_ChIP-seq | TCACCTGTTGCTAGGCAGA | TCTGCCTAGCAACAGGTGA |

TABLE 5-continued

Transcription Factor Binding Sites of Synthetic Promoters

| Name | Binding Site Sequence | Reverse Complement |
|---|---|---|
| GBX2_GBX1_1_SELEX\|HOXA4_Hoxa2_1_SELEX\|HOXC5_HOXB3_1_SELEX\|LHX8_LHX6_1_SELEX\|GBX1_2\|HOXB3_2\|HOXA2_3\|LHX6_3 | ACTAATTAGC | GCTAATTAGT |
| EGR3_V$EGR2_01_Transfac\|EGR1_known2 | ACGCCCACGCAA | TTGCGTGGGCGT |
| ZBTB4_ZBTB4!METH_f1_HocoMoco | CAATAGCGGTGGTGG | CCACCACCGCTATTG |
| SP1_known6\|SP1_known7 | CCCCGCCCCC | GGGGGCGGGG |
| EGR3_V$EGR3_01_Transfac\|EGR3_V$EGR1_01_Transfac\|EGR1_known1\|EGR3_1 | ACGCCCACGCAT | ATGCGTGGGCGT |
| SP5_pTH9394_PBM | ACACGCCCCT | AGGGGCGTGT |
| HOXD12_Hoxc12_3480_PBM\|HOXD12_Hoxd12_3481_PBM\|HOXC10_Hoxb9_3413_PBM\|HOXC10_Hoxc11_3718_PBM | GGTCATAAAA | TTTTATGACC |
| RAD21_disc1 | GGCCACCAGATGGCACTATA | TATAGTGCCATCTGGTGGCC |
| HHEX_pTH6423_PBM | GGGCAATAGA | TCTATTGCCC |
| PPARA_V$PPARA_01_Transfac\|PPARA_1 | CAAAACTAGGTCAAAGGTCA | TGACCTTTGACCTAGTTTTG |
| GLI1_GLI1_f1_HocoMoco | AGACCACCCAG | CTGGGTGGTCT |
| SMAD2_SMAD3_f1_HocoMoco | GGCCAGACAC | GTGTCTGGCC |
| GLI1_GLI2_f1_HocoMoco\|GLI1_Ci_SANGER_5_FBgn0004859_81H | AGACCACCCAC | GTGGGTGGTCT |
| SPIC_MA0080.3_ChIP-seq\|SPIC_GSE11329_Sfpi1_ChIP-seq | AAAAAGAGGAAGTGA | TCACTTCCTCTTTTT |
| FOXD1_MA0040.1_SELEX\|FOXQ1_2 | AATAAACAATA | TATTGTTTATT |
| HEY1_pTH5102_PBM\|NPAS2_tai_Clk_SANGER_5_FBgn0023076_B1H | GACACGTGC | GCACGTGTC |
| USF1_pTH4376_PBM | CCCACGTGATA | TATCACGTGGG |
| CBX5_1 | AATATTCAACAG | CTGTTGAATATT |
| TFAP2A_TFAP2A_5_SELEX | TGCCCTAGGGCA | TGCCCTAGGGCA |
| NFYC_NFYC_f1_HocoMoco | CAGCCAATCAGCGC | GCGCTGATTGGCTG |
| FOXD1_MA0033.1_SELEX\|FOXL1_2 | TATACATA | TATGTATA |
| ETV5_GM12878_GABP_HudsonAlpha_ChIP-seq | CACTTCCGGCG | CGCCGGAAGTG |
| RARG_RARG_5_SELEX\|RARG_5 | AAGGTCAAGCAAAGGTCA | TGACCTTTGCTTGACCTT |
| HOXC5_Abd-A_FlyReg_FBgn0000014_81H\|HOXC5_HXD4_f1_HocoMoco | TCAATTAA | TTAATTGA |
| FOXD1_FOXI1_f1_HocoMoco | AACCAATCAGAG | CTCTGATTGGTT |
| ETV5_ELK1_3_SELEX\|ETS_known13 | CACTTCCGCCGGAAGTG | CACTTCCGGCGGAAGTG |
| SPIC_SPIB_f1_HocoMoco | AAAAAGAGGAAG | CTTCCTCTTTTT |
| POU4F1_POU4F2_1_SELEX\|POU4F1_POU4F3_1_SELEX\|POU4F1_POU4F2_2_SELEX\|POU4F2_1\|POU4F2_2\|POU4F3_2 | ATGCATAATTAATGAG | CTCATTAATTATGCAT |
| HDX_Hdx_3845_PBM | GAAATCA | TGATTTC |
| GCM1_pTH9341_PBM\|GCM1_pTH9357_PBM\|GCM1_GCM2_1_SELEX\|GCM2_1 | TACCCGCATA | TATGCGGGTA |
| MSX2_1 | AGCGCTAATTGGTCTTC | GAAGACCAATTAGCGCT |

TABLE 5-continued

Transcription Factor Binding Sites of Synthetic Promoters

| Name | Binding Site Sequence | Reverse Complement |
|---|---|---|
| STAT5B_STA5A_do_HocoMoco | AATTCCTGGAAA | TTTCCAGGAATT |
| PKNOX2_MEIS2_2_SELEX\|MEIS2_2 | GCTGTCAA | TTGACAGC |
| AL662830.5_V$PBX1_02_Transfac\|PBX1_2 | AATTTGATTGATGTG | CACATCAATCAAATT |
| LHX8_Lhx8_1_SELEX\|LHX8_2 | CTAATTAGCGCTAATTAA | TTAATTAGCGCTAATTAG |
| RFX8_RFX1_4537_PBM | GTAGCAACCA | TGGTTGCTAC |
| BCL6B_BCL66_1_SELEX\|BCL6B_2 | TGAATTCCTAGAAAGCA | TGCTTTCTAGGAATTCA |
| JUN_HepG2_CJUN_Stanford_ChIP-seq | GAGGATGACGTCATC | GATGACGTCATCCTC |
| ATOH7_MA0461.1_ChIP-seq | CAGATGGC | GCCATCTG |
| MYBL1_MYBL1_1_SELEX\|MYBL1_2 | ACCGTTAAACGG | CCGTTTAACGGT |
| TLX3_TLX1_f1_HocoMoco | CGCCAAGGAGC | GCTCCTTGGCG |
| ETS_known5 | AATTACTTCCTGTC | GACAGGAAGTAATT |
| STAT_disc4 | ATTGCACAA | TTGTGCAAT |
| RARG_Rara_2_SELEX\|RARA_9 | AGGTCACTCAAAGGTCA | TGACCTTTGAGTGACCT |
| XBP1_XBP1_f1_HocoMoco | GACGTGTCATTA | TAATGACACGTC |
| ESRRB_1 | AGCTCAAGGTCA | TGACCTTGAGCT |
| MYOD1_MA0499.1_ChIP-seq | AGGGACAGCTGCA | TGCAGCTGTCCCT |
| CEBPA_K562_CEBPB_Stanford_ChIP-seq | GATTGTGCAATACC | GGTATTGCACAATC |
| MAFB_Mafb_3_SELEX\|MAF_known12 | AATGCTTACGTCAGCACT | AGTGCTGACGTAAGCATT |
| NPAS2_Met_Clk_SANGER_5_FBgn0023076_B1H | CACGTGTC | GACACGTG |
| HOXC10_HOXA10_2_SELEX\|HOXA10_3 | GGTAATAAAAA | TTTTTATTACC |
| ONECUT3_ONECUT1_1_SELEX\|ONECUT3_ONECUT1_2_SELEX\|ONECUT3_ONECUT2_1_SELEX\|ONECUT1_2\|ONECUT1_3\|PNECUT2_1 | AAAAAATCGATAAT | ATTATCGATTTTTT |
| EBF1_known2 | GTCCCTTGGGA | TCCCAAGGGAC |
| TERF2_pTH7805_PBM | CTAGGGTTA | TAACCCTAG |
| PAX5_known3 | CTGGAACTCAC | GTGAGTTCCAG |
| SOX1_SOX14_1_SELEX\|SOX14_2 | ACAATAACATTG | CAATGTTATTGT |
| SRF_known4 | CCCATATAAGGAGATGGC | GCCATCTCCTTATATGGG |
| CTCF_HEEpiC_CTCF_UW_ChIP-seq | CCACCAGAGGGCG | CGCCCTCTGGTGG |
| CTCF_HeLa-53_CTCF_Broad_ChIP-seq\|CTCF_SRP000217_Ctcf_ChIP-seq\|CTCF_NHLF_CTCF_Broad_ChIP-seq\|CTCF_HPAF_CTCF_UW_ChIP-seq\|CTCF_HepG2_CTCF_HudsonAlpha_ChIP-seq | AGCGCCCCTGGTGG | CCACCAGGGGCGCT |
| PAX7_1 | CGAACTAATTAGTACTA | TAGTACTAATTAGTTCG |
| NR2E3_Hr51_SANGER_5_FBgn0034012_B1H | AAAAATCAAGGT | ACCTTGATTTTT |

TABLE 5-continued

Transcription Factor Binding Sites of Synthetic Promoters

| Name | Binding Site Sequence | Reverse Complement |
|---|---|---|
| CR936877.3_RXRG_4_SELEX\|CR936877.3_RXRA_2_SELEX\|RXRA_known11 | GGGGTCATGACCCC | GGGGTCATGACCCC |
| DUXA_DUXA_1_SELEX\|DUXA_1 | CTAATTTAATCAA | TTGATTAAATTAG |
| ESR2_MA0112.2_ChIP-seq\|ESRRA_known4 | AGGTCAGGGTGACCTGGGCC | GGCCCAGGTCACCCTGACCT |
| SPDEF_SPDEF_3_SELEX\|SPDEF_4 | GCAGTAAGAAGTATAC | GTATACTTCTTACTGC |
| YY2_K562b_YY1_UCD_ChIP-seq | CAAGATGGCGGCGGC | GCCGCCGCCATCTTG |
| ZIC1_2 | CACCCCCGGGGGGG | CCCCCCCGGGGGTG |
| ESRRG_ESRRG_3_SELEX\|ESRRG_pTH2311_PBM\|ESRRG_3 | ATGACCTTGA | TCAAGGTCAT |
| SP9_pTH5423_PBM | GAGCGGGA | TCCCGCTC |
| SMARCC1_SMRC1_f1_HocoMoco | CTGAGTCAC | GTGACTCAG |
| ISL2_tup_SOLEXA_10_FBgn0003896_B1H | CTTAATTGA | TCAATTAAG |
| TFAP2A_Tcfap2b_3988_PBM | CCTGAGGCGA | TCGCCTCAGG |
| E2F3_E2F3_si_HocoMoco | CGCGCGAAAC | GTTTCGCGCG |
| TEAD1_MA0090.1_COMPILED\|TEAD1_2 | CACATTCCTCCG | CGGAGGAATGTG |
| ESRRA_known3 | ACCGTGACCTG | CAGGTCACGGT |
| KLF4_CG9895_SOLEXA_5_FBgn0034810_B1H | GGCCACGCCCA | TGGGCGTGGCC |
| RARG_RARB_1_SELEX\|RARG_Rarb_1_SELEX\|RARB_1 | AAAGGTCAAAAGGTCA | TGACCTTTTGACCTTT |
| RARG_pTH4269_PBM\|RARG_pTH2804_PBM | AGAGGTCACC | GGTGACCTCT |
| ZEB1_known5 | CACCTG | CAGGTG |
| NR2C2_pTH1284_PBM | AGAGGTCACG | CGTGACCTCT |
| E2F1_E2F1_f2_HocoMoco\|E2F4_E2F4_do_HocoMoco | AATTGGCGGGAAAA | TTTTCCCGCCAATT |
| MAFK_MAFK_2_SELEX\|MAF_known7 | AAAATGCTGACTCAGCATTTT | AAAATGCTGAGTCAGCATTTT |
| ENSG00000250096_MA0511.1_ChIP-seq | CAAACCACAAACCCC | GGGGTTTGTGGTTTG |
| EP300_disc8 | CGGCGCCCGC | GCGGGCGCCG |
| ETV5_Ets96B_SANGER_5_FBgn0039225_B1H | ACCGGAAGTAC | GTACTTCCGGT |
| RFX5_disc3 | AACTGATGA | TCATCAGTT |
| HLF_pTH9052_PBM | TATTTACGTAACA | TGTTACGTAAATA |
| FOXD1_fd64A_SANGER_5_FBgn0004895_B1H | TATAAACA | TGTTTATA |
| RFX7_1 | CCGCATAGCAACGGA | TCCGTTGCTATGCGG |
| SEF1_1 | AACACGGATATCTGTGGTC | GACCACAGATATCCGTGTT |
| NFIA_NFIX_4_SELEX | CTGGCAAATTGCCAA | TTGGCAATTTGCCAG |
| POU2F2_1\|POU2F3_1 | TCTAATTTGCATACAA | TTGTATGCAAATTAGA |
| REST_PFSK-1_NRSF_HudsonAlpha_ChIP-seq | CAGCACCATGGACAG | CTGTCCATGGTGCTG |
| GRHL1_GRHL1_3_SELEX\|GRHL1_3 | AAAACCGGTTTT | AAAACCGGTTTT |
| NR1H3_EcR_SANGER_5_FBgn0000546_B1H | ATGACCTC | GAGGTCAT |

TABLE 5-continued

Transcription Factor Binding Sites of Synthetic Promoters

| Name | Binding Site Sequence | Reverse Complement |
|---|---|---|
| SREBP_known3 | CACCCCA | TGGGGTG |
| TBX1_TBX1_5_SELEX\|TBX1_4 | TTCACACCTAGAGGTGTGAA | TTCACACCTCTAGGTGTGAA |
| REST_disc10 | AAGGTGCTG | CAGCACCTT |
| SPIC_SP\|1_1_SELEX\|SPIC_SPIB_1_SELEX\|SPIC_Spic_1_SELEX\|SPI1_known4\|SPIB_2\|SPIC_2 | AAAAAGCGGAAGTA | TACTTCCGCTTTTT |
| MAX_GM12878_MAX_Stanford_ChIP-seq | CAGTCACGTGGTC | GACCACGTGACTG |
| MYBL2_pTH3712_PBM | CGACCGTTA | TAACGGTCG |
| TFAP2A_TFAP2A_4_SELEX | AGCCTGAGGCA | TGCCTCAGGCT |
| ZNF691_1 | ATAGTGAGCACTGTTCG | CGAACAGTGCTCACTAT |
| GMEB2_GMEB2_2_SELEX\|GMEB2_2 | AACGTAACCACGTA | TACGTGGTTACGTT |
| STAT1_STAT1_f2_HocoMoco | CATTTCCCGGAAATG | CATTTCCGGGAAATG |
| NR2E1_tll_FlyReg_FBgn0003720_B1H | AAAGTCA | TGACTTT |
| RELA_GM12878_NFKB_Stanford_ChIP-seq | AAGGGGATTTCCAA | TTGGAAATCCCCTT |
| PTF1A_Fer1_SANGER_5_FBgn0037475_B1H | ACGACAGCTGACG | CGTCAGCTGTCGT |
| MSX1_V$MSX1_01_Transfac\|MSX1_1 | CAATTACGG | CCGTAATTG |
| TFAP2A_HeLa-S3_AP2ALPHA_UCD_ChIP-seq | ACTGCCTCAGGGCAT | ATGCCCTGAGGCAGT |
| GATA2_V$GATA1_03_Transfac\|GATA_known5 | AGGAAGATTACCGC | GCGGTAATCTTCCT |
| ELF3_EHF_si_HocoMoco | AAACCCGGAAGTA | TACTTCCGGGTTT |
| ZNF282_ZNF282_1_SELEX\|ZNF282_1 | CTTTCCCACAACACGAC | GTCGTGTTGTGGGAAAG |
| ZNF232_ZNF232_1_SELEX\|ZNF232_1 | ATGTTAAATGTAGATTAAG | CTTAATCTACATTTAACAT |
| ALX3_1 | CTCAGCTAATTAGTTTA | TAAACTAATTAGCTGAG |
| POU3F3_pTH9245_PBM | ATGCTAATTA | TAATTAGCAT |
| PRDM16_V$EVI1_05_Transfac\|PRDM16_V$EVI1_03_Transfac\|RUNX1_4\|RUNX1_6 | AGATAAGATAA | TTATCTTATCT |
| HOXB13_Hoxb13_3479_PBM\|HOXB13_Hoxc13_3127_PBM | GCTCATAAAA | TTTTATGAGC |
| NR2F2_COT2_f2_HocoMoco | AAGGTCAAAGGTCAA | TTGACCTTTGACCTT |
| IRF9_IRF9_f1_HocoMoco | AGTTTCGCTTTC | GAAAGCGAAACT |
| EGR3_Egr3_1_SELEX\|EGR3_3 | AAATGCGTGGGCGTA | TACGCCCACGCATTT |
| DNMT1_pTH7029_PBM | CCCCGCGGCC | GGCCGCGGGG |
| FOXD1_Foxc1_2_SELEX\|FOXC1_7 | ATAAACA | TGTTTAT |
| GCM1_pTH7965_PBM\|GCM1_Gcm1_3732_PBM | ACCCGCATC | GATGCGGGT |
| SRF_V$SRF_01_Transfac\|SRF_known1 | ATGCCCATATATGGTAAT | ATTACCATATATGGGCAT |
| PAX9_pTH8556_PBM | CATGACCACC | GGTGGTCATG |
| TLX2_2 | AAGTTATTAATTAATTA | TAATTAATTAATAACTT |
| ZNF691_Zfp691_0895_PBM | AGGAGCAC | GTGCTCCT |
| ETV5_Ets65A_SANGER_10_FBgn0005658_B1H | ATTTCCGG | CCGGAAAT |

TABLE 5-continued

Transcription Factor Binding Sites of Synthetic Promoters

| Name | Binding Site Sequence | Reverse Complement |
| --- | --- | --- |
| SOX17_Sox17_2_SELEX\|SOX17_5 | ATGAATGAAATTCAT | ATGAATTTCATTCAT |
| ATF5_ATF4_1_SELEX\|ATF4_2 | GGATGATGCAATA | TATTGCATCATCC |
| XBP1_V$HTF_01_Transfac | ATTAAATGACACGTCATCTTTCTG | CAGAAAGATGACGTGTCATTTAAT |
| SIX6_pTH5437_PBM | TAGGGGATAA | TTATCCCCTA |
| TP63_TP63_1_SELEX\|TP63_1 | AACATGTTGGGACATGTC | GACATGTCCCAACATGTT |
| ZBTB33_disc4 | AACCTCGC | GCGAGGTT |
| TBX3_TBX4_2_SELEX\|TBX3_TBX5_2_SELEX\|TBX4_2\|TBX5_5 | AGGTGTGAAATTTCACACCT | AGGTGTGAAATTTCACACCT |
| GATA_disc2 | GTGTGAGTCA | TGACTCACAC |
| RFX3_1 | TGTGACCCTTAGCAACCGATTAA | TTAATCGGTTGCTAAGGGTCACA |
| AP1_disc6 | AAAACCCGGAGCGGA | TCCGCTCCGGGTTTT |
| ZFHX3_ZFHX3_f1_HocoMoco | ATTAATAATTA | TAATTATTAAT |
| HOXC10_HOXD11_2_SELEX\|HOXD11_3 | GGTAATAAAA | TTTTATTACC |
| HOXA4_Ind_Cell_FBgn0025776_B1H | CACTAATTA | TAATTAGTG |
| NKX2-6_1 | AATGTTAAGTGGCTTA | TAAGCCACTTAACATT |
| SP9_SP1_f1_HocoMoco\|SP9_MA0079.3_ChIP-seq | GCCCCGCCCCC | GGGGGCGGGGC |
| BARHL2_CG11085_SOLEXA_FBgn0030408_B1H | ACCAATTAAA | TTTAATTGGT |
| TEF_pTH4377_PBM | AATTTATGTAATA | TATTACATAAATT |
| SRF_disc2 | GAGGGGCCGGC | GCCGGCCCCTC |
| IRF_known7 | GAAAGTGAAACTGAA | TTCAGTTTCACTTTC |
| PRDM16_V$EVI1_04_Transfac\|RUNX1_5 | AGATAAGATAAGATA | TATCTTATCTTATCT |
| STAT5B_V$STAT56_01_Transfac\|STAT_known5 | AAATTCCAGGAAATC | GATTTCCTGGAATTT |
| TP53_V$P53_01_Transfac\|TP53_P53_f2_HocoMoco | AGACATGCCCGGGCATGTCC | GGACATGCCCGGGCATGTCT |

TABLE 5-continued

Transcription Factor Binding Sites of Synthetic Promoters

| Name | Binding Site Sequence | Reverse Complement |
|---|---|---|
| EGR3_GM12878_EGR1_HudsonAlpha_ChIP-seq | CCCCCCCCCCGCCCCCGCAC | GTGCGGGGGCGGGGGGGGGG |
| IRF3_IRF3_f1_HocoMoco | GGAAAGCGAAACTGAAA | TTTCAGTTTCGCTTTCC |
| NFIL3_2 | ATGTTACATAA | TTATGTAACAT |
| CUX1_V$CDPCR1_01_Transfac\|CUX1_3 | AATCGATCGC | GCGATCGATT |
| OVOL1_ovo_FlyReg_FBgn0003028_B1H | AGTAACGG | CCGTTACT |
| PPARA_V$PPARG_03_Transfac\|PPARA_3 | AACTAGGGCAAAGGTCA | TGACCTTTGCCCTAGTT |
| ZEB1_V$AREB6_02_Transfac\|ZEB1_known2 | ATTCACCTGTAC | GTACAGGTGAAT |
| VDR_pTH5509_PBM | ATGAACC | GGTTCAT |
| HNF4G_V$HNF4_01_Transfac | ACAGGGTCAAAGGTCACGA | TCGTGACCTTTGACCCTGT |
| RARG_RARA_S_SELEX\|RARA_6 | AAAGGTCATGTGAGGTCA | TGACCTCACATGACCTTT |
| FOXA2_FOXA2_f1_HocoMoco | CTAAGTAAACAA | TTGTTTACTTAG |
| ATF3_known10 | CTCTGACGTCA | TGACGTCAGAG |
| MYPOP_pTH3456_PBM | TGGCGCAAAA | TTTTGCGCCA |
| TWIST2_MA0249.1_DNaseI\|TWIST_twi_FlyReg_FBgn0003900_B1H | CAACATATGCGA | TCGCATATGTTG |
| GBX2_MA0224.1_B1H\|DLX1_DII_Cell_FBgn0000157_B1H\|GBX2_Exex_Cell_FBgn0041156_B1H\|DLX1_MA0187.1_B1H | GTAATTA | TAATTAC |
| IRX3_Irx3_2226_PBM | ATTACATG | CATGTAAT |
| PPARA_V$PPARG_02_Transfac\|RXRA_known2 | AAGTAGGTCACCGTGACCTACTT | AAGTAGGTCACGGTGACCTACTT |
| NR2E1_NR2E1_1_SELEX\|NR2E1_Nr2e1_1_SELEX\|NR2E1_1\|NR2E1_3 | AAAAGTCAA | TTGACTTTT |
| HOXC5_Hoxb4_2627_PBM\|HOXC5_Hoxb5_3122_PBM\|HOXC5_Hoxb3_1720_PBM\|HOXC5_Hoxc4_3491_PBM\|HOXC5_Hoxa3_2783_PBM | GGTCATTAA | TTAATGACC |
| FOXA2_V$HNF36_01_Transfac | TAAATAAACATTTCA | TGAAATGTTTATTTA |
| AP1_known2 | GGTGACTCAGA | TCTGAGTCACC |
| FEZF2_CG31670_SOLEXA_5_FBgn0031375_B1H | CAAAAAGAGCAACCA | TGGTTGCTCTTTTTG |
| ARNT2_pTH5111_PBM | AAGCACGTGATT | AATCACGTGCTT |
| MYBL2_MYBL2_3_SELEX\|MYBL2_3 | ATAACCGTTAA | TTAACGGTTAT |
| HNF4_disc3 | AGTCCAAAG | CTTTGGACT |
| HOXC5_Hoxb6_3428_PBM | GCCATTA | TAATGGC |
| FOXD1_FOXA1_f1_HocoMoco\|EP300_disc3\|FOXA_known | CAAAGTAAACA | TGTTTACTTTG |

TABLE 5-continued

Transcription Factor Binding Sites of Synthetic Promoters

| Name | Binding Site Sequence | Reverse Complement |
|---|---|---|
| 5 | | |
| CREB3L2_CREB3L1_5_SELEX\|CREB3L2_CREB3L1_3_SELEX\|<br>CREB3L2_Creb3l2_2_SELEX\|CREB3L2_CREB3L1_2_SELEX\|C<br>REB3L1_2\|CREB3L1_3\|CREB3L2_2 | TGCCACGTGGCA | TGCCACGTGGCA |
| E2F_disc2\|EGR1_disc3 | GCGCATGCGC | GCGCATGCGC |
| FOXD1_ECC-1_FOXA1_HudsonAlpha_ChIP-seq | CCCTAAGTAAACAAA | TTTGTTTACTTAGGG |
| TP53_1 | GGACATGCCCGGGCATGTCC | GGACATGCCCGGGCATGTCC |
| FOXD1_FOXC1_f1_HocoMoco | CGTTGTTTACTTAAG | CTTAAGTAAACAACG |
| PKNOX2_Mrg2_2302_PBM\|PKNOX2_Mrg1_2246_PBM | ACCTGTCAA | TTGACAGGT |
| SCRT2_scrt_SOLEXA_2.5_2_FBgn0004880_B1H | ACCACCTGTTGCA | TGCAACAGGTGGT |
| MYBL1_MYB_f1_HocoMoco | CAGTTGG | CCAACTG |
| MEIS1_pTH5781_PBM | ACCTGTCAT | ATGACAGGT |
| TP73_P73_si_HocoMoco | CAGACCTGCCCC | GGGGCAGGTCTG |
| JUN_HepG2_JUND_HudsonAlpha_ChIP-seq | GAGGATGAGTCAC | GTGACTCATCCTC |

All references, patents and patent applications disclosed herein are incorporated by reference with respect to the subject matter for which each is cited, which in some cases may encompass the entirety of the document.

The indefinite articles "a" and "an," as used herein in the specification and in the claims, unless clearly indicated to the contrary, should be understood to mean "at least one."

It should also be understood that, unless clearly indicated to the contrary, in any methods claimed herein that include more than one step or act, the order of the steps or acts of the method is not necessarily limited to the order in which the steps or acts of the method are recited.

In the claims, as well as in the specification above, all transitional phrases such as "comprising," "including," "carrying," "having," "containing," "involving," "holding," "composed of," and the like are to be understood to be open-ended, i.e., to mean including but not limited to. Only the transitional phrases "consisting of" and "consisting essentially of" shall be closed or semi-closed transitional phrases, respectively, as set forth in the United States Patent Office Manual of Patent Examining Procedures, Section 2111.03.

SEQUENCE LISTING (18466 sequences)

SEQ ID NO: 1 - DNA, 203 bp, Artificial Sequence
  Synthetic polynucleotide
caggggatgctttaggcgggaaagtcagagtttctgcctccatttcccaggggatgctttaggcgggaaagtcagagtttctgcctccatttgtcatgcatctcaattacccaggggatgctttaggcgggaaagtcagagtttctgcctccatttcccaggggatgctttaggcgggaaagtcagagtttctgcctccattt

SEQ ID NO: 2 - DNA, 186 bp, Artificial Sequence
  Synthetic polynucleotide
cccgtttccagccgaaacgtagccgtttcgtactcgagctttggcgcatccgtttcccgaattcccgaaacgttcctttggcgctgccctactgacactgcctgcgtttccagccgaaacgtagccgtttcgtactcgagctttggcgcatccgtttcccgaattcccgaaacgttcctttggcgc

SEQ ID NO: 3 - DNA, 502 bp, Artificial Sequence
  Synthetic polynucleotide
cccgtttccagccgaaacgtagccgtttcgtactcgagctttggcgcatccgtttcccgaattcccgaaacgttcctttggcgctgccctactgacactgcctgcgtttccagccgaaacgtagccgtttcgtactcgagctttggcgcatccgtttcccgaattcccgaaacgttcctttggcgcggcgcgccagacgctagcggggggctataaaagggggtgggggcgttcgtcctcactctagatctgcgatctaagtaagcttgatatcgcggccgcccctggacacccttggaagcaaatcccctgcaggcccgtttccagccgaaacgtagccgtttcgtactcgagctttggcgcatccgtttcccgaattcccgaaacgttcctttggcgctgccctactgacactgcctgcgtttccagccgaaacgtagccgtttcgtactcgagctttggcgcatccgtttcccgaattcccgaaacgttcctttggcgc

SEQ ID NO: 4 - DNA, 248 bp, Artificial Sequence
  Synthetic polynucleotide
ccggtgactcagtagcggtgactcagaatcgatgactcagacagtgactaagtactatgagtcaggtcgaatgagtcagcgagtgactcaatggtccatgactcacgaattcctgccctactgacactgcctgccggtgactcagtagcggtgactcagaatcgatgactcagacagtgactaagtactatgagtcaggtcgaatgagtcagcgagtgactcaatggtccatgactcagaatatccgc

SEQ ID NO: 5 - DNA, 521 bp, Artificial Sequence
  Synthetic polynucleotide
ccggtgactcagtagcggtgactcagaatcgatgactcagacagtgactaagtactatgagtcaggtcgaatgagtcagcgagtgactcaatggtccatgactcacgaattcctgccctactgacactgcctgccggtgactcagtagcggtgactcagaatcgatgactcagacagtgactaagtactatgagtcaggtcgaatgagtcagcgagtgactcaatggtccatgactcagaatatccgcggcttggaagcaaatcccctgcaggccggtgactcagtagcggtgactcagaatcgatgactcagacagtgactaagtactatgagtcaggtcgaatgagtcagcgagtgactcaatggtccatgactcacgaattcctgccctactgacactgcctgccggtgactcagtagcggtgactcagaatcgatgactcagacagtgactaagtactatgagtcaggtcgaatgagtcagcgagtgactcaatggtccatgactcagaatatccgc

SEQ ID NO: 6 - DNA, 278 bp, Artificial Sequence
  Synthetic polynucleotide
tccacacgtgcaagccgagcacgtggctcatcaccacgagtcagacaaccacgtgctcactgaccacgtgcctgtcggccacgtgtgagtccacacgtgcatcccgagcacgtggctccgaattcctgccctactgacactgcctgccgtccacacgtgcaagccgagcacgtggctcatcaccacgagtcagacaaccacgtgctcactgaccacgtgcctgtcggccacgtgtgagtccacacgtgcatcccgagcacgtggctccgaatatccgc

SEQ ID NO: 7 - DNA, 258 bp, Artificial Sequence
  Synthetic polynucleotide
cgtacgtgcggcagcccggacgtgcgccatctgcgtgaggacgcgcgtgacaactcgtacgtgcggcgtcccggacgtgcgccgagtgcgtgagtccgcgcgtgacaccgaattcctgccctactgacactgcctgccgcgtacgtgcggcagcccggacgtgcgccatctgcgtgaggacgcgcgtgacaactcgtacgtgcggcgtcccggacgtgcgccgagtgcgtgagtccgcgcgtgacaccgaatatccgc

SEQ ID NO: 8 - DNA, 298 bp, Artificial Sequence
  Synthetic polynucleotide
ctcatttcaaaaaagccccatttaagagtatcctcatttcagattgactatttggtaaactatatttggcaatgcacgtcgtattttgcaatggctgagctcatttcaaaaatcccccatttaagagtcgaattcctgccctactgacactgcctgccgctcatttcaaaaaagccccatttaagagtatctatttggtaagacctcatttcagattactgtattttgcaatggctgtcatatttggcaatgcacgagcccatttaagagttccctcatttcaaaaacgaatatccgc

SEQ ID NO: 9 - DNA, 297 bp, Artificial Sequence
  Synthetic polynucleotide
ccgcgaggaggcagagctgaccactagatggcagtaatctggccaccagagggcgcgactcgccactaggtggcgcacttggccaccagggggcgccagtcccgcgaggaggcaggagtggccaccagagggcgccgaattcctgccctactgacactgcctgccgtcgccactaggtggcgcagctggccaccagggggcgccagacccgcgaggaggcagacttgaccactagatggcagtagagtggccaccagggggcgccatcctcgccactaggtggcgccgaatatccgc

SEQ ID NO: 10 - DNA, 268 bp, Artificial Sequence
  Synthetic polynucleotide
cgaccatctggtagccgaacatctgttatccgaccatctgttgacccacctgcccgactccagctgctcggtccgaccatctggtgagccacctgcccgtcccgaccatctgttcgaattcctgccctactgacactgcctgccgccacctgcccgagcccagctgctcgatccgaccatctggtgaccgaacatctgttactccagctgctcggtcccacctgcccggagccagctgctcgtcccgaccatctggtcgaatatccgc

SEQ ID NO: 11 - DNA, 278 bp, Artificial Sequence
  Synthetic polynucleotide
ctgattggccaaagcctgattggccaaatcctgattggccaagacctgattggccaaactctgattggccaagtctctgattggccaaggagctgattggccaatccctgattggccaacgaattcctgccctactgacactgcctgccgctgattggccaaagcctgattggccaaatcctgattggccaagacctgattggccaaactctgattggccaagtcctgattggccaagagctgattggccaatccctgattggccaacgaatatccgc

SEQ ID NO: 12 - DNA, 275 bp, Artificial Sequence
  Synthetic polynucleotide
aaacaggaagttcgtagcccaaccggaagtatcaaccggaagtagacgaccggaagtaactgaccggaagtagtcgaccggaagtggagaaacaggaagttcgttccccaaccggaagtcgaattcctgccctactgacactgcctgccggaccggaagtaagcaaccggaagtaatcgaccggaagtggacaaacaggaagttcgtactccaaccggaagtgtcaaccggaagtagaggaccggaagtatccgaccggaagtgcgaatatccgc

SEQ ID NO: 13 - DNA, 288 bp, Artificial Sequence
  Synthetic polynucleotide
ggcccaggggatgctttaggcgagcggcccaggggatgctttaggcgatcggcccaggggatgctttaggcggacggcccaggggatgctttaggcgactggcccaggggatgctttaggcggtcgaattcctgccctactgacactgcctgccgggcccaggggatgctttaggcgagcggcccaggggatgctttaggcgatcggcccaggggatgctttaggcggacggcccaggggatgctttaggcggtcggcccaggggatgctttaggcgcgaatatccgc

SEQ ID NO: 14 - DNA, 307 bp, Artificial Sequence
  Synthetic polynucleotide
cggttgccatggcaaccgagccggtttccatggaaacaaatcaagttactaggcaaaaggaccggttgccatggcaaccgactaagttactaggcaaaaggagcggtttccatggaaacaatcccggttgccatggcaaccgcgaattcctgccctactgacactgcctgccgaagttactaggcaaaagagccggttgccatggcaaccgatccggtttccatggaaacaagaccggttgccatggcaaccgactaagttactaggcaaaaggtccggtttccatggaaacaatccgaatatccgc

SEQ ID NO: 15 - DNA, 420 bp, Artificial Sequence
  Synthetic polynucleotide
cccaggggatgctttaggcgggaaagtcagagtttctgcctccatttcccaggggatgctttaggcgggaaagtcagagtttctgcctccatttgtcatgcatctcaattacccaggggatgctttaggcgggaaagtcagagtttctgcctccatttcccaggggatgctttaggcgggaaagtcagagtttctgcctccatttggcctgcaggcccaggggatgctttaggcgggaaagtcagagtttctgcctccatttcccaggggatgctttaggcgggaaagtcagagtttctgcctccatttgtcatgcatctcaattacccaggggatgctttaggcgggaaagtcagagtttctgcctccatttcccaggggatgctttaggcgggaaagtcagagtttctgcctccattt

SEQ ID NO: 16 - DNA, 287 bp, Artificial Sequence
  Synthetic polynucleotide
tagggtgggcgtggcagccggggcggggcatctagggcggggccgacggggggcggggccacttagggtgggcgtggcgtccggggcggggcgagtagggcggggcctccggggggcggggcccgaattctgccctactgacactgcctgccgtagggtgggcgtggcagccggggcggggcatctagggcggggccgacggggggcggggccacttagggtgggcgtggcgtccggggcggggcgagtagggcggggcctccggggggcggggcccgaatatccgc

SEQ ID NO: 17 - DNA, 295 bp, Artificial Sequence
  Synthetic polynucleotide
cgggtgacgtcaacggagcgggctgacgtaaacggatctgacgtcagaccaatgacgtcacgactcgggtgacgtcaacgggtcgggctgacgtaaacgggagtgacgtcatcccaatgacgtcacgcgaattctgccctactgacactgcctgccgcgggtgacgtcaacggagcgggctgacgtaaacggatctgacgtcagaccaatgacgtcacgactcgggtgacgtcaacgggtcgggctgacgtaaacgggagtgacgtcatcccaatgacgtcacgcgaatatccgc

SEQ ID NO: 18 - DNA, 295 bp, Artificial Sequence; identical to SEQ ID NO: 17
  Synthetic polynucleotide

SEQ ID NO: 19 - DNA, 279 bp, Artificial Sequence
  Synthetic polynucleotide
tacgcgcgaaaactgagcgcgccaaaatcgctgagcgcgaaacggacggggcgggaagacttacgcgcgaaaactggtcgcgccaaagaggctgagcgcgaaacgtccggggcgggaagcgaattctgccctactgacactgcctgccgtacgcgcgaaaactgagcgcgccaaaatcgctgagcgcgaaacggacggggcgggaagacttacgcgcgaaaactggtcgcgccaaagaggctgagcgcgaaacgtccggggcgggaagcgaatatccgc

SEQ ID NO: 20 - DNA, 287 bp, Artificial Sequence
  Synthetic polynucleotide
tctgatgcaatagcggtatgatgcaaggaatcagattgtgaaatgtgacattgtgaaataacttctgatgcaatgtcggtatgatgcaaggagagagattgtgaaatgttccattgtgaaatacgaattctgccctactgacactgcctgccgtctgatgcaatagcggtatgatgcaaggaatcagattgtgaaatgtgacattgtgaaataacttctgatgcaatgtcggtatgatgcaaggagagagattgtgaaatgttccattgtgaaatacgaatatccgc

SEQ ID NO: 21 - DNA, 295 bp, Artificial Sequence
  Synthetic polynucleotide
tcagccaatcagagagcgagccaatcagaatcccagccaatcagagactgggccaatcagaaacttcagccaatcagaggtcgagccaatcagagagccagccaatcagatcctgggccaatcagaacgaattctgccctactgacactgcctgccgtcagccaatcagagagcgagccaatcagaatcccagccaatcagagactgggccaatcagaaacttcagccaatcagaggtcgagccaatcagagagccagccaatcagatcctgggccaatcagaacgaatatccgc

SEQ ID NO: 22 - DNA, 276 bp, Artificial Sequence
  Synthetic polynucleotide
agccgcacgtgacagcagccgcacgtgacatccacccacgtgcgaccacccacgtgcactagccgcacgtgaccacagccgcacgtgacgagcacccacgtgctcccacccacgtgccgaattctgccctactgacactgcctgccgagccgcacgtgacagcagccgcacgtgacatccacccacgtgcgaccacccacgtgcactagccgcacgtgaccatcagccgcacgtgacgagcacccacgtgctcccacccacgtgccgaatatccgc

SEQ ID NO: 23 - DNA, 276 bp, Artificial Sequence
  Synthetic polynucleotide
gaccacgtggaagcgaccacgtggaatccgccacgtgcgcgaccgccacgtgcgcactagaccacgtggtcgtcagaccacgtggtcgagaaaacacgtggttccaaaacacgtggtcgaattctgccctactgacactgcctgccggaccacgtggaagcgaccacgtggaatccgccacgtgcgcgaccgccacgtgcgcactagaccacgtggtcgtcagaccacgtggtcgagaaaacacgtggttccaaaacacgtggtcgaatatccgcg

SEQ ID NO: 24 - DNA, 295 bp, Artificial Sequence
  Synthetic polynucleotide
tagcctggggccgagctagcctggggccgatcaccgcctgaggggagacaccgcctgaggggaacttgccctggggccgtctgccctggggccgagttgccctagggcattccttgccctagggcatcgaattctgccctactgacactgcctgccgtagcctggggccgagctagcctggggccgatcaccgcctgaggggagacaccgcctgaggggaacttgccctggggccgtctgccctggggccgagttgccctagggcattccttgccctagggcatcgaatatccgc

SEQ ID NO: 25 - DNA, 259 bp, Artificial Sequence
  Synthetic polynucleotide
gggaattcccagcgggaattcccatcggggactttccagacggggactttccaactgggaattcccgtcgggaattcccgagggggactttccatccggggactttccacgaattctgccctactgacactgcctgccggggaattcccagcgggaattcccatcggggactttccagacggggactttccaactgggaattcccgtcgggaattcccgagggggactttccatccggggactttccacgaatatccgc

SEQ ID NO: 26 - DNA, 295 bp, Artificial Sequence
  Synthetic polynucleotide
agcgcatttcccggaaatgatatctattccaggaactgactattccaggaactactgcatttcccggaaatgatgtcgcatttcccggaaatgatgagtattccaggaacttcctattccaggaactcgaattctgccctactgacactgcctgccggcatttcccggaaatgatagcgcatttcccggaaatgatactattccaggaactactgcatttcccggaaatgatgtcgcatttcccggaaatgatgagtattccaggaacttcctattccaggaactcgaatatccg

SEQ ID NO: 27 - DNA, 312 bp, Artificial Sequence
  Synthetic polynucleotide
atgcgtgggcgtagcatgcgtgggcgtatccgcggcgggggcggaggaccgcggcgggggcggagactaatgcgggggcggagtcaatgcgggggcggagaggggcgggggcggggcctccgggcgggggcggggcccgaattctgccctactgacactgcctgccgatgcgtgggcgtacatgcgtgggcgtatccgcggcgggggcggaggccgcggcgggggcggagctaatgcgggggcggagtcaatgcgggggcggagaggggcgggggcggggcctccgggcgggggcggggcccgaatatccgc

SEQ ID NO: 28 - DNA, 186 bp, Artificial Sequence
  Synthetic polynucleotide
gcgccaaaggaacgtttcgggaattcgggaaacggatgcgccaaagctcgagtacgaaacggctacgtttcggctggaaacgcaggcagtgtcagtagggcagcgccaaaggaacgtttcgggaattcgggaaacggatgcgccaaagctcgagtacgaaacggctacgtttcggctggaaacggg

SEQ ID NO: 29 - DNA, 390 bp, Artificial Sequence
  Synthetic polynucleotide
gcgccaaaggaacgtttcgggaattcgggaaacggatgcgccaaagctcgagtacgaaacggctacgtttcggctggaaacgcaggcagtgtcagtagggcagcgccaaaggaacgtttcgggaattcgggaaacggatgcgccaaagctcgagtacgaaacggctacgtttcggctggaaacgcaggcagtgtcagtagggcagcgccaaaggaacgtttcgggaattcgggaaacggatgcgccaaagctcgagtacgaaacggctacgtttcggctggaaacgcaggcagtgtcagtagggcagcgccaaaggaacgtttcgggaattcgggaaacggatgcgccaaagctcgagtacgaaacggctacgtttcggctggaaacggg

SEQ ID NO: 30 - DNA, 297 bp, Artificial Sequence
  Synthetic polynucleotide
gcggatattcggcgccacctagtggcgaggatggcgccccctggtggccactctactgccatctagtggtcaagtctgcctcctcgcgggtctggcgccccctggtggccagctgcgccacctagtggcgacggcaggcagtgtcagtagggcaggaattcggcgccctctggtggccactcctgcctcctcgcgggactggcgccccctggtggccaagtgcgccacctagtggcgagtcgcgccctctggtggccagattactgccatctagtggtcagctctgcctcctcgcgg

SEQ ID NO: 31 - DNA, 268 bp, Artificial Sequence
  Synthetic polynucleotide
gcggatattcgaccagatggtcgggacgagcagctggctccgggcaggtgggaccgagcagctggagtaacagatgttcggtcaccagatggtcggatcgagcagctgggctcgggcaggtggcggcaggcagtgtcagtagggcaggaattcgaacagatggtcgggacgggcaggtggctcaccagatggtcggaccgagcagctggagtcgggcaggtgggtcaacagatggtcggataacagatgttcggctaccagatggtcg

SEQ ID NO: 32 - DNA, 274 bp, Artificial Sequence
  Synthetic polynucleotide
gaccacgtggaaagcgaccacgtggaaatcgaccacgtggaagacgaccacgtggaaactgaccacgtggaagtcgaccacgtggaagaggaccacgtggaatccgaccacgtggaagaattctgccctactgacactgcctgccggaccacgtggaaagcgaccacgtggaaatcgaccacgtggaagacgaccacgtggaaactgaccacgtggaagtcgaccacgtggaagaggaccacgtggaatccgaccacgtggaacgaatatccgc

SEQ ID NO: 33 - DNA, 275 bp, Artificial Sequence
  Synthetic polynucleotide
tccgccacgtgcgcgacgactccgccacgtgcgcgacacttccgccacgtgcgcgacgtctccgccacgtgcgcgacgagtccgccacgtgcgcgactcctccgccacgtgcgcgaccgaattctgccctactgacactgcctgccgtccgccacgtgcgcgacgactccgccacgtgcgcgacacttccgccacgtgcgcgacgtctccgccacgtgcgcgacgagtccgccacgtgcgcgactcctccgccacgtgcgcgaccgaatatccgc

SEQ ID NO: 34 - DNA, 291 bp, Artificial Sequence
  Synthetic polynucleotide
agaccacgtggtcagcagaccacgtggtcatcagaccacgtggtcgacagaccacgtggtcactagaccacgtggtcgtcagaccacgtggtcgagagaccacgtggtctccagaccacgtggtccgaattctgccctactgacactgcctgccgagaccacgtggtcagcagaccacgtggtcatcagaccacgtggtcgacagaccacgtggtcactagaccacgtggtcgtcagaccacgtggtcgagagaccacgtggtctccagaccacgtggtccgaatatccgc

SEQ ID NO: 35 - DNA, 275 bp, Artificial Sequence
  Synthetic polynucleotide
aaaacacgtggtagcaaaacacgtggtatcaaaacacgtggtgacaaaacacgtggtactaaaacacgtggtgtcaaaacacgtggtgagaaaacacgtggttccaaaacacgtggtcgaattctgccctactgacactgcctgccgaaaacacgtggtagcaaaacacgtggtatcaaaacacgtggtgacaaaacacgtggtactaaaacacgtggtgtcaaaacacgtggtgagaaaacacgtggttccaaaacacgtggtcgaatatccgc

SEQ ID NO: 36 - DNA, 135 bp, Artificial Sequence
  Synthetic polynucleotide
gtccgccacgtgcgcgacagtccgccacgtgcgcgactggtccgccacgtgcgcgaccgtccgccacgtgcgcgaccggtccgccacgtgcgcgaccgtccgccacgtgcgcgacgtgtccgccacgtgcgcgcc

SEQ ID NO: 37 - DNA, 131 bp, Artificial Sequence
  Synthetic polynucleotide
ttccgccacgtggcggaagttccgccacgtggcggaattccgccacgtggcggaaattccgccacgtggcggaattccgccacgtggcggaatttccgccacgtggcggaattccgccacgtggcggaacc

SEQ ID NO: 38 - DNA, 96 bp, Artificial Sequence
  Synthetic polynucleotide
gccacgtgagcgccacgtgatcgccacgtggacgccacgtgactgccacgtgagtgccacgtggtcgccacgtggatgccacgtggctgccacgtg

SEQ ID NO: 39 - DNA, 276 bp, Artificial Sequence
  Synthetic polynucleotide
gcggatattcgaccacgtgttttggaaccacgtgttttctcgaccacgtggtctgacgaccacgtggtctagtgcgcacgtggcggtcgcgcacgtggcggattccacgtggtcgcttccacgtggtccggcaggcagtgtcagtagggcagaattcgaccacgtgttttggaaccacgtgttttctcgaccacgtggtctgacgaccacgtggtctagtgcgcacgtggcggtcgcgcacgtggcggattccacgtggtcgcttccacgtggtcc

SEQ ID NO: 40 - DNA, 601 bp, Artificial Sequence
  Synthetic polynucleotide
ggccgccctgcacctgcagggaccacgtggaagcgaccacgtggaatccgccacgtgcgcgaccgccacgtgcgcactagaccacgtggtcgtcagaccacgtggtcgagaaaacacgtggttccaaaacacgtggtcgaattctgccctactgacactgcctgccggaccacgtggaagcgaccacgtggaatccgccacgtgcgcgaccgccacgtgcgcactagaccacgtggtcgtcagaccacgtggtcgagaaaacacgtggttccaaaacacgtggtcgaatatccgcggcgcgccagacgtgcagggaccacgtggaagcgaccacgtggaatccgccacgtgcgcgaccgccacgtgcgcactagaccacgtggtcgtcagaccacgtggtcgagaaaacacgtggttccaaaacacgtggtcgaattctgccctactgacactgcctgccggaccacgtggaagcgaccacgtggaatccgccacgtgcgcgaccgccacgtgcgcactagaccacgtggtcgtcagaccacgtggtcgagaaaacacgtggttccaaaacacgtggtcgaatatccgcggcgcgccagac

SEQ ID NO: 41 - DNA, 94 bp, Artificial Sequence
  Synthetic polynucleotide
gacgccatgacgcatgacgccatgacgccatgacgccatgacgccatgacgccatgacgcatgacgccatgacgccatgacgccattacgccat

SEQ ID NO: 42 - DNA, 96 bp, Artificial Sequence
  Synthetic polynucleotide
gggggtccagcgggggtccatcgggggtccgacgggggtccactgggggtccagtgggggtccgtcgggggtccgatgggggtccgctgggggtcc

SEQ ID NO: 43 - DNA, 95 bp, Artificial Sequence
  Synthetic polynucleotide
agtggggtagcagtgggtatcagtggggtgacagtggggtactagtggggtagtagtggggtgtcagtggggtgatagtggggtgctagtggggt

SEQ ID NO: 44 - DNA, 95 bp, Artificial Sequence
  Synthetic polynucleotide
gtgcccgcgtaatcccgcccgcgtagacccgcccgcgtaactccgcccgcgtaagtccgcccgcgtagtcccgcccgcgtagatccgcccgcgta

SEQ ID NO: 45 - DNA, 96 bp, Artificial Sequence
  Synthetic polynucleotide
gagacatagagacatagagacatagagacatagagacatagagacatagagacatagagacatagagacatagagacatagagacatagagacata

SEQ ID NO: 46 - DNA, 88 bp, Artificial Sequence
  Synthetic polynucleotide
cactgggtcacggggtcacggggtcacggggtcacggggtcacggggtcacggggtcacggggtcacggggtcacggggtcacggggt

SEQ ID NO: 47 - DNA, 96 bp, Artificial Sequence
  Synthetic polynucleotide
gggaatgagggaatgagggaatgagggaatgagggaatgagggaatgagggaatgagggaatgagggaatgtgggaatgtgggaatgtgggaatgt

SEQ ID NO: 48 - DNA, 96 bp, Artificial Sequence
  Synthetic polynucleotide
gaaggcaggaaggcaggaaggcaggaaggcaggaaggcaggaaggcaggaaggcaggaaggcaggaaggcaggaaggcaggaaggcaggaaggcag

SEQ ID NO: 49 - DNA, 93 bp, Artificial Sequence
  Synthetic polynucleotide
gggccaaatggatcgggccaaatgggacggggcaaatggactgggcaaatggagtggggcaaatgggtcgggcaaatgggatggggcaaatgg

SEQ ID NO: 50 - DNA, 191 bp, Artificial Sequence
  Synthetic polynucleotide
atcatctcaccttgcctcctgtggagagatttatctggcctgcaggccaattaattaattacgagaccaattaattaattacgtcgccaattaattaattacggacccaattaattaattacgctaccaattaattaattacgactccaattaattaattacgtgcggcgcgccatgcttcatcagactct

SEQ ID NO: 51 - DNA, 191 bp, Artificial Sequence; identical to SEQ ID NO: 50
  Synthetic polynucleotide

SEQ ID NO: 52 - DNA, 196 bp, Artificial Sequence
  Synthetic polynucleotide
atcatctcaccttgcctcctggaccgaatacactgtgacctgcaggaatgattgatgcaagaaatgattgatgcatcgaatgattgatgcagacaatgattgatgcactaaatgattgatgcaactaatgattgatgcatgcaatgattgatgcagtaaatgattgatgcaggcgcgccatgcttcatcagactct

SEQ ID NO: 53 - DNA, 196 bp, Artificial Sequence; identical to SEQ ID NO: 52
  Synthetic polynucleotide

SEQ ID NO: 54 - DNA, 185 bp, Artificial Sequence
  Synthetic polynucleotide
atcatctcaccttgcctcctgggtactgtaggtatccgcctgcaggggggtcaaagtccattagaggggtcaaagtccatttcgggggtcaaagtccattgacggggtcaaagtccattctaggggtcaaagtccattactggggtcaaagtccatttgcggcgcgccatgcttcatcagactct

SEQ ID NO: 55 - DNA, 185 bp, Artificial Sequence; identical to SEQ ID NO: 54
  Synthetic polynucleotide

SEQ ID NO: 56 - DNA, 191 bp, Artificial Sequence
  Synthetic polynucleotide
atcatctcaccttgcctcctgtaagggtcccattgtcccctgcaggaatattacatgtatattagaaatattacatgtatatttcgaatattacatgtatattgacaatattacatgtatattctaaatattacatgtatattactaatattacatgtatatttgcggcgcgccatgcttcatcagactct

SEQ ID NO: 57 - DNA, 191 bp, Artificial Sequence; identical to SEQ ID NO: 56
  Synthetic polynucleotide

SEQ ID NO: 58 - DNA, 196 bp, Artificial Sequence
  Synthetic polynucleotide
atcatctcaccttgcctcctgagctattctatgttcgtcctgcaggtgaaattctattgttctttattagatgaaattctattgttctttatttcgtgaaattctattgttctttattgactgaaattctattgttctttattctatgaaattctattgttctttattactggcgcgccatgcttcatcagactct

SEQ ID NO: 59 - DNA, 196 bp, Artificial Sequence; identical to SEQ ID NO: 58
  Synthetic polynucleotide

SEQ ID NO: 60 - DNA, 172 bp, Artificial Sequence
  Synthetic polynucleotide
atcatctcaccttgcctcctgtaaacagtgttacgaggcctgcaggccattgttttagaccattgtttttcgccattgttttgacccattgttttctaccattgttttactccattgtttttgcccattgttttgtaccattgttttggcgcgccatgcttcatcagactct

SEQ ID NO: 61 - DNA, 172 bp, Artificial Sequence; identical to SEQ ID NO: 60
  Synthetic polynucleotide

SEQ ID NO: 62 - DNA, 180 bp, Artificial Sequence
  Synthetic polynucleotide
atcatctcaccttgcctcctgccaggttatatgcctggcctgcaggcgcctcaggcaagacgcctcaggcatcgcgcctcaggcagaccgcctcaggcactacgcctcaggcaactcgcctcaggcatgccgcctcaggcagtacgcctcaggcaggcgcgccatgcttcatcagactct

SEQ ID NO: 63 - DNA, 180 bp, Artificial Sequence; identical to SEQ ID NO: 62
  Synthetic polynucleotide

SEQ ID NO: 64 - DNA, 190 bp, Artificial Sequence
  Synthetic polynucleotide
atcatctcaccttgcctcctggggtagggaagtgtgtgcctgcaggtataagtaggtcaaagatataagtaggtcaatcgtataagtaggtcaagactataagtaggtcaactatataagtaggtcaaacttataagtaggtcaatgctataagtaggtcaagtaggcgcgccatgcttcatcagactct

SEQ ID NO: 65 - DNA, 190 bp, Artificial Sequence; identical to SEQ ID NO: 64
  Synthetic polynucleotide

SEQ ID NO: 66 - DNA, 156 bp, Artificial Sequence
  Synthetic polynucleotide
atcatctcaccttgcctcctggaaatgcgaattggaagcctgcaggtggaaatcagatggaaatctcgtggaaatcgactggaaatcctatggaaatcacttggaaatctgctggaaatcgtatggaaatcggcgcgccatgcttcatcagactct

SEQ ID NO: 67 - DNA, 156 bp, Artificial Sequence; identical to SEQ ID NO: 66
  Synthetic polynucleotide

SEQ ID NO: 68 - DNA, 180 bp, Artificial Sequence
  Synthetic polynucleotide
atcatctcaccttgcctcctgctgctgaccggctgtttcctgcaggggtcgtaaaatagaggtcgtaaaattcgggtcgtaaaatgacggtcgtaaaatctaggtcgtaaaatactggtcgtaaaattgcggtcgtaaaatgtaggtcgtaaaatggcgcgccatgcttcatcagactct

SEQ ID NO: 69 - DNA, 180 bp, Artificial Sequence; identical to SEQ ID NO: 68
  Synthetic polynucleotide

SEQ ID NO: 70 - DNA, 180 bp, Artificial Sequence
  Synthetic polynucleotide
atcatctcaccttgcctcctgaaatagcgagaagctcacctgcaggcaaaccacagaagacaaaccacagatcgcaaaccacagagaccaaaccacagactacaaaccacagaactcaaaccacagatgccaaaccacagagtacaaaccacagaggcgcgccatgcttcatcagactct

SEQ ID NO: 71 - DNA, 180 bp, Artificial Sequence; identical to SEQ ID NO: 70
  Synthetic polynucleotide

SEQ ID NO: 72 - DNA, 156 bp, Artificial Sequence
  Synthetic polynucleotide
atcatctcaccttgcctcctgaggaaagaaatgccagacctgcaggtggaaataagatggaaatatcgtggaaatagactggaaatactatggaaataacttggaaatatgctggaaatagtatggaaataggcgcgccatgcttcatcagactct

SEQ ID NO: 73 - DNA, 156 bp, Artificial Sequence; identical to SEQ ID NO: 72
  Synthetic polynucleotide

SEQ ID NO: 74 - DNA, 188 bp, Artificial Sequence
  Synthetic polynucleotide
atcatctcaccttgcctcctggcactgatatactactgcctgcaggctaccatcaatcagactaccatcaatctcgctaccatcaatcgacctaccatcaatcctactaccatcaatcactctaccatcaatctgcctaccatcaatcgtactaccatcaatcggcgcgccatgcttcatcagactct

SEQ ID NO: 75 - DNA, 188 bp, Artificial Sequence; identical to SEQ ID NO: 74
  Synthetic polynucleotide

SEQ ID NO: 76 - DNA, 172 bp, Artificial Sequence
  Synthetic polynucleotide
atcatctcaccttgcctcctgatctagactcttcagatcctgcaggccagatgtcaagaccagatgtcatcgccagatgtcagacccagatgtcactaccagatgtcaactccagatgtcatgcccagatgtcagtaccagatgtcaggcgcgccatgcttcatcagactct

SEQ ID NO: 77 - DNA, 172 bp, Artificial Sequence; identical to SEQ ID NO: 76
  Synthetic polynucleotide

SEQ ID NO: 78 - DNA, 190 bp, Artificial Sequence
  Synthetic polynucleotide
atcatctcaccttgcctcctgctcgttatttcaaacgccctgcaggttgttacattgttgagattgttacattgttgtcgttgttacattgttggacttgttacattgttgctattgttacattgttgactttgttacattgttgtgcttgttacattgttggtaggcgcgccatgcttcatcagactct

SEQ ID NO: 79 - DNA, 190 bp, Artificial Sequence; identical to SEQ ID NO: 78
  Synthetic polynucleotide

SEQ ID NO: 80 - DNA, 191 bp, Artificial Sequence
  Synthetic polynucleotide
atcatctcaccttgcctcctgttcactcttgtcggaaacctgcaggaagattttacgaccttgagaaagattttacgaccttgtcgaagattttacgaccttggacaagattttacgaccttgctaaagattttacgaccttgactaagattttacgaccttgtgcggcgcgccatgcttcatcagactct

SEQ ID NO: 81 - DNA, 191 bp, Artificial Sequence; identical to SEQ ID NO: 80
  Synthetic polynucleotide

SEQ ID NO: 82 - DNA, 180 bp, Artificial Sequence
  Synthetic polynucleotide
atcatctcaccttgcctcctgctctctatagcacgacacctgcaggggtcgtaaaaaagaggtcgtaaaaatcgggtcgtaaaaagacggtcgtaaaaactaggtcgtaaaaaactggtcgtaaaaatgcggtcgtaaaaagtaggtcgtaaaaaggcgcgccatgcttcatcagactct

SEQ ID NO: 83 - DNA, 180 bp, Artificial Sequence; identical to SEQ ID NO: 82
  Synthetic polynucleotide

SEQ ID NO: 84 - DNA, 180 bp, Artificial Sequence
  Synthetic polynucleotide
atcatctcaccttgcctcctgtttgtcggtcatcaagccctgcaggagcctgaggcaagaagcctgaggcatcgagcctgaggcagacagcctgaggcactaagcctgaggcaactagcctgaggcatgcagcctgaggcagtaagcctgaggcaggcgcgccatgcttcatcagactct

SEQ ID NO: 85 - DNA, 180 bp, Artificial Sequence; identical to SEQ ID NO: 84
  Synthetic polynucleotide

SEQ ID NO: 86 - DNA, 197 bp, Artificial Sequence
  Synthetic polynucleotide
atcatctcaccttgcctcctggtgtagggaaatcagctcctgcaggcggccaccagggggcagacggccaccagggggctcgcggccaccagggggcgaccggccaccagggggcctacggccaccagggggcactcggccaccagggggctgccggccaccagggggcgtaggcgcgccatgcttcatcagactct

SEQ ID NO: 87 - DNA, 197 bp, Artificial Sequence; identical to SEQ ID NO: 86
  Synthetic polynucleotide

SEQ ID NO: 88 - DNA, 188 bp, Artificial Sequence
  Synthetic polynucleotide
atcatctcaccttgcctcctgagttgtccaacccgggtcctgcagggattacgtggcaagagattacgtggcatcggattacgtggcagacgattacgtggcactagattacgtggcaactgattacgtggcatgcgattacgtggcagtagattacgtggcaggcgcgccatgcttcatcagactct

SEQ ID NO: 89 - DNA, 188 bp, Artificial Sequence; identical to SEQ ID NO: 88
  Synthetic polynucleotide

SEQ ID NO: 90 - DNA, 156 bp, Artificial Sequence
  Synthetic polynucleotide
atcatctcaccttgcctcctgccctgcgatcctactagcctgcagggtgaccccagagtgacccctcggtgaccccgacgtgaccccctagtgaccccactgtgacccctgcgtgaccccgtagtgaccccggcgcgccatgcttcatcagactct

SEQ ID NO: 91 - DNA, 156 bp, Artificial Sequence; identical to SEQ ID NO: 90
  Synthetic polynucleotide

SEQ ID NO: 92 - DNA, 197 bp, Artificial Sequence
  Synthetic polynucleotide
atcatctcaccttgcctcctgtctatagcttccctccacctgcaggctgtccatggtgctgagactgtccatggtgctgtcgctgtccatggtgctggacctgtccatggtgctgctactgtccatggtgctgactctgtccatggtgctgtgcctgtccatggtgctggtaggcgcgccatgcttcatcagactct

SEQ ID NO: 93 - DNA, 197 bp, Artificial Sequence; identical to SEQ ID NO: 92
  Synthetic polynucleotide

SEQ ID NO: 94 - DNA, 191 bp, Artificial Sequence
  Synthetic polynucleotide
atcatctcaccttgcctcctgttggctcgaccctgatccctgcaggaaactacaattcccagaatgcagaaaactacaattcccagaatgctcgaaactacaattcccagaatgcgacaaactacaattcccagaatgcctaaaactacaattcccagaatgcactggcgcgccatgcttcatcagactct

SEQ ID NO: 95 - DNA, 191 bp, Artificial Sequence; identical to SEQ ID NO: 94
  Synthetic polynucleotide

SEQ ID NO: 96 - DNA, 172 bp, Artificial Sequence
  Synthetic polynucleotide
atcatctcaccttgcctcctgctacacgtcagtatccacctgcaggtgcctcagggagatgcctcagggtcgtgcctcaggggactgcctcagggctatgcctcagggacttgcctcagggtgctgcctcaggggtatgcctcagggggcgcgccatgcttcatcagactct

SEQ ID NO: 97 - DNA, 172 bp, Artificial Sequence; identical to SEQ ID NO: 96
  Synthetic polynucleotide

SEQ ID NO: 98 - DNA, 197 bp, Artificial Sequence
  Synthetic polynucleotide
atcatctcaccttgcctcctgttctagggccatttccacctgcaggaagtgaaagtgaaagagaaagtgaaagtgaaagtcgaagtgaaagtgaaaggacaagtgaaagtgaaagctaaagtgaaagtgaaagactaagtgaaagtgaaagtgcaagtgaaagtgaaaggtaggcgcgccatgcttcatcagactct

SEQ ID NO: 99 - DNA, 197 bp, Artificial Sequence; identical to SEQ ID NO: 98
  Synthetic polynucleotide

SEQ ID NO: 100 - DNA, 197 bp, Artificial Sequence
  Synthetic polynucleotide
atcatctcaccttgcctcctgtgccgagctcacagcttcctgcaggacccccccgggggggagaacccccccgggggggtcgacccccccggggggggacacccccccgggggggctaacccccccgggggggactacccccccgggggggtgcacccccccggggggggtaggcgcgccatgcttcatcagactct

SEQ ID NO: 101 - DNA, 197 bp, Artificial Sequence; identical to SEQ ID NO: 100
  Synthetic polynucleotide

SEQ ID NO: 102 - DNA, 180 bp, Artificial Sequence
  Synthetic polynucleotide
atcatctcaccttgcctcctgcctacgacgccttaatccctgcagggagacatgtccagagagacatgtcctcggagacatgtccgacgagacatgtccctagagacatgtccactgagacatgtcctgcgagacatgtccgtagagacatgtccggcgcgccatgcttcatcagactct

SEQ ID NO: 103 - DNA, 180 bp, Artificial Sequence; identical to SEQ ID NO: 102
  Synthetic polynucleotide

SEQ ID NO: 104 - DNA, 164 bp, Artificial Sequence
  Synthetic polynucleotide
atcatctcaccttgcctcctggaagttaccaggatatccctgcagggccatcttgagagccatcttgtcggccatcttggacgccatcttgctagccatcttgactgccatcttgtgcgccatcttggtagccatcttgggcgcgccatgcttcatcagactct

SEQ ID NO: 105 - DNA, 164 bp, Artificial Sequence; identical to SEQ ID NO: 104
  Synthetic polynucleotide

SEQ ID NO: 106 - DNA, 164 bp, Artificial Sequence
  Synthetic polynucleotide
atcatctcaccttgcctcctgcgcatcgatcaagggaacctgcaggttgacagctagattgacagcttcgttgacagctgacttgacagctctattgacagctactttgacagcttgcttgacagctgtattgacagctggcgcgccatgcttcatcagactct

SEQ ID NO: 107 - DNA, 164 bp, Artificial Sequence; identical to SEQ ID NO: 106
  Synthetic polynucleotide

SEQ ID NO: 108 - DNA, 156 bp, Artificial Sequence
  Synthetic polynucleotide
atcatctcaccttgcctcctgtaccaacgtcagttactcctgcaggacctagtgagaacctagtgtcgacctagtggacacctagtgctaacctagtgactacctagtgtgcacctagtggtaacctagtgggcgcgccatgcttcatcagactct

SEQ ID NO: 109 - DNA, 156 bp, Artificial Sequence; identical to SEQ ID NO: 108
  Synthetic polynucleotide

SEQ ID NO: 110 - DNA, 197 bp, Artificial Sequence
  Synthetic polynucleotide
atcatctcaccttgcctcctgatgctactgggtgggagcctgcaggaccatggacagcgccagaaccatggacagcgcctcgaccatggacagcgccgacaccatggacagcgccctaaccatggacagcgccactaccatggacagcgcctgcaccatggacagcgccgtaggcgcgccatgcttcatcagactct

SEQ ID NO: 111 - DNA, 197 bp, Artificial Sequence; identical to SEQ ID NO: 110
  Synthetic polynucleotide

SEQ ID NO: 112 - DNA, 172 bp, Artificial Sequence
  Synthetic polynucleotide
atcatctcaccttgcctcctgttgttacctaccctttacctgcaggatcaaggtcaagaatcaaggtcatcgatcaaggtcagacatcaaggtcactaatcaaggtcaactatcaaggtcatgcatcaaggtcagtaatcaaggtcaggcgcgccatgcttcatcagactct

SEQ ID NO: 113 - DNA, 172 bp, Artificial Sequence; identical to SEQ ID NO: 112
  Synthetic polynucleotide

SEQ ID NO: 114 - DNA, 190 bp, Artificial Sequence
  Synthetic polynucleotide
atcatctcaccttgcctcctgactgtggcaaccagccacctgcaggtggacacgtgacccagatggacacgtgaccctcgtggacacgtgacccgactggacacgtgacccctatggacacgtgacccacttggacacgtgaccctgctggacacgtgacccgtaggcgcgccatgcttcatcagactct

SEQ ID NO: 115 - DNA, 190 bp, Artificial Sequence; identical to SEQ ID NO: 114
  Synthetic polynucleotide

SEQ ID NO: 116 - DNA, 185 bp, Artificial Sequence
  Synthetic polynucleotide
atcatctcaccttgcctcctggaaatcatgggtatctgcctgcaggaatgttaagtggcttaagaaatgttaagtggcttatcgaatgttaagtggcttagacaatgttaagtggcttactaaatgttaagtggcttaactaatgttaagtggcttatgcggcgcgccatgcttcatcagactct

SEQ ID NO: 117 - DNA, 185 bp, Artificial Sequence; identical to SEQ ID NO: 116
  Synthetic polynucleotide

SEQ ID NO: 118 - DNA, 156 bp, Artificial Sequence
  Synthetic polynucleotide
atcatctcaccttgcctcctgatcttcgttgtgagtgtcctgcaggagtcacggagaagtcacggtcgagtcacgggacagtcacggctaagtcacggactagtcacggtgcagtcacgggtaagtcacggggcgcgccatgcttcatcagactct

SEQ ID NO: 119 - DNA, 156 bp, Artificial Sequence; identical to SEQ ID NO: 118
  Synthetic polynucleotide

SEQ ID NO: 120 - DNA, 172 bp, Artificial Sequence
  Synthetic polynucleotide
atcatctcaccttgcctcctgaggtgtaggaaagagctcctgcaggttaattgcttagattaattgctttcgttaattgcttgacttaattgcttctattaattgcttactttaattgctttgcttaattgcttgtattaattgcttggcgcgccatgcttcatcagactct

SEQ ID NO: 121 - DNA, 172 bp, Artificial Sequence; identical to SEQ ID NO: 120
  Synthetic polynucleotide

SEQ ID NO: 122 - DNA, 200 bp, Artificial Sequence
  Synthetic polynucleotide
atcatctcaccttgcctcctgaagtggaaatagacgtgcctgcaggtgaggtcaaaaaagttcagagatgaggtcaaaaaagttcagtcgtgaggtcaaaaaagttcaggactgaggtcaaaaaagttcagctatgaggtcaaaaaagttcagacttgaggtcaaaaaagttcagggcgcgccatgcttcatcagactct

SEQ ID NO: 123 - DNA, 200 bp, Artificial Sequence; identical to SEQ ID NO: 122
  Synthetic polynucleotide

SEQ ID NO: 124 - DNA, 156 bp, Artificial Sequence
  Synthetic polynucleotide
atcatctcaccttgcctcctgctgacaatgtggcaacgcctgcaggagtcacgcagaagtcacgctcgagtcacgcgacagtcacgcctaagtcacgcactagtcacgctgcagtcacgcgtaagtcacgcggcgcgccatgcttcatcagactct

SEQ ID NO: 125 - DNA, 156 bp, Artificial Sequence; identical to SEQ ID NO: 124
  Synthetic polynucleotide

SEQ ID NO: 126 - DNA, 164 bp, Artificial Sequence
  Synthetic polynucleotide
atcatctcaccttgcctcctggccatctcttcaccaagcctgcagggtgacctttagagtgaccttttcggtgacctttgacgtgacctttctagtgacctttactgtgaccttttgcgtgacctttgtagtgacctttggcgcgccatgcttcatcagactct

SEQ ID NO: 127 - DNA, 164 bp, Artificial Sequence; identical to SEQ ID NO: 126
  Synthetic polynucleotide

SEQ ID NO: 128 - DNA, 172 bp, Artificial Sequence
  Synthetic polynucleotide
atcatctcaccttgcctcctggtccagtcgcctttaggcctgcagggtggggggggagagtggggggggtcggtgggggggggacgtggggggggctagtggggggggactgtggggggggtgcgtgggggggggtagtggggggggggcgcgccatgcttcatcagactct

SEQ ID NO: 129 - DNA, 172 bp, Artificial Sequence; identical to SEQ ID NO: 128
  Synthetic polynucleotide

SEQ ID NO: 130 - DNA, 196 bp, Artificial Sequence
  Synthetic polynucleotide
atcatctcaccttgcctcctgccctcggagcgtttatccctgcagggaccacgtgactgagagaccacgtgactgtcggaccacgtgactggacgaccacgtgactgctagaccacgtgactgactgaccacgtgactgtgcgaccacgtgactggtagaccacgtgactgggcgcgccatgcttcatcagactct

SEQ ID NO: 131 - DNA, 196 bp, Artificial Sequence; identical to SEQ ID NO: 130
  Synthetic polynucleotide

SEQ ID NO: 132 - DNA, 191 bp, Artificial Sequence
  Synthetic polynucleotide
atcatctcaccttgcctcctgatcgctaacgagcggtccctgcaggtgccactaattagtgtaagatgccactaattagtgtatcgtgccactaattagtgtagactgccactaattagtgtactatgccactaattagtgtaacttgccactaattagtgtatgcggcgcgccatgcttcatcagactct

SEQ ID NO: 133 - DNA, 191 bp, Artificial Sequence; identical to SEQ ID NO: 132
  Synthetic polynucleotide

SEQ ID NO: 134 - DNA, 156 bp, Artificial Sequence
  Synthetic polynucleotide
atcatctcaccttgcctcctgtaggttccgttccaccacctgcaggttcattgaagattcattgatcgttcattgagacttcattgactattcattgaactttcattgatgcttcattgagtattcattgaggcgcgccatgcttcatcagactct

SEQ ID NO: 135 - DNA, 156 bp, Artificial Sequence; identical to SEQ ID NO: 134
  Synthetic polynucleotide

SEQ ID NO: 136 - DNA, 188 bp, Artificial Sequence
  Synthetic polynucleotide
atcatctcaccttgcctcctgacaggaaatcctaatgacctgcaggttattgatttttagattattgattttttcgttattgatttttgacttattgatttttctattattgatttttactttattgattttttgcttattgatttttgtattattgatttttggcgcgccatgcttcatcagactct

SEQ ID NO: 137 - DNA, 188 bp, Artificial Sequence; identical to SEQ ID NO: 136
  Synthetic polynucleotide

SEQ ID NO: 138 - DNA, 172 bp, Artificial Sequence
  Synthetic polynucleotide
atcatctcaccttgcctcctgcatcacactcattcgagcctgcaggactaattaacagaactaattaactcgactaattaacgacactaattaacctaactaattaacactactaattaactgcactaattaacgtaactaattaacggcgcgccatgcttcatcagactct

SEQ ID NO: 139 - DNA, 172 bp, Artificial Sequence; identical to SEQ ID NO: 138
  Synthetic polynucleotide

SEQ ID NO: 140 - DNA, 188 bp, Artificial Sequence
  Synthetic polynucleotide
atcatctcaccttgcctcctggggtcatttccatacatcctgcaggcagtttcattttagacagtttcatttttcgcagtttcattttgaccagtttcattttctacagtttcattttactcagtttcatttttgccagtttcattttgtacagtttcattttggcgcgccatgcttcatcagactct

SEQ ID NO: 141 - DNA, 188 bp, Artificial Sequence; identical to SEQ ID NO: 140
  Synthetic polynucleotide

SEQ ID NO: 142 - DNA, 197 bp, Artificial Sequence
  Synthetic polynucleotide
atcatctcaccttgcctcctgagcggacttggacctaccctgcaggattggtgcgtgacggagaattggtgcgtgacggtcgattggtgcgtgacgggacattggtgcgtgacggctaattggtgcgtgacggactattggtgcgtgacggtgcattggtgcgtgacgggtaggcgcgccatgcttcatcagactct

SEQ ID NO: 143 - DNA, 197 bp, Artificial Sequence; identical to SEQ ID NO: 142
  Synthetic polynucleotide

SEQ ID NO: 144 - DNA, 197 bp, Artificial Sequence
  Synthetic polynucleotide
atcatctcaccttgcctcctgagactacttaaggaaggcctgcaggccggcaggtgtccgcagaccggcaggtgtccgctcgccggcaggtgtccgcgacccggcaggtgtccgcctaccggcaggtgtccgcactccggcaggtgtccgctgcccggcaggtgtccgcgtaggcgcgccatgcttcatcagactct

SEQ ID NO: 145 - DNA, 197 bp, Artificial Sequence; identical to SEQ ID NO: 144
  Synthetic polynucleotide

SEQ ID NO: 146 - DNA, 185 bp, Artificial Sequence
  Synthetic polynucleotide
atcatctcaccttgcctcctgtgtgggttatgaactgccctgcagggtcattcgtaatgagcagagtcattcgtaatgagctcggtcattcgtaatgagcgacgtcattcgtaatgagcctagtcattcgtaatgagcactgtcattcgtaatgagctgcggcgcgccatgcttcatcagactct

SEQ ID NO: 147 - DNA, 185 bp, Artificial Sequence; identical to SEQ ID NO: 146
  Synthetic polynucleotide

SEQ ID NO: 148 - DNA, 156 bp, Artificial Sequence
  Synthetic polynucleotide
atcatctcaccttgcctcctggtataatcgcagagcctcctgcaggaaacgtagagaaaacgtagtcgaaacgtaggacaaacgtagctaaaacgtagactaaacgtagtgcaaacgtaggtaaaacgtagggcgcgccatgcttcatcagactct

SEQ ID NO: 149 - DNA, 156 bp, Artificial Sequence; identical to SEQ ID NO: 148
  Synthetic polynucleotide

SEQ ID NO: 150 - DNA, 196 bp, Artificial Sequence
  Synthetic polynucleotide
atcatctcaccttgcctcctgatgacatctcttagtggcctgcaggttttatacatgttagattttatacatgtttcgttttatacatgttgacttttatacatgttctattttatacatgttactttttatacatgtttgcttttatacatgttgtattttatacatgttggcgcgccatgcttcatcagactct

SEQ ID NO: 151 - DNA, 196 bp, Artificial Sequence; identical to SEQ ID NO: 150
  Synthetic polynucleotide

SEQ ID NO: 152 - DNA, 197 bp, Artificial Sequence
  Synthetic polynucleotide
atcatctcaccttgcctcctgatcctatttatggcccacctgcaggttaggacataatgttcccagattaggacataatgttccctcgttaggacataatgttcccgacttaggacataatgttcccctattaggacataatgttcccactttaggacataatgttccctgcggcgcgccatgcttcatcagactct

SEQ ID NO: 153 - DNA, 197 bp, Artificial Sequence; identical to SEQ ID NO: 152
  Synthetic polynucleotide

SEQ ID NO: 154 - DNA, 190 bp, Artificial Sequence
  Synthetic polynucleotide
atcatctcaccttgcctcctgtgataagccttggcaaccctgcaggaaatgggcgtggccagaaaatgggcgtggcctcgaaatgggcgtggccgacaaatgggcgtggccctaaaatgggcgtggccactaaatgggcgtggcctgcaaatgggcgtggccgtaggcgcgccatgcttcatcagactct

SEQ ID NO: 155 - DNA, 190 bp, Artificial Sequence; identical to SEQ ID NO: 154
  Synthetic polynucleotide

SEQ ID NO: 156 - DNA, 197 bp, Artificial Sequence
  Synthetic polynucleotide
atcatctcaccttgcctcctgaacgactggtcatggcacctgcaggaatcaatagattggaagaaatcaatagattggatcgaatcaatagattggagacaatcaatagattggactaaatcaatagattggaactaatcaatagattggatgcaatcaatagattggagtaggcgcgccatgcttcatcagactct

SEQ ID NO: 157 - DNA, 197 bp, Artificial Sequence; identical to SEQ ID NO: 156
  Synthetic polynucleotide

SEQ ID NO: 158 - DNA, 172 bp, Artificial Sequence
  Synthetic polynucleotide
atcatctcaccttgcctcctgagagtcgggtttcaacacctgcaggactaattaagagaactaattaagtcgactaattaaggacactaattaagctaactaattaagactactaattaagtgcactaattaaggtaactaattaagggcgcgccatgcttcatcagactct

SEQ ID NO: 159 - DNA, 172 bp, Artificial Sequence; identical to SEQ ID NO: 158
  Synthetic polynucleotide

SEQ ID NO: 160 - DNA, 180 bp, Artificial Sequence
  Synthetic polynucleotide
atcatctcaccttgcctcctgaaatatcatatccgaggcctgcaggtaatctaattaagataatctaattatcgtaatctaattagactaatctaattactataatctaattaacttaatctaattatgctaatctaattagtataatctaattaggcgcgccatgcttcatcagactct

SEQ ID NO: 161 - DNA, 180 bp, Artificial Sequence; identical to SEQ ID NO: 160
  Synthetic polynucleotide

SEQ ID NO: 162 - DNA, 185 bp, Artificial Sequence
  Synthetic polynucleotide
atcatctcaccttgcctcctggaggtagtcttcggctacctgcaggctgagctaattaccgtagactgagctaattaccgttcgctgagctaattaccgtgacctgagctaattaccgtctactgagctaattaccgtactctgagctaattaccgttgcggcgcgccatgcttcatcagactct

SEQ ID NO: 163 - DNA, 185 bp, Artificial Sequence; identical to SEQ ID NO: 162
  Synthetic polynucleotide

SEQ ID NO: 164 - DNA, 197 bp, Artificial Sequence
  Synthetic polynucleotide
atcatctcaccttgcctcctgcgtgtgtggaataagctcctgcaggatgccacgcccctttttgagaatgccacgcccctttttgtcgatgccacgcccctttttggacatgccacgcccctttttgctaatgccacgcccctttttgactatgccacgcccctttttgtgcggcgcgccatgcttcatcagactct

SEQ ID NO: 165 - DNA, 197 bp, Artificial Sequence; identical to SEQ ID NO: 164
  Synthetic polynucleotide

SEQ ID NO: 166 - DNA, 164 bp, Artificial Sequence
  Synthetic polynucleotide
atcatctcaccttgcctcctgattacggtctcttaaaccctgcaggactagagggagaactagagggtcgactagaggggacactagagggctaactagagggactactagagggtgcactagaggggtaactagagggggcgcgccatgcttcatcagactct

SEQ ID NO: 167 - DNA, 164 bp, Artificial Sequence; identical to SEQ ID NO: 166
  Synthetic polynucleotide

SEQ ID NO: 168 - DNA, 197 bp, Artificial Sequence
  Synthetic polynucleotide
atcatctcaccttgcctcctgcgggataatggaccattcctgcagggtgacctacttcctggcaagagtgacctacttcctggcatcggtgacctacttcctggcagacgtgacctacttcctggcactagtgacctacttcctggcaactgtgacctacttcctggcatgcggcgcgccatgcttcatcagactct

SEQ ID NO: 169 - DNA, 197 bp, Artificial Sequence; identical to SEQ ID NO: 168
  Synthetic polynucleotide

SEQ ID NO: 170 - DNA, 185 bp, Artificial Sequence
  Synthetic polynucleotide
atcatctcaccttgcctcctgcagcggcatacacacttcctgcaggtttaaccaattaacctagatttaaccaattaaccttcgtttaaccaattaacctgactttaaccaattaacctctatttaaccaattaacctacttttaaccaattaaccttgcggcgcgccatgcttcatcagactct

SEQ ID NO: 171 - DNA, 185 bp, Artificial Sequence; identical to SEQ ID NO: 170
  Synthetic polynucleotide

SEQ ID NO: 172 - DNA, 172 bp, Artificial Sequence
  Synthetic polynucleotide
atcatctcaccttgcctcctggaagtattatccaacgacctgcaggactaattaaaagaactaattaaatcgactaattaaagacactaattaaactaactaattaaaactactaattaaatgcactaattaaagtaactaattaaaggcgcgccatgcttcatcagactct

SEQ ID NO: 173 - DNA, 172 bp, Artificial Sequence; identical to SEQ ID NO: 172
  Synthetic polynucleotide

SEQ ID NO: 174 - DNA, 140 bp, Artificial Sequence
  Synthetic polynucleotide
atcatctcaccttgcctcctggtaccttaaccatgatacctgcagggtcatgagagtcatgtcggtcatggacgtcatgctagtcatgactgtcatgtgcgtcatggtagtcatgggcgcgccatgcttcatcagactct

SEQ ID NO: 175 - DNA, 140 bp, Artificial Sequence; identical to SEQ ID NO: 174
  Synthetic polynucleotide

SEQ ID NO: 176 - DNA, 200 bp, Artificial Sequence
  Synthetic polynucleotide
atcatctcaccttgcctcctgccacatgaacaggttcgcctgcaggacgaagccattaagccctcagaacgaagccattaagccctctcgacgaagccattaagccctcgacacgaagccattaagccctcctaacgaagccattaagccctcactacgaagccattaagccctcggcgcgccatgcttcatcagactct

SEQ ID NO: 177 - DNA, 200 bp, Artificial Sequence; identical to SEQ ID NO: 176
  Synthetic polynucleotide

SEQ ID NO: 178 - DNA, 180 bp, Artificial Sequence
  Synthetic polynucleotide
atcatctcaccttgcctcctgataaatgcaacttacgccctgcaggagataagataaagaagataagataatcgagataagataagacagataagataactaagataagataaactagataagataatgcagataagataagtaagataagataaggcgcgccatgcttcatcagactct

SEQ ID NO: 179 - DNA, 180 bp, Artificial Sequence; identical to SEQ ID NO: 178
  Synthetic polynucleotide

SEQ ID NO: 180 - DNA, 200 bp, Artificial Sequence
  Synthetic polynucleotide
atcatctcaccttgcctcctgaatgtgtagccgttgctcctgcaggctgaacttttttgacctcaagactgaacttttttgacctcatcgctgaacttttttgacctcagacctgaacttttttgacctcactactgaacttttttgacctcaactctgaacttttttgacctcaggcgcgccatgcttcatcagactct

SEQ ID NO: 181 - DNA, 200 bp, Artificial Sequence; identical to SEQ ID NO: 180
  Synthetic polynucleotide

SEQ ID NO: 182 - DNA, 172 bp, Artificial Sequence
  Synthetic polynucleotide
atcatctcaccttgcctcctgattatcccatcacctcccctgcaggggagcaggtgagaggagcaggtgtcgggagcaggtggacggagcaggtgctaggagcaggtgactggagcaggtgtgcggagcaggtggtaggagcaggtgggcgcgccatgcttcatcagactct

SEQ ID NO: 183 - DNA, 172 bp, Artificial Sequence; identical to SEQ ID NO: 182
  Synthetic polynucleotide

SEQ ID NO: 184 - DNA, 200 bp, Artificial Sequence
  Synthetic polynucleotide
atcatctcaccttgcctcctgttggttccgattgggagcctgcaggtaactaggttagtaggtcaagataactaggttagtaggtcatcgtaactaggttagtaggtcagactaactaggttagtaggtcactataactaggttagtaggtcaacttaactaggttagtaggtcaggcgcgccatgcttcatcagactct

SEQ ID NO: 185 - DNA, 200 bp, Artificial Sequence; identical to SEQ ID NO: 184
  Synthetic polynucleotide

SEQ ID NO: 186 - DNA, 172 bp, Artificial Sequence
  Synthetic polynucleotide
atcatctcaccttgcctcctgtgtgaatcagagatcaacctgcaggaggggtcacgagaaggggtcacgtcgaggggtcacggacaggggtcacgctaaggggtcacgactaggggtcacgtgcaggggtcacggtaaggggtcacgggcgcgccatgcttcatcagactct

SEQ ID NO: 187 - DNA, 172 bp, Artificial Sequence; identical to SEQ ID NO: 186
  Synthetic polynucleotide

SEQ ID NO: 188 - DNA, 188 bp, Artificial Sequence
  Synthetic polynucleotide
atcatctcaccttgcctcctgtgatcacgctgagcgatcctgcaggtgccctagggcaagatgccctagggcatcgtgccctagggcagactgccctagggcactatgccctagggcaacttgccctagggcatgctgccctagggcagtatgccctagggcaggcgcgccatgcttcatcagactct

SEQ ID NO: 189 - DNA, 188 bp, Artificial Sequence; identical to SEQ ID NO: 188
  Synthetic polynucleotide

SEQ ID NO: 190 - DNA, 185 bp, Artificial Sequence
  Synthetic polynucleotide
atcatctcaccttgcctcctgcacatatgactgccatgcctgcagggtgaacacctgttaatagagtgaacacctgttaattcggtgaacacctgttaatgacgtgaacacctgttaatctagtgaacacctgttaatactgtgaacacctgttaattgcggcgcgccatgcttcatcagactct

SEQ ID NO: 191 - DNA, 185 bp, Artificial Sequence; identical to SEQ ID NO: 190
  Synthetic polynucleotide

SEQ ID NO: 192 - DNA, 156 bp, Artificial Sequence
  Synthetic polynucleotide
atcatctcaccttgcctcctggccagtgcaatggcgtacctgcaggttaatgacagattaatgactcgttaatgacgacttaatgacctattaatgacactttaatgactgcttaatgacgtattaatgacggcgcgccatgcttcatcagactct

SEQ ID NO: 193 - DNA, 156 bp, Artificial Sequence; identical to SEQ ID NO: 192
  Synthetic polynucleotide

SEQ ID NO: 194 - DNA, 197 bp, Artificial Sequence
  Synthetic polynucleotide
atcatctcaccttgcctcctgttggtaacgattgccgacctgcaggcccaggtcaccgtgacctagacccaggtcaccgtgaccttcgcccaggtcaccgtgacctgaccccaggtcaccgtgacctctacccaggtcaccgtgacctactcccaggtcaccgtgaccttgcggcgcgccatgcttcatcagactct

SEQ ID NO: 195 - DNA, 197 bp, Artificial Sequence; identical to SEQ ID NO: 194
  Synthetic polynucleotide

SEQ ID NO: 196 - DNA, 196 bp, Artificial Sequence
  Synthetic polynucleotide
atcatctcaccttgcctcctgaggacgtgctgggtaaccctgcaggggggggggggccaagaggggggggggccatcgggggggggggccagacggggggggggccactaggggggggggccaactggggggggggccatgcggggggggggccagtaggggggggggccaggcgcgccatgcttcatcagactct

SEQ ID NO: 197 - DNA, 196 bp, Artificial Sequence; identical to SEQ ID NO: 196
  Synthetic polynucleotide

SEQ ID NO: 198 - DNA, 191 bp, Artificial Sequence
  Synthetic polynucleotide
atcatctcaccttgcctcctgcgcactctgatgtaaggcctgcaggttcagcaccatggacagcgccagattcagcaccatggacagcgcctcgttcagcaccatggacagcgccgacttcagcaccatggacagcgccctattcagcaccatggacagcgccactggcgcgccatgcttcatcagactct

SEQ ID NO: 199 - DNA, 191 bp, Artificial Sequence; identical to SEQ ID NO: 198
  Synthetic polynucleotide

SEQ ID NO: 200 - DNA, 180 bp, Artificial Sequence
  Synthetic polynucleotide
atcatctcaccttgcctcctgggcctaaatcttctttccctgcagggggcactacttagagggcactactttcggggcactacttgacgggcactacttctagggcactacttactgggcactactttgcgggcactacttgtagggcactacttggcgcgccatgcttcatcagactct

SEQ ID NO: 201 - DNA, 180 bp, Artificial Sequence; identical to SEQ ID NO: 200
  Synthetic polynucleotide

SEQ ID NO: 202 - DNA, 197 bp, Artificial Sequence
  Synthetic polynucleotide
atcatctcaccttgcctcctgccttgagcggctttctacctgcaggaatttgattgatgtgagaaatttgattgatgtgtcgaatttgattgatgtggacaatttgattgatgtgctaaatttgattgatgtgactaatttgattgatgtgtgcaatttgattgatgtggtaggcgcgccatgcttcatcagactct

SEQ ID NO: 203 - DNA, 197 bp, Artificial Sequence; identical to SEQ ID NO: 202
  Synthetic polynucleotide

SEQ ID NO: 204 - DNA, 172 bp, Artificial Sequence
  Synthetic polynucleotide
atcatctcaccttgcctcctggcacagtgccaatcttccctgcaggaaattttcctagaaaattttccttcgaaattttcctgacaaattttcctctaaaattttcctactaaattttccttgcaaattttcctgtaaaattttcctggcgcgccatgcttcatcagactct

SEQ ID NO: 205 - DNA, 172 bp, Artificial Sequence; identical to SEQ ID NO: 204
  Synthetic polynucleotide

SEQ ID NO: 206 - DNA, 148 bp, Artificial Sequence
  Synthetic polynucleotide
atcatctcaccttgcctcctggttcaactgttctgtaacctgcaggtgaccttagatgacctttcgtgaccttgactgaccttctatgaccttacttgacctttgctgaccttgtatgaccttggcgcgccatgcttcatcagactct

SEQ ID NO: 207 - DNA, 148 bp, Artificial Sequence; identical to SEQ ID NO: 206
  Synthetic polynucleotide

SEQ ID NO: 208 - DNA, 172 bp, Artificial Sequence
  Synthetic polynucleotide
atcatctcaccttgcctcctgatcgacaagagggcgagcctgcaggcagtcaagcgagacagtcaagcgtcgcagtcaagcggaccagtcaagcgctacagtcaagcgactcagtcaagcgtgccagtcaagcggtacagtcaagcgggcgcgccatgcttcatcagactct

SEQ ID NO: 209 - DNA, 172 bp, Artificial Sequence; identical to SEQ ID NO: 208
  Synthetic polynucleotide

SEQ ID NO: 210 - DNA, 185 bp, Artificial Sequence
  Synthetic polynucleotide
atcatctcaccttgcctcctgggataagtgtttaccggcctgcaggggtacaatctgttctgagaggtacaatctgttctgtcgggtacaatctgttctggacggtacaatctgttctgctaggtacaatctgttctgactggtacaatctgttctgtgcggcgcgccatgcttcatcagactct

SEQ ID NO: 211 - DNA, 185 bp, Artificial Sequence; identical to SEQ ID NO: 210
  Synthetic polynucleotide

SEQ ID NO: 212 - DNA, 180 bp, Artificial Sequence
  Synthetic polynucleotide
atcatctcaccttgcctcctgggaatcaacgccttcatcctgcaggacaggaagtggagaacaggaagtggtcgacaggaagtgggacacaggaagtggctaacaggaagtggactacaggaagtggtgcacaggaagtgggtaacaggaagtggggcgcgccatgcttcatcagactct

SEQ ID NO: 213 - DNA, 180 bp, Artificial Sequence; identical to SEQ ID NO: 212
  Synthetic polynucleotide

SEQ ID NO: 214 - DNA, 164 bp, Artificial Sequence
  Synthetic polynucleotide
atcatctcaccttgcctcctgatgttgcccactgcatgcctgcaggccaatcagcagaccaatcagctcgccaatcagcgacccaatcagcctaccaatcagcactccaatcagctgcccaatcagcgtaccaatcagcggcgcgccatgcttcatcagactct

SEQ ID NO: 215 - DNA, 164 bp, Artificial Sequence; identical to SEQ ID NO: 214
  Synthetic polynucleotide

SEQ ID NO: 216 - DNA, 172 bp, Artificial Sequence
  Synthetic polynucleotide
atcatctcaccttgcctcctgacaatacgtgaacgagccctgcaggaagaggaagtagaaagaggaagttcgaagaggaagtgacaagaggaagtctaaagaggaagtactaagaggaagttgcaagaggaagtgtaaagaggaagtggcgcgccatgcttcatcagactct

SEQ ID NO: 217 - DNA, 172 bp, Artificial Sequence; identical to SEQ ID NO: 216
  Synthetic polynucleotide

SEQ ID NO: 218 - DNA, 190 bp, Artificial Sequence
  Synthetic polynucleotide
atcatctcaccttgcctcctggtattcgatgacgcttgcctgcaggggggtgacgtcatcagaggggtgacgtcatctcgggggtgacgtcatcgacggggtgacgtcatcctaggggtgacgtcatcactggggtgacgtcatctgcggggtgacgtcatcgtaggcgcgccatgcttcatcagactct

SEQ ID NO: 219 - DNA, 190 bp, Artificial Sequence; identical to SEQ ID NO: 218
  Synthetic polynucleotide

SEQ ID NO: 220 - DNA, 197 bp, Artificial Sequence
  Synthetic polynucleotide
atcatctcaccttgcctcctgccttcctggtcatggaccctgcaggcatttcccggaaaccagacatttcccggaaacctcgcatttcccggaaaccgaccatttcccggaaaccctacatttcccggaaaccactcatttcccggaaacctgccatttcccggaaaccgtaggcgcgccatgcttcatcagactct

SEQ ID NO: 221 - DNA, 197 bp, Artificial Sequence; identical to SEQ ID NO: 220
  Synthetic polynucleotide

SEQ ID NO: 222 - DNA, 185 bp, Artificial Sequence
  Synthetic polynucleotide
atcatctcaccttgcctcctggaccgtctatatctgggcctgcaggtataattataatattcagatataattataatattctcgtataattataatattcgactataattataatattcctatataattataatattcacttataattataatattctgcggcgcgccatgcttcatcagactct

SEQ ID NO: 223 - DNA, 185 bp, Artificial Sequence; identical to SEQ ID NO: 222
  Synthetic polynucleotide

SEQ ID NO: 224 - DNA, 191 bp, Artificial Sequence
  Synthetic polynucleotide
atcatctcaccttgcctcctgagatcctgggtaagaaccctgcaggttttcctttgatctataagattttcctttgatctatatcgttttcctttgatctatagacttttcctttgatctatactattttcctttgatctataactttttcctttgatctatatgcggcgcgccatgcttcatcagactct

SEQ ID NO: 225 - DNA, 191 bp, Artificial Sequence; identical to SEQ ID NO: 224
  Synthetic polynucleotide

SEQ ID NO: 226 - DNA, 172 bp, Artificial Sequence
  Synthetic polynucleotide
atcatctcaccttgcctcctgttggcgtacctaagcgtcctgcaggtttttattacagatttttattactcgtttttattacgactttttattacctatttttattacacttttttattactgctttttattacgtatttttattacggcgcgccatgcttcatcagactct

SEQ ID NO: 227 - DNA, 172 bp, Artificial Sequence; identical to SEQ ID NO: 226
  Synthetic polynucleotide

SEQ ID NO: 228 - DNA, 190 bp, Artificial Sequence
  Synthetic polynucleotide
atcatctcaccttgcctcctgggaatacctttgttaaccctgcagggcccctcccccaccagagcccctcccccacctcggcccctcccccaccgacgcccctcccccaccctagcccctcccccaccactgcccctcccccacctgcgcccctcccccaccgtaggcgcgccatgcttcatcagactct

SEQ ID NO: 229 - DNA, 190 bp, Artificial Sequence; identical to SEQ ID NO: 228
  Synthetic polynucleotide

SEQ ID NO: 230 - DNA, 185 bp, Artificial Sequence
  Synthetic polynucleotide
atcatctcaccttgcctcctgagaatgccatccacccgcctgcaggtgaacccttgacccctagatgaacccttgaccccttcgtgaacccttgacccctgactgaacccttgacccctctatgaacccttgacccctacttgaacccttgaccccttgcggcgcgccatgcttcatcagactct

SEQ ID NO: 231 - DNA, 185 bp, Artificial Sequence; identical to SEQ ID NO: 230
  Synthetic polynucleotide

SEQ ID NO: 232 - DNA, 148 bp, Artificial Sequence
  Synthetic polynucleotide
atcatctcaccttgcctcctgcgagcataatctccgatcctgcaggggtatcaagaggtatcatcgggtatcagacggtatcactaggtatcaactggtatcatgcggtatcagtaggtatcaggcgcgccatgcttcatcagactct

SEQ ID NO: 233 - DNA, 148 bp, Artificial Sequence; identical to SEQ ID NO: 232
  Synthetic polynucleotide

SEQ ID NO: 234 - DNA, 197 bp, Artificial Sequence
  Synthetic polynucleotide
atcatctcaccttgcctcctgtaagctgcgtcattgaacctgcagggtttgttttgccagaagagtttgttttgccagatcggtttgttttgccagagacgtttgttttgccagactagtttgttttgccagaactgtttgttttgccagatgcgtttgttttgccagagtaggcgcgccatgcttcatcagactct

SEQ ID NO: 235 - DNA, 197 bp, Artificial Sequence; identical to SEQ ID NO: 234
  Synthetic polynucleotide

SEQ ID NO: 236 - DNA, 164 bp, Artificial Sequence
  Synthetic polynucleotide
atcatctcaccttgcctcctgagaatcctcctaaataccctgcaggtgcacctggagatgcacctggtcgtgcacctgggactgcacctggctatgcacctggacttgcacctggtgctgcacctgggtatgcacctggggcgcgccatgcttcatcagactct

SEQ ID NO: 237 - DNA, 164 bp, Artificial Sequence; identical to SEQ ID NO: 236
  Synthetic polynucleotide

SEQ ID NO: 238 - DNA, 191 bp, Artificial Sequence
  Synthetic polynucleotide
atcatctcaccttgcctcctggtacgtcaacgctacgtcctgcagggaacaataccattgttcagagaacaataccattgttctcggaacaataccattgttcgacgaacaataccattgttcctagaacaataccattgttcactgaacaataccattgttctgcggcgcgccatgcttcatcagactct

SEQ ID NO: 239 - DNA, 191 bp, Artificial Sequence; identical to SEQ ID NO: 238
  Synthetic polynucleotide

SEQ ID NO: 240 - DNA, 185 bp, Artificial Sequence
  Synthetic polynucleotide
atcatctcaccttgcctcctgggcttgccgcctgtatacctgcagggcccgtttcgcgccaaagagcccgtttcgcgccaatcggcccgtttcgcgccaagacgcccgtttcgcgccaactagcccgtttcgcgccaaactgcccgtttcgcgccaatgcggcgcgccatgcttcatcagactct

SEQ ID NO: 241 - DNA, 185 bp, Artificial Sequence; identical to SEQ ID NO: 240
  Synthetic polynucleotide

SEQ ID NO: 242 - DNA, 140 bp, Artificial Sequence
  Synthetic polynucleotide
atcatctcaccttgcctcctggcagatcactgaggttccctgcaggtccccaagatccccatcgtccccagactccccactatccccaacttccccatgctccccagtatccccaggcgcgccatgcttcatcagactct

SEQ ID NO: 243 - DNA, 140 bp, Artificial Sequence; identical to SEQ ID NO: 242
  Synthetic polynucleotide

SEQ ID NO: 244 - DNA, 172 bp, Artificial Sequence
  Synthetic polynucleotide
atcatctcaccttgcctcctgaatagacgcctattgagcctgcaggccttatctgtagaccttatctgttcgccttatctgtgacccttatctgtctaccttatctgtactccttatctgttgcccttatctgtgtaccttatctgtggcgcgccatgcttcatcagactct

SEQ ID NO: 245 - DNA, 172 bp, Artificial Sequence; identical to SEQ ID NO: 244
  Synthetic polynucleotide

SEQ ID NO: 246 - DNA, 156 bp, Artificial Sequence
  Synthetic polynucleotide
atcatctcaccttgcctcctgcttcttactttctaggtcctgcaggctaggtcaagactaggtcatcgctaggtcagacctaggtcactactaggtcaactctaggtcatgcctaggtcagtactaggtcaggcgcgccatgcttcatcagactct

SEQ ID NO: 247 - DNA, 156 bp, Artificial Sequence; identical to SEQ ID NO: 246
  Synthetic polynucleotide

SEQ ID NO: 248 - DNA, 191 bp, Artificial Sequence
  Synthetic polynucleotide
atcatctcaccttgcctcctgacagtccgtactgtcgccctgcaggcgcgttaattaattaccagacgcgttaattaattacctcgcgcgttaattaattaccgaccgcgttaattaattaccctacgcgttaattaattaccactcgcgttaattaattacctgcggcgcgccatgcttcatcagactct

SEQ ID NO: 249 - DNA, 191 bp, Artificial Sequence; identical to SEQ ID NO: 248
  Synthetic polynucleotide

SEQ ID NO: 250 - DNA, 156 bp, Artificial Sequence
  Synthetic polynucleotide
atcatctcaccttgcctcctgacaacttcctggccagtcctgcaggtccccactagatccccacttcgtccccactgactccccactctatccccactacttccccacttgctccccactgtatccccactggcgcgccatgcttcatcagactct

SEQ ID NO: 251 - DNA, 156 bp, Artificial Sequence; identical to SEQ ID NO: 250
  Synthetic polynucleotide

SEQ ID NO: 252 - DNA, 190 bp, Artificial Sequence
  Synthetic polynucleotide
atcatctcaccttgcctcctggatgcagtcatacatggcctgcaggtacttccgctttttagatacttccgcttttttcgtacttccgctttttgactacttccgctttttctatacttccgctttttacttacttccgcttttttgctacttccgctttttgtaggcgcgccatgcttcatcagactct

SEQ ID NO: 253 - DNA, 190 bp, Artificial Sequence; identical to SEQ ID NO: 252
  Synthetic polynucleotide

SEQ ID NO: 254 - DNA, 172 bp, Artificial Sequence
  Synthetic polynucleotide
atcatctcaccttgcctcctgtaggcacccgttatgtccctgcaggccttatctgcagaccttatctgctcgccttatctgcgacccttatctgcctaccttatctgcactccttatctgctgcccttatctgcgtaccttatctgcggcgcgccatgcttcatcagactct

SEQ ID NO: 255 - DNA, 172 bp, Artificial Sequence; identical to SEQ ID NO: 254
  Synthetic polynucleotide

SEQ ID NO: 256 - DNA, 172 bp, Artificial Sequence
  Synthetic polynucleotide
atcatctcaccttgcctcctgggttcgagagaacagtccctgcaggacacgtcatcagaacacgtcatctcgacacgtcatcgacacacgtcatcctaacacgtcatcactacacgtcatctgcacacgtcatcgtaacacgtcatcggcgcgccatgcttcatcagactct

SEQ ID NO: 257 - DNA, 172 bp, Artificial Sequence; identical to SEQ ID NO: 256
  Synthetic polynucleotide

SEQ ID NO: 258 - DNA, 164 bp, Artificial Sequence
  Synthetic polynucleotide
atcatctcaccttgcctcctgacctctacctagggaaccctgcagggtaatcagcagagtaatcagctcggtaatcagcgacgtaatcagcctagtaatcagcactgtaatcagctgcgtaatcagcgtagtaatcagcggcgcgccatgcttcatcagactct

SEQ ID NO: 259 - DNA, 164 bp, Artificial Sequence; identical to SEQ ID NO: 258
  Synthetic polynucleotide

SEQ ID NO: 260 - DNA, 172 bp, Artificial Sequence
  Synthetic polynucleotide
atcatctcaccttgcctcctgtcatacttacaagagcgcctgcaggaagcaattagagaaagcaattagtcgaagcaattaggacaagcaattagctaaagcaattagactaagcaattagtgcaagcaattaggtaaagcaattagggcgcgccatgcttcatcagactct

SEQ ID NO: 261 - DNA, 172 bp, Artificial Sequence; identical to SEQ ID NO: 260
  Synthetic polynucleotide

SEQ ID NO: 262 - DNA, 148 bp, Artificial Sequence
  Synthetic polynucleotide
atcatctcaccttgcctcctgggctccctttcgcaactcctgcaggattgtttagaattgttttcgattgtttgacattgtttctaattgtttactattgttttgcattgtttgtaattgtttggcgcgccatgcttcatcagactct

SEQ ID NO: 263 - DNA, 148 bp, Artificial Sequence; identical to SEQ ID NO: 262
  Synthetic polynucleotide

SEQ ID NO: 264 - DNA, 196 bp, Artificial Sequence
  Synthetic polynucleotide
atcatctcaccttgcctcctgtcgcgatcgcgaaacgtcctgcaggttggggcgcagctgcgcccctcagattggggcgcagctgcgcccctctcgttggggcgcagctgcgcccctcgacttggggcgcagctgcgcccctcctattggggcgcagctgcgcccctcactggcgcgccatgcttcatcagactct

SEQ ID NO: 265 - DNA, 196 bp, Artificial Sequence; identical to SEQ ID NO: 264
  Synthetic polynucleotide

SEQ ID NO: 266 - DNA, 172 bp, Artificial Sequence
  Synthetic polynucleotide
atcatctcaccttgcctcctggttgatactgctacgctcctgcaggtgaggtgttaagatgaggtgttatcgtgaggtgttagactgaggtgttactatgaggtgttaacttgaggtgttatgctgaggtgttagtatgaggtgttaggcgcgccatgcttcatcagactct

SEQ ID NO: 267 - DNA, 172 bp, Artificial Sequence; identical to SEQ ID NO: 266
  Synthetic polynucleotide

SEQ ID NO: 268 - DNA, 180 bp, Artificial Sequence
  Synthetic polynucleotide
atcatctcaccttgcctcctgataactggatgtctgcccctgcaggcctttgatcttagacctttgatctttcgcctttgatcttgaccctttgatcttctacctttgatcttactcctttgatctttgccctttgatcttgtacctttgatcttggcgcgccatgcttcatcagactct

SEQ ID NO: 269 - DNA, 180 bp, Artificial Sequence; identical to SEQ ID NO: 268
  Synthetic polynucleotide

SEQ ID NO: 270 - DNA, 172 bp, Artificial Sequence
  Synthetic polynucleotide
atcatctcaccttgcctcctgcgaagaatgtaatgacgcctgcaggttaacaatacagattaacaatactcgttaacaatacgacttaacaatacctattaacaatacactttaacaatactgcttaacaatacgtattaacaatacggcgcgccatgcttcatcagactct

SEQ ID NO: 271 - DNA, 172 bp, Artificial Sequence; identical to SEQ ID NO: 270
  Synthetic polynucleotide

SEQ ID NO: 272 - DNA, 185 bp, Artificial Sequence
  Synthetic polynucleotide
atcatctcaccttgcctcctgtgtaggcgggatgcttgcctgcaggtgacctttaaaggtcaagatgacctttaaaggtcatcgtgacctttaaaggtcagactgacctttaaaggtcactatgacctttaaaggtcaacttgacctttaaaggtcatgcggcgcgccatgcttcatcagactct

SEQ ID NO: 273 - DNA, 185 bp, Artificial Sequence; identical to SEQ ID NO: 272
  Synthetic polynucleotide

SEQ ID NO: 274 - DNA, 180 bp, Artificial Sequence
  Synthetic polynucleotide
atcatctcaccttgcctcctgctacgctggtcgatactcctgcagggtggggtgatcagagtggggtgatctcggtggggtgatcgacgtggggtgatcctagtggggtgatcactgtggggtgatctgcgtggggtgatcgtagtggggtgatcggcgcgccatgcttcatcagactct

SEQ ID NO: 275 - DNA, 180 bp, Artificial Sequence; identical to SEQ ID NO: 274
  Synthetic polynucleotide

SEQ ID NO: 276 - DNA, 197 bp, Artificial Sequence
  Synthetic polynucleotide
atcatctcaccttgcctcctgtgggtaccaggcattggcctgcaggtctggcaaaacaaacagatctggcaaaacaaactcgtctggcaaaacaaacgactctggcaaaacaaacctatctggcaaaacaaacacttctggcaaaacaaactgctctggcaaaacaaacgtaggcgcgccatgcttcatcagactct

SEQ ID NO: 277 - DNA, 197 bp, Artificial Sequence; identical to SEQ ID NO: 276
  Synthetic polynucleotide

SEQ ID NO: 278 - DNA, 180 bp, Artificial Sequence
  Synthetic polynucleotide
atcatctcaccttgcctcctgggtatgcttccacatcccctgcagggcccacgtgacagagcccacgtgactcggcccacgtgacgacgcccacgtgacctagcccacgtgacactgcccacgtgactgcgcccacgtgacgtagcccacgtgacggcgcgccatgcttcatcagactct

SEQ ID NO: 279 - DNA, 180 bp, Artificial Sequence; identical to SEQ ID NO: 278
  Synthetic polynucleotide

SEQ ID NO: 280 - DNA, 164 bp, Artificial Sequence
  Synthetic polynucleotide
atcatctcaccttgcctcctgcttgcggatgatagtcacctgcaggcgtgcgcaaagacgtgcgcaatcgcgtgcgcaagaccgtgcgcaactacgtgcgcaaactcgtgcgcaatgccgtgcgcaagtacgtgcgcaaggcgcgccatgcttcatcagactct

SEQ ID NO: 281 - DNA, 164 bp, Artificial Sequence; identical to SEQ ID NO: 280
  Synthetic polynucleotide

SEQ ID NO: 282 - DNA, 164 bp, Artificial Sequence
  Synthetic polynucleotide
atcatctcaccttgcctcctggactcaccactaattatcctgcaggttttacgacagattttacgactcgttttacgacgacttttacgacctattttacgacactttttacgactgcttttacgacgtattttacgacggcgcgccatgcttcatcagactct

SEQ ID NO: 283 - DNA, 164 bp, Artificial Sequence; identical to SEQ ID NO: 282
  Synthetic polynucleotide

SEQ ID NO: 284 - DNA, 188 bp, Artificial Sequence
  Synthetic polynucleotide
atcatctcaccttgcctcctggtatagtttggaggtaccctgcaggggaaatgggcccagaggaaatgggccctcgggaaatgggcccgacggaaatgggcccctaggaaatgggcccactggaaatgggccctgcggaaatgggcccgtaggaaatgggcccggcgcgccatgcttcatcagactct

SEQ ID NO: 285 - DNA, 188 bp, Artificial Sequence; identical to SEQ ID NO: 284
  Synthetic polynucleotide

SEQ ID NO: 286 - DNA, 172 bp, Artificial Sequence
  Synthetic polynucleotide
atcatctcaccttgcctcctgaacctctaagtgggtaacctgcaggggccacgtgaagaggccacgtgatcgggccacgtgagacggccacgtgactaggccacgtgaactggccacgtgatgcggccacgtgagtaggccacgtgaggcgcgccatgcttcatcagactct

SEQ ID NO: 287 - DNA, 172 bp, Artificial Sequence; identical to SEQ ID NO: 286
  Synthetic polynucleotide

SEQ ID NO: 288 - DNA, 197 bp, Artificial Sequence
  Synthetic polynucleotide
atcatctcaccttgcctcctgtaggacatcgatcttaccctgcagggcacagcggggggtcagagcacagcggggggtctcggcacagcggggggtcgacgcacagcggggggtcctagcacagcggggggtcactgcacagcggggggtctgcgcacagcggggggtcgtaggcgcgccatgcttcatcagactct

SEQ ID NO: 289 - DNA, 197 bp, Artificial Sequence; identical to SEQ ID NO: 288
  Synthetic polynucleotide

SEQ ID NO: 290 - DNA, 190 bp, Artificial Sequence
  Synthetic polynucleotide
atcatctcaccttgcctcctgcggcatttatttacctacctgcaggcggctactgtttttagacggctactgttttttcgcggctactgtttttgaccggctactgtttttctacggctactgtttttactcggctactgttttttgccggctactgtttttgtaggcgcgccatgcttcatcagactct

SEQ ID NO: 291 - DNA, 190 bp, Artificial Sequence; identical to SEQ ID NO: 290
  Synthetic polynucleotide

SEQ ID NO: 292 - DNA, 197 bp, Artificial Sequence
  Synthetic polynucleotide
atcatctcaccttgcctcctgctgctttactgcaactacctgcaggcaaaaagagcaaccaagacaaaaagagcaaccatcgcaaaaagagcaaccagaccaaaaagagcaaccactacaaaaagagcaaccaactcaaaaagagcaaccatgccaaaaagagcaaccagtaggcgcgccatgcttcatcagactct

SEQ ID NO: 293 - DNA, 197 bp, Artificial Sequence; identical to SEQ ID NO: 292
  Synthetic polynucleotide

SEQ ID NO: 294 - DNA, 197 bp, Artificial Sequence
  Synthetic polynucleotide
atcatctcaccttgcctcctgttagtgcagtctcgctccctgcaggaaaggtcaagagaggtcaagaaaaggtcaagagaggtcatcgaaaggtcaagagaggtcagacaaaggtcaagagaggtcactaaaaggtcaagagaggtcaactaaaggtcaagagaggtcatgcggcgcgccatgcttcatcagactct

SEQ ID NO: 295 - DNA, 197 bp, Artificial Sequence; identical to SEQ ID NO: 294
  Synthetic polynucleotide

SEQ ID NO: 296 - DNA, 164 bp, Artificial Sequence
  Synthetic polynucleotide
atcatctcaccttgcctcctggacccgcatgtcagtgacctgcaggtcaattaagagatcaattaagtcgtcaattaaggactcaattaagctatcaattaagacttcaattaagtgctcaattaaggtatcaattaagggcgcgccatgcttcatcagactct

SEQ ID NO: 297 - DNA, 164 bp, Artificial Sequence; identical to SEQ ID NO: 296
  Synthetic polynucleotide

SEQ ID NO: 298 - DNA, 172 bp, Artificial Sequence
  Synthetic polynucleotide
atcatctcaccttgcctcctgaagattagggacactagcctgcaggtgggcggggcagatgggcggggctcgtgggcggggcgactgggcggggcctatgggcggggcacttgggcggggctgctgggcggggcgtatgggcggggcggcgcgccatgcttcatcagactct

SEQ ID NO: 299 - DNA, 172 bp, Artificial Sequence; identical to SEQ ID NO: 298
  Synthetic polynucleotide

SEQ ID NO: 300 - DNA, 185 bp, Artificial Sequence
  Synthetic polynucleotide
atcatctcaccttgcctcctgcgtcttagttatcaacacctgcaggcaggtaattacctcagagacaggtaattacctcagtcgcaggtaattacctcaggaccaggtaattacctcagctacaggtaattacctcagactcaggtaattacctcagtgcggcgcgccatgcttcatcagactct

SEQ ID NO: 301 - DNA, 185 bp, Artificial Sequence; identical to SEQ ID NO: 300
  Synthetic polynucleotide

SEQ ID NO: 302 - DNA, 180 bp, Artificial Sequence
  Synthetic polynucleotide
atcatctcaccttgcctcctgtcttggtttcactttgccctgcagggtggggtgataagagtggggtgatatcggtggggtgatagacgtggggtgatactagtggggtgataactgtggggtgatatgcgtggggtgatagtagtggggtgataggcgcgccatgcttcatcagactct

SEQ ID NO: 303 - DNA, 180 bp, Artificial Sequence; identical to SEQ ID NO: 302
  Synthetic polynucleotide

SEQ ID NO: 304 - DNA, 188 bp, Artificial Sequence
  Synthetic polynucleotide
atcatctcaccttgcctcctgccacatgagaatggtttcctgcaggtgacacctgtcaagatgacacctgtcatcgtgacacctgtcagactgacacctgtcactatgacacctgtcaacttgacacctgtcatgctgacacctgtcagtatgacacctgtcaggcgcgccatgcttcatcagactct

SEQ ID NO: 305 - DNA, 188 bp, Artificial Sequence; identical to SEQ ID NO: 304
  Synthetic polynucleotide

SEQ ID NO: 306 - DNA, 197 bp, Artificial Sequence
  Synthetic polynucleotide
atcatctcaccttgcctcctggttcgagctattcatcccctgcaggctgattggtccatttagactgattggtccattttcgctgattggtccatttgacctgattggtccatttctactgattggtccatttactctgattggtccattttgcctgattggtccatttgtaggcgcgccatgcttcatcagactct

SEQ ID NO: 307 - DNA, 197 bp, Artificial Sequence; identical to SEQ ID NO: 306
  Synthetic polynucleotide

SEQ ID NO: 308 - DNA, 197 bp, Artificial Sequence
  Synthetic polynucleotide
atcatctcaccttgcctcctgctatggaattgagactccctgcaggtccaatctattgattagatccaatctattgatttcgtccaatctattgattgactccaatctattgattctatccaatctattgattacttccaatctattgatttgctccaatctattgattgtaggcgcgccatgcttcatcagactct

SEQ ID NO: 309 - DNA, 197 bp, Artificial Sequence; identical to SEQ ID NO: 308
  Synthetic polynucleotide

SEQ ID NO: 310 - DNA, 164 bp, Artificial Sequence
  Synthetic polynucleotide
atcatctcaccttgcctcctgtctcacagacggtagatcctgcaggcaattaaaaagacaattaaaatcgcaattaaaagaccaattaaaactacaattaaaaactcaattaaaatgccaattaaaagtacaattaaaaggcgcgccatgcttcatcagactct

SEQ ID NO: 311 - DNA, 164 bp, Artificial Sequence; identical to SEQ ID NO: 310
  Synthetic polynucleotide

SEQ ID NO: 312 - DNA, 190 bp, Artificial Sequence
  Synthetic polynucleotide
atcatctcaccttgcctcctgcggatatagtcggctatcctgcaggagattcttatctgtagaagattcttatctgttcgagattcttatctgtgacagattcttatctgtctaagattcttatctgtactagattcttatctgttgcagattcttatctgtgtaggcgcgccatgcttcatcagactct

SEQ ID NO: 313 - DNA, 190 bp, Artificial Sequence; identical to SEQ ID NO: 312
  Synthetic polynucleotide

SEQ ID NO: 314 - DNA, 185 bp, Artificial Sequence
  Synthetic polynucleotide
atcatctcaccttgcctcctgcgctacgctagcctttccctgcaggttggggtaattaacgtagattggggtaattaacgttcgttggggtaattaacgtgacttggggtaattaacgtctattggggtaattaacgtactttggggtaattaacgttgcggcgcgccatgcttcatcagactct

SEQ ID NO: 315 - DNA, 185 bp, Artificial Sequence; identical to SEQ ID NO: 314
  Synthetic polynucleotide

SEQ ID NO: 316 - DNA, 197 bp, Artificial Sequence
  Synthetic polynucleotide
atcatctcaccttgcctcctgcatcgtaatggatctcccctgcaggaaatgcgtgggcgtaagaaaatgcgtgggcgtatcgaaatgcgtgggcgtagacaaatgcgtgggcgtactaaaatgcgtgggcgtaactaaatgcgtgggcgtatgcaaatgcgtgggcgtagtaggcgcgccatgcttcatcagactct

SEQ ID NO: 317 - DNA, 197 bp, Artificial Sequence; identical to SEQ ID NO: 316
  Synthetic polynucleotide

SEQ ID NO: 318 - DNA, 188 bp, Artificial Sequence
  Synthetic polynucleotide
atcatctcaccttgcctcctgatcgcccacgacaactacctgcagggtcagcaaatttagagtcagcaaattttcggtcagcaaatttgacgtcagcaaatttctagtcagcaaatttactgtcagcaaattttgcgtcagcaaatttgtagtcagcaaatttggcgcgccatgcttcatcagactct

SEQ ID NO: 319 - DNA, 188 bp, Artificial Sequence; identical to SEQ ID NO: 318
  Synthetic polynucleotide

SEQ ID NO: 320 - DNA, 185 bp, Artificial Sequence
  Synthetic polynucleotide
atcatctcaccttgcctcctgtgatcagctacttgtcacctgcaggtgaccacgtggtcgggagatgaccacgtggtcgggtcgtgaccacgtggtcggggactgaccacgtggtcgggctatgaccacgtggtcgggacttgaccacgtggtcgggtgcggcgcgccatgcttcatcagactct

SEQ ID NO: 321 - DNA, 185 bp, Artificial Sequence; identical to SEQ ID NO: 320
  Synthetic polynucleotide

SEQ ID NO: 322 - DNA, 185 bp, Artificial Sequence
  Synthetic polynucleotide
atcatctcaccttgcctcctgctacccacctcttatgccctgcagggaatattataattataagagaatattataattatatcggaatattataattatagacgaatattataattatactagaatattataattataactgaatattataattatatgcggcgcgccatgcttcatcagactct

SEQ ID NO: 323 - DNA, 185 bp, Artificial Sequence; identical to SEQ ID NO: 322
  Synthetic polynucleotide

SEQ ID NO: 324 - DNA, 140 bp, Artificial Sequence
  Synthetic polynucleotide
atcatctcaccttgcctcctggtcgccatagagatctccctgcaggctatctagactatcttcgctatctgacctatctctactatctactctatcttgcctatctgtactatctggcgcgccatgcttcatcagactct

SEQ ID NO: 325 - DNA, 140 bp, Artificial Sequence; identical to SEQ ID NO: 324
  Synthetic polynucleotide

SEQ ID NO: 326 - DNA, 164 bp, Artificial Sequence
  Synthetic polynucleotide
atcatctcaccttgcctcctgtaccctacaacccacgtcctgcaggcgtgaccccagacgtgacccctcgcgtgaccccgaccgtgaccccctacgtgaccccactcgtgacccctgccgtgaccccgtacgtgaccccggcgcgccatgcttcatcagactct

SEQ ID NO: 327 - DNA, 164 bp, Artificial Sequence; identical to SEQ ID NO: 326
  Synthetic polynucleotide

SEQ ID NO: 328 - DNA, 188 bp, Artificial Sequence
  Synthetic polynucleotide
atcatctcaccttgcctcctgctgcttacatcaacaagcctgcaggaaaaaaacacaaagaaaaaaaacacaatcgaaaaaaacacaagacaaaaaaacacaactaaaaaaaacacaaactaaaaaaacacaatgcaaaaaaacacaagtaaaaaaaacacaaggcgcgccatgcttcatcagactct

SEQ ID NO: 329 - DNA, 188 bp, Artificial Sequence; identical to SEQ ID NO: 328
  Synthetic polynucleotide

SEQ ID NO: 330 - DNA, 185 bp, Artificial Sequence
  Synthetic polynucleotide
atcatctcaccttgcctcctgggcggtcttacatttgacctgcaggatctcgtttcccacagagaatctcgtttcccacagtcgatctcgtttcccacaggacatctcgtttcccacagctaatctcgtttcccacagactatctcgtttcccacagtgcggcgcgccatgcttcatcagactct

SEQ ID NO: 331 - DNA, 185 bp, Artificial Sequence; identical to SEQ ID NO: 330
  Synthetic polynucleotide

SEQ ID NO: 332 - DNA, 148 bp, Artificial Sequence
  Synthetic polynucleotide
atcatctcaccttgcctcctgcatagaatactaagctccctgcaggtctctgcagatctctgctcgtctctgcgactctctgcctatctctgcacttctctgctgctctctgcgtatctctgcggcgcgccatgcttcatcagactct

SEQ ID NO: 333 - DNA, 148 bp, Artificial Sequence; identical to SEQ ID NO: 332
  Synthetic polynucleotide

SEQ ID NO: 334 - DNA, 156 bp, Artificial Sequence
  Synthetic polynucleotide
atcatctcaccttgcctcctggacgtagatttgtttctcctgcaggttttatgaagattttatgatcgttttatgagacttttatgactattttatgaactttttatgatgcttttatgagtattttatgaggcgcgccatgcttcatcagactct

SEQ ID NO: 335 - DNA, 156 bp, Artificial Sequence; identical to SEQ ID NO: 334
  Synthetic polynucleotide

SEQ ID NO: 336 - DNA, 156 bp, Artificial Sequence
  Synthetic polynucleotide
atcatctcaccttgcctcctgctcggaagcatgactgccctgcaggccacttaaagaccacttaatcgccacttaagacccacttaactaccacttaaactccacttaatgcccacttaagtaccacttaaggcgcgccatgcttcatcagactct

SEQ ID NO: 337 - DNA, 156 bp, Artificial Sequence; identical to SEQ ID NO: 336
  Synthetic polynucleotide

SEQ ID NO: 338 - DNA, 197 bp, Artificial Sequence
  Synthetic polynucleotide
atcatctcaccttgcctcctgtgcgtttcacactgccccctgcagggtgacctttgacctacttagagtgacctttgacctactttcggtgacctttgacctacttgacgtgacctttgacctacttctagtgacctttgacctacttactgtgacctttgacctactttgcggcgcgccatgcttcatcagactct

SEQ ID NO: 339 - DNA, 197 bp, Artificial Sequence; identical to SEQ ID NO: 338
  Synthetic polynucleotide

SEQ ID NO: 340 - DNA, 191 bp, Artificial Sequence
  Synthetic polynucleotide
atcatctcaccttgcctcctgatcaccggtctcctaatcctgcaggacatgtctatgacatgtagaacatgtctatgacatgttcgacatgtctatgacatgtgacacatgtctatgacatgtctaacatgtctatgacatgtactacatgtctatgacatgttgcggcgcgccatgcttcatcagactct

SEQ ID NO: 341 - DNA, 191 bp, Artificial Sequence; identical to SEQ ID NO: 340
  Synthetic polynucleotide

SEQ ID NO: 342 - DNA, 164 bp, Artificial Sequence
  Synthetic polynucleotide
atcatctcaccttgcctcctggcttgtacataatgactcctgcaggagagaaaccagaagagaaacctcgagagaaaccgacagagaaaccctaagagaaaccactagagaaacctgcagagaaaccgtaagagaaaccggcgcgccatgcttcatcagactct

SEQ ID NO: 343 - DNA, 164 bp, Artificial Sequence; identical to SEQ ID NO: 342
  Synthetic polynucleotide

SEQ ID NO: 344 - DNA, 191 bp, Artificial Sequence
  Synthetic polynucleotide
atcatctcaccttgcctcctgtttgtggattgttcgtgcctgcaggaaacaattgcattgtttagaaaacaattgcattgttttcgaaacaattgcattgtttgacaaacaattgcattgtttctaaaacaattgcattgtttactaaacaattgcattgttttgcggcgcgccatgcttcatcagactct

SEQ ID NO: 345 - DNA, 191 bp, Artificial Sequence; identical to SEQ ID NO: 344
  Synthetic polynucleotide

SEQ ID NO: 346 - DNA, 197 bp, Artificial Sequence
  Synthetic polynucleotide
atcatctcaccttgcctcctgttgtggtatgctggttgcctgcaggggtcacgtggcccggagaggtcacgtggcccggtcgggtcacgtggcccgggacggtcacgtggcccggctaggtcacgtggcccggactggtcacgtggcccggtgcggtcacgtggcccgggtaggcgcgccatgcttcatcagactct

SEQ ID NO: 347 - DNA, 197 bp, Artificial Sequence; identical to SEQ ID NO: 346
  Synthetic polynucleotide

SEQ ID NO: 348 - DNA, 197 bp, Artificial Sequence
  Synthetic polynucleotide
atcatctcaccttgcctcctgcggctggtaaagaatgccctgcagggaggtcaaaaggtcaatgagagaggtcaaaaggtcaatgtcggaggtcaaaaggtcaatggacgaggtcaaaaggtcaatgctagaggtcaaaaggtcaatgactgaggtcaaaaggtcaatgtgcggcgcgccatgcttcatcagactct

SEQ ID NO: 349 - DNA, 197 bp, Artificial Sequence; identical to SEQ ID NO: 348
  Synthetic polynucleotide

SEQ ID NO: 350 - DNA, 190 bp, Artificial Sequence
  Synthetic polynucleotide
atcatctcaccttgcctcctgaatgcgtcttctaagagcctgcaggttctagaacattctagattctagaacattcttcgttctagaacattctgacttctagaacattctctattctagaacattctactttctagaacattcttgcttctagaacattctgtaggcgcgccatgcttcatcagactct

SEQ ID NO: 351 - DNA, 190 bp, Artificial Sequence; identical to SEQ ID NO: 350
  Synthetic polynucleotide

SEQ ID NO: 352 - DNA, 183 bp, Artificial Sequence
  Synthetic polynucleotide
atcatctcaccttgcctcctgtattcactataggcacccctgcaggggactacaattcccagaatgccccgagaggactacaattcccagaatgccccgtcgggactacaattcccagaatgccccggacggactacaattcccagaatgccccgctaggcgcgccatgcttcatcagactct

SEQ ID NO: 353 - DNA, 183 bp, Artificial Sequence; identical to SEQ ID NO: 352
  Synthetic polynucleotide

SEQ ID NO: 354 - DNA, 188 bp, Artificial Sequence
  Synthetic polynucleotide
atcatctcaccttgcctcctggctgaatccttagatgacctgcaggcgccgcccccgcagacgccgcccccgctcgcgccgcccccgcgaccgccgcccccgcctacgccgcccccgcactcgccgcccccgctgccgccgcccccgcgtacgccgcccccgcggcgcgccatgcttcatcagactct

SEQ ID NO: 355 - DNA, 188 bp, Artificial Sequence; identical to SEQ ID NO: 354
  Synthetic polynucleotide

SEQ ID NO: 356 - DNA, 191 bp, Artificial Sequence
  Synthetic polynucleotide
atcatctcaccttgcctcctggggccgaccaagtatagcctgcaggcatcaattgcagtgatcagacatcaattgcagtgatctcgcatcaattgcagtgatcgaccatcaattgcagtgatcctacatcaattgcagtgatcactcatcaattgcagtgatctgcggcgcgccatgcttcatcagactct

SEQ ID NO: 357 - DNA, 191 bp, Artificial Sequence; identical to SEQ ID NO: 356
  Synthetic polynucleotide

SEQ ID NO: 358 - DNA, 196 bp, Artificial Sequence
  Synthetic polynucleotide
atcatctcaccttgcctcctgtcataaagtgaactaggcctgcaggtcgtcacgcttcaagatcgtcacgcttcatcgtcgtcacgcttcagactcgtcacgcttcactatcgtcacgcttcaacttcgtcacgcttcatgctcgtcacgcttcagtatcgtcacgcttcaggcgcgccatgcttcatcagactct

SEQ ID NO: 359 - DNA, 196 bp, Artificial Sequence; identical to SEQ ID NO: 358
  Synthetic polynucleotide

SEQ ID NO: 360 - DNA, 188 bp, Artificial Sequence
  Synthetic polynucleotide
atcatctcaccttgcctcctgaataagctcgtgacctacctgcaggcattgcgtcaggagacattgcgtcaggtcgcattgcgtcagggaccattgcgtcaggctacattgcgtcaggactcattgcgtcaggtgccattgcgtcagggtacattgcgtcaggggcgcgccatgcttcatcagactct

SEQ ID NO: 361 - DNA, 188 bp, Artificial Sequence; identical to SEQ ID NO: 360
  Synthetic polynucleotide

SEQ ID NO: 362 - DNA, 191 bp, Artificial Sequence
  Synthetic polynucleotide
atcatctcaccttgcctcctgccttgtcctgtgtcactcctgcaggcgtaattaattaattggagacgtaattaattaattggtcgcgtaattaattaattgggaccgtaattaattaattggctacgtaattaattaattggactcgtaattaattaattggtgcggcgcgccatgcttcatcagactct

SEQ ID NO: 363 - DNA, 191 bp, Artificial Sequence; identical to SEQ ID NO: 362
  Synthetic polynucleotide

SEQ ID NO: 364 - DNA, 156 bp, Artificial Sequence
  Synthetic polynucleotide
atcatctcaccttgcctcctggaaccaatcagaagggtcctgcaggccgcgcgcagaccgcgcgctcgccgcgcgcgacccgcgcgcctaccgcgcgcactccgcgcgctgcccgcgcgcgtaccgcgcgcggcgcgccatgcttcatcagactct

SEQ ID NO: 365 - DNA, 156 bp, Artificial Sequence; identical to SEQ ID NO: 364
  Synthetic polynucleotide

SEQ ID NO: 366 - DNA, 172 bp, Artificial Sequence
  Synthetic polynucleotide
atcatctcaccttgcctcctggtccactcccatttgtccctgcaggaagcaattaaagaaagcaattaatcgaagcaattaagacaagcaattaactaaagcaattaaactaagcaattaatgcaagcaattaagtaaagcaattaaggcgcgccatgcttcatcagactct

SEQ ID NO: 367 - DNA, 172 bp, Artificial Sequence; identical to SEQ ID NO: 366
  Synthetic polynucleotide

SEQ ID NO: 368 - DNA, 197 bp, Artificial Sequence
  Synthetic polynucleotide
atcatctcaccttgcctcctgtacgctggatacaactccctgcaggaataatcgcgaatatagaaataatcgcgaatattcgaataatcgcgaatatgacaataatcgcgaatatctaaataatcgcgaatatactaataatcgcgaatattgcaataatcgcgaatatgtaggcgcgccatgcttcatcagactct

SEQ ID NO: 369 - DNA, 197 bp, Artificial Sequence; identical to SEQ ID NO: 368
  Synthetic polynucleotide

SEQ ID NO: 370 - DNA, 148 bp, Artificial Sequence
  Synthetic polynucleotide
atcatctcaccttgcctcctgcccattggagctctactcctgcaggacaacacagaacaacactcgacaacacgacacaacacctaacaacacactacaacactgcacaacacgtaacaacacggcgcgccatgcttcatcagactct

SEQ ID NO: 371 - DNA, 148 bp, Artificial Sequence; identical to SEQ ID NO: 370
  Synthetic polynucleotide

SEQ ID NO: 372 - DNA, 197 bp, Artificial Sequence
  Synthetic polynucleotide
atcatctcaccttgcctcctgaagtgagtgactccctccctgcaggcaatagcggtggtggagacaatagcggtggtggtcgcaatagcggtggtgggaccaatagcggtggtggctacaatagcggtggtggactcaatagcggtggtggtgccaatagcggtggtgggtaggcgcgccatgcttcatcagactct

SEQ ID NO: 373 - DNA, 197 bp, Artificial Sequence; identical to SEQ ID NO: 372
  Synthetic polynucleotide

SEQ ID NO: 374 - DNA, 164 bp, Artificial Sequence
  Synthetic polynucleotide
atcatctcaccttgcctcctgcgtgcgtcacatcgagtcctgcaggatgaccttgagaatgaccttgtcgatgaccttggacatgaccttgctaatgaccttgactatgaccttgtgcatgaccttggtaatgaccttgggcgcgccatgcttcatcagactct

SEQ ID NO: 375 - DNA, 164 bp, Artificial Sequence; identical to SEQ ID NO: 374
  Synthetic polynucleotide

SEQ ID NO: 376 - DNA, 197 bp, Artificial Sequence
  Synthetic polynucleotide
atcatctcaccttgcctcctgtatcggtacaatacgtacctgcaggccacttccggttccgagaccacttccggttccgtcgccacttccggttccggacccacttccggttccgctaccacttccggttccgactccacttccggttccgtgcccacttccggttccggtaggcgcgccatgcttcatcagactct

SEQ ID NO: 377 - DNA, 197 bp, Artificial Sequence; identical to SEQ ID NO: 376
  Synthetic polynucleotide

SEQ ID NO: 378 - DNA, 156 bp, Artificial Sequence
  Synthetic polynucleotide
atcatctcaccttgcctcctgagcgcagcaaatgtgttcctgcagggttaatccagagttaatcctcggttaatccgacgttaatccctagttaatccactgttaatcctgcgttaatccgtagttaatccggcgcgccatgcttcatcagactct

SEQ ID NO: 379 - DNA, 156 bp, Artificial Sequence; identical to SEQ ID NO: 378
  Synthetic polynucleotide

SEQ ID NO: 380 - DNA, 196 bp, Artificial Sequence
  Synthetic polynucleotide
atcatctcaccttgcctcctggtgctcatattgccgcacctgcaggccaccagagggcgagaccaccagagggcgtcgccaccagagggcggacccaccagagggcgctaccaccagagggcgactccaccagagggcgtgcccaccagagggcggtaccaccagagggcgggcgcgccatgcttcatcagactct

SEQ ID NO: 381 - DNA, 196 bp, Artificial Sequence; identical to SEQ ID NO: 380
  Synthetic polynucleotide

SEQ ID NO: 382 - DNA, 191 bp, Artificial Sequence
  Synthetic polynucleotide
atcatctcaccttgcctcctgaactcaagctctgccctcctgcagggatctccatttttggacagagatctccatttttggactcggatctccatttttggacgacgatctccatttttggacctagatctccatttttggacactgatctccatttttggactgcggcgcgccatgcttcatcagactct

SEQ ID NO: 383 - DNA, 191 bp, Artificial Sequence; identical to SEQ ID NO: 382
  Synthetic polynucleotide

SEQ ID NO: 384 - DNA, 164 bp, Artificial Sequence
  Synthetic polynucleotide
atcatctcaccttgcctcctgagggagccagagtttaccctgcagggcgtaaataagagcgtaaatatcggcgtaaatagacgcgtaaatactagcgtaaataactgcgtaaatatgcgcgtaaatagtagcgtaaataggcgcgccatgcttcatcagactct

SEQ ID NO: 385 - DNA, 164 bp, Artificial Sequence; identical to SEQ ID NO: 384
  Synthetic polynucleotide

SEQ ID NO: 386 - DNA, 180 bp, Artificial Sequence
  Synthetic polynucleotide
atcatctcaccttgcctcctgaagtcttggagtcacgccctgcaggttatcttatctagattatcttatcttcgttatcttatctgacttatcttatctctattatcttatctactttatcttatcttgcttatcttatctgtattatcttatctggcgcgccatgcttcatcagactct

SEQ ID NO: 387 - DNA, 180 bp, Artificial Sequence; identical to SEQ ID NO: 386
  Synthetic polynucleotide

SEQ ID NO: 388 - DNA, 185 bp, Artificial Sequence
  Synthetic polynucleotide
atcatctcaccttgcctcctggtgacttgagataatcccctgcaggtcgaacagatggtgacagatcgaacagatggtgactcgtcgaacagatggtgacgactcgaacagatggtgacctatcgaacagatggtgacacttcgaacagatggtgactgcggcgcgccatgcttcatcagactct

SEQ ID NO: 389 - DNA, 185 bp, Artificial Sequence; identical to SEQ ID NO: 388
  Synthetic polynucleotide

SEQ ID NO: 390 - DNA, 172 bp, Artificial Sequence
  Synthetic polynucleotide
atcatctcaccttgcctcctgctatctccgatgcttcgcctgcaggaccagctgtgagaaccagctgtgtcgaccagctgtggacaccagctgtgctaaccagctgtgactaccagctgtgtgcaccagctgtggtaaccagctgtgggcgcgccatgcttcatcagactct

SEQ ID NO: 391 - DNA, 172 bp, Artificial Sequence; identical to SEQ ID NO: 390
  Synthetic polynucleotide

SEQ ID NO: 392 - DNA, 196 bp, Artificial Sequence
  Synthetic polynucleotide
atcatctcaccttgcctcctgtcatcttactgctgggacctgcaggttcccaggaatttagattcccaggaattttcgttcccaggaatttgacttcccaggaatttctattcccaggaatttactttcccaggaattttgcttcccaggaatttgtattcccaggaatttggcgcgccatgcttcatcagactct

SEQ ID NO: 393 - DNA, 196 bp, Artificial Sequence; identical to SEQ ID NO: 392
  Synthetic polynucleotide

SEQ ID NO: 394 - DNA, 197 bp, Artificial Sequence
  Synthetic polynucleotide
atcatctcaccttgcctcctgaagaccgtttagaggcacctgcagggctaaccacaaacgtagagctaaccacaaacgttcggctaaccacaaacgtgacgctaaccacaaacgtctagctaaccacaaacgtactgctaaccacaaacgttgcgctaaccacaaacgtgtaggcgcgccatgcttcatcagactct

SEQ ID NO: 395 - DNA, 197 bp, Artificial Sequence; identical to SEQ ID NO: 394
  Synthetic polynucleotide

SEQ ID NO: 396 - DNA, 196 bp, Artificial Sequence
  Synthetic polynucleotide
atcatctcaccttgcctcctggcccgccctgatgtaatcctgcagggggtggggtgaggagagggtggggtgaggtcggggtggggtgagggacgggtggggtgaggctagggtggggtgaggactgggtggggtgaggtgcgggtggggtgagggtagggtggggtgaggggcgcgccatgcttcatcagactct

SEQ ID NO: 397 - DNA, 196 bp, Artificial Sequence; identical to SEQ ID NO: 396
  Synthetic polynucleotide

SEQ ID NO: 398 - DNA, 156 bp, Artificial Sequence
  Synthetic polynucleotide
atcatctcaccttgcctcctggggcacaagtgtttccacctgcagggacagctgagagacagctgtcggacagctggacgacagctgctagacagctgactgacagctgtgcgacagctggtagacagctgggcgcgccatgcttcatcagactct

SEQ ID NO: 399 - DNA, 156 bp, Artificial Sequence; identical to SEQ ID NO: 398
  Synthetic polynucleotide

SEQ ID NO: 400 - DNA, 188 bp, Artificial Sequence
  Synthetic polynucleotide
atcatctcaccttgcctcctggaaccacacttgtcgcgcctgcaggaaaaatagccctagaaaaaatagcccttcgaaaaatagccctgacaaaaatagccctctaaaaaatagccctactaaaaatagcccttgcaaaaatagccctgtaaaaaatagccctggcgcgccatgcttcatcagactct

SEQ ID NO: 401 - DNA, 188 bp, Artificial Sequence; identical to SEQ ID NO: 400
  Synthetic polynucleotide

SEQ ID NO: 402 - DNA, 172 bp, Artificial Sequence
  Synthetic polynucleotide
atcatctcaccttgcctcctgtctagtacactgctaatcctgcaggtggccttgaaagatggccttgaatcgtggccttgaagactggccttgaactatggccttgaaacttggccttgaatgctggccttgaagtatggccttgaaggcgcgccatgcttcatcagactct

SEQ ID NO: 403 - DNA, 172 bp, Artificial Sequence; identical to SEQ ID NO: 402
  Synthetic polynucleotide

SEQ ID NO: 404 - DNA, 148 bp, Artificial Sequence
  Synthetic polynucleotide
atcatctcaccttgcctcctggatttacgcgttaaacccctgcagggaggtcaagagaggtcatcggaggtcagacgaggtcactagaggtcaactgaggtcatgcgaggtcagtagaggtcaggcgcgccatgcttcatcagactct

SEQ ID NO: 405 - DNA, 148 bp, Artificial Sequence; identical to SEQ ID NO: 404
  Synthetic polynucleotide

SEQ ID NO: 406 - DNA, 180 bp, Artificial Sequence
  Synthetic polynucleotide
atcatctcaccttgcctcctgcgacgaaatcagaacaacctgcaggttgggattacaagattgggattacatcgttgggattacagacttgggattacactattgggattacaactttgggattacatgcttgggattacagtattgggattacaggcgcgccatgcttcatcagactct

SEQ ID NO: 407 - DNA, 180 bp, Artificial Sequence; identical to SEQ ID NO: 406
  Synthetic polynucleotide

SEQ ID NO: 408 - DNA, 148 bp, Artificial Sequence
  Synthetic polynucleotide
atcatctcaccttgcctcctgttcatgccatcaaggcgcctgcagggacaaagagagacaaagtcggacaaaggacgacaaagctagacaaagactgacaaagtgcgacaaaggtagacaaagggcgcgccatgcttcatcagactct

SEQ ID NO: 409 - DNA, 148 bp, Artificial Sequence; identical to SEQ ID NO: 408
  Synthetic polynucleotide

SEQ ID NO: 410 - DNA, 172 bp, Artificial Sequence
  Synthetic polynucleotide
atcatctcaccttgcctcctgcaataggtaagtaacggcctgcaggccggaagtggagaccggaagtggtcgccggaagtgggacccggaagtggctaccggaagtggactccggaagtggtgcccggaagtgggtaccggaagtggggcgcgccatgcttcatcagactct

SEQ ID NO: 411 - DNA, 172 bp, Artificial Sequence; identical to SEQ ID NO: 410
  Synthetic polynucleotide

SEQ ID NO: 412 - DNA, 164 bp, Artificial Sequence
  Synthetic polynucleotide
atcatctcaccttgcctcctgatcgtctcctttgagcccctgcaggccctaatgaagaccctaatgatcgccctaatgagacccctaatgactaccctaatgaactccctaatgatgcccctaatgagtaccctaatgaggcgcgccatgcttcatcagactct

SEQ ID NO: 413 - DNA, 164 bp, Artificial Sequence; identical to SEQ ID NO: 412
  Synthetic polynucleotide

SEQ ID NO: 414 - DNA, 180 bp, Artificial Sequence
  Synthetic polynucleotide
atcatctcaccttgcctcctgcgacccgaattaagtcgcctgcaggagctgtcagaaagaagctgtcagaatcgagctgtcagaagacagctgtcagaactaagctgtcagaaactagctgtcagaatgcagctgtcagaagtaagctgtcagaaggcgcgccatgcttcatcagactct

SEQ ID NO: 415 - DNA, 180 bp, Artificial Sequence; identical to SEQ ID NO: 414
  Synthetic polynucleotide

SEQ ID NO: 416 - DNA, 200 bp, Artificial Sequence
  Synthetic polynucleotide
atcatctcaccttgcctcctgttccctagggtcggttgcctgcaggctagtttcacttcctctttagactagtttcacttcctcttttcgctagtttcacttcctctttgacctagtttcacttcctctttctactagtttcacttcctctttactctagtttcacttcctctttggcgcgccatgcttcatcagactct

SEQ ID NO: 417 - DNA, 200 bp, Artificial Sequence; identical to SEQ ID NO: 416
  Synthetic polynucleotide

SEQ ID NO: 418 - DNA, 197 bp, Artificial Sequence
  Synthetic polynucleotide
atcatctcaccttgcctcctggctacgcagaacagcatcctgcaggggtatttggcaatgcacaagaggtatttggcaatgcacatcgggtatttggcaatgcacagacggtatttggcaatgcacactaggtatttggcaatgcacaactggtatttggcaatgcacatgcggcgcgccatgcttcatcagactct

SEQ ID NO: 419 - DNA, 197 bp, Artificial Sequence; identical to SEQ ID NO: 418
  Synthetic polynucleotide

SEQ ID NO: 420 - DNA, 156 bp, Artificial Sequence
  Synthetic polynucleotide
atcatctcaccttgcctcctgatgcgcttattagataccctgcaggcctcagccagacctcagcctcgcctcagccgaccctcagccctacctcagccactcctcagcctgccctcagccgtacctcagccggcgcgccatgcttcatcagactct

SEQ ID NO: 421 - DNA, 156 bp, Artificial Sequence; identical to SEQ ID NO: 420
  Synthetic polynucleotide

SEQ ID NO: 422 - DNA, 190 bp, Artificial Sequence
  Synthetic polynucleotide
atcatctcaccttgcctcctgagctgtatgttcaacctcctgcaggtgagtaaacaaaaaagatgagtaaacaaaaatcgtgagtaaacaaaaagactgagtaaacaaaaactatgagtaaacaaaaaacttgagtaaacaaaaatgctgagtaaacaaaaagtaggcgcgccatgcttcatcagactct

SEQ ID NO: 423 - DNA, 190 bp, Artificial Sequence; identical to SEQ ID NO: 422
  Synthetic polynucleotide

SEQ ID NO: 424 - DNA, 190 bp, Artificial Sequence
  Synthetic polynucleotide
atcatctcaccttgcctcctgcttgggtgacaatcaatcctgcaggggttacgtcagcgcagaggttacgtcagcgctcgggttacgtcagcgcgacggttacgtcagcgcctaggttacgtcagcgcactggttacgtcagcgctgcggttacgtcagcgcgtaggcgcgccatgcttcatcagactct

SEQ ID NO: 425 - DNA, 190 bp, Artificial Sequence; identical to SEQ ID NO: 424
  Synthetic polynucleotide

SEQ ID NO: 426 - DNA, 191 bp, Artificial Sequence
  Synthetic polynucleotide
atcatctcaccttgcctcctgagtcaaacacgcgtatccctgcaggataaacaattgtaaacaagaataaacaattgtaaacatcgataaacaattgtaaacagacataaacaattgtaaacactaataaacaattgtaaacaactataaacaattgtaaacatgcggcgcgccatgcttcatcagactct

SEQ ID NO: 427 - DNA, 191 bp, Artificial Sequence; identical to SEQ ID NO: 426
  Synthetic polynucleotide

SEQ ID NO: 428 - DNA, 164 bp, Artificial Sequence
  Synthetic polynucleotide
atcatctcaccttgcctcctgttgatgggcaccttgctcctgcaggagataagagagaagataagagtcgagataagaggacagataagagctaagataagagactagataagagtgcagataagaggtaagataagagggcgcgccatgcttcatcagactct

SEQ ID NO: 429 - DNA, 164 bp, Artificial Sequence; identical to SEQ ID NO: 428
  Synthetic polynucleotide

SEQ ID NO: 430 - DNA, 191 bp, Artificial Sequence
  Synthetic polynucleotide
atcatctcaccttgcctcctgcaggacaacctgacgtccctgcagggtgaactcatgcgtgaaaattagagtgaactcatgcgtgaaaatttcggtgaactcatgcgtgaaaattgacgtgaactcatgcgtgaaaattctagtgaactcatgcgtgaaaattactggcgcgccatgcttcatcagactct

SEQ ID NO: 431 - DNA, 191 bp, Artificial Sequence; identical to SEQ ID NO: 430
  Synthetic polynucleotide

SEQ ID NO: 432 - DNA, 188 bp, Artificial Sequence
  Synthetic polynucleotide
atcatctcaccttgcctcctgttgagtctccgcctagccctgcaggccgtttaacggtagaccgtttaacggttcgccgtttaacggtgacccgtttaacggtctaccgtttaacggtactccgtttaacggttgcccgtttaacggtgtaccgtttaacggtggcgcgccatgcttcatcagactct

SEQ ID NO: 433 - DNA, 188 bp, Artificial Sequence; identical to SEQ ID NO: 432
  Synthetic polynucleotide

SEQ ID NO: 434 - DNA, 180 bp, Artificial Sequence
  Synthetic polynucleotide
atcatctcaccttgcctcctgccgacgacagagccttacctgcaggcaggtcacggtagacaggtcacggttcgcaggtcacggtgaccaggtcacggtctacaggtcacggtactcaggtcacggttgccaggtcacggtgtacaggtcacggtggcgcgccatgcttcatcagactct

SEQ ID NO: 435 - DNA, 180 bp, Artificial Sequence; identical to SEQ ID NO: 434
  Synthetic polynucleotide

SEQ ID NO: 436 - DNA, 191 bp, Artificial Sequence
  Synthetic polynucleotide
atcatctcaccttgcctcctgatgctcagccttcagggcctgcaggattgttaatccctctaaagaattgttaatccctctaatcgattgttaatccctctaagacattgttaatccctctaactaattgttaatccctctaaactattgttaatccctctaatgcggcgcgccatgcttcatcagactct

SEQ ID NO: 437 - DNA, 191 bp, Artificial Sequence; identical to SEQ ID NO: 436
  Synthetic polynucleotide

SEQ ID NO: 438 - DNA, 197 bp, Artificial Sequence
  Synthetic polynucleotide
atcatctcaccttgcctcctgtgctggtcactcctatccctgcagggcagccggcgccgccagagcagccggcgccgcctcggcagccggcgccgccgacgcagccggcgccgccctagcagccggcgccgccactgcagccggcgccgcctgcgcagccggcgccgccgtaggcgcgccatgcttcatcagactct

SEQ ID NO: 439 - DNA, 197 bp, Artificial Sequence; identical to SEQ ID NO: 438
  Synthetic polynucleotide

SEQ ID NO: 440 - DNA, 185 bp, Artificial Sequence
  Synthetic polynucleotide
atcatctcaccttgcctcctgcctcctttgcgctaatccctgcaggagcaccatggacagcgagaagcaccatggacagcgtcgagcaccatggacagcggacagcaccatggacagcgctaagcaccatggacagcgactagcaccatggacagcgtgcggcgcgccatgcttcatcagactct

SEQ ID NO: 441 - DNA, 185 bp, Artificial Sequence; identical to SEQ ID NO: 440
  Synthetic polynucleotide

SEQ ID NO: 442 - DNA, 190 bp, Artificial Sequence
  Synthetic polynucleotide
atcatctcaccttgcctcctgattagctgaagggtggtcctgcaggggcacgggttcgagagaggcacgggttcgagtcgggcacgggttcgaggacggcacgggttcgagctaggcacgggttcgagactggcacgggttcgagtgcggcacgggttcgaggtaggcgcgccatgcttcatcagactct

SEQ ID NO: 443 - DNA, 190 bp, Artificial Sequence; identical to SEQ ID NO: 442
  Synthetic polynucleotide

SEQ ID NO: 444 - DNA, 191 bp, Artificial Sequence
  Synthetic polynucleotide
atcatctcaccttgcctcctgaaactgtacgcatacgccctgcaggggcggtcatgcgtgcgcgaccagaggcggtcatgcgtgcgcgacctcgggcggtcatgcgtgcgcgaccgacggcggtcatgcgtgcgcgaccctaggcggtcatgcgtgcgcgaccactggcgcgccatgcttcatcagactct

SEQ ID NO: 445 - DNA, 191 bp, Artificial Sequence; identical to SEQ ID NO: 444
  Synthetic polynucleotide

SEQ ID NO: 446 - DNA, 180 bp, Artificial Sequence
  Synthetic polynucleotide
atcatctcaccttgcctcctgcctctggattggaagtacctgcaggggcttgtttatagaggcttgtttattcgggcttgtttatgacggcttgtttatctaggcttgtttatactggcttgtttattgcggcttgtttatgtaggcttgtttatggcgcgccatgcttcatcagactct

SEQ ID NO: 447 - DNA, 180 bp, Artificial Sequence; identical to SEQ ID NO: 446
  Synthetic polynucleotide

SEQ ID NO: 448 - DNA, 172 bp, Artificial Sequence
  Synthetic polynucleotide
atcatctcaccttgcctcctggcacaagcgtaccacagcctgcaggactaattagcagaactaattagctcgactaattagcgacactaattagcctaactaattagcactactaattagctgcactaattagcgtaactaattagcggcgcgccatgcttcatcagactct

SEQ ID NO: 449 - DNA, 172 bp, Artificial Sequence; identical to SEQ ID NO: 448
  Synthetic polynucleotide

SEQ ID NO: 450 - DNA, 180 bp, Artificial Sequence
  Synthetic polynucleotide
atcatctcaccttgcctcctgatgggatacagtaagctcctgcaggattttacgaccagaattttacgacctcgattttacgaccgacattttacgaccctaattttacgaccactattttacgacctgcattttacgaccgtaattttacgaccggcgcgccatgcttcatcagactct

SEQ ID NO: 451 - DNA, 180 bp, Artificial Sequence; identical to SEQ ID NO: 450
  Synthetic polynucleotide

SEQ ID NO: 452 - DNA, 191 bp, Artificial Sequence
  Synthetic polynucleotide
atcatctcaccttgcctcctgactgagggtaagtggtgcctgcaggcctattaattaattccgagacctattaattaattccgtcgcctattaattaattccggaccctattaattaattccgctacctattaattaattccgactcctattaattaattccgtgcggcgcgccatgcttcatcagactct

SEQ ID NO: 453 - DNA, 191 bp, Artificial Sequence; identical to SEQ ID NO: 452
  Synthetic polynucleotide

SEQ ID NO: 454 - DNA, 164 bp, Artificial Sequence
  Synthetic polynucleotide
atcatctcaccttgcctcctgtggagaacattggtattcctgcaggggtcataaaagaggtcataaatcgggtcataaagacggtcataaactaggtcataaaactggtcataaatgcggtcataaagtaggtcataaaggcgcgccatgcttcatcagactct

SEQ ID NO: 455 - DNA, 164 bp, Artificial Sequence; identical to SEQ ID NO: 454
  Synthetic polynucleotide

SEQ ID NO: 456 - DNA, 164 bp, Artificial Sequence
  Synthetic polynucleotide
atcatctcaccttgcctcctgtcggttgcgaatcggctcctgcaggatcgcgttaagaatcgcgttatcgatcgcgttagacatcgcgttactaatcgcgttaactatcgcgttatgcatcgcgttagtaatcgcgttaggcgcgccatgcttcatcagactct

SEQ ID NO: 457 - DNA, 164 bp, Artificial Sequence; identical to SEQ ID NO: 456
  Synthetic polynucleotide

SEQ ID NO: 458 - DNA, 164 bp, Artificial Sequence
  Synthetic polynucleotide
atcatctcaccttgcctcctgcctatgtggttgtgctccctgcagggggattagcagagggattagctcggggattagcgacgggattagcctagggattagcactgggattagctgcgggattagcgtagggattagcggcgcgccatgcttcatcagactct

SEQ ID NO: 459 - DNA, 164 bp, Artificial Sequence; identical to SEQ ID NO: 458
  Synthetic polynucleotide

SEQ ID NO: 460 - DNA, 191 bp, Artificial Sequence
  Synthetic polynucleotide
atcatctcaccttgcctcctggttaagaagtttctacgcctgcaggaatcactgcaattgattagaaatcactgcaattgatttcgaatcactgcaattgattgacaatcactgcaattgattctaaatcactgcaattgattactaatcactgcaattgatttgcggcgcgccatgcttcatcagactct

SEQ ID NO: 461 - DNA, 191 bp, Artificial Sequence; identical to SEQ ID NO: 460
  Synthetic polynucleotide

SEQ ID NO: 462 - DNA, 196 bp, Artificial Sequence
  Synthetic polynucleotide
atcatctcaccttgcctcctgcgtattggaatgccgctcctgcaggaggggattcccctagaaggggattccccttcgaggggattcccctgacaggggattcccctctaaggggattcccctactaggggattccccttgcaggggattcccctgtaaggggattcccctggcgcgccatgcttcatcagactct

SEQ ID NO: 463 - DNA, 196 bp, Artificial Sequence; identical to SEQ ID NO: 462
  Synthetic polynucleotide

SEQ ID NO: 464 - DNA, 164 bp, Artificial Sequence
  Synthetic polynucleotide
atcatctcaccttgcctcctgaattaccgaccctacaccctgcaggaccacgtggagaaccacgtggtcgaccacgtgggacaccacgtggctaaccacgtggactaccacgtggtgcaccacgtgggtaaccacgtggggcgcgccatgcttcatcagactct

SEQ ID NO: 465 - DNA, 164 bp, Artificial Sequence; identical to SEQ ID NO: 464
  Synthetic polynucleotide

SEQ ID NO: 466 - DNA, 172 bp, Artificial Sequence
  Synthetic polynucleotide
atcatctcaccttgcctcctgatatattccgactggtccctgcaggaccacgtgatagaaccacgtgattcgaccacgtgatgacaccacgtgatctaaccacgtgatactaccacgtgattgcaccacgtgatgtaaccacgtgatggcgcgccatgcttcatcagactct

SEQ ID NO: 467 - DNA, 172 bp, Artificial Sequence; identical to SEQ ID NO: 466
  Synthetic polynucleotide

SEQ ID NO: 468 - DNA, 197 bp, Artificial Sequence
  Synthetic polynucleotide
atcatctcaccttgcctcctgcggtactagcttcgaagcctgcaggttatattaatttctcagattatattaatttctctcgttatattaatttctcgacttatattaatttctcctattatattaatttctcactttatattaatttctctgcttatattaatttctcgtaggcgcgccatgcttcatcagactct

SEQ ID NO: 469 - DNA, 197 bp, Artificial Sequence; identical to SEQ ID NO: 468
  Synthetic polynucleotide

SEQ ID NO: 470 - DNA, 172 bp, Artificial Sequence
  Synthetic polynucleotide
atcatctcaccttgcctcctgacaggtcgcacaagatccctgcaggctataaatagagactataaatagtcgctataaataggacctataaatagctactataaatagactctataaatagtgcctataaataggtactataaatagggcgcgccatgcttcatcagactct

SEQ ID NO: 471 - DNA, 172 bp, Artificial Sequence; identical to SEQ ID NO: 470
  Synthetic polynucleotide

SEQ ID NO: 472 - DNA, 156 bp, Artificial Sequence
  Synthetic polynucleotide
atcatctcaccttgcctcctgccgattcatatagtagtcctgcaggaggtgcggagaaggtgcggtcgaggtgcgggacaggtgcggctaaggtgcggactaggtgcggtgcaggtgcgggtaaggtgcggggcgcgccatgcttcatcagactct

SEQ ID NO: 473 - DNA, 156 bp, Artificial Sequence; identical to SEQ ID NO: 472
  Synthetic polynucleotide

SEQ ID NO: 474 - DNA, 172 bp, Artificial Sequence
  Synthetic polynucleotide
atcatctcaccttgcctcctgctggtaaggaaggtatccctgcaggaccacgtgccagaaccacgtgcctcgaccacgtgccgacaccacgtgccctaaccacgtgccactaccacgtgcctgcaccacgtgccgtaaccacgtgccggcgcgccatgcttcatcagactct

SEQ ID NO: 475 - DNA, 172 bp, Artificial Sequence; identical to SEQ ID NO: 474
  Synthetic polynucleotide

SEQ ID NO: 476 - DNA, 190 bp, Artificial Sequence
  Synthetic polynucleotide
atcatctcaccttgcctcctgtgtgaggtggactcgtacctgcaggggcaataaaactttagaggcaataaaacttttcgggcaataaaactttgacggcaataaaactttctaggcaataaaactttactggcaataaaacttttgcggcaataaaactttgtaggcgcgccatgcttcatcagactct

SEQ ID NO: 477 - DNA, 190 bp, Artificial Sequence; identical to SEQ ID NO: 476
  Synthetic polynucleotide

SEQ ID NO: 478 - DNA, 180 bp, Artificial Sequence
  Synthetic polynucleotide
atcatctcaccttgcctcctgtttaagcagtgagcgagcctgcaggtaaataggtcaagataaataggtcatcgtaaataggtcagactaaataggtcactataaataggtcaacttaaataggtcatgctaaataggtcagtataaataggtcaggcgcgccatgcttcatcagactct

SEQ ID NO: 479 - DNA, 180 bp, Artificial Sequence; identical to SEQ ID NO: 478
  Synthetic polynucleotide

SEQ ID NO: 480 - DNA, 197 bp, Artificial Sequence
  Synthetic polynucleotide
atcatctcaccttgcctcctgtctagcagaggagaggacctgcagggatgagtcaccccccagagatgagtcacccccctcggatgagtcaccccccgacgatgagtcaccccccctagatgagtcaccccccactgatgagtcacccccctgcgatgagtcaccccccgtaggcgcgccatgcttcatcagactct

SEQ ID NO: 481 - DNA, 197 bp, Artificial Sequence; identical to SEQ ID NO: 480
  Synthetic polynucleotide

SEQ ID NO: 482 - DNA, 164 bp, Artificial Sequence
  Synthetic polynucleotide
atcatctcaccttgcctcctgcacaccatcattggtcacctgcaggtaattagtgagataattagtgtcgtaattagtggactaattagtgctataattagtgacttaattagtgtgctaattagtggtataattagtgggcgcgccatgcttcatcagactct

SEQ ID NO: 483 - DNA, 164 bp, Artificial Sequence; identical to SEQ ID NO: 482
  Synthetic polynucleotide

SEQ ID NO: 484 - DNA, 185 bp, Artificial Sequence
  Synthetic polynucleotide
atcatctcaccttgcctcctgatccagaaaccagctcacctgcaggttgggggcgcccctagagattgggggcgcccctagtcgttgggggcgcccctaggacttgggggcgcccctagctattgggggcgcccctagactttgggggcgcccctagtgcggcgcgccatgcttcatcagactct

SEQ ID NO: 485 - DNA, 185 bp, Artificial Sequence; identical to SEQ ID NO: 484
  Synthetic polynucleotide

SEQ ID NO: 486 - DNA, 190 bp, Artificial Sequence
  Synthetic polynucleotide
atcatctcaccttgcctcctgtggctagtggtgtaaatcctgcaggtgacctttgaccccagatgacctttgacccctcgtgacctttgaccccgactgacctttgaccccctatgacctttgaccccacttgacctttgacccctgctgacctttgaccccgtaggcgcgccatgcttcatcagactct

SEQ ID NO: 487 - DNA, 190 bp, Artificial Sequence; identical to SEQ ID NO: 486
  Synthetic polynucleotide

SEQ ID NO: 488 - DNA, 156 bp, Artificial Sequence
  Synthetic polynucleotide
atcatctcaccttgcctcctgaagtctaccgtgccatgcctgcaggtgtgtcatagatgtgtcattcgtgtgtcatgactgtgtcatctatgtgtcatacttgtgtcattgctgtgtcatgtatgtgtcatggcgcgccatgcttcatcagactct

SEQ ID NO: 489 - DNA, 156 bp, Artificial Sequence; identical to SEQ ID NO: 488
  Synthetic polynucleotide

SEQ ID NO: 490 - DNA, 185 bp, Artificial Sequence
  Synthetic polynucleotide
atcatctcaccttgcctcctgcacccgagtggaatgagcctgcagggcgaactaattaatgcagagcgaactaattaatgctcggcgaactaattaatgcgacgcgaactaattaatgcctagcgaactaattaatgcactgcgaactaattaatgctgcggcgcgccatgcttcatcagactct

SEQ ID NO: 491 - DNA, 185 bp, Artificial Sequence; identical to SEQ ID NO: 490
  Synthetic polynucleotide

SEQ ID NO: 492 - DNA, 191 bp, Artificial Sequence
  Synthetic polynucleotide
atcatctcaccttgcctcctgttctagacatgagttggcctgcaggccctccctcccccccccagaccctccctccccccccctcgccctccctcccccccccgacccctccctcccccccccctaccctccctcccccccccactccctccctccccccccctgcggcgcgccatgcttcatcagactct

SEQ ID NO: 493 - DNA, 191 bp, Artificial Sequence; identical to SEQ ID NO: 492
  Synthetic polynucleotide

SEQ ID NO: 494 - DNA, 197 bp, Artificial Sequence
  Synthetic polynucleotide
atcatctcaccttgcctcctgtcggcctataataggaccctgcaggagagtccaaagtccaagaagagtccaaagtccatcgagagtccaaagtccagacagagtccaaagtccactaagagtccaaagtccaactagagtccaaagtccatgcagagtccaaagtccagtaggcgcgccatgcttcatcagactct

SEQ ID NO: 495 - DNA, 197 bp, Artificial Sequence; identical to SEQ ID NO: 494
  Synthetic polynucleotide

SEQ ID NO: 496 - DNA, 148 bp, Artificial Sequence
  Synthetic polynucleotide
atcatctcaccttgcctcctgattgggatagctgcgagcctgcaggatttatgagaatttatgtcgatttatggacatttatgctaatttatgactatttatgtgcatttatggtaatttatgggcgcgccatgcttcatcagactct

SEQ ID NO: 497 - DNA, 148 bp, Artificial Sequence; identical to SEQ ID NO: 496
  Synthetic polynucleotide

SEQ ID NO: 498 - DNA, 196 bp, Artificial Sequence
  Synthetic polynucleotide
atcatctcaccttgcctcctgccgagtagacaagttctcctgcaggtggccccccccccagatggcccccccccctcgtggccccccccccgactggccccccccccctatggccccccccccacttggcccccccccctgctggccccccccccgtatggccccccccccggcgcgccatgcttcatcagactct

SEQ ID NO: 499 - DNA, 196 bp, Artificial Sequence; identical to SEQ ID NO: 498
  Synthetic polynucleotide

SEQ ID NO: 500 - DNA, 180 bp, Artificial Sequence
  Synthetic polynucleotide
atcatctcaccttgcctcctgacgcggatattctgtatcctgcaggggatgactcatagaggatgactcattcgggatgactcatgacggatgactcatctaggatgactcatactggatgactcattgcggatgactcatgtaggatgactcatggcgcgccatgcttcatcagactct

SEQ ID NO: 501 - DNA, 180 bp, Artificial Sequence; identical to SEQ ID NO: 500
  Synthetic polynucleotide

SEQ ID NO: 502 - DNA, 196 bp, Artificial Sequence
  Synthetic polynucleotide
atcatctcaccttgcctcctggcgaatggtggttcactcctgcaggcatcaatcaagctagacatcaatcaagcttcgcatcaatcaagctgaccatcaatcaagctctacatcaatcaagctactcatcaatcaagcttgccatcaatcaagctgtacatcaatcaagctggcgcgccatgcttcatcagactct

SEQ ID NO: 503 - DNA, 196 bp, Artificial Sequence; identical to SEQ ID NO: 502
  Synthetic polynucleotide

SEQ ID NO: 504 - DNA, 179 bp, Artificial Sequence
  Synthetic polynucleotide
atcatctcaccttgcctcctgagtgacaatgatacggtcctgcaggattaaatgacacgtcatctttcagagaattaaatgacacgtcatctttcagtcgattaaatgacacgtcatctttcaggacattaaatgacacgtcatctttcagctaggcgcgccatgcttcatcagactct

SEQ ID NO: 505 - DNA, 179 bp, Artificial Sequence; identical to SEQ ID NO: 504
  Synthetic polynucleotide

SEQ ID NO: 506 - DNA, 196 bp, Artificial Sequence
  Synthetic polynucleotide
atcatctcaccttgcctcctgtgaaagtaggctcaaagcctgcaggagaaagggttaatagaagaaagggttaattcgagaaagggttaatgacagaaagggttaatctaagaaagggttaatactagaaagggttaattgcagaaagggttaatgtaagaaagggttaatggcgcgccatgcttcatcagactct

SEQ ID NO: 507 - DNA, 196 bp, Artificial Sequence; identical to SEQ ID NO: 506
  Synthetic polynucleotide

SEQ ID NO: 508 - DNA, 191 bp, Artificial Sequence
  Synthetic polynucleotide
atcatctcaccttgcctcctgtttgtcatcggagcccacctgcaggtaattattaattaattaagataattattaattaattatcgtaattattaattaattagactaattattaattaattactataattattaattaattaacttaattattaattaattatgcggcgcgccatgcttcatcagactct

SEQ ID NO: 509 - DNA, 191 bp, Artificial Sequence; identical to SEQ ID NO: 508
  Synthetic polynucleotide

SEQ ID NO: 510 - DNA, 140 bp, Artificial Sequence
  Synthetic polynucleotide
atcatctcaccttgcctcctgcagctacatatttgttccctgcaggttaattagattaatttcgttaattgacttaattctattaattactttaatttgcttaattgtattaattggcgcgccatgcttcatcagactct

SEQ ID NO: 511 - DNA, 140 bp, Artificial Sequence; identical to SEQ ID NO: 510
  Synthetic polynucleotide

SEQ ID NO: 512 - DNA, 191 bp, Artificial Sequence
  Synthetic polynucleotide
atcatctcaccttgcctcctgcccgactggcgcatattcctgcagggaacactgcaattgttcagagaacactgcaattgttctcggaacactgcaattgttcgacgaacactgcaattgttcctagaacactgcaattgttcactgaacactgcaattgttctgcggcgcgccatgcttcatcagactct

SEQ ID NO: 513 - DNA, 191 bp, Artificial Sequence; identical to SEQ ID NO: 512
  Synthetic polynucleotide

SEQ ID NO: 514 - DNA, 172 bp, Artificial Sequence
  Synthetic polynucleotide
atcatctcaccttgcctcctgtgattggaagccctatgcctgcaggcaagcgtgacagacaagcgtgactcgcaagcgtgacgaccaagcgtgacctacaagcgtgacactcaagcgtgactgccaagcgtgacgtacaagcgtgacggcgcgccatgcttcatcagactct

SEQ ID NO: 515 - DNA, 172 bp, Artificial Sequence; identical to SEQ ID NO: 514
  Synthetic polynucleotide

SEQ ID NO: 516 - DNA, 164 bp, Artificial Sequence
  Synthetic polynucleotide
atcatctcaccttgcctcctgcaccttgtcagcgttgccctgcaggcctgcaggtagacctgcaggttcgcctgcaggtgaccctgcaggtctacctgcaggtactcctgcaggttgccctgcaggtgtacctgcaggtggcgcgccatgcttcatcagactct

SEQ ID NO: 517 - DNA, 164 bp, Artificial Sequence; identical to SEQ ID NO: 516
  Synthetic polynucleotide

SEQ ID NO: 518 - DNA, 188 bp, Artificial Sequence
  Synthetic polynucleotide
atcatctcaccttgcctcctgggagtaagagctgcgtccctgcaggggtttcgctttcagaggtttcgctttctcgggtttcgctttcgacggtttcgctttcctaggtttcgctttcactggtttcgctttctgcggtttcgctttcgtaggtttcgctttcggcgcgccatgcttcatcagactct

SEQ ID NO: 519 - DNA, 188 bp, Artificial Sequence; identical to SEQ ID NO: 518
  Synthetic polynucleotide

SEQ ID NO: 520 - DNA, 164 bp, Artificial Sequence
  Synthetic polynucleotide
atcatctcaccttgcctcctgtcccatgcttcataagacctgcaggctttggactagactttggacttcgctttggactgacctttggactctactttggactactctttggacttgcctttggactgtactttggactggcgcgccatgcttcatcagactct

SEQ ID NO: 521 - DNA, 164 bp, Artificial Sequence; identical to SEQ ID NO: 520
  Synthetic polynucleotide

SEQ ID NO: 522 - DNA, 156 bp, Artificial Sequence
  Synthetic polynucleotide
atcatctcaccttgcctcctgcaacaggagcttagggccctgcaggttaatggcagattaatggctcgttaatggcgacttaatggcctattaatggcactttaatggctgcttaatggcgtattaatggcggcgcgccatgcttcatcagactct

SEQ ID NO: 523 - DNA, 156 bp, Artificial Sequence; identical to SEQ ID NO: 522
  Synthetic polynucleotide

SEQ ID NO: 524 - DNA, 156 bp, Artificial Sequence
  Synthetic polynucleotide
atcatctcaccttgcctcctggcacgaacaatgggttgcctgcaggggggagggagaggggagggtcgggggaggggacggggagggctaggggagggactggggagggtgcggggaggggtaggggagggggcgcgccatgcttcatcagactct

SEQ ID NO: 525 - DNA, 156 bp, Artificial Sequence; identical to SEQ ID NO: 524
  Synthetic polynucleotide

SEQ ID NO: 526 - DNA, 188 bp, Artificial Sequence
  Synthetic polynucleotide
atcatctcaccttgcctcctgcaccggtaggtatacgtcctgcaggccgcacgtacgcagaccgcacgtacgctcgccgcacgtacgcgacccgcacgtacgcctaccgcacgtacgcactccgcacgtacgctgcccgcacgtacgcgtaccgcacgtacgcggcgcgccatgcttcatcagactct

SEQ ID NO: 527 - DNA, 188 bp, Artificial Sequence; identical to SEQ ID NO: 526
  Synthetic polynucleotide

SEQ ID NO: 528 - DNA, 191 bp, Artificial Sequence
  Synthetic polynucleotide
atcatctcaccttgcctcctgtgcgattatacagacatcctgcaggtagtgccatctggtggcagatagtgccatctggtggctcgtagtgccatctggtggcgactagtgccatctggtggcctatagtgccatctggtggcacttagtgccatctggtggctgcggcgcgccatgcttcatcagactct

SEQ ID NO: 529 - DNA, 191 bp, Artificial Sequence; identical to SEQ ID NO: 528
  Synthetic polynucleotide

SEQ ID NO: 530 - DNA, 196 bp, Artificial Sequence
  Synthetic polynucleotide
atcatctcaccttgcctcctgagtattcccagcactttcctgcaggctcatgaatatatagactcatgaatatattcgctcatgaatatatgacctcatgaatatatctactcatgaatatatactctcatgaatatattgcctcatgaatatatgtactcatgaatatatggcgcgccatgcttcatcagactct

SEQ ID NO: 531 - DNA, 196 bp, Artificial Sequence; identical to SEQ ID NO: 530
  Synthetic polynucleotide

SEQ ID NO: 532 - DNA, 180 bp, Artificial Sequence
  Synthetic polynucleotide
atcatctcaccttgcctcctggacctataccgatagaacctgcaggggggattggccagaggggattggcctcgggggattggccgacggggattggccctaggggattggccactggggattggcctgcggggattggccgtaggggattggccggcgcgccatgcttcatcagactct

SEQ ID NO: 533 - DNA, 180 bp, Artificial Sequence; identical to SEQ ID NO: 532
  Synthetic polynucleotide

SEQ ID NO: 534 - DNA, 148 bp, Artificial Sequence
  Synthetic polynucleotide
atcatctcaccttgcctcctggcagcttcagcgattggcctgcaggttttccaagattttccatcgttttccagacttttccactattttccaactttttccatgcttttccagtattttccaggcgcgccatgcttcatcagactct

SEQ ID NO: 535 - DNA, 148 bp, Artificial Sequence; identical to SEQ ID NO: 534
  Synthetic polynucleotide

SEQ ID NO: 536 - DNA, 190 bp, Artificial Sequence
  Synthetic polynucleotide
atcatctcaccttgcctcctgtcgagtgggtgcagaaccctgcaggtttgcatatgcatgagatttgcatatgcatgtcgtttgcatatgcatggactttgcatatgcatgctatttgcatatgcatgacttttgcatatgcatgtgctttgcatatgcatggtaggcgcgccatgcttcatcagactct

SEQ ID NO: 537 - DNA, 190 bp, Artificial Sequence; identical to SEQ ID NO: 536
  Synthetic polynucleotide

SEQ ID NO: 538 - DNA, 172 bp, Artificial Sequence
  Synthetic polynucleotide
atcatctcaccttgcctcctgtatccttgagcatggtacctgcaggcgtgatagggagacgtgatagggtcgcgtgataggggaccgtgatagggctacgtgatagggactcgtgatagggtgccgtgataggggtacgtgatagggggcgcgccatgcttcatcagactct

SEQ ID NO: 539 - DNA, 172 bp, Artificial Sequence; identical to SEQ ID NO: 538
  Synthetic polynucleotide

SEQ ID NO: 540 - DNA, 172 bp, Artificial Sequence
  Synthetic polynucleotide
atcatctcaccttgcctcctgatctaaagcaagcatctcctgcaggatttgcatatagaatttgcatattcgatttgcatatgacatttgcatatctaatttgcatatactatttgcatattgcatttgcatatgtaatttgcatatggcgcgccatgcttcatcagactct

SEQ ID NO: 541 - DNA, 172 bp, Artificial Sequence; identical to SEQ ID NO: 540
  Synthetic polynucleotide

SEQ ID NO: 542 - DNA, 196 bp, Artificial Sequence
  Synthetic polynucleotide
atcatctcaccttgcctcctgtagaatgacccactatgcctgcaggggtattcccaagtagaggtattcccaagttcgggtattcccaagtgacggtattcccaagtctaggtattcccaagtactggtattcccaagttgcggtattcccaagtgtaggtattcccaagtggcgcgccatgcttcatcagactct

SEQ ID NO: 543 - DNA, 196 bp, Artificial Sequence; identical to SEQ ID NO: 542
  Synthetic polynucleotide

SEQ ID NO: 544 - DNA, 156 bp, Artificial Sequence
  Synthetic polynucleotide
atcatctcaccttgcctcctgaccaaacatctcgtatccctgcaggagcgctgtagaagcgctgttcgagcgctgtgacagcgctgtctaagcgctgtactagcgctgttgcagcgctgtgtaagcgctgtggcgcgccatgcttcatcagactct

SEQ ID NO: 545 - DNA, 156 bp, Artificial Sequence; identical to SEQ ID NO: 544
  Synthetic polynucleotide

SEQ ID NO: 546 - DNA, 156 bp, Artificial Sequence
  Synthetic polynucleotide
atcatctcaccttgcctcctgttatagcgtcattagggcctgcaggtaacaataagataacaatatcgtaacaatagactaacaatactataacaataacttaacaatatgctaacaatagtataacaataggcgcgccatgcttcatcagactct

SEQ ID NO: 547 - DNA, 156 bp, Artificial Sequence; identical to SEQ ID NO: 546
  Synthetic polynucleotide

SEQ ID NO: 548 - DNA, 172 bp, Artificial Sequence
  Synthetic polynucleotide
atcatctcaccttgcctcctgtgaatagaccacgcacgcctgcaggtttgaaccctagatttgaacccttcgtttgaaccctgactttgaaccctctatttgaaccctacttttgaacccttgctttgaaccctgtatttgaaccctggcgcgccatgcttcatcagactct

SEQ ID NO: 549 - DNA, 172 bp, Artificial Sequence; identical to SEQ ID NO: 548
  Synthetic polynucleotide

SEQ ID NO: 550 - DNA, 188 bp, Artificial Sequence
  Synthetic polynucleotide
atcatctcaccttgcctcctgatggtgtggcaaacggtcctgcaggctaatttgcataagactaatttgcatatcgctaatttgcatagacctaatttgcatactactaatttgcataactctaatttgcatatgcctaatttgcatagtactaatttgcataggcgcgccatgcttcatcagactct

SEQ ID NO: 551 - DNA, 188 bp, Artificial Sequence; identical to SEQ ID NO: 550
  Synthetic polynucleotide

SEQ ID NO: 552 - DNA, 156 bp, Artificial Sequence
  Synthetic polynucleotide
atcatctcaccttgcctcctgcactttgacgtatctgccctgcaggttgaccccagattgacccctcgttgaccccgacttgaccccctattgaccccactttgacccctgcttgaccccgtattgaccccggcgcgccatgcttcatcagactct

SEQ ID NO: 553 - DNA, 156 bp, Artificial Sequence; identical to SEQ ID NO: 552
  Synthetic polynucleotide

SEQ ID NO: 554 - DNA, 172 bp, Artificial Sequence
  Synthetic polynucleotide
atcatctcaccttgcctcctgccaaaggcatcccgaagcctgcaggccacatgaccagaccacatgacctcgccacatgaccgacccacatgaccctaccacatgaccactccacatgacctgcccacatgaccgtaccacatgaccggcgcgccatgcttcatcagactct

SEQ ID NO: 555 - DNA, 172 bp, Artificial Sequence; identical to SEQ ID NO: 554
  Synthetic polynucleotide

SEQ ID NO: 556 - DNA, 180 bp, Artificial Sequence
  Synthetic polynucleotide
atcatctcaccttgcctcctgttgacatacctttcagtcctgcagggattgtgtccgagagattgtgtccgtcggattgtgtccggacgattgtgtccgctagattgtgtccgactgattgtgtccgtgcgattgtgtccggtagattgtgtccgggcgcgccatgcttcatcagactct

SEQ ID NO: 557 - DNA, 180 bp, Artificial Sequence; identical to SEQ ID NO: 556
  Synthetic polynucleotide

SEQ ID NO: 558 - DNA, 200 bp, Artificial Sequence
  Synthetic polynucleotide
atcatctcaccttgcctcctggctcatctcaccaactccctgcaggtcacacctttaaggtgtgaagatcacacctttaaggtgtgatcgtcacacctttaaggtgtgagactcacacctttaaggtgtgactatcacacctttaaggtgtgaacttcacacctttaaggtgtgaggcgcgccatgcttcatcagactct

SEQ ID NO: 559 - DNA, 200 bp, Artificial Sequence; identical to SEQ ID NO: 558
  Synthetic polynucleotide

SEQ ID NO: 560 - DNA, 190 bp, Artificial Sequence
  Synthetic polynucleotide
atcatctcaccttgcctcctggctcaatggccgtgttgcctgcaggagattgtgcaatgtagaagattgtgcaatgttcgagattgtgcaatgtgacagattgtgcaatgtctaagattgtgcaatgtactagattgtgcaatgttgcagattgtgcaatgtgtaggcgcgccatgcttcatcagactct

SEQ ID NO: 561 - DNA, 190 bp, Artificial Sequence; identical to SEQ ID NO: 560
  Synthetic polynucleotide

SEQ ID NO: 562 - DNA, 188 bp, Artificial Sequence
  Synthetic polynucleotide
atcatctcaccttgcctcctgtattcctcggccaatttcctgcaggaatttgcatattagaaatttgcatatttcgaatttgcatattgacaatttgcatattctaaatttgcatattactaatttgcatatttgcaatttgcatattgtaaatttgcatattggcgcgccatgcttcatcagactct

SEQ ID NO: 563 - DNA, 188 bp, Artificial Sequence; identical to SEQ ID NO: 562
  Synthetic polynucleotide

SEQ ID NO: 564 - DNA, 172 bp, Artificial Sequence
  Synthetic polynucleotide
atcatctcaccttgcctcctgaatcactgtcaggtgctcctgcaggcgtctagacaagacgtctagacatcgcgtctagacagaccgtctagacactacgtctagacaactcgtctagacatgccgtctagacagtacgtctagacaggcgcgccatgcttcatcagactct

SEQ ID NO: 565 - DNA, 172 bp, Artificial Sequence; identical to SEQ ID NO: 564
  Synthetic polynucleotide

SEQ ID NO: 566 - DNA, 191 bp, Artificial Sequence
  Synthetic polynucleotide
atcatctcaccttgcctcctgtctacatggatctctcccctgcaggtagtgaacaatagatttagatagtgaacaatagattttcgtagtgaacaatagatttgactagtgaacaatagatttctatagtgaacaatagatttacttagtgaacaatagattttgcggcgcgccatgcttcatcagactct

SEQ ID NO: 567 - DNA, 191 bp, Artificial Sequence; identical to SEQ ID NO: 566
  Synthetic polynucleotide

SEQ ID NO: 568 - DNA, 197 bp, Artificial Sequence
  Synthetic polynucleotide
atcatctcaccttgcctcctgcacctaaggatttccatcctgcaggagaacattctgttctagaagaacattctgttcttcgagaacattctgttctgacagaacattctgttctctaagaacattctgttctactagaacattctgttcttgcagaacattctgttctgtaggcgcgccatgcttcatcagactct

SEQ ID NO: 569 - DNA, 197 bp, Artificial Sequence; identical to SEQ ID NO: 568
  Synthetic polynucleotide

SEQ ID NO: 570 - DNA, 148 bp, Artificial Sequence
  Synthetic polynucleotide
atcatctcaccttgcctcctgtattgctctgattgcaccctgcaggaagataaagaaagataatcgaagataagacaagataactaaagataaactaagataatgcaagataagtaaagataaggcgcgccatgcttcatcagactct

SEQ ID NO: 571 - DNA, 148 bp, Artificial Sequence; identical to SEQ ID NO: 570
  Synthetic polynucleotide

SEQ ID NO: 572 - DNA, 185 bp, Artificial Sequence
  Synthetic polynucleotide
atcatctcaccttgcctcctggctgagatgtgggatcccctgcaggaaggtaattacctaatagaaaggtaattacctaattcgaaggtaattacctaatgacaaggtaattacctaatctaaaggtaattacctaatactaaggtaattacctaattgcggcgcgccatgcttcatcagactct

SEQ ID NO: 573 - DNA, 185 bp, Artificial Sequence; identical to SEQ ID NO: 572
  Synthetic polynucleotide

SEQ ID NO: 574 - DNA, 172 bp, Artificial Sequence
  Synthetic polynucleotide
atcatctcaccttgcctcctgagacacgttagcagaatcctgcaggaaaacaatggagaaaaacaatggtcgaaaacaatgggacaaaacaatggctaaaaacaatggactaaaacaatggtgcaaaacaatgggtaaaaacaatggggcgcgccatgcttcatcagactct

SEQ ID NO: 575 - DNA, 172 bp, Artificial Sequence; identical to SEQ ID NO: 574
  Synthetic polynucleotide

SEQ ID NO: 576 - DNA, 185 bp, Artificial Sequence
  Synthetic polynucleotide
atcatctcaccttgcctcctgtgttcagcgacgttacccctgcagggatggactttggactcagagatggactttggactctcggatggactttggactcgacgatggactttggactcctagatggactttggactcactgatggactttggactctgcggcgcgccatgcttcatcagactct

SEQ ID NO: 577 - DNA, 185 bp, Artificial Sequence; identical to SEQ ID NO: 576
  Synthetic polynucleotide

SEQ ID NO: 578 - DNA, 197 bp, Artificial Sequence
  Synthetic polynucleotide
atcatctcaccttgcctcctgcagcctgagtaatcaagcctgcaggaagatggcggccgccagaaagatggcggccgcctcgaagatggcggccgccgacaagatggcggccgccctaaagatggcggccgccactaagatggcggccgcctgcaagatggcggccgccgtaggcgcgccatgcttcatcagactct

SEQ ID NO: 579 - DNA, 197 bp, Artificial Sequence; identical to SEQ ID NO: 578
  Synthetic polynucleotide

SEQ ID NO: 580 - DNA, 180 bp, Artificial Sequence
  Synthetic polynucleotide
atcatctcaccttgcctcctgggacaaaggtatgcgtgcctgcaggaaaataaacatagaaaaataaacattcgaaaataaacatgacaaaataaacatctaaaaataaacatactaaaataaacattgcaaaataaacatgtaaaaataaacatggcgcgccatgcttcatcagactct

SEQ ID NO: 581 - DNA, 180 bp, Artificial Sequence; identical to SEQ ID NO: 580
  Synthetic polynucleotide

SEQ ID NO: 582 - DNA, 190 bp, Artificial Sequence
  Synthetic polynucleotide
atcatctcaccttgcctcctggtgtgtctcacgttgctcctgcaggtcgctgtgtcattcagatcgctgtgtcattctcgtcgctgtgtcattcgactcgctgtgtcattcctatcgctgtgtcattcacttcgctgtgtcattctgctcgctgtgtcattcgtaggcgcgccatgcttcatcagactct

SEQ ID NO: 583 - DNA, 190 bp, Artificial Sequence; identical to SEQ ID NO: 582
  Synthetic polynucleotide

SEQ ID NO: 584 - DNA, 172 bp, Artificial Sequence
  Synthetic polynucleotide
atcatctcaccttgcctcctgcgggatttatgcttacccctgcagggggctttcccagagggctttccctcggggctttcccgacgggctttcccctagggctttcccactgggctttccctgcgggctttcccgtagggctttcccggcgcgccatgcttcatcagactct

SEQ ID NO: 585 - DNA, 172 bp, Artificial Sequence; identical to SEQ ID NO: 584
  Synthetic polynucleotide

SEQ ID NO: 586 - DNA, 156 bp, Artificial Sequence
  Synthetic polynucleotide
atcatctcaccttgcctcctgcggatcatctccaattccctgcaggctttgatcagactttgatctcgctttgatcgacctttgatcctactttgatcactctttgatctgcctttgatcgtactttgatcggcgcgccatgcttcatcagactct

SEQ ID NO: 587 - DNA, 156 bp, Artificial Sequence; identical to SEQ ID NO: 586
  Synthetic polynucleotide

SEQ ID NO: 588 - DNA, 156 bp, Artificial Sequence
  Synthetic polynucleotide
atcatctcaccttgcctcctggaattgacgttctcagacctgcaggaggtgtgaagaaggtgtgatcgaggtgtgagacaggtgtgactaaggtgtgaactaggtgtgatgcaggtgtgagtaaggtgtgaggcgcgccatgcttcatcagactct

SEQ ID NO: 589 - DNA, 156 bp, Artificial Sequence; identical to SEQ ID NO: 588
  Synthetic polynucleotide

SEQ ID NO: 590 - DNA, 156 bp, Artificial Sequence
  Synthetic polynucleotide
atcatctcaccttgcctcctgtccacaggatgagggcacctgcaggaccgttatagaaccgttattcgaccgttatgacaccgttatctaaccgttatactaccgttattgcaccgttatgtaaccgttatggcgcgccatgcttcatcagactct

SEQ ID NO: 591 - DNA, 156 bp, Artificial Sequence; identical to SEQ ID NO: 590
  Synthetic polynucleotide

SEQ ID NO: 592 - DNA, 156 bp, Artificial Sequence
  Synthetic polynucleotide
atcatctcaccttgcctcctgggtcatatatctcatctcctgcagggttaatgaagagttaatgatcggttaatgagacgttaatgactagttaatgaactgttaatgatgcgttaatgagtagttaatgaggcgcgccatgcttcatcagactct

SEQ ID NO: 593 - DNA, 156 bp, Artificial Sequence; identical to SEQ ID NO: 592
  Synthetic polynucleotide

SEQ ID NO: 594 - DNA, 197 bp, Artificial Sequence
  Synthetic polynucleotide
atcatctcaccttgcctcctgacgtcataaccctccgtcctgcagggacatgtctggacatgtcagagacatgtctggacatgtctcggacatgtctggacatgtcgacgacatgtctggacatgtcctagacatgtctggacatgtcactgacatgtctggacatgtctgcggcgcgccatgcttcatcagactct

SEQ ID NO: 595 - DNA, 197 bp, Artificial Sequence; identical to SEQ ID NO: 594
  Synthetic polynucleotide

SEQ ID NO: 596 - DNA, 172 bp, Artificial Sequence
  Synthetic polynucleotide
atcatctcaccttgcctcctgcaggtgaagctaatcaccctgcaggtgaccttgatagatgaccttgattcgtgaccttgatgactgaccttgatctatgaccttgatacttgaccttgattgctgaccttgatgtatgaccttgatggcgcgccatgcttcatcagactct

SEQ ID NO: 597 - DNA, 172 bp, Artificial Sequence; identical to SEQ ID NO: 596
  Synthetic polynucleotide

SEQ ID NO: 598 - DNA, 191 bp, Artificial Sequence
  Synthetic polynucleotide
atcatctcaccttgcctcctgtagccaggcgacttaaacctgcagggttgcgggtacagagtgttctagggaaagagttgcgggtacagagtgttctagggaatcggttgcgggtacagagtgttctagggaagacgttgcgggtacagagtgttctagggaactaggcgcgccatgcttcatcagactct

SEQ ID NO: 599 - DNA, 191 bp, Artificial Sequence; identical to SEQ ID NO: 598
  Synthetic polynucleotide

SEQ ID NO: 600 - DNA, 156 bp, Artificial Sequence
  Synthetic polynucleotide
atcatctcaccttgcctcctggtcgtcgaccctatttccctgcaggtaacaatgagataacaatgtcgtaacaatggactaacaatgctataacaatgacttaacaatgtgctaacaatggtataacaatgggcgcgccatgcttcatcagactct

SEQ ID NO: 601 - DNA, 156 bp, Artificial Sequence; identical to SEQ ID NO: 600
  Synthetic polynucleotide

SEQ ID NO: 602 - DNA, 185 bp, Artificial Sequence
  Synthetic polynucleotide
atcatctcaccttgcctcctgctgtagcgcactgagaccctgcaggaaagacctgtcaatacagaaaagacctgtcaatactcgaaagacctgtcaatacgacaaagacctgtcaatacctaaaagacctgtcaatacactaaagacctgtcaatactgcggcgcgccatgcttcatcagactct

SEQ ID NO: 603 - DNA, 185 bp, Artificial Sequence; identical to SEQ ID NO: 602
  Synthetic polynucleotide

SEQ ID NO: 604 - DNA, 180 bp, Artificial Sequence
  Synthetic polynucleotide
atcatctcaccttgcctcctgcagcataaacttgactacctgcaggaacgacgctttagaaacgacgcttttcgaacgacgctttgacaacgacgctttctaaacgacgctttactaacgacgcttttgcaacgacgctttgtaaacgacgctttggcgcgccatgcttcatcagactct

SEQ ID NO: 605 - DNA, 180 bp, Artificial Sequence; identical to SEQ ID NO: 604
  Synthetic polynucleotide

SEQ ID NO: 606 - DNA, 197 bp, Artificial Sequence
  Synthetic polynucleotide
atcatctcaccttgcctcctgcacaacgtaccgcactacctgcaggttctctccagtatgaagattctctccagtatgatcgttctctccagtatgagacttctctccagtatgactattctctccagtatgaactttctctccagtatgatgcttctctccagtatgagtaggcgcgccatgcttcatcagactct

SEQ ID NO: 607 - DNA, 197 bp, Artificial Sequence; identical to SEQ ID NO: 606
  Synthetic polynucleotide

SEQ ID NO: 608 - DNA, 188 bp, Artificial Sequence
  Synthetic polynucleotide
atcatctcaccttgcctcctgtcccgtgttgtgctcgtcctgcaggaattagcatagaagaaattagcatagatcgaattagcatagagacaattagcatagactaaattagcatagaactaattagcatagatgcaattagcatagagtaaattagcatagaggcgcgccatgcttcatcagactct

SEQ ID NO: 609 - DNA, 188 bp, Artificial Sequence; identical to SEQ ID NO: 608
  Synthetic polynucleotide

SEQ ID NO: 610 - DNA, 172 bp, Artificial Sequence
  Synthetic polynucleotide
atcatctcaccttgcctcctggaacgaggcgatgcgatcctgcaggcacaggtgttagacacaggtgtttcgcacaggtgttgaccacaggtgttctacacaggtgttactcacaggtgtttgccacaggtgttgtacacaggtgttggcgcgccatgcttcatcagactct

SEQ ID NO: 611 - DNA, 172 bp, Artificial Sequence; identical to SEQ ID NO: 610
  Synthetic polynucleotide

SEQ ID NO: 612 - DNA, 180 bp, Artificial Sequence
  Synthetic polynucleotide
atcatctcaccttgcctcctgagatcgcgtctgctaaccctgcaggtgacaggtgttagatgacaggtgtttcgtgacaggtgttgactgacaggtgttctatgacaggtgttacttgacaggtgtttgctgacaggtgttgtatgacaggtgttggcgcgccatgcttcatcagactct

SEQ ID NO: 613 - DNA, 180 bp, Artificial Sequence; identical to SEQ ID NO: 612
  Synthetic polynucleotide

SEQ ID NO: 614 - DNA, 185 bp, Artificial Sequence
  Synthetic polynucleotide
atcatctcaccttgcctcctgtgtctgtcctttggccacctgcagggaacaattgcagtgttagagaacaattgcagtgtttcggaacaattgcagtgttgacgaacaattgcagtgttctagaacaattgcagtgttactgaacaattgcagtgtttgcggcgcgccatgcttcatcagactct

SEQ ID NO: 615 - DNA, 185 bp, Artificial Sequence; identical to SEQ ID NO: 614
  Synthetic polynucleotide

SEQ ID NO: 616 - DNA, 197 bp, Artificial Sequence
  Synthetic polynucleotide
atcatctcaccttgcctcctgtatagccggtcgggtctcctgcaggctggccccgccccctagactggccccgcccccttcgctggccccgccccctgacctggccccgccccctctactggccccgccccctactctggccccgcccccttgcctggccccgccccctgtaggcgcgccatgcttcatcagactct

SEQ ID NO: 617 - DNA, 197 bp, Artificial Sequence; identical to SEQ ID NO: 616
  Synthetic polynucleotide

SEQ ID NO: 618 - DNA, 164 bp, Artificial Sequence
  Synthetic polynucleotide
atcatctcaccttgcctcctggtggccgcactgtaagtcctgcaggatgttcccaagaatgttcccatcgatgttcccagacatgttcccactaatgttcccaactatgttcccatgcatgttcccagtaatgttcccaggcgcgccatgcttcatcagactct

SEQ ID NO: 619 - DNA, 164 bp, Artificial Sequence; identical to SEQ ID NO: 618
  Synthetic polynucleotide

SEQ ID NO: 620 - DNA, 197 bp, Artificial Sequence
  Synthetic polynucleotide
atcatctcaccttgcctcctgagtatccttatacaggacctgcagggttgccatggcgacgagagttgccatggcgacgtcggttgccatggcgacggacgttgccatggcgacgctagttgccatggcgacgactgttgccatggcgacgtgcgttgccatggcgacggtaggcgcgccatgcttcatcagactct

SEQ ID NO: 621 - DNA, 197 bp, Artificial Sequence; identical to SEQ ID NO: 620
  Synthetic polynucleotide

SEQ ID NO: 622 - DNA, 191 bp, Artificial Sequence
  Synthetic polynucleotide
atcatctcaccttgcctcctgatctactgtatacaggacctgcaggccggcgccccctggtggagaccggcgccccctggtggtcgccggcgccccctggtgggacccggcgccccctggtggctaccggcgccccctggtggactccggcgccccctggtggtgcggcgcgccatgcttcatcagactct

SEQ ID NO: 623 - DNA, 191 bp, Artificial Sequence; identical to SEQ ID NO: 622
  Synthetic polynucleotide

SEQ ID NO: 624 - DNA, 188 bp, Artificial Sequence
  Synthetic polynucleotide
atcatctcaccttgcctcctggtattgtatggaaatggcctgcaggtttattaaccctagatttattaacccttcgtttattaaccctgactttattaaccctctatttattaaccctacttttattaacccttgctttattaaccctgtatttattaaccctggcgcgccatgcttcatcagactct

SEQ ID NO: 625 - DNA, 188 bp, Artificial Sequence; identical to SEQ ID NO: 624
  Synthetic polynucleotide

SEQ ID NO: 626 - DNA, 197 bp, Artificial Sequence
  Synthetic polynucleotide
atcatctcaccttgcctcctgcatgttatgttggtggtcctgcaggaaccctttgatctttagaaaccctttgatcttttcgaaccctttgatctttgacaaccctttgatctttctaaaccctttgatctttactaaccctttgatcttttgcaaccctttgatctttgtaggcgcgccatgcttcatcagactct

SEQ ID NO: 627 - DNA, 197 bp, Artificial Sequence; identical to SEQ ID NO: 626
  Synthetic polynucleotide

SEQ ID NO: 628 - DNA, 188 bp, Artificial Sequence
  Synthetic polynucleotide
atcatctcaccttgcctcctgacgttcctcgggatctgcctgcaggtctaaaaatagaagatctaaaaatagatcgtctaaaaatagagactctaaaaatagactatctaaaaatagaacttctaaaaatagatgctctaaaaatagagtatctaaaaatagaggcgcgccatgcttcatcagactct

SEQ ID NO: 629 - DNA, 188 bp, Artificial Sequence; identical to SEQ ID NO: 628
  Synthetic polynucleotide

SEQ ID NO: 630 - DNA, 185 bp, Artificial Sequence
  Synthetic polynucleotide
atcatctcaccttgcctcctgatgaccaatattgccgtcctgcagggtagtaattaatggaaagagtagtaattaatggaatcggtagtaattaatggaagacgtagtaattaatggaactagtagtaattaatggaaactgtagtaattaatggaatgcggcgcgccatgcttcatcagactct

SEQ ID NO: 631 - DNA, 185 bp, Artificial Sequence; identical to SEQ ID NO: 630
  Synthetic polynucleotide

SEQ ID NO: 632 - DNA, 197 bp, Artificial Sequence
  Synthetic polynucleotide
atcatctcaccttgcctcctgcctccacgatgtaggaacctgcagggcaattaaaaaccaattaagagcaattaaaaaccaattatcggcaattaaaaaccaattagacgcaattaaaaaccaattactagcaattaaaaaccaattaactgcaattaaaaaccaattatgcggcgcgccatgcttcatcagactct

SEQ ID NO: 633 - DNA, 197 bp, Artificial Sequence; identical to SEQ ID NO: 632
  Synthetic polynucleotide

SEQ ID NO: 634 - DNA, 156 bp, Artificial Sequence
  Synthetic polynucleotide
atcatctcaccttgcctcctggtcctagtggtattacgcctgcaggatgcaaatagaatgcaaattcgatgcaaatgacatgcaaatctaatgcaaatactatgcaaattgcatgcaaatgtaatgcaaatggcgcgccatgcttcatcagactct

SEQ ID NO: 635 - DNA, 156 bp, Artificial Sequence; identical to SEQ ID NO: 634
  Synthetic polynucleotide

SEQ ID NO: 636 - DNA, 164 bp, Artificial Sequence
  Synthetic polynucleotide
atcatctcaccttgcctcctgcatgcagagaaggataccctgcagggtggtgagtagagtggtgagttcggtggtgagtgacgtggtgagtctagtggtgagtactgtggtgagttgcgtggtgagtgtagtggtgagtggcgcgccatgcttcatcagactct

SEQ ID NO: 637 - DNA, 164 bp, Artificial Sequence; identical to SEQ ID NO: 636
  Synthetic polynucleotide

SEQ ID NO: 638 - DNA, 191 bp, Artificial Sequence
  Synthetic polynucleotide
atcatctcaccttgcctcctgtccagggtaaatccaaccctgcaggcggtacaccgtgtacccagacggtacaccgtgtaccctcgcggtacaccgtgtacccgaccggtacaccgtgtacccctacggtacaccgtgtacccactcggtacaccgtgtaccctgcggcgcgccatgcttcatcagactct

SEQ ID NO: 639 - DNA, 191 bp, Artificial Sequence; identical to SEQ ID NO: 638
  Synthetic polynucleotide

SEQ ID NO: 640 - DNA, 188 bp, Artificial Sequence
  Synthetic polynucleotide
atcatctcaccttgcctcctgacttacttagcaaaccccctgcaggtgaccttgagctagatgaccttgagcttcgtgaccttgagctgactgaccttgagctctatgaccttgagctacttgaccttgagcttgctgaccttgagctgtatgaccttgagctggcgcgccatgcttcatcagactct

SEQ ID NO: 641 - DNA, 188 bp, Artificial Sequence; identical to SEQ ID NO: 640
  Synthetic polynucleotide

SEQ ID NO: 642 - DNA, 196 bp, Artificial Sequence
  Synthetic polynucleotide
atcatctcaccttgcctcctgaagaaggccctataggacctgcaggggccataaatcacagaggccataaatcactcgggccataaatcacgacggccataaatcacctaggccataaatcacactggccataaatcactgcggccataaatcacgtaggccataaatcacggcgcgccatgcttcatcagactct

SEQ ID NO: 643 - DNA, 196 bp, Artificial Sequence; identical to SEQ ID NO: 642
  Synthetic polynucleotide

SEQ ID NO: 644 - DNA, 164 bp, Artificial Sequence
  Synthetic polynucleotide
atcatctcaccttgcctcctgtgagctcggattgactacctgcaggaaggaagtaagaaaggaagtatcgaaggaagtagacaaggaagtactaaaggaagtaactaaggaagtatgcaaggaagtagtaaaggaagtaggcgcgccatgcttcatcagactct

SEQ ID NO: 645 - DNA, 164 bp, Artificial Sequence; identical to SEQ ID NO: 644
  Synthetic polynucleotide

SEQ ID NO: 646 - DNA, 190 bp, Artificial Sequence
  Synthetic polynucleotide
atcatctcaccttgcctcctgcagacgcttaatccgatcctgcaggggcgctgtccggggagaggcgctgtccggggtcgggcgctgtccgggggacggcgctgtccggggctaggcgctgtccggggactggcgctgtccggggtgcggcgctgtccgggggtaggcgcgccatgcttcatcagactct

SEQ ID NO: 647 - DNA, 190 bp, Artificial Sequence; identical to SEQ ID NO: 646
  Synthetic polynucleotide

SEQ ID NO: 648 - DNA, 188 bp, Artificial Sequence
  Synthetic polynucleotide
atcatctcaccttgcctcctgggtagtcactgtacgcccctgcagggatgacgtcatcagagatgacgtcatctcggatgacgtcatcgacgatgacgtcatcctagatgacgtcatcactgatgacgtcatctgcgatgacgtcatcgtagatgacgtcatcggcgcgccatgcttcatcagactct

SEQ ID NO: 649 - DNA, 188 bp, Artificial Sequence; identical to SEQ ID NO: 648
  Synthetic polynucleotide

SEQ ID NO: 650 - DNA, 172 bp, Artificial Sequence
  Synthetic polynucleotide
atcatctcaccttgcctcctgtacctcaagccattgctcctgcaggactaattaccagaactaattacctcgactaattaccgacactaattaccctaactaattaccactactaattacctgcactaattaccgtaactaattaccggcgcgccatgcttcatcagactct

SEQ ID NO: 651 - DNA, 172 bp, Artificial Sequence; identical to SEQ ID NO: 650
  Synthetic polynucleotide

SEQ ID NO: 652 - DNA, 172 bp, Artificial Sequence
  Synthetic polynucleotide
atcatctcaccttgcctcctgaagaatccaacagataccctgcagggtacccgcatagagtacccgcattcggtacccgcatgacgtacccgcatctagtacccgcatactgtacccgcattgcgtacccgcatgtagtacccgcatggcgcgccatgcttcatcagactct

SEQ ID NO: 653 - DNA, 172 bp, Artificial Sequence; identical to SEQ ID NO: 652
  Synthetic polynucleotide

SEQ ID NO: 654 - DNA, 156 bp, Artificial Sequence
  Synthetic polynucleotide
atcatctcaccttgcctcctgtagtcaaagaatggatccctgcaggaggagcacagaaggagcactcgaggagcacgacaggagcacctaaggagcacactaggagcactgcaggagcacgtaaggagcacggcgcgccatgcttcatcagactct

SEQ ID NO: 655 - DNA, 156 bp, Artificial Sequence; identical to SEQ ID NO: 654
  Synthetic polynucleotide

SEQ ID NO: 656 - DNA, 198 bp, Artificial Sequence
  Synthetic polynucleotide
atcatctcaccttgcctcctggatgatgaagggccttccctgcaggggcagagggcaaaggtcagggggagaggcagagggcaaaggtcagggggtcgggcagagggcaaaggtcaggggggacggcagagggcaaaggtcagggggctaggcagagggcaaaggtcagggggggcgcgccatgcttcatcagactct

SEQ ID NO: 657 - DNA, 198 bp, Artificial Sequence; identical to SEQ ID NO: 656
  Synthetic polynucleotide

SEQ ID NO: 658 - DNA, 172 bp, Artificial Sequence
  Synthetic polynucleotide
atcatctcaccttgcctcctgcctcgaggtcttggtaacctgcaggtgcgtgcgtgagatgcgtgcgtgtcgtgcgtgcgtggactgcgtgcgtgctatgcgtgcgtgacttgcgtgcgtgtgctgcgtgcgtggtatgcgtgcgtgggcgcgccatgcttcatcagactct

SEQ ID NO: 659 - DNA, 172 bp, Artificial Sequence; identical to SEQ ID NO: 658
  Synthetic polynucleotide

SEQ ID NO: 660 - DNA, 186 bp, Artificial Sequence
  Synthetic polynucleotide
atcatctcaccttgcctcctgacagttccagggtggctcctgcagggggggtcacccagaggtcacagagggggtcacccagaggtcactcggggggtcacccagaggtcacgacgggggtcacccagaggtcacctagggggtcacccagaggtcacactggcgcgccatgcttcatcagactct

SEQ ID NO: 661 - DNA, 186 bp, Artificial Sequence; identical to SEQ ID NO: 660
  Synthetic polynucleotide

SEQ ID NO: 662 - DNA, 197 bp, Artificial Sequence
  Synthetic polynucleotide
atcatctcaccttgcctcctgttcgacggtgagatggacctgcaggatgaataacattcatagaatgaataacattcattcgatgaataacattcatgacatgaataacattcatctaatgaataacattcatactatgaataacattcattgcatgaataacattcatgtaggcgcgccatgcttcatcagactct

SEQ ID NO: 663 - DNA, 197 bp, Artificial Sequence; identical to SEQ ID NO: 662
  Synthetic polynucleotide

SEQ ID NO: 664 - DNA, 190 bp, Artificial Sequence
  Synthetic polynucleotide
atcatctcaccttgcctcctgcaccatcgtactgaactcctgcaggaggggatttccaggagaaggggatttccaggtcgaggggatttccagggacaggggatttccaggctaaggggatttccaggactaggggatttccaggtgcaggggatttccagggtaggcgcgccatgcttcatcagactct

SEQ ID NO: 665 - DNA, 190 bp, Artificial Sequence; identical to SEQ ID NO: 664
  Synthetic polynucleotide

SEQ ID NO: 666 - DNA, 172 bp, Artificial Sequence
  Synthetic polynucleotide
atcatctcaccttgcctcctggtttggctatattacgtcctgcaggatcaccccatagaatcaccccattcgatcaccccatgacatcaccccatctaatcaccccatactatcaccccattgcatcaccccatgtaatcaccccatggcgcgccatgcttcatcagactct

SEQ ID NO: 667 - DNA, 172 bp, Artificial Sequence; identical to SEQ ID NO: 666
  Synthetic polynucleotide

SEQ ID NO: 668 - DNA, 197 bp, Artificial Sequence
  Synthetic polynucleotide
atcatctcaccttgcctcctgtttgtgtccagcctggtcctgcaggacgtttgtggttagcagaacgtttgtggttagctcgacgtttgtggttagcgacacgtttgtggttagcctaacgtttgtggttagcactacgtttgtggttagctgcacgtttgtggttagcgtaggcgcgccatgcttcatcagactct

SEQ ID NO: 669 - DNA, 197 bp, Artificial Sequence; identical to SEQ ID NO: 668
  Synthetic polynucleotide

SEQ ID NO: 670 - DNA, 197 bp, Artificial Sequence
  Synthetic polynucleotide
atcatctcaccttgcctcctgataatgcacaccgttctcctgcaggccagtatgaattctcagaccagtatgaattctctcgccagtatgaattctcgacccagtatgaattctcctaccagtatgaattctcactccagtatgaattctctgcccagtatgaattctcgtaggcgcgccatgcttcatcagactct

SEQ ID NO: 671 - DNA, 197 bp, Artificial Sequence; identical to SEQ ID NO: 670
  Synthetic polynucleotide

SEQ ID NO: 672 - DNA, 196 bp, Artificial Sequence
  Synthetic polynucleotide
atcatctcaccttgcctcctgagcgcagagcggacatacctgcaggtaacgacacgtgcagataacgacacgtgctcgtaacgacacgtgcgactaacgacacgtgcctataacgacacgtgcacttaacgacacgtgctgctaacgacacgtgcgtataacgacacgtgcggcgcgccatgcttcatcagactct

SEQ ID NO: 673 - DNA, 196 bp, Artificial Sequence; identical to SEQ ID NO: 672
  Synthetic polynucleotide

SEQ ID NO: 674 - DNA, 197 bp, Artificial Sequence
  Synthetic polynucleotide
atcatctcaccttgcctcctgacggaatcagtctattccctgcagggatttcctggaatttagagatttcctggaattttcggatttcctggaatttgacgatttcctggaatttctagatttcctggaatttactgatttcctggaattttgcgatttcctggaatttgtaggcgcgccatgcttcatcagactct

SEQ ID NO: 675 - DNA, 197 bp, Artificial Sequence; identical to SEQ ID NO: 674
  Synthetic polynucleotide

SEQ ID NO: 676 - DNA, 196 bp, Artificial Sequence
  Synthetic polynucleotide
atcatctcaccttgcctcctgtagtcctggtgggtacacctgcaggaggtgctatttttagcaccggaagaaggtgctatttttagcaccggatcgaggtgctatttttagcaccggagacaggtgctatttttagcaccggactaaggtgctatttttagcaccggaactggcgcgccatgcttcatcagactct

SEQ ID NO: 677 - DNA, 196 bp, Artificial Sequence; identical to SEQ ID NO: 676
  Synthetic polynucleotide

SEQ ID NO: 678 - DNA, 172 bp, Artificial Sequence
  Synthetic polynucleotide
atcatctcaccttgcctcctgtaccacctatggtgtgccctgcaggtatgaattatagatatgaattattcgtatgaattatgactatgaattatctatatgaattatacttatgaattattgctatgaattatgtatatgaattatggcgcgccatgcttcatcagactct

SEQ ID NO: 679 - DNA, 172 bp, Artificial Sequence; identical to SEQ ID NO: 678
  Synthetic polynucleotide

SEQ ID NO: 680 - DNA, 191 bp, Artificial Sequence
  Synthetic polynucleotide
atcatctcaccttgcctcctgaggtatgcgaagcctggcctgcaggtaaatagataccccataagataaatagataccccatatcgtaaatagataccccatagactaaatagataccccatactataaatagataccccataacttaaatagataccccatatgcggcgcgccatgcttcatcagactct

SEQ ID NO: 681 - DNA, 191 bp, Artificial Sequence; identical to SEQ ID NO: 680
  Synthetic polynucleotide

SEQ ID NO: 682 - DNA, 148 bp, Artificial Sequence
  Synthetic polynucleotide
atcatctcaccttgcctcctgcctgggcatacttaattcctgcaggttaattgagattaattgtcgttaattggacttaattgctattaattgactttaattgtgcttaattggtattaattgggcgcgccatgcttcatcagactct

SEQ ID NO: 683 - DNA, 148 bp, Artificial Sequence; identical to SEQ ID NO: 682
  Synthetic polynucleotide

SEQ ID NO: 684 - DNA, 199 bp, Artificial Sequence
  Synthetic polynucleotide
atcatctcaccttgcctcctgctattagggactccaagcctgcagggaacagatcaaactttagcttcaatacaaagagaacagatcaaactttagcttcaatacaatcggaacagatcaaactttagcttcaatacaagacgaacagatcaaactttagcttcaatacaactaggcgcgccatgcttcatcagactct

SEQ ID NO: 685 - DNA, 199 bp, Artificial Sequence; identical to SEQ ID NO: 684
  Synthetic polynucleotide

SEQ ID NO: 686 - DNA, 148 bp, Artificial Sequence
  Synthetic polynucleotide
atcatctcaccttgcctcctgtgtccatgaaaggtcttcctgcaggttaattaagattaattatcgttaattagacttaattactattaattaactttaattatgcttaattagtattaattaggcgcgccatgcttcatcagactct

SEQ ID NO: 687 - DNA, 148 bp, Artificial Sequence; identical to SEQ ID NO: 686
  Synthetic polynucleotide

SEQ ID NO: 688 - DNA, 156 bp, Artificial Sequence
  Synthetic polynucleotide
atcatctcaccttgcctcctggaaatgcgtttatctgccctgcaggataatgaaagaataatgaatcgataatgaagacataatgaactaataatgaaactataatgaatgcataatgaagtaataatgaaggcgcgccatgcttcatcagactct

SEQ ID NO: 689 - DNA, 156 bp, Artificial Sequence; identical to SEQ ID NO: 688
  Synthetic polynucleotide

SEQ ID NO: 690 - DNA, 185 bp, Artificial Sequence
  Synthetic polynucleotide
atcatctcaccttgcctcctgttagtttcaccatgtcgcctgcaggaaagacctgtcaatccagaaaagacctgtcaatcctcgaaagacctgtcaatccgacaaagacctgtcaatccctaaaagacctgtcaatccactaaagacctgtcaatcctgcggcgcgccatgcttcatcagactct

SEQ ID NO: 691 - DNA, 185 bp, Artificial Sequence; identical to SEQ ID NO: 690
  Synthetic polynucleotide

SEQ ID NO: 692 - DNA, 190 bp, Artificial Sequence
  Synthetic polynucleotide
atcatctcaccttgcctcctgaaagggacgtcagagggcctgcaggccatttcctggaaaagaccatttcctggaaatcgccatttcctggaaagacccatttcctggaaactaccatttcctggaaaactccatttcctggaaatgcccatttcctggaaagtaggcgcgccatgcttcatcagactct

SEQ ID NO: 693 - DNA, 190 bp, Artificial Sequence; identical to SEQ ID NO: 692
  Synthetic polynucleotide

SEQ ID NO: 694 - DNA, 191 bp, Artificial Sequence
  Synthetic polynucleotide
atcatctcaccttgcctcctgtgctgcactgccgaatacctgcaggtaacggttataacggccagataacggttataacggcctcgtaacggttataacggccgactaacggttataacggccctataacggttataacggccacttaacggttataacggcctgcggcgcgccatgcttcatcagactct

SEQ ID NO: 695 - DNA, 191 bp, Artificial Sequence; identical to SEQ ID NO: 694
  Synthetic polynucleotide

SEQ ID NO: 696 - DNA, 185 bp, Artificial Sequence
  Synthetic polynucleotide
atcatctcaccttgcctcctgtctcgaaattctcgcttcctgcaggaccgttaaaaccgttaagaaccgttaaaaccgttatcgaccgttaaaaccgttagacaccgttaaaaccgttactaaccgttaaaaccgttaactaccgttaaaaccgttatgcggcgcgccatgcttcatcagactct

SEQ ID NO: 697 - DNA, 185 bp, Artificial Sequence; identical to SEQ ID NO: 696
  Synthetic polynucleotide

SEQ ID NO: 698 - DNA, 180 bp, Artificial Sequence
  Synthetic polynucleotide
atcatctcaccttgcctcctgcgtctggtatgtaccctcctgcagggtgtagttaatagagtgtagttaattcggtgtagttaatgacgtgtagttaatctagtgtagttaatactgtgtagttaattgcgtgtagttaatgtagtgtagttaatggcgcgccatgcttcatcagactct

SEQ ID NO: 699 - DNA, 180 bp, Artificial Sequence; identical to SEQ ID NO: 698
  Synthetic polynucleotide

SEQ ID NO: 700 - DNA, 188 bp, Artificial Sequence
  Synthetic polynucleotide
atcatctcaccttgcctcctgactcacggaactcccagcctgcaggccgattttttccagaccgattttttcctcgccgattttttccgacccgattttttccctaccgattttttccactccgattttttcctgcccgattttttccgtaccgattttttccggcgcgccatgcttcatcagactct

SEQ ID NO: 701 - DNA, 188 bp, Artificial Sequence; identical to SEQ ID NO: 700
  Synthetic polynucleotide

SEQ ID NO: 702 - DNA, 156 bp, Artificial Sequence
  Synthetic polynucleotide
atcatctcaccttgcctcctggttatagccgatttggacctgcaggacatatggagaacatatggtcgacatatgggacacatatggctaacatatggactacatatggtgcacatatgggtaacatatggggcgcgccatgcttcatcagactct

SEQ ID NO: 703 - DNA, 156 bp, Artificial Sequence; identical to SEQ ID NO: 702
  Synthetic polynucleotide

SEQ ID NO: 704 - DNA, 164 bp, Artificial Sequence
  Synthetic polynucleotide
atcatctcaccttgcctcctggaatgaagtgcctgtatcctgcagggatccgggtagagatccgggttcggatccgggtgacgatccgggtctagatccgggtactgatccgggttgcgatccgggtgtagatccgggtggcgcgccatgcttcatcagactct

SEQ ID NO: 705 - DNA, 164 bp, Artificial Sequence; identical to SEQ ID NO: 704
  Synthetic polynucleotide

SEQ ID NO: 706 - DNA, 190 bp, Artificial Sequence
  Synthetic polynucleotide
atcatctcaccttgcctcctggaatggaccttgcatcgcctgcaggaactcatgcgtgaaagaaactcatgcgtgaatcgaactcatgcgtgaagacaactcatgcgtgaactaaactcatgcgtgaaactaactcatgcgtgaatgcaactcatgcgtgaagtaggcgcgccatgcttcatcagactct

SEQ ID NO: 707 - DNA, 190 bp, Artificial Sequence; identical to SEQ ID NO: 706
  Synthetic polynucleotide

SEQ ID NO: 708 - DNA, 180 bp, Artificial Sequence
  Synthetic polynucleotide
atcatctcaccttgcctcctggggtttactgaactaaacctgcaggggggattccccagaggggattcccctcgggggattccccgacggggattccccctaggggattccccactggggattcccctgcggggattccccgtaggggattccccggcgcgccatgcttcatcagactct

SEQ ID NO: 709 - DNA, 180 bp, Artificial Sequence; identical to SEQ ID NO: 708
  Synthetic polynucleotide

SEQ ID NO: 710 - DNA, 191 bp, Artificial Sequence
  Synthetic polynucleotide
atcatctcaccttgcctcctgttatgaattctggccaacctgcagggtccactaattagtggtagagtccactaattagtggttcggtccactaattagtggtgacgtccactaattagtggtctagtccactaattagtggtactgtccactaattagtggttgcggcgcgccatgcttcatcagactct

SEQ ID NO: 711 - DNA, 191 bp, Artificial Sequence; identical to SEQ ID NO: 710
  Synthetic polynucleotide

SEQ ID NO: 712 - DNA, 190 bp, Artificial Sequence
  Synthetic polynucleotide
atcatctcaccttgcctcctgatgtttctgtagatcagcctgcaggtgtcaatatttacaagatgtcaatatttacatcgtgtcaatatttacagactgtcaatatttacactatgtcaatatttacaacttgtcaatatttacatgctgtcaatatttacagtaggcgcgccatgcttcatcagactct

SEQ ID NO: 713 - DNA, 190 bp, Artificial Sequence; identical to SEQ ID NO: 712
  Synthetic polynucleotide

SEQ ID NO: 714 - DNA, 196 bp, Artificial Sequence
  Synthetic polynucleotide
atcatctcaccttgcctcctgacgtgctctgcctacatcctgcaggaaaagtaggtcagagaaaaagtaggtcagtcgaaaagtaggtcaggacaaaagtaggtcagctaaaaagtaggtcagactaaaagtaggtcagtgcaaaagtaggtcaggtaaaaagtaggtcagggcgcgccatgcttcatcagactct

SEQ ID NO: 715 - DNA, 196 bp, Artificial Sequence; identical to SEQ ID NO: 714
  Synthetic polynucleotide

SEQ ID NO: 716 - DNA, 197 bp, Artificial Sequence
  Synthetic polynucleotide
atcatctcaccttgcctcctggcagaaaccttccgctccctgcaggggcgggaaatttgaaagaggcgggaaatttgaatcgggcgggaaatttgaagacggcgggaaatttgaactaggcgggaaatttgaaactggcgggaaatttgaatgcggcgggaaatttgaagtaggcgcgccatgcttcatcagactct

SEQ ID NO: 717 - DNA, 197 bp, Artificial Sequence; identical to SEQ ID NO: 716
  Synthetic polynucleotide

SEQ ID NO: 718 - DNA, 186 bp, Artificial Sequence
  Synthetic polynucleotide
atcatctcaccttgcctcctgatacagacagaatactccctgcaggagtaggtcaccgtgacctacagaagtaggtcaccgtgacctactcgagtaggtcaccgtgacctacgacagtaggtcaccgtgacctacctaagtaggtcaccgtgacctacactggcgcgccatgcttcatcagactct

SEQ ID NO: 719 - DNA, 186 bp, Artificial Sequence; identical to SEQ ID NO: 718
  Synthetic polynucleotide

SEQ ID NO: 720 - DNA, 164 bp, Artificial Sequence
  Synthetic polynucleotide
atcatctcaccttgcctcctggtacgctaccggtaatgcctgcaggcgttcgaaaagacgttcgaaatcgcgttcgaaagaccgttcgaaactacgttcgaaaactcgttcgaaatgccgttcgaaagtacgttcgaaaggcgcgccatgcttcatcagactct

SEQ ID NO: 721 - DNA, 164 bp, Artificial Sequence; identical to SEQ ID NO: 720
  Synthetic polynucleotide

SEQ ID NO: 722 - DNA, 197 bp, Artificial Sequence
  Synthetic polynucleotide
atcatctcaccttgcctcctgtctatgcttcatgccgtcctgcaggactcacgcaatactgagaactcacgcaatactgtcgactcacgcaatactggacactcacgcaatactgctaactcacgcaatactgactactcacgcaatactgtgcactcacgcaatactggtaggcgcgccatgcttcatcagactct

SEQ ID NO: 723 - DNA, 197 bp, Artificial Sequence; identical to SEQ ID NO: 722
  Synthetic polynucleotide

SEQ ID NO: 724 - DNA, 190 bp, Artificial Sequence
  Synthetic polynucleotide
atcatctcaccttgcctcctgtactacaacctgaagagcctgcaggactaattacctcaaagaactaattacctcaatcgactaattacctcaagacactaattacctcaactaactaattacctcaaactactaattacctcaatgcactaattacctcaagtaggcgcgccatgcttcatcagactct

SEQ ID NO: 725 - DNA, 190 bp, Artificial Sequence; identical to SEQ ID NO: 724
  Synthetic polynucleotide

SEQ ID NO: 726 - DNA, 185 bp, Artificial Sequence
  Synthetic polynucleotide
atcatctcaccttgcctcctggtcacttagaggatccgcctgcaggtcgtacccgcatcattagatcgtacccgcatcatttcgtcgtacccgcatcattgactcgtacccgcatcattctatcgtacccgcatcattacttcgtacccgcatcatttgcggcgcgccatgcttcatcagactct

SEQ ID NO: 727 - DNA, 185 bp, Artificial Sequence; identical to SEQ ID NO: 726
  Synthetic polynucleotide

SEQ ID NO: 728 - DNA, 191 bp, Artificial Sequence
  Synthetic polynucleotide
atcatctcaccttgcctcctgaagttagccctgtcgatcctgcaggctttcccacaacacgacagactttcccacaacacgactcgctttcccacaacacgacgacctttcccacaacacgacctactttcccacaacacgacactctttcccacaacacgactgcggcgcgccatgcttcatcagactct

SEQ ID NO: 729 - DNA, 191 bp, Artificial Sequence; identical to SEQ ID NO: 728
  Synthetic polynucleotide

SEQ ID NO: 730 - DNA, 191 bp, Artificial Sequence
  Synthetic polynucleotide
atcatctcaccttgcctcctgttaaataggcctctgaccctgcagggtgctgaccccgcagccttcgagagtgctgaccccgcagccttcgtcggtgctgaccccgcagccttcggacgtgctgaccccgcagccttcgctagtgctgaccccgcagccttcgactggcgcgccatgcttcatcagactct

SEQ ID NO: 731 - DNA, 191 bp, Artificial Sequence; identical to SEQ ID NO: 730
  Synthetic polynucleotide

SEQ ID NO: 732 - DNA, 140 bp, Artificial Sequence
  Synthetic polynucleotide
atcatctcaccttgcctcctgattcctgaccaacttcgcctgcaggtggggaagatggggatcgtggggagactggggactatggggaacttggggatgctggggagtatggggaggcgcgccatgcttcatcagactct

SEQ ID NO: 733 - DNA, 140 bp, Artificial Sequence; identical to SEQ ID NO: 732
  Synthetic polynucleotide

SEQ ID NO: 734 - DNA, 156 bp, Artificial Sequence
  Synthetic polynucleotide
atcatctcaccttgcctcctggatccaggcttgaagtgcctgcaggaagttcacagaaagttcactcgaagttcacgacaagttcacctaaagttcacactaagttcactgcaagttcacgtaaagttcacggcgcgccatgcttcatcagactct

SEQ ID NO: 735 - DNA, 156 bp, Artificial Sequence; identical to SEQ ID NO: 734
  Synthetic polynucleotide

SEQ ID NO: 736 - DNA, 197 bp, Artificial Sequence
  Synthetic polynucleotide
atcatctcaccttgcctcctgccactgtacagacagaacctgcaggctggcactgtgccaaagactggcactgtgccaatcgctggcactgtgccaagacctggcactgtgccaactactggcactgtgccaaactctggcactgtgccaatgcctggcactgtgccaagtaggcgcgccatgcttcatcagactct

SEQ ID NO: 737 - DNA, 197 bp, Artificial Sequence; identical to SEQ ID NO: 736
  Synthetic polynucleotide

SEQ ID NO: 738 - DNA, 200 bp, Artificial Sequence
  Synthetic polynucleotide
atcatctcaccttgcctcctgctggagctgtagcgtcacctgcaggacaggtcactgtgacctgaagaacaggtcactgtgacctgatcgacaggtcactgtgacctgagacacaggtcactgtgacctgactaacaggtcactgtgacctgaactacaggtcactgtgacctgaggcgcgccatgcttcatcagactct

SEQ ID NO: 739 - DNA, 200 bp, Artificial Sequence; identical to SEQ ID NO: 738
  Synthetic polynucleotide

SEQ ID NO: 740 - DNA, 200 bp, Artificial Sequence
  Synthetic polynucleotide
atcatctcaccttgcctcctggttcctaggcagatcttcctgcaggaaaaattaacccaaaatccaacctcaccccagaaaaaattaacccaaaatccaacctcacccctcgaaaaattaacccaaaatccaacctcaccccgacaaaaattaacccaaaatccaacctcaccccggcgcgccatgcttcatcagactct

SEQ ID NO: 741 - DNA, 200 bp, Artificial Sequence; identical to SEQ ID NO: 740
  Synthetic polynucleotide

SEQ ID NO: 742 - DNA, 164 bp, Artificial Sequence
  Synthetic polynucleotide
atcatctcaccttgcctcctgtagtgtaggcagtaatgcctgcagggggattaagagagggattaagtcggggattaaggacgggattaagctagggattaagactgggattaagtgcgggattaaggtagggattaagggcgcgccatgcttcatcagactct

SEQ ID NO: 743 - DNA, 164 bp, Artificial Sequence; identical to SEQ ID NO: 742
  Synthetic polynucleotide

SEQ ID NO: 744 - DNA, 164 bp, Artificial Sequence
  Synthetic polynucleotide
atcatctcaccttgcctcctgtgaacacttcttgcgtccctgcaggttgacaggtagattgacaggttcgttgacaggtgacttgacaggtctattgacaggtactttgacaggttgcttgacaggtgtattgacaggtggcgcgccatgcttcatcagactct

SEQ ID NO: 745 - DNA, 164 bp, Artificial Sequence; identical to SEQ ID NO: 744
  Synthetic polynucleotide

SEQ ID NO: 746 - DNA, 180 bp, Artificial Sequence
  Synthetic polynucleotide
atcatctcaccttgcctcctgaccgaacagccatgggacctgcagggggtgactcatagagggtgactcattcggggtgactcatgacgggtgactcatctagggtgactcatactgggtgactcattgcgggtgactcatgtagggtgactcatggcgcgccatgcttcatcagactct

SEQ ID NO: 747 - DNA, 180 bp, Artificial Sequence; identical to SEQ ID NO: 746
  Synthetic polynucleotide

SEQ ID NO: 748 - DNA, 172 bp, Artificial Sequence
  Synthetic polynucleotide
atcatctcaccttgcctcctggtcttaggatgatccgacctgcagggccggaagtgagagccggaagtgtcggccggaagtggacgccggaagtgctagccggaagtgactgccggaagtgtgcgccggaagtggtagccggaagtgggcgcgccatgcttcatcagactct

SEQ ID NO: 749 - DNA, 172 bp, Artificial Sequence; identical to SEQ ID NO: 748
  Synthetic polynucleotide

SEQ ID NO: 750 - DNA, 185 bp, Artificial Sequence
  Synthetic polynucleotide
atcatctcaccttgcctcctgagaaccacagtatgcagcctgcaggatgtattaattaagtaagaatgtattaattaagtatcgatgtattaattaagtagacatgtattaattaagtactaatgtattaattaagtaactatgtattaattaagtatgcggcgcgccatgcttcatcagactct

SEQ ID NO: 751 - DNA, 185 bp, Artificial Sequence; identical to SEQ ID NO: 750
  Synthetic polynucleotide

SEQ ID NO: 752 - DNA, 190 bp, Artificial Sequence
  Synthetic polynucleotide
atcatctcaccttgcctcctgtctaccgaactaaatcccctgcaggcgaccacgtggtcaagacgaccacgtggtcatcgcgaccacgtggtcagaccgaccacgtggtcactacgaccacgtggtcaactcgaccacgtggtcatgccgaccacgtggtcagtaggcgcgccatgcttcatcagactct

SEQ ID NO: 753 - DNA, 190 bp, Artificial Sequence; identical to SEQ ID NO: 752
  Synthetic polynucleotide

SEQ ID NO: 754 - DNA, 191 bp, Artificial Sequence
  Synthetic polynucleotide
atcatctcaccttgcctcctgccttgctttagtcgctacctgcaggcagccgacacgtgccccagacagccgacacgtgcccctcgcagccgacacgtgccccgaccagccgacacgtgccccctacagccgacacgtgccccactcagccgacacgtgcccctgcggcgcgccatgcttcatcagactct

SEQ ID NO: 755 - DNA, 191 bp, Artificial Sequence; identical to SEQ ID NO: 754
  Synthetic polynucleotide

SEQ ID NO: 756 - DNA, 196 bp, Artificial Sequence
  Synthetic polynucleotide
atcatctcaccttgcctcctgaaacttgcgaacgggtccctgcaggttctataaatagaagattctataaatagatcgttctataaatagagacttctataaatagactattctataaatagaactttctataaatagatgcttctataaatagagtattctataaatagaggcgcgccatgcttcatcagactct

SEQ ID NO: 757 - DNA, 196 bp, Artificial Sequence; identical to SEQ ID NO: 756
  Synthetic polynucleotide

SEQ ID NO: 758 - DNA, 164 bp, Artificial Sequence
  Synthetic polynucleotide
atcatctcaccttgcctcctggtttctacatacgatgccctgcaggctgtttgctagactgtttgcttcgctgtttgctgacctgtttgctctactgtttgctactctgtttgcttgcctgtttgctgtactgtttgctggcgcgccatgcttcatcagactct

SEQ ID NO: 759 - DNA, 164 bp, Artificial Sequence; identical to SEQ ID NO: 758
  Synthetic polynucleotide

SEQ ID NO: 760 - DNA, 172 bp, Artificial Sequence
  Synthetic polynucleotide
atcatctcaccttgcctcctgtattgtgctaccgaaatcctgcaggaccacgtgctagaaccacgtgcttcgaccacgtgctgacaccacgtgctctaaccacgtgctactaccacgtgcttgcaccacgtgctgtaaccacgtgctggcgcgccatgcttcatcagactct

SEQ ID NO: 761 - DNA, 172 bp, Artificial Sequence; identical to SEQ ID NO: 760
  Synthetic polynucleotide

SEQ ID NO: 762 - DNA, 180 bp, Artificial Sequence
  Synthetic polynucleotide
atcatctcaccttgcctcctgaatgggttcggaaggcgcctgcaggtgacgtcatcgagatgacgtcatcgtcgtgacgtcatcggactgacgtcatcgctatgacgtcatcgacttgacgtcatcgtgctgacgtcatcggtatgacgtcatcgggcgcgccatgcttcatcagactct

SEQ ID NO: 763 - DNA, 180 bp, Artificial Sequence; identical to SEQ ID NO: 762
  Synthetic polynucleotide

SEQ ID NO: 764 - DNA, 180 bp, Artificial Sequence
  Synthetic polynucleotide
atcatctcaccttgcctcctgcgcccactggatataaacctgcaggttcacgcttgaagattcacgcttgatcgttcacgcttgagacttcacgcttgactattcacgcttgaactttcacgcttgatgcttcacgcttgagtattcacgcttgaggcgcgccatgcttcatcagactct

SEQ ID NO: 765 - DNA, 180 bp, Artificial Sequence; identical to SEQ ID NO: 764
  Synthetic polynucleotide

SEQ ID NO: 766 - DNA, 197 bp, Artificial Sequence
  Synthetic polynucleotide
atcatctcaccttgcctcctgtaatatgggatccgattcctgcagggcatgtcccgacatgagagcatgtcccgacatgtcggcatgtcccgacatggacgcatgtcccgacatgctagcatgtcccgacatgactgcatgtcccgacatgtgcgcatgtcccgacatggtaggcgcgccatgcttcatcagactct

SEQ ID NO: 767 - DNA, 197 bp, Artificial Sequence; identical to SEQ ID NO: 766
  Synthetic polynucleotide

SEQ ID NO: 768 - DNA, 164 bp, Artificial Sequence
  Synthetic polynucleotide
atcatctcaccttgcctcctgattgggtcgcttaaacacctgcaggagacagacaagaagacagacatcgagacagacagacagacagacactaagacagacaactagacagacatgcagacagacagtaagacagacaggcgcgccatgcttcatcagactct

SEQ ID NO: 769 - DNA, 164 bp, Artificial Sequence; identical to SEQ ID NO: 768
  Synthetic polynucleotide

SEQ ID NO: 770 - DNA, 148 bp, Artificial Sequence
  Synthetic polynucleotide
atcatctcaccttgcctcctggcttaacaccggtcgaccctgcaggagattggagaagattggtcgagattgggacagattggctaagattggactagattggtgcagattgggtaagattggggcgcgccatgcttcatcagactct

SEQ ID NO: 771 - DNA, 148 bp, Artificial Sequence; identical to SEQ ID NO: 770
  Synthetic polynucleotide

SEQ ID NO: 772 - DNA, 190 bp, Artificial Sequence
  Synthetic polynucleotide
atcatctcaccttgcctcctggcacccgacaataaccccctgcaggttcctttgatctttagattcctttgatcttttcgttcctttgatctttgacttcctttgatctttctattcctttgatctttactttcctttgatcttttgcttcctttgatctttgtaggcgcgccatgcttcatcagactct

SEQ ID NO: 773 - DNA, 190 bp, Artificial Sequence; identical to SEQ ID NO: 772
  Synthetic polynucleotide

SEQ ID NO: 774 - DNA, 180 bp, Artificial Sequence
  Synthetic polynucleotide
atcatctcaccttgcctcctgtacgcgaccaagtgtttcctgcaggaccgtgaccacagaaccgtgaccactcgaccgtgaccacgacaccgtgaccacctaaccgtgaccacactaccgtgaccactgcaccgtgaccacgtaaccgtgaccacggcgcgccatgcttcatcagactct

SEQ ID NO: 775 - DNA, 180 bp, Artificial Sequence; identical to SEQ ID NO: 774
  Synthetic polynucleotide

SEQ ID NO: 776 - DNA, 191 bp, Artificial Sequence
  Synthetic polynucleotide
atcatctcaccttgcctcctgtgacgctccacatagtgcctgcagggggtacacggtgtaccgagagggtacacggtgtaccgtcggggtacacggtgtaccggacgggtacacggtgtaccgctagggtacacggtgtaccgactgggtacacggtgtaccgtgcggcgcgccatgcttcatcagactct

SEQ ID NO: 777 - DNA, 191 bp, Artificial Sequence; identical to SEQ ID NO: 776
  Synthetic polynucleotide

SEQ ID NO: 778 - DNA, 190 bp, Artificial Sequence
  Synthetic polynucleotide
atcatctcaccttgcctcctgtaccgttgatgataagtcctgcaggcaaggtcattaaccagacaaggtcattaacctcgcaaggtcattaaccgaccaaggtcattaaccctacaaggtcattaaccactcaaggtcattaacctgccaaggtcattaaccgtaggcgcgccatgcttcatcagactct

SEQ ID NO: 779 - DNA, 190 bp, Artificial Sequence; identical to SEQ ID NO: 778
  Synthetic polynucleotide

SEQ ID NO: 780 - DNA, 180 bp, Artificial Sequence
  Synthetic polynucleotide
atcatctcaccttgcctcctgccaggagaatagcggctcctgcaggtgtttatttacagatgtttatttactcgtgtttatttacgactgtttatttacctatgtttatttacacttgtttatttactgctgtttatttacgtatgtttatttacggcgcgccatgcttcatcagactct

SEQ ID NO: 781 - DNA, 180 bp, Artificial Sequence; identical to SEQ ID NO: 780
  Synthetic polynucleotide

SEQ ID NO: 782 - DNA, 172 bp, Artificial Sequence
  Synthetic polynucleotide
atcatctcaccttgcctcctgtctgcagtcgaccagatcctgcaggtcacgtcaccagatcacgtcacctcgtcacgtcaccgactcacgtcaccctatcacgtcaccacttcacgtcacctgctcacgtcaccgtatcacgtcaccggcgcgccatgcttcatcagactct

SEQ ID NO: 783 - DNA, 172 bp, Artificial Sequence; identical to SEQ ID NO: 782
  Synthetic polynucleotide

SEQ ID NO: 784 - DNA, 197 bp, Artificial Sequence
  Synthetic polynucleotide
atcatctcaccttgcctcctggaatttattcgatggtccctgcaggccttatctgccccccccaagaccttatctgccccccccatcgccttatctgccccccccagacccttatctgccccccccactaccttatctgccccccccaactccttatctgccccccccatgcggcgcgccatgcttcatcagactct

SEQ ID NO: 785 - DNA, 197 bp, Artificial Sequence; identical to SEQ ID NO: 784
  Synthetic polynucleotide

SEQ ID NO: 786 - DNA, 156 bp, Artificial Sequence
  Synthetic polynucleotide
atcatctcaccttgcctcctgagggccgacatgtatcccctgcaggaggtgtcaagaaggtgtcatcgaggtgtcagacaggtgtcactaaggtgtcaactaggtgtcatgcaggtgtcagtaaggtgtcaggcgcgccatgcttcatcagactct

SEQ ID NO: 787 - DNA, 156 bp, Artificial Sequence; identical to SEQ ID NO: 786
  Synthetic polynucleotide

SEQ ID NO: 788 - DNA, 191 bp, Artificial Sequence
  Synthetic polynucleotide
atcatctcaccttgcctcctgtgatgctaatccttaaccctgcaggaactagggcaaaggtcaagaaactagggcaaaggtcatcgaactagggcaaaggtcagacaactagggcaaaggtcactaaactagggcaaaggtcaactaactagggcaaaggtcatgcggcgcgccatgcttcatcagactct

SEQ ID NO: 789 - DNA, 191 bp, Artificial Sequence; identical to SEQ ID NO: 788
  Synthetic polynucleotide

SEQ ID NO: 790 - DNA, 190 bp, Artificial Sequence
  Synthetic polynucleotide
atcatctcaccttgcctcctgctaactctcccaccggacctgcaggttcgctaattagccagattcgctaattagcctcgttcgctaattagccgacttcgctaattagccctattcgctaattagccactttcgctaattagcctgcttcgctaattagccgtaggcgcgccatgcttcatcagactct

SEQ ID NO: 791 - DNA, 190 bp, Artificial Sequence; identical to SEQ ID NO: 790
  Synthetic polynucleotide

SEQ ID NO: 792 - DNA, 156 bp, Artificial Sequence
  Synthetic polynucleotide
atcatctcaccttgcctcctgatcaggtttgggtttaccctgcaggttcattatagattcattattcgttcattatgacttcattatctattcattatactttcattattgcttcattatgtattcattatggcgcgccatgcttcatcagactct

SEQ ID NO: 793 - DNA, 156 bp, Artificial Sequence; identical to SEQ ID NO: 792
  Synthetic polynucleotide

SEQ ID NO: 794 - DNA, 197 bp, Artificial Sequence
  Synthetic polynucleotide
atcatctcaccttgcctcctgagtggtgagaagaactgcctgcaggagtgccatctagtggagaagtgccatctagtggtcgagtgccatctagtgggacagtgccatctagtggctaagtgccatctagtggactagtgccatctagtggtgcagtgccatctagtgggtaggcgcgccatgcttcatcagactct

SEQ ID NO: 795 - DNA, 197 bp, Artificial Sequence; identical to SEQ ID NO: 794
  Synthetic polynucleotide

SEQ ID NO: 796 - DNA, 191 bp, Artificial Sequence
  Synthetic polynucleotide
atcatctcaccttgcctcctgaataaagggatcagtgccctgcaggattttagttaactaaggagaattttagttaactaaggtcgattttagttaactaagggacattttagttaactaaggctaattttagttaactaaggactattttagttaactaaggtgcggcgcgccatgcttcatcagactct

SEQ ID NO: 797 - DNA, 191 bp, Artificial Sequence; identical to SEQ ID NO: 796
  Synthetic polynucleotide

SEQ ID NO: 798 - DNA, 180 bp, Artificial Sequence
  Synthetic polynucleotide
atcatctcaccttgcctcctggtgaattacccattccacctgcaggtttcacaccttagatttcacacctttcgtttcacaccttgactttcacaccttctatttcacaccttacttttcacacctttgctttcacaccttgtatttcacaccttggcgcgccatgcttcatcagactct

SEQ ID NO: 799 - DNA, 180 bp, Artificial Sequence; identical to SEQ ID NO: 798
  Synthetic polynucleotide

SEQ ID NO: 800 - DNA, 172 bp, Artificial Sequence
  Synthetic polynucleotide
atcatctcaccttgcctcctgccatgtcccagcgatgacctgcaggcactttcactagacactttcacttcgcactttcactgaccactttcactctacactttcactactcactttcacttgccactttcactgtacactttcactggcgcgccatgcttcatcagactct

SEQ ID NO: 801 - DNA, 172 bp, Artificial Sequence; identical to SEQ ID NO: 800
  Synthetic polynucleotide

SEQ ID NO: 802 - DNA, 196 bp, Artificial Sequence
  Synthetic polynucleotide
atcatctcaccttgcctcctggtctactagaatacctccctgcaggttccctagcaacaagattccctagcaacatcgttccctagcaacagacttccctagcaacactattccctagcaacaactttccctagcaacatgcttccctagcaacagtattccctagcaacaggcgcgccatgcttcatcagactct

SEQ ID NO: 803 - DNA, 196 bp, Artificial Sequence; identical to SEQ ID NO: 802
  Synthetic polynucleotide

SEQ ID NO: 804 - DNA, 186 bp, Artificial Sequence
  Synthetic polynucleotide
atcatctcaccttgcctcctggagaaagggtgtgattacctgcaggtgaattgtaaacaaagaggaagatgaattgtaaacaaagaggatcgtgaattgtaaacaaagaggagactgaattgtaaacaaagaggactatgaattgtaaacaaagaggaactggcgcgccatgcttcatcagactct

SEQ ID NO: 805 - DNA, 186 bp, Artificial Sequence; identical to SEQ ID NO: 804
  Synthetic polynucleotide

SEQ ID NO: 806 - DNA, 156 bp, Artificial Sequence
  Synthetic polynucleotide
atcatctcaccttgcctcctggtgttatcaaacagctccctgcaggaagtttcaagaaagtttcatcgaagtttcagacaagtttcactaaagtttcaactaagtttcatgcaagtttcagtaaagtttcaggcgcgccatgcttcatcagactct

SEQ ID NO: 807 - DNA, 156 bp, Artificial Sequence; identical to SEQ ID NO: 806
  Synthetic polynucleotide

SEQ ID NO: 808 - DNA, 191 bp, Artificial Sequence
  Synthetic polynucleotide
atcatctcaccttgcctcctggggtcgacaatccgcaacctgcagggaggtcaggtcaggtcaagagaggtcaggtcaggtcatcggaggtcaggtcaggtcagacgaggtcaggtcaggtcactagaggtcaggtcaggtcaactgaggtcaggtcaggtcatgcggcgcgccatgcttcatcagactct

SEQ ID NO: 809 - DNA, 191 bp, Artificial Sequence; identical to SEQ ID NO: 808
  Synthetic polynucleotide

SEQ ID NO: 810 - DNA, 191 bp, Artificial Sequence
  Synthetic polynucleotide
atcatctcaccttgcctcctggatattggatacgcatccctgcagggtgcactaattagtgcaagagtgcactaattagtgcatcggtgcactaattagtgcagacgtgcactaattagtgcactagtgcactaattagtgcaactgtgcactaattagtgcatgcggcgcgccatgcttcatcagactct

SEQ ID NO: 811 - DNA, 191 bp, Artificial Sequence; identical to SEQ ID NO: 810
  Synthetic polynucleotide

SEQ ID NO: 812 - DNA, 197 bp, Artificial Sequence
  Synthetic polynucleotide
atcatctcaccttgcctcctgacacatacccgtcagggcctgcaggggttgccatggcgacagaggttgccatggcgactcgggttgccatggcgacgacggttgccatggcgacctaggttgccatggcgacactggttgccatggcgactgcggttgccatggcgacgtaggcgcgccatgcttcatcagactct

SEQ ID NO: 813 - DNA, 197 bp, Artificial Sequence; identical to SEQ ID NO: 812
  Synthetic polynucleotide

SEQ ID NO: 814 - DNA, 200 bp, Artificial Sequence
  Synthetic polynucleotide
atcatctcaccttgcctcctgccgaaggttccaagctacctgcaggaggagagaaggggaagggaagaaagggagaagaaggagagaaggggaagggaagaaagggagatcgaggagagaaggggaagggaagaaagggagagacaggagagaaggggaagggaagaaagggagaggcgcgccatgcttcatcagactct

SEQ ID NO: 815 - DNA, 200 bp, Artificial Sequence; identical to SEQ ID NO: 814
  Synthetic polynucleotide

SEQ ID NO: 816 - DNA, 191 bp, Artificial Sequence
  Synthetic polynucleotide
atcatctcaccttgcctcctgggctgggaaattactatcctgcaggcgagttaattaataattagacgagttaattaataatttcgcgagttaattaataattgaccgagttaattaataattctacgagttaattaataattactcgagttaattaataatttgcggcgcgccatgcttcatcagactct

SEQ ID NO: 817 - DNA, 191 bp, Artificial Sequence; identical to SEQ ID NO: 816
  Synthetic polynucleotide

SEQ ID NO: 818 - DNA, 180 bp, Artificial Sequence
  Synthetic polynucleotide
atcatctcaccttgcctcctgtcaatcctcatgcgagacctgcagggcggcgcctgcagagcggcgcctgctcggcggcgcctgcgacgcggcgcctgcctagcggcgcctgcactgcggcgcctgctgcgcggcgcctgcgtagcggcgcctgcggcgcgccatgcttcatcagactct

SEQ ID NO: 819 - DNA, 180 bp, Artificial Sequence; identical to SEQ ID NO: 818
  Synthetic polynucleotide

SEQ ID NO: 820 - DNA, 140 bp, Artificial Sequence
  Synthetic polynucleotide
atcatctcaccttgcctcctgagctaagtggcctgccacctgcaggtttaatagatttaattcgtttaatgactttaatctatttaatacttttaattgctttaatgtatttaatggcgcgccatgcttcatcagactct

SEQ ID NO: 821 - DNA, 140 bp, Artificial Sequence; identical to SEQ ID NO: 820
  Synthetic polynucleotide

SEQ ID NO: 822 - DNA, 185 bp, Artificial Sequence
  Synthetic polynucleotide
atcatctcaccttgcctcctggtatcgtatctcaatcccctgcaggagttattaatgaggtcagaagttattaatgaggtctcgagttattaatgaggtcgacagttattaatgaggtcctaagttattaatgaggtcactagttattaatgaggtctgcggcgcgccatgcttcatcagactct

SEQ ID NO: 823 - DNA, 185 bp, Artificial Sequence; identical to SEQ ID NO: 822
  Synthetic polynucleotide

SEQ ID NO: 824 - DNA, 197 bp, Artificial Sequence
  Synthetic polynucleotide
atcatctcaccttgcctcctgtgagcagcttcaagaaccctgcagggtgccccctggtggcagagtgccccctggtggctcggtgccccctggtggcgacgtgccccctggtggcctagtgccccctggtggcactgtgccccctggtggctgcgtgccccctggtggcgtaggcgcgccatgcttcatcagactct

SEQ ID NO: 825 - DNA, 197 bp, Artificial Sequence; identical to SEQ ID NO: 824
  Synthetic polynucleotide

SEQ ID NO: 826 - DNA, 172 bp, Artificial Sequence
  Synthetic polynucleotide
atcatctcaccttgcctcctgagatcagagtccctaatcctgcaggaatgacgtcaagaaatgacgtcatcgaatgacgtcagacaatgacgtcactaaatgacgtcaactaatgacgtcatgcaatgacgtcagtaaatgacgtcaggcgcgccatgcttcatcagactct

SEQ ID NO: 827 - DNA, 172 bp, Artificial Sequence; identical to SEQ ID NO: 826
  Synthetic polynucleotide

SEQ ID NO: 828 - DNA, 156 bp, Artificial Sequence
  Synthetic polynucleotide
atcatctcaccttgcctcctgtgctcgcaactctactacctgcaggaagttcatagaaagttcattcgaagttcatgacaagttcatctaaagttcatactaagttcattgcaagttcatgtaaagttcatggcgcgccatgcttcatcagactct

SEQ ID NO: 829 - DNA, 156 bp, Artificial Sequence; identical to SEQ ID NO: 828
  Synthetic polynucleotide

SEQ ID NO: 830 - DNA, 188 bp, Artificial Sequence
  Synthetic polynucleotide
atcatctcaccttgcctcctgttctaatggtcataacgcctgcaggaattagcatacaagaaattagcatacatcgaattagcatacagacaattagcatacactaaattagcatacaactaattagcatacatgcaattagcatacagtaaattagcatacaggcgcgccatgcttcatcagactct

SEQ ID NO: 831 - DNA, 188 bp, Artificial Sequence; identical to SEQ ID NO: 830
  Synthetic polynucleotide

SEQ ID NO: 832 - DNA, 197 bp, Artificial Sequence
  Synthetic polynucleotide
atcatctcaccttgcctcctgagaagtaggttcgagggcctgcaggctacgcccacgcactagactacgcccacgcacttcgctacgcccacgcactgacctacgcccacgcactctactacgcccacgcactactctacgcccacgcacttgcctacgcccacgcactgtaggcgcgccatgcttcatcagactct

SEQ ID NO: 833 - DNA, 197 bp, Artificial Sequence; identical to SEQ ID NO: 832
  Synthetic polynucleotide

SEQ ID NO: 834 - DNA, 148 bp, Artificial Sequence
  Synthetic polynucleotide
atcatctcaccttgcctcctggttgatggtccggtcgacctgcaggattaataagaattaatatcgattaatagacattaatactaattaataactattaatatgcattaatagtaattaataggcgcgccatgcttcatcagactct

SEQ ID NO: 835 - DNA, 148 bp, Artificial Sequence; identical to SEQ ID NO: 834
  Synthetic polynucleotide

SEQ ID NO: 836 - DNA, 190 bp, Artificial Sequence
  Synthetic polynucleotide
atcatctcaccttgcctcctgacaccctcagtctcacacctgcaggatgaataattaatgagaatgaataattaatgtcgatgaataattaatggacatgaataattaatgctaatgaataattaatgactatgaataattaatgtgcatgaataattaatggtaggcgcgccatgcttcatcagactct

SEQ ID NO: 837 - DNA, 190 bp, Artificial Sequence; identical to SEQ ID NO: 836
  Synthetic polynucleotide

SEQ ID NO: 838 - DNA, 190 bp, Artificial Sequence
  Synthetic polynucleotide
atcatctcaccttgcctcctgctgacgaacggacaaggcctgcaggtgctgagtcacgttagatgctgagtcacgtttcgtgctgagtcacgttgactgctgagtcacgttctatgctgagtcacgttacttgctgagtcacgtttgctgctgagtcacgttgtaggcgcgccatgcttcatcagactct

SEQ ID NO: 839 - DNA, 190 bp, Artificial Sequence; identical to SEQ ID NO: 838
  Synthetic polynucleotide

SEQ ID NO: 840 - DNA, 191 bp, Artificial Sequence
  Synthetic polynucleotide
atcatctcaccttgcctcctgagtcagcggttagcgttcctgcaggataaattttattgcattagaataaattttattgcatttcgataaattttattgcattgacataaattttattgcattctaataaattttattgcattactataaattttattgcatttgcggcgcgccatgcttcatcagactct

SEQ ID NO: 841 - DNA, 191 bp, Artificial Sequence; identical to SEQ ID NO: 840
  Synthetic polynucleotide

SEQ ID NO: 842 - DNA, 188 bp, Artificial Sequence
  Synthetic polynucleotide
atcatctcaccttgcctcctgatagtcaacgttagcgacctgcaggccttcccgcccaagaccttcccgcccatcgccttcccgcccagacccttcccgcccactaccttcccgcccaactccttcccgcccatgcccttcccgcccagtaccttcccgcccaggcgcgccatgcttcatcagactct

SEQ ID NO: 843 - DNA, 188 bp, Artificial Sequence; identical to SEQ ID NO: 842
  Synthetic polynucleotide

SEQ ID NO: 844 - DNA, 190 bp, Artificial Sequence
  Synthetic polynucleotide
atcatctcaccttgcctcctgccctatttccgtgttgtcctgcaggggttaataattaacagaggttaataattaactcgggttaataattaacgacggttaataattaacctaggttaataattaacactggttaataattaactgcggttaataattaacgtaggcgcgccatgcttcatcagactct

SEQ ID NO: 845 - DNA, 190 bp, Artificial Sequence; identical to SEQ ID NO: 844
  Synthetic polynucleotide

SEQ ID NO: 846 - DNA, 164 bp, Artificial Sequence
  Synthetic polynucleotide
atcatctcaccttgcctcctgtagttggtaggcaacctcctgcaggtaaaacaatagataaaacaattcgtaaaacaatgactaaaacaatctataaaacaatacttaaaacaattgctaaaacaatgtataaaacaatggcgcgccatgcttcatcagactct

SEQ ID NO: 847 - DNA, 164 bp, Artificial Sequence; identical to SEQ ID NO: 846
  Synthetic polynucleotide

SEQ ID NO: 848 - DNA, 188 bp, Artificial Sequence
  Synthetic polynucleotide
atcatctcaccttgcctcctgtattgatcttgcgtggtcctgcaggtagggctgcaaaagatagggctgcaaatcgtagggctgcaaagactagggctgcaaactatagggctgcaaaacttagggctgcaaatgctagggctgcaaagtatagggctgcaaaggcgcgccatgcttcatcagactct

SEQ ID NO: 849 - DNA, 188 bp, Artificial Sequence; identical to SEQ ID NO: 848
  Synthetic polynucleotide

SEQ ID NO: 850 - DNA, 197 bp, Artificial Sequence
  Synthetic polynucleotide
atcatctcaccttgcctcctgcgatatctgaacggtaccctgcaggaatttgattgatgggagaaatttgattgatgggtcgaatttgattgatggggacaatttgattgatgggctaaatttgattgatgggactaatttgattgatgggtgcaatttgattgatggggtaggcgcgccatgcttcatcagactct

SEQ ID NO: 851 - DNA, 197 bp, Artificial Sequence; identical to SEQ ID NO: 850
  Synthetic polynucleotide

SEQ ID NO: 852 - DNA, 191 bp, Artificial Sequence
  Synthetic polynucleotide
atcatctcaccttgcctcctgcgtgtcaaatgtccaaccctgcaggggaagggattaattatcagaggaagggattaattatctcgggaagggattaattatcgacggaagggattaattatcctaggaagggattaattatcactggaagggattaattatctgcggcgcgccatgcttcatcagactct

SEQ ID NO: 853 - DNA, 191 bp, Artificial Sequence; identical to SEQ ID NO: 852
  Synthetic polynucleotide

SEQ ID NO: 854 - DNA, 190 bp, Artificial Sequence
  Synthetic polynucleotide
atcatctcaccttgcctcctgtataccgacctgtaagacctgcaggatattgcacaactcagaatattgcacaactctcgatattgcacaactcgacatattgcacaactcctaatattgcacaactcactatattgcacaactctgcatattgcacaactcgtaggcgcgccatgcttcatcagactct

SEQ ID NO: 855 - DNA, 190 bp, Artificial Sequence; identical to SEQ ID NO: 854
  Synthetic polynucleotide

SEQ ID NO: 856 - DNA, 148 bp, Artificial Sequence
  Synthetic polynucleotide
atcatctcaccttgcctcctggttaacgaatacaggcacctgcaggtttattaagatttattatcgtttattagactttattactatttattaacttttattatgctttattagtatttattaggcgcgccatgcttcatcagactct

SEQ ID NO: 857 - DNA, 148 bp, Artificial Sequence; identical to SEQ ID NO: 856
  Synthetic polynucleotide

SEQ ID NO: 858 - DNA, 188 bp, Artificial Sequence
  Synthetic polynucleotide
atcatctcaccttgcctcctgcagtatggactgacccacctgcaggaggtcaaggtcaagaaggtcaaggtcatcgaggtcaaggtcagacaggtcaaggtcactaaggtcaaggtcaactaggtcaaggtcatgcaggtcaaggtcagtaaggtcaaggtcaggcgcgccatgcttcatcagactct

SEQ ID NO: 859 - DNA, 188 bp, Artificial Sequence; identical to SEQ ID NO: 858
  Synthetic polynucleotide

SEQ ID NO: 860 - DNA, 190 bp, Artificial Sequence
  Synthetic polynucleotide
atcatctcaccttgcctcctggtttctagcaggctggacctgcaggccagcagggggcggagaccagcagggggcggtcgccagcagggggcgggacccagcagggggcggctaccagcagggggcggactccagcagggggcggtgcccagcagggggcgggtaggcgcgccatgcttcatcagactct

SEQ ID NO: 861 - DNA, 190 bp, Artificial Sequence; identical to SEQ ID NO: 860
  Synthetic polynucleotide

SEQ ID NO: 862 - DNA, 188 bp, Artificial Sequence
  Synthetic polynucleotide
atcatctcaccttgcctcctgaacgctgcttctgtagacctgcaggtgacctagttttagatgacctagtttttcgtgacctagttttgactgacctagttttctatgacctagttttacttgacctagtttttgctgacctagttttgtatgacctagttttggcgcgccatgcttcatcagactct

SEQ ID NO: 863 - DNA, 188 bp, Artificial Sequence; identical to SEQ ID NO: 862
  Synthetic polynucleotide

SEQ ID NO: 864 - DNA, 172 bp, Artificial Sequence
  Synthetic polynucleotide
atcatctcaccttgcctcctgtgtatcagtccaatccccctgcaggacttcctcttagaacttcctctttcgacttcctcttgacacttcctcttctaacttcctcttactacttcctctttgcacttcctcttgtaacttcctcttggcgcgccatgcttcatcagactct

SEQ ID NO: 865 - DNA, 172 bp, Artificial Sequence; identical to SEQ ID NO: 864
  Synthetic polynucleotide

SEQ ID NO: 866 - DNA, 197 bp, Artificial Sequence
  Synthetic polynucleotide
atcatctcaccttgcctcctggccgtcaaaggaagcaacctgcagggggcaggggtctcggagagggcaggggtctcggtcggggcaggggtctcgggacgggcaggggtctcggctagggcaggggtctcggactgggcaggggtctcggtgcgggcaggggtctcgggtaggcgcgccatgcttcatcagactct

SEQ ID NO: 867 - DNA, 197 bp, Artificial Sequence; identical to SEQ ID NO: 866
  Synthetic polynucleotide

SEQ ID NO: 868 - DNA, 197 bp, Artificial Sequence
  Synthetic polynucleotide
atcatctcaccttgcctcctgcccaataataaacgacgcctgcaggaattcataattatacacaagaaattcataattatacacatcgaattcataattatacacagacaattcataattatacacactaaattcataattatacacaactaattcataattatacacatgcggcgcgccatgcttcatcagactct

SEQ ID NO: 869 - DNA, 197 bp, Artificial Sequence; identical to SEQ ID NO: 868
  Synthetic polynucleotide

SEQ ID NO: 870 - DNA, 148 bp, Artificial Sequence
  Synthetic polynucleotide
atcatctcaccttgcctcctgaatgtcaatagggtctacctgcaggtttattgagatttattgtcgtttattggactttattgctatttattgacttttattgtgctttattggtatttattgggcgcgccatgcttcatcagactct

SEQ ID NO: 871 - DNA, 148 bp, Artificial Sequence; identical to SEQ ID NO: 870
  Synthetic polynucleotide

SEQ ID NO: 872 - DNA, 148 bp, Artificial Sequence
  Synthetic polynucleotide
atcatctcaccttgcctcctgttagagatagcctgcggcctgcaggcccactgagacccactgtcgcccactggaccccactgctacccactgactcccactgtgccccactggtacccactgggcgcgccatgcttcatcagactct

SEQ ID NO: 873 - DNA, 148 bp, Artificial Sequence; identical to SEQ ID NO: 872
  Synthetic polynucleotide

SEQ ID NO: 874 - DNA, 197 bp, Artificial Sequence
  Synthetic polynucleotide
atcatctcaccttgcctcctgtaacctttggcaaccggcctgcaggggggggggggggggaagaggggggggggggggatcgggggggggggggggagacggggggggggggggactaggggggggggggggaactggggggggggggggatgcggggggggggggggagtaggcgcgccatgcttcatcagactct

SEQ ID NO: 875 - DNA, 197 bp, Artificial Sequence; identical to SEQ ID NO: 874
  Synthetic polynucleotide

SEQ ID NO: 876 - DNA, 191 bp, Artificial Sequence
  Synthetic polynucleotide
atcatctcaccttgcctcctgtagctgccgcttgctaacctgcaggctcagctaattagtttaagactcagctaattagtttatcgctcagctaattagtttagacctcagctaattagtttactactcagctaattagtttaactctcagctaattagtttatgcggcgcgccatgcttcatcagactct

SEQ ID NO: 877 - DNA, 191 bp, Artificial Sequence; identical to SEQ ID NO: 876
  Synthetic polynucleotide

SEQ ID NO: 878 - DNA, 186 bp, Artificial Sequence
  Synthetic polynucleotide
atcatctcaccttgcctcctggattgactccgcccttgcctgcaggggacatgcccgggcatgtccagaggacatgcccgggcatgtcctcgggacatgcccgggcatgtccgacggacatgcccgggcatgtccctaggacatgcccgggcatgtccactggcgcgccatgcttcatcagactct

SEQ ID NO: 879 - DNA, 186 bp, Artificial Sequence; identical to SEQ ID NO: 878
  Synthetic polynucleotide

SEQ ID NO: 880 - DNA, 172 bp, Artificial Sequence
  Synthetic polynucleotide
atcatctcaccttgcctcctgaaggataggattagacccctgcaggggtcataaaaagaggtcataaaatcgggtcataaaagacggtcataaaactaggtcataaaaactggtcataaaatgcggtcataaaagtaggtcataaaaggcgcgccatgcttcatcagactct

SEQ ID NO: 881 - DNA, 172 bp, Artificial Sequence; identical to SEQ ID NO: 880
  Synthetic polynucleotide

SEQ ID NO: 882 - DNA, 172 bp, Artificial Sequence
  Synthetic polynucleotide
atcatctcaccttgcctcctggttaatcctagaagtggcctgcaggggggattagcagaggggattagctcgggggattagcgacggggattagcctaggggattagcactggggattagctgcggggattagcgtaggggattagcggcgcgccatgcttcatcagactct

SEQ ID NO: 883 - DNA, 172 bp, Artificial Sequence; identical to SEQ ID NO: 882
  Synthetic polynucleotide

SEQ ID NO: 884 - DNA, 188 bp, Artificial Sequence
  Synthetic polynucleotide
atcatctcaccttgcctcctgtatttcaaagtcctgcgcctgcagggggttcgagggtagagggttcgagggttcggggttcgagggtgacgggttcgagggtctagggttcgagggtactgggttcgagggttgcgggttcgagggtgtagggttcgagggtggcgcgccatgcttcatcagactct

SEQ ID NO: 885 - DNA, 188 bp, Artificial Sequence; identical to SEQ ID NO: 884
  Synthetic polynucleotide

SEQ ID NO: 886 - DNA, 172 bp, Artificial Sequence
  Synthetic polynucleotide
atcatctcaccttgcctcctggcaacctagacctgtggcctgcaggagttttattgagaagttttattgtcgagttttattggacagttttattgctaagttttattgactagttttattgtgcagttttattggtaagttttattgggcgcgccatgcttcatcagactct

SEQ ID NO: 887 - DNA, 172 bp, Artificial Sequence; identical to SEQ ID NO: 886
  Synthetic polynucleotide

SEQ ID NO: 888 - DNA, 156 bp, Artificial Sequence
  Synthetic polynucleotide
atcatctcaccttgcctcctgtccatatagttagccttcctgcagggggtatcaagagggtatcatcggggtatcagacgggtatcactagggtatcaactgggtatcatgcgggtatcagtagggtatcaggcgcgccatgcttcatcagactct

SEQ ID NO: 889 - DNA, 156 bp, Artificial Sequence; identical to SEQ ID NO: 888
  Synthetic polynucleotide

SEQ ID NO: 890 - DNA, 140 bp, Artificial Sequence
  Synthetic polynucleotide
atcatctcaccttgcctcctgcgacgtcttattgagcacctgcaggtgccaaagatgccaatcgtgccaagactgccaactatgccaaacttgccaatgctgccaagtatgccaaggcgcgccatgcttcatcagactct

SEQ ID NO: 891 - DNA, 140 bp, Artificial Sequence; identical to SEQ ID NO: 890
  Synthetic polynucleotide

SEQ ID NO: 892 - DNA, 188 bp, Artificial Sequence
  Synthetic polynucleotide
atcatctcaccttgcctcctgcgtacgaataaagtgtacctgcaggcgttacataacgagacgttacataacgtcgcgttacataacggaccgttacataacgctacgttacataacgactcgttacataacgtgccgttacataacggtacgttacataacgggcgcgccatgcttcatcagactct

SEQ ID NO: 893 - DNA, 188 bp, Artificial Sequence; identical to SEQ ID NO: 892
  Synthetic polynucleotide

SEQ ID NO: 894 - DNA, 186 bp, Artificial Sequence
  Synthetic polynucleotide
atcatctcaccttgcctcctgtgtcggctcgtctgatccctgcaggggacatgcccgggcatgtctagaggacatgcccgggcatgtcttcgggacatgcccgggcatgtctgacggacatgcccgggcatgtctctaggacatgcccgggcatgtctactggcgcgccatgcttcatcagactct

SEQ ID NO: 895 - DNA, 186 bp, Artificial Sequence; identical to SEQ ID NO: 894
  Synthetic polynucleotide

SEQ ID NO: 896 - DNA, 148 bp, Artificial Sequence
  Synthetic polynucleotide
atcatctcaccttgcctcctgtgctgacctcagtctcgcctgcaggtaatggcagataatggctcgtaatggcgactaatggcctataatggcacttaatggctgctaatggcgtataatggcggcgcgccatgcttcatcagactct

SEQ ID NO: 897 - DNA, 148 bp, Artificial Sequence; identical to SEQ ID NO: 896
  Synthetic polynucleotide

SEQ ID NO: 898 - DNA, 196 bp, Artificial Sequence
  Synthetic polynucleotide
atcatctcaccttgcctcctgacgttggccgtgcaactcctgcaggacaacctccctggggagttgtgagaacaacctccctggggagttgtgtcgacaacctccctggggagttgtggacacaacctccctggggagttgtgctaacaacctccctggggagttgtgactggcgcgccatgcttcatcagactct

SEQ ID NO: 899 - DNA, 196 bp, Artificial Sequence; identical to SEQ ID NO: 898
  Synthetic polynucleotide

SEQ ID NO: 900 - DNA, 197 bp, Artificial Sequence
  Synthetic polynucleotide
atcatctcaccttgcctcctgcaagtctgcctagaagtcctgcaggcaacaatcttcattgtccagacaacaatcttcattgtcctcgcaacaatcttcattgtccgaccaacaatcttcattgtccctacaacaatcttcattgtccactcaacaatcttcattgtcctgcggcgcgccatgcttcatcagactct

SEQ ID NO: 901 - DNA, 197 bp, Artificial Sequence; identical to SEQ ID NO: 900
  Synthetic polynucleotide

SEQ ID NO: 902 - DNA, 156 bp, Artificial Sequence
  Synthetic polynucleotide
atcatctcaccttgcctcctgacctgttgctcgattcccctgcaggcttaagtgagacttaagtgtcgcttaagtggaccttaagtgctacttaagtgactcttaagtgtgccttaagtggtacttaagtgggcgcgccatgcttcatcagactct

SEQ ID NO: 903 - DNA, 156 bp, Artificial Sequence; identical to SEQ ID NO: 902
  Synthetic polynucleotide

SEQ ID NO: 904 - DNA, 197 bp, Artificial Sequence
  Synthetic polynucleotide
atcatctcaccttgcctcctgagggacacatctctgcgcctgcagggttaatcggattaacagagttaatcggattaactcggttaatcggattaacgacgttaatcggattaacctagttaatcggattaacactgttaatcggattaactgcgttaatcggattaacgtaggcgcgccatgcttcatcagactct

SEQ ID NO: 905 - DNA, 197 bp, Artificial Sequence; identical to SEQ ID NO: 904
  Synthetic polynucleotide

SEQ ID NO: 906 - DNA, 191 bp, Artificial Sequence
  Synthetic polynucleotide
atcatctcaccttgcctcctgcgaacagtcatcgaactcctgcaggcacgtggttagcacgtgagacacgtggttagcacgtgtcgcacgtggttagcacgtggaccacgtggttagcacgtgctacacgtggttagcacgtgactcacgtggttagcacgtgtgcggcgcgccatgcttcatcagactct

SEQ ID NO: 907 - DNA, 191 bp, Artificial Sequence; identical to SEQ ID NO: 906
  Synthetic polynucleotide

SEQ ID NO: 908 - DNA, 148 bp, Artificial Sequence
  Synthetic polynucleotide
atcatctcaccttgcctcctgccctaacgcttgtgtgtcctgcaggctttgatagactttgattcgctttgatgacctttgatctactttgatactctttgattgcctttgatgtactttgatggcgcgccatgcttcatcagactct

SEQ ID NO: 909 - DNA, 148 bp, Artificial Sequence; identical to SEQ ID NO: 908
  Synthetic polynucleotide

SEQ ID NO: 910 - DNA, 172 bp, Artificial Sequence
  Synthetic polynucleotide
atcatctcaccttgcctcctgaagtagccatttgattgcctgcaggcgaacattctagacgaacattcttcgcgaacattctgaccgaacattctctacgaacattctactcgaacattcttgccgaacattctgtacgaacattctggcgcgccatgcttcatcagactct

SEQ ID NO: 911 - DNA, 172 bp, Artificial Sequence; identical to SEQ ID NO: 910
  Synthetic polynucleotide

SEQ ID NO: 912 - DNA, 172 bp, Artificial Sequence
  Synthetic polynucleotide
atcatctcaccttgcctcctgtggataacttagggcagcctgcaggagcggaagtgagaagcggaagtgtcgagcggaagtggacagcggaagtgctaagcggaagtgactagcggaagtgtgcagcggaagtggtaagcggaagtgggcgcgccatgcttcatcagactct

SEQ ID NO: 913 - DNA, 172 bp, Artificial Sequence; identical to SEQ ID NO: 912
  Synthetic polynucleotide

SEQ ID NO: 914 - DNA, 188 bp, Artificial Sequence
  Synthetic polynucleotide
atcatctcaccttgcctcctgcaatagatttagtccgacctgcagggaaacatctggaagagaaacatctggatcggaaacatctggagacgaaacatctggactagaaacatctggaactgaaacatctggatgcgaaacatctggagtagaaacatctggaggcgcgccatgcttcatcagactct

SEQ ID NO: 915 - DNA, 188 bp, Artificial Sequence; identical to SEQ ID NO: 914
  Synthetic polynucleotide

SEQ ID NO: 916 - DNA, 172 bp, Artificial Sequence
  Synthetic polynucleotide
atcatctcaccttgcctcctgactatgaagctggaccccctgcaggtaaaacaaaaagataaaacaaaatcgtaaaacaaaagactaaaacaaaactataaaacaaaaacttaaaacaaaatgctaaaacaaaagtataaaacaaaaggcgcgccatgcttcatcagactct

SEQ ID NO: 917 - DNA, 172 bp, Artificial Sequence; identical to SEQ ID NO: 916
  Synthetic polynucleotide

SEQ ID NO: 918 - DNA, 188 bp, Artificial Sequence
  Synthetic polynucleotide
atcatctcaccttgcctcctgagacaacagcgtgcgaccctgcaggcctaagtaaacaagacctaagtaaacatcgcctaagtaaacagaccctaagtaaacactacctaagtaaacaactcctaagtaaacatgccctaagtaaacagtacctaagtaaacaggcgcgccatgcttcatcagactct

SEQ ID NO: 919 - DNA, 188 bp, Artificial Sequence; identical to SEQ ID NO: 918
  Synthetic polynucleotide

SEQ ID NO: 920 - DNA, 191 bp, Artificial Sequence
  Synthetic polynucleotide
atcatctcaccttgcctcctgcagtttagtatgttgggcctgcaggaaggtcattcaaggtcaagaaaggtcattcaaggtcatcgaaggtcattcaaggtcagacaaggtcattcaaggtcactaaaggtcattcaaggtcaactaaggtcattcaaggtcatgcggcgcgccatgcttcatcagactct

SEQ ID NO: 921 - DNA, 191 bp, Artificial Sequence; identical to SEQ ID NO: 920
  Synthetic polynucleotide

SEQ ID NO: 922 - DNA, 164 bp, Artificial Sequence
  Synthetic polynucleotide
atcatctcaccttgcctcctgtttcttgccttgaagatcctgcaggcagggggtgagacagggggtgtcgcagggggtggaccagggggtgctacagggggtgactcagggggtgtgccagggggtggtacagggggtgggcgcgccatgcttcatcagactct

SEQ ID NO: 923 - DNA, 164 bp, Artificial Sequence; identical to SEQ ID NO: 922
  Synthetic polynucleotide

SEQ ID NO: 924 - DNA, 185 bp, Artificial Sequence
  Synthetic polynucleotide
atcatctcaccttgcctcctgaaatgaccgacctcacacctgcaggatgcgggtacccgcatagaatgcgggtacccgcattcgatgcgggtacccgcatgacatgcgggtacccgcatctaatgcgggtacccgcatactatgcgggtacccgcattgcggcgcgccatgcttcatcagactct

SEQ ID NO: 925 - DNA, 185 bp, Artificial Sequence; identical to SEQ ID NO: 924
  Synthetic polynucleotide

SEQ ID NO: 926 - DNA, 197 bp, Artificial Sequence
  Synthetic polynucleotide
atcatctcaccttgcctcctgagggatggcgggtaacacctgcaggtccatatatgggcatagatccatatatgggcattcgtccatatatgggcatgactccatatatgggcatctatccatatatgggcatacttccatatatgggcattgctccatatatgggcatgtaggcgcgccatgcttcatcagactct

SEQ ID NO: 927 - DNA, 197 bp, Artificial Sequence; identical to SEQ ID NO: 926
  Synthetic polynucleotide

SEQ ID NO: 928 - DNA, 190 bp, Artificial Sequence
  Synthetic polynucleotide
atcatctcaccttgcctcctggaggcgttcgtgcaaaccctgcagggctgtgcgaggtgcagagctgtgcgaggtgctcggctgtgcgaggtgcgacgctgtgcgaggtgcctagctgtgcgaggtgcactgctgtgcgaggtgctgcgctgtgcgaggtgcgtaggcgcgccatgcttcatcagactct

SEQ ID NO: 929 - DNA, 190 bp, Artificial Sequence; identical to SEQ ID NO: 928
  Synthetic polynucleotide

SEQ ID NO: 930 - DNA, 172 bp, Artificial Sequence
  Synthetic polynucleotide
atcatctcaccttgcctcctgatactcttatggcgcctcctgcaggagctgtcaaaagaagctgtcaaatcgagctgtcaaagacagctgtcaaactaagctgtcaaaactagctgtcaaatgcagctgtcaaagtaagctgtcaaaggcgcgccatgcttcatcagactct

SEQ ID NO: 931 - DNA, 172 bp, Artificial Sequence; identical to SEQ ID NO: 930
  Synthetic polynucleotide

SEQ ID NO: 932 - DNA, 197 bp, Artificial Sequence
  Synthetic polynucleotide
atcatctcaccttgcctcctgcggagaaagggtgatttcctgcaggtgtgcattgccaaataccagatgtgcattgccaaatacctcgtgtgcattgccaaataccgactgtgcattgccaaataccctatgtgcattgccaaataccacttgtgcattgccaaatacctgcggcgcgccatgcttcatcagactct

SEQ ID NO: 933 - DNA, 197 bp, Artificial Sequence; identical to SEQ ID NO: 932
  Synthetic polynucleotide

SEQ ID NO: 934 - DNA, 172 bp, Artificial Sequence
  Synthetic polynucleotide
atcatctcaccttgcctcctggcttagcttacatagaccctgcaggataatgagctagaataatgagcttcgataatgagctgacataatgagctctaataatgagctactataatgagcttgcataatgagctgtaataatgagctggcgcgccatgcttcatcagactct

SEQ ID NO: 935 - DNA, 172 bp, Artificial Sequence; identical to SEQ ID NO: 934
  Synthetic polynucleotide

SEQ ID NO: 936 - DNA, 196 bp, Artificial Sequence
  Synthetic polynucleotide
atcatctcaccttgcctcctgaggagcagttcgaggagcctgcaggccccctcacctgcagaccccctcacctgctcgccccctcacctgcgacccccctcacctgcctaccccctcacctgcactccccctcacctgctgcccccctcacctgcgtaccccctcacctgcggcgcgccatgcttcatcagactct

SEQ ID NO: 937 - DNA, 196 bp, Artificial Sequence; identical to SEQ ID NO: 936
  Synthetic polynucleotide

SEQ ID NO: 938 - DNA, 180 bp, Artificial Sequence
  Synthetic polynucleotide
atcatctcaccttgcctcctgccgtccgccagagtttacctgcagggacagctgttcagagacagctgttctcggacagctgttcgacgacagctgttcctagacagctgttcactgacagctgttctgcgacagctgttcgtagacagctgttcggcgcgccatgcttcatcagactct

SEQ ID NO: 939 - DNA, 180 bp, Artificial Sequence; identical to SEQ ID NO: 938
  Synthetic polynucleotide

SEQ ID NO: 940 - DNA, 196 bp, Artificial Sequence
  Synthetic polynucleotide
atcatctcaccttgcctcctggatcggatatcgtcccacctgcaggtgtttggtaagttagatgtttggtaagtttcgtgtttggtaagttgactgtttggtaagttctatgtttggtaagttacttgtttggtaagtttgctgtttggtaagttgtatgtttggtaagttggcgcgccatgcttcatcagactct

SEQ ID NO: 941 - DNA, 196 bp, Artificial Sequence; identical to SEQ ID NO: 940
  Synthetic polynucleotide

SEQ ID NO: 942 - DNA, 191 bp, Artificial Sequence
  Synthetic polynucleotide
atcatctcaccttgcctcctgccacgcaagatcagatccctgcaggtcgctataattaccgacagatcgctataattaccgactcgtcgctataattaccgacgactcgctataattaccgacctatcgctataattaccgacacttcgctataattaccgactgcggcgcgccatgcttcatcagactct

SEQ ID NO: 943 - DNA, 191 bp, Artificial Sequence; identical to SEQ ID NO: 942
  Synthetic polynucleotide

SEQ ID NO: 944 - DNA, 197 bp, Artificial Sequence
  Synthetic polynucleotide
atcatctcaccttgcctcctgtgaactagtgacagtagcctgcaggaaaaatggcgccatttttagaaaaaatggcgccattttttcgaaaaatggcgccatttttgacaaaaatggcgccatttttctaaaaaatggcgccatttttactaaaaatggcgccattttttgcggcgcgccatgcttcatcagactct

SEQ ID NO: 945 - DNA, 197 bp, Artificial Sequence; identical to SEQ ID NO: 944
  Synthetic polynucleotide

SEQ ID NO: 946 - DNA, 164 bp, Artificial Sequence
  Synthetic polynucleotide
atcatctcaccttgcctcctgtgcaggatacaaagaagcctgcagggtgacctctagagtgacctcttcggtgacctctgacgtgacctctctagtgacctctactgtgacctcttgcgtgacctctgtagtgacctctggcgcgccatgcttcatcagactct

SEQ ID NO: 947 - DNA, 164 bp, Artificial Sequence; identical to SEQ ID NO: 946
  Synthetic polynucleotide

SEQ ID NO: 948 - DNA, 188 bp, Artificial Sequence
  Synthetic polynucleotide
atcatctcaccttgcctcctgcctgactatataagagccctgcaggggctcttgagggagaggctcttgagggtcgggctcttgaggggacggctcttgagggctaggctcttgagggactggctcttgagggtgcggctcttgaggggtaggctcttgagggggcgcgccatgcttcatcagactct

SEQ ID NO: 949 - DNA, 188 bp, Artificial Sequence; identical to SEQ ID NO: 948
  Synthetic polynucleotide

SEQ ID NO: 950 - DNA, 185 bp, Artificial Sequence
  Synthetic polynucleotide
atcatctcaccttgcctcctgatctcttatcgggtaatcctgcagggtattgacagctagttagagtattgacagctagtttcggtattgacagctagttgacgtattgacagctagttctagtattgacagctagttactgtattgacagctagtttgcggcgcgccatgcttcatcagactct

SEQ ID NO: 951 - DNA, 185 bp, Artificial Sequence; identical to SEQ ID NO: 950
  Synthetic polynucleotide

SEQ ID NO: 952 - DNA, 190 bp, Artificial Sequence
  Synthetic polynucleotide
atcatctcaccttgcctcctgaccgagaacgagactaacctgcaggggttaataattaccagaggttaataattacctcgggttaataattaccgacggttaataattaccctaggttaataattaccactggttaataattacctgcggttaataattaccgtaggcgcgccatgcttcatcagactct

SEQ ID NO: 953 - DNA, 190 bp, Artificial Sequence; identical to SEQ ID NO: 952
  Synthetic polynucleotide

SEQ ID NO: 954 - DNA, 172 bp, Artificial Sequence
  Synthetic polynucleotide
atcatctcaccttgcctcctggctgatccattcgtaggcctgcaggagctgtcaatagaagctgtcaattcgagctgtcaatgacagctgtcaatctaagctgtcaatactagctgtcaattgcagctgtcaatgtaagctgtcaatggcgcgccatgcttcatcagactct

SEQ ID NO: 955 - DNA, 172 bp, Artificial Sequence; identical to SEQ ID NO: 954
  Synthetic polynucleotide

SEQ ID NO: 956 - DNA, 180 bp, Artificial Sequence
  Synthetic polynucleotide
atcatctcaccttgcctcctgatccaccttacgcagcccctgcagggccccgcccccagagccccgccccctcggccccgcccccgacgccccgcccccctagccccgcccccactgccccgccccctgcgccccgcccccgtagccccgcccccggcgcgccatgcttcatcagactct

SEQ ID NO: 957 - DNA, 180 bp, Artificial Sequence; identical to SEQ ID NO: 956
  Synthetic polynucleotide

SEQ ID NO: 958 - DNA, 180 bp, Artificial Sequence
  Synthetic polynucleotide
atcatctcaccttgcctcctgagccgttcttagtcagccctgcagggatgactcagtagagatgactcagttcggatgactcagtgacgatgactcagtctagatgactcagtactgatgactcagttgcgatgactcagtgtagatgactcagtggcgcgccatgcttcatcagactct

SEQ ID NO: 959 - DNA, 180 bp, Artificial Sequence; identical to SEQ ID NO: 958
  Synthetic polynucleotide

SEQ ID NO: 960 - DNA, 172 bp, Artificial Sequence
  Synthetic polynucleotide
atcatctcaccttgcctcctggaggtattgatgatcatcctgcaggtcccttgggtagatcccttgggttcgtcccttgggtgactcccttgggtctatcccttgggtacttcccttgggttgctcccttgggtgtatcccttgggtggcgcgccatgcttcatcagactct

SEQ ID NO: 961 - DNA, 172 bp, Artificial Sequence; identical to SEQ ID NO: 960
  Synthetic polynucleotide

SEQ ID NO: 962 - DNA, 197 bp, Artificial Sequence
  Synthetic polynucleotide
atcatctcaccttgcctcctgtatcgctcattgcggttcctgcagggagcagtcaagcgtgacgagagagcagtcaagcgtgacgtcggagcagtcaagcgtgacggacgagcagtcaagcgtgacgctagagcagtcaagcgtgacgactgagcagtcaagcgtgacgtgcggcgcgccatgcttcatcagactct

SEQ ID NO: 963 - DNA, 197 bp, Artificial Sequence; identical to SEQ ID NO: 962
  Synthetic polynucleotide

SEQ ID NO: 964 - DNA, 191 bp, Artificial Sequence
  Synthetic polynucleotide
atcatctcaccttgcctcctgacagaacatcgactaaacctgcaggagcgccacctagtggtaagaagcgccacctagtggtatcgagcgccacctagtggtagacagcgccacctagtggtactaagcgccacctagtggtaactagcgccacctagtggtatgcggcgcgccatgcttcatcagactct

SEQ ID NO: 965 - DNA, 191 bp, Artificial Sequence; identical to SEQ ID NO: 964
  Synthetic polynucleotide

SEQ ID NO: 966 - DNA, 172 bp, Artificial Sequence
  Synthetic polynucleotide
atcatctcaccttgcctcctgagctcgtaaccctgatccctgcagggttgccatggagagttgccatggtcggttgccatgggacgttgccatggctagttgccatggactgttgccatggtgcgttgccatgggtagttgccatggggcgcgccatgcttcatcagactct

SEQ ID NO: 967 - DNA, 172 bp, Artificial Sequence; identical to SEQ ID NO: 966
  Synthetic polynucleotide

SEQ ID NO: 968 - DNA, 172 bp, Artificial Sequence
  Synthetic polynucleotide
atcatctcaccttgcctcctgcgcattacgggtgcatgcctgcaggtgctgagtcaagatgctgagtcatcgtgctgagtcagactgctgagtcactatgctgagtcaacttgctgagtcatgctgctgagtcagtatgctgagtcaggcgcgccatgcttcatcagactct

SEQ ID NO: 969 - DNA, 172 bp, Artificial Sequence; identical to SEQ ID NO: 968
  Synthetic polynucleotide

SEQ ID NO: 970 - DNA, 172 bp, Artificial Sequence
  Synthetic polynucleotide
atcatctcaccttgcctcctgtgaagtgctatacggtgcctgcaggaaacgaaactagaaaacgaaacttcgaaacgaaactgacaaacgaaactctaaaacgaaactactaaacgaaacttgcaaacgaaactgtaaaacgaaactggcgcgccatgcttcatcagactct

SEQ ID NO: 971 - DNA, 172 bp, Artificial Sequence; identical to SEQ ID NO: 970
  Synthetic polynucleotide

SEQ ID NO: 972 - DNA, 172 bp, Artificial Sequence
  Synthetic polynucleotide
atcatctcaccttgcctcctgacttcggtgtctgtaatcctgcagggtttggcgcgagagtttggcgcgtcggtttggcgcggacgtttggcgcgctagtttggcgcgactgtttggcgcgtgcgtttggcgcggtagtttggcgcgggcgcgccatgcttcatcagactct

SEQ ID NO: 973 - DNA, 172 bp, Artificial Sequence; identical to SEQ ID NO: 972
  Synthetic polynucleotide

SEQ ID NO: 974 - DNA, 156 bp, Artificial Sequence
  Synthetic polynucleotide
atcatctcaccttgcctcctgtgtgtgggacgtaccaacctgcaggcaatatcgagacaatatcgtcgcaatatcggaccaatatcgctacaatatcgactcaatatcgtgccaatatcggtacaatatcgggcgcgccatgcttcatcagactct

SEQ ID NO: 975 - DNA, 156 bp, Artificial Sequence; identical to SEQ ID NO: 974
  Synthetic polynucleotide

SEQ ID NO: 976 - DNA, 191 bp, Artificial Sequence
  Synthetic polynucleotide
atcatctcaccttgcctcctgaagatgactaccagctgcctgcaggcgctaatcggaaaacgattagagacgctaatcggaaaacgattagtcgcgctaatcggaaaacgattaggaccgctaatcggaaaacgattagctacgctaatcggaaaacgattagactggcgcgccatgcttcatcagactct

SEQ ID NO: 977 - DNA, 191 bp, Artificial Sequence; identical to SEQ ID NO: 976
  Synthetic polynucleotide

SEQ ID NO: 978 - DNA, 185 bp, Artificial Sequence
  Synthetic polynucleotide
atcatctcaccttgcctcctgcgggaggaggtaatccacctgcaggaggcaacttccctctaagaaggcaacttccctctatcgaggcaacttccctctagacaggcaacttccctctactaaggcaacttccctctaactaggcaacttccctctatgcggcgcgccatgcttcatcagactct

SEQ ID NO: 979 - DNA, 185 bp, Artificial Sequence; identical to SEQ ID NO: 978
  Synthetic polynucleotide

SEQ ID NO: 980 - DNA, 156 bp, Artificial Sequence
  Synthetic polynucleotide
atcatctcaccttgcctcctggtccacagggatacagtcctgcagggctactggagagctactggtcggctactgggacgctactggctagctactggactgctactggtgcgctactgggtagctactggggcgcgccatgcttcatcagactct

SEQ ID NO: 981 - DNA, 156 bp, Artificial Sequence; identical to SEQ ID NO: 980
  Synthetic polynucleotide

SEQ ID NO: 982 - DNA, 180 bp, Artificial Sequence
  Synthetic polynucleotide
atcatctcaccttgcctcctggagcaactctgagtgctcctgcaggatcagctggtcagaatcagctggtctcgatcagctggtcgacatcagctggtcctaatcagctggtcactatcagctggtctgcatcagctggtcgtaatcagctggtcggcgcgccatgcttcatcagactct

SEQ ID NO: 983 - DNA, 180 bp, Artificial Sequence; identical to SEQ ID NO: 982
  Synthetic polynucleotide

SEQ ID NO: 984 - DNA, 188 bp, Artificial Sequence
  Synthetic polynucleotide
atcatctcaccttgcctcctgacctgaggcaaacgtaccctgcaggtgtttacttaggagatgtttacttaggtcgtgtttacttagggactgtttacttaggctatgtttacttaggacttgtttacttaggtgctgtttacttagggtatgtttacttaggggcgcgccatgcttcatcagactct

SEQ ID NO: 985 - DNA, 188 bp, Artificial Sequence; identical to SEQ ID NO: 984
  Synthetic polynucleotide

SEQ ID NO: 986 - DNA, 188 bp, Artificial Sequence
  Synthetic polynucleotide
atcatctcaccttgcctcctgtgaccttgggagggtaacctgcaggggtcattaattcagaggtcattaattctcgggtcattaattcgacggtcattaattcctaggtcattaattcactggtcattaattctgcggtcattaattcgtaggtcattaattcggcgcgccatgcttcatcagactct

SEQ ID NO: 987 - DNA, 188 bp, Artificial Sequence; identical to SEQ ID NO: 986
  Synthetic polynucleotide

SEQ ID NO: 988 - DNA, 196 bp, Artificial Sequence
  Synthetic polynucleotide
atcatctcaccttgcctcctgagtgactgtctacacttcctgcagggcagcagctgtcaagagcagcagctgtcatcggcagcagctgtcagacgcagcagctgtcactagcagcagctgtcaactgcagcagctgtcatgcgcagcagctgtcagtagcagcagctgtcaggcgcgccatgcttcatcagactct

SEQ ID NO: 989 - DNA, 196 bp, Artificial Sequence; identical to SEQ ID NO: 988
  Synthetic polynucleotide

SEQ ID NO: 990 - DNA, 191 bp, Artificial Sequence
  Synthetic polynucleotide
atcatctcaccttgcctcctgatcgcatccgcgattgacctgcaggtatagatcaaaggaaatagatatagatcaaaggaaattcgtatagatcaaaggaaatgactatagatcaaaggaaatctatatagatcaaaggaaatacttatagatcaaaggaaattgcggcgcgccatgcttcatcagactct

SEQ ID NO: 991 - DNA, 191 bp, Artificial Sequence; identical to SEQ ID NO: 990
  Synthetic polynucleotide

SEQ ID NO: 992 - DNA, 191 bp, Artificial Sequence
  Synthetic polynucleotide
atcatctcaccttgcctcctgactcgttcggtcggtaacctgcaggagtgacaggcccgccggccaaagaagtgacaggcccgccggccaatcgagtgacaggcccgccggccaagacagtgacaggcccgccggccaactaagtgacaggcccgccggccaaactggcgcgccatgcttcatcagactct

SEQ ID NO: 993 - DNA, 191 bp, Artificial Sequence; identical to SEQ ID NO: 992
  Synthetic polynucleotide

SEQ ID NO: 994 - DNA, 164 bp, Artificial Sequence
  Synthetic polynucleotide
atcatctcaccttgcctcctgggagccaagggttaggacctgcaggattgtttacagaattgtttactcgattgtttacgacattgtttacctaattgtttacactattgtttactgcattgtttacgtaattgtttacggcgcgccatgcttcatcagactct

SEQ ID NO: 995 - DNA, 164 bp, Artificial Sequence; identical to SEQ ID NO: 994
  Synthetic polynucleotide

SEQ ID NO: 996 - DNA, 164 bp, Artificial Sequence
  Synthetic polynucleotide
atcatctcaccttgcctcctggtcctcagaatcagagccctgcaggtttggcgcgagatttggcgcgtcgtttggcgcggactttggcgcgctatttggcgcgacttttggcgcgtgctttggcgcggtatttggcgcgggcgcgccatgcttcatcagactct

SEQ ID NO: 997 - DNA, 164 bp, Artificial Sequence; identical to SEQ ID NO: 996
  Synthetic polynucleotide

SEQ ID NO: 998 - DNA, 164 bp, Artificial Sequence
  Synthetic polynucleotide
atcatctcaccttgcctcctgatacccattgctcggaccctgcaggcctccctctagacctccctcttcgcctccctctgaccctccctctctacctccctctactcctccctcttgccctccctctgtacctccctctggcgcgccatgcttcatcagactct

SEQ ID NO: 999 - DNA, 164 bp, Artificial Sequence; identical to SEQ ID NO: 998
  Synthetic polynucleotide

SEQ ID NO: 1000 - DNA, 156 bp, Artificial Sequence
  Synthetic polynucleotide
atcatctcaccttgcctcctgcttgaggacgtttgtgccctgcaggagaacaatagaagaacaattcgagaacaatgacagaacaatctaagaacaatactagaacaattgcagaacaatgtaagaacaatggcgcgccatgcttcatcagactct

SEQ ID NO: 1001 - DNA, 156 bp, Artificial Sequence; identical to SEQ ID NO: 1000
  Synthetic polynucleotide

SEQ ID NO: 1002 - DNA, 197 bp, Artificial Sequence
  Synthetic polynucleotide
atcatctcaccttgcctcctgaagattctgccctggctcctgcagggcctttgttttgcaaagagcctttgttttgcaatcggcctttgttttgcaagacgcctttgttttgcaactagcctttgttttgcaaactgcctttgttttgcaatgcgcctttgttttgcaagtaggcgcgccatgcttcatcagactct

SEQ ID NO: 1003 - DNA, 197 bp, Artificial Sequence; identical to SEQ ID NO: 1002
  Synthetic polynucleotide

SEQ ID NO: 1004 - DNA, 180 bp, Artificial Sequence
  Synthetic polynucleotide
atcatctcaccttgcctcctgctaaaccttagtgcttacctgcaggatatataataaagaatatataataatcgatatataataagacatatataataactaatatataataaactatatataataatgcatatataataagtaatatataataaggcgcgccatgcttcatcagactct

SEQ ID NO: 1005 - DNA, 180 bp, Artificial Sequence; identical to SEQ ID NO: 1004
  Synthetic polynucleotide

SEQ ID NO: 1006 - DNA, 196 bp, Artificial Sequence
  Synthetic polynucleotide
atcatctcaccttgcctcctgatcctctgacggatgggcctgcagggtaaacataaacaagagtaaacataaacatcggtaaacataaacagacgtaaacataaacactagtaaacataaacaactgtaaacataaacatgcgtaaacataaacagtagtaaacataaacaggcgcgccatgcttcatcagactct

SEQ ID NO: 1007 - DNA, 196 bp, Artificial Sequence; identical to SEQ ID NO: 1006
  Synthetic polynucleotide

SEQ ID NO: 1008 - DNA, 191 bp, Artificial Sequence
  Synthetic polynucleotide
atcatctcaccttgcctcctgggatggcccatcaaatgcctgcaggcgaattaattaacaataagacgaattaattaacaatatcgcgaattaattaacaatagaccgaattaattaacaatactacgaattaattaacaataactcgaattaattaacaatatgcggcgcgccatgcttcatcagactct

SEQ ID NO: 1009 - DNA, 191 bp, Artificial Sequence; identical to SEQ ID NO: 1008
  Synthetic polynucleotide

SEQ ID NO: 1010 - DNA, 185 bp, Artificial Sequence
  Synthetic polynucleotide
atcatctcaccttgcctcctgcatcaatctactcggcgcctgcaggagtctatttatagcttagaagtctatttatagctttcgagtctatttatagcttgacagtctatttatagcttctaagtctatttatagcttactagtctatttatagctttgcggcgcgccatgcttcatcagactct

SEQ ID NO: 1011 - DNA, 185 bp, Artificial Sequence; identical to SEQ ID NO: 1010
  Synthetic polynucleotide

SEQ ID NO: 1012 - DNA, 197 bp, Artificial Sequence
  Synthetic polynucleotide
atcatctcaccttgcctcctgtacgagtgtctgaggttcctgcaggcactgcgcatgcgcaagacactgcgcatgcgcatcgcactgcgcatgcgcagaccactgcgcatgcgcactacactgcgcatgcgcaactcactgcgcatgcgcatgccactgcgcatgcgcagtaggcgcgccatgcttcatcagactct

SEQ ID NO: 1013 - DNA, 197 bp, Artificial Sequence; identical to SEQ ID NO: 1012
  Synthetic polynucleotide

SEQ ID NO: 1014 - DNA, 197 bp, Artificial Sequence
  Synthetic polynucleotide
atcatctcaccttgcctcctggagctgcgaactatagtcctgcagggtcccgggttcgaatcccagagtcccgggttcgaatccctcggtcccgggttcgaatcccgacgtcccgggttcgaatcccctagtcccgggttcgaatcccactgtcccgggttcgaatccctgcggcgcgccatgcttcatcagactct

SEQ ID NO: 1015 - DNA, 197 bp, Artificial Sequence; identical to SEQ ID NO: 1014
  Synthetic polynucleotide

SEQ ID NO: 1016 - DNA, 188 bp, Artificial Sequence
  Synthetic polynucleotide
atcatctcaccttgcctcctgttgagcagaagccaattcctgcaggtgcccccgggcaagatgcccccgggcatcgtgcccccgggcagactgcccccgggcactatgcccccgggcaacttgcccccgggcatgctgcccccgggcagtatgcccccgggcaggcgcgccatgcttcatcagactct

SEQ ID NO: 1017 - DNA, 188 bp, Artificial Sequence; identical to SEQ ID NO: 1016
  Synthetic polynucleotide

SEQ ID NO: 1018 - DNA, 180 bp, Artificial Sequence
  Synthetic polynucleotide
atcatctcaccttgcctcctgcctaataccgagtaacccctgcaggggccacacccaagaggccacacccatcgggccacacccagacggccacacccactaggccacacccaactggccacacccatgcggccacacccagtaggccacacccaggcgcgccatgcttcatcagactct

SEQ ID NO: 1019 - DNA, 180 bp, Artificial Sequence; identical to SEQ ID NO: 1018
  Synthetic polynucleotide

SEQ ID NO: 1020 - DNA, 156 bp, Artificial Sequence
  Synthetic polynucleotide
atcatctcaccttgcctcctggagtcgcacgatcttggcctgcaggctgtcaaaagactgtcaaatcgctgtcaaagacctgtcaaactactgtcaaaactctgtcaaatgcctgtcaaagtactgtcaaaggcgcgccatgcttcatcagactct

SEQ ID NO: 1021 - DNA, 156 bp, Artificial Sequence; identical to SEQ ID NO: 1020
  Synthetic polynucleotide

SEQ ID NO: 1022 - DNA, 196 bp, Artificial Sequence
  Synthetic polynucleotide
atcatctcaccttgcctcctgtgacgtaaaccgttgaacctgcaggccctggggagctgagaccctggggagctgtcgccctggggagctggacccctggggagctgctaccctggggagctgactccctggggagctgtgcccctggggagctggtaccctggggagctgggcgcgccatgcttcatcagactct

SEQ ID NO: 1023 - DNA, 196 bp, Artificial Sequence; identical to SEQ ID NO: 1022
  Synthetic polynucleotide

SEQ ID NO: 1024 - DNA, 180 bp, Artificial Sequence
  Synthetic polynucleotide
atcatctcaccttgcctcctgccagagatagtgccacacctgcagggctccttggcgagagctccttggcgtcggctccttggcggacgctccttggcgctagctccttggcgactgctccttggcgtgcgctccttggcggtagctccttggcgggcgcgccatgcttcatcagactct

SEQ ID NO: 1025 - DNA, 180 bp, Artificial Sequence; identical to SEQ ID NO: 1024
  Synthetic polynucleotide

SEQ ID NO: 1026 - DNA, 148 bp, Artificial Sequence
  Synthetic polynucleotide
atcatctcaccttgcctcctgagtcgacaaggtgagcccctgcaggcagtgggagacagtgggtcgcagtggggaccagtgggctacagtgggactcagtgggtgccagtggggtacagtgggggcgcgccatgcttcatcagactct

SEQ ID NO: 1027 - DNA, 148 bp, Artificial Sequence; identical to SEQ ID NO: 1026
  Synthetic polynucleotide

SEQ ID NO: 1028 - DNA, 191 bp, Artificial Sequence
  Synthetic polynucleotide
atcatctcaccttgcctcctggtttggtagttctgaggcctgcaggcttaaaaacgatgttttagacttaaaaacgatgtttttcgcttaaaaacgatgttttgaccttaaaaacgatgttttctacttaaaaacgatgttttactcttaaaaacgatgtttttgcggcgcgccatgcttcatcagactct

SEQ ID NO: 1029 - DNA, 191 bp, Artificial Sequence; identical to SEQ ID NO: 1028
  Synthetic polynucleotide

SEQ ID NO: 1030 - DNA, 180 bp, Artificial Sequence
  Synthetic polynucleotide
atcatctcaccttgcctcctggattggcgtaaacgtcacctgcaggctgcagctgtcagactgcagctgtctcgctgcagctgtcgacctgcagctgtcctactgcagctgtcactctgcagctgtctgcctgcagctgtcgtactgcagctgtcggcgcgccatgcttcatcagactct

SEQ ID NO: 1031 - DNA, 180 bp, Artificial Sequence; identical to SEQ ID NO: 1030
  Synthetic polynucleotide

SEQ ID NO: 1032 - DNA, 200 bp, Artificial Sequence
  Synthetic polynucleotide
atcatctcaccttgcctcctgaacgaaggttggcctaccctgcagggcctgctgggagttgtagtagagcctgctgggagttgtagttcggcctgctgggagttgtagtgacgcctgctgggagttgtagtctagcctgctgggagttgtagtactgcctgctgggagttgtagtggcgcgccatgcttcatcagactct

SEQ ID NO: 1033 - DNA, 200 bp, Artificial Sequence; identical to SEQ ID NO: 1032
  Synthetic polynucleotide

SEQ ID NO: 1034 - DNA, 185 bp, Artificial Sequence
  Synthetic polynucleotide
atcatctcaccttgcctcctggtgtaacaaacggcgagcctgcaggattaacaggtgttcacagaattaacaggtgttcactcgattaacaggtgttcacgacattaacaggtgttcacctaattaacaggtgttcacactattaacaggtgttcactgcggcgcgccatgcttcatcagactct

SEQ ID NO: 1035 - DNA, 185 bp, Artificial Sequence; identical to SEQ ID NO: 1034
  Synthetic polynucleotide

SEQ ID NO: 1036 - DNA, 164 bp, Artificial Sequence
  Synthetic polynucleotide
atcatctcaccttgcctcctgccgatacatctaggctccctgcagggccacgtgtagagccacgtgttcggccacgtgtgacgccacgtgtctagccacgtgtactgccacgtgttgcgccacgtgtgtagccacgtgtggcgcgccatgcttcatcagactct

SEQ ID NO: 1037 - DNA, 164 bp, Artificial Sequence; identical to SEQ ID NO: 1036
  Synthetic polynucleotide

SEQ ID NO: 1038 - DNA, 190 bp, Artificial Sequence
  Synthetic polynucleotide
atcatctcaccttgcctcctgttgtcctctacgattatcctgcaggaggtcattgaccctagaaggtcattgacccttcgaggtcattgaccctgacaggtcattgaccctctaaggtcattgaccctactaggtcattgacccttgcaggtcattgaccctgtaggcgcgccatgcttcatcagactct

SEQ ID NO: 1039 - DNA, 190 bp, Artificial Sequence; identical to SEQ ID NO: 1038
  Synthetic polynucleotide

SEQ ID NO: 1040 - DNA, 191 bp, Artificial Sequence
  Synthetic polynucleotide
atcatctcaccttgcctcctgacccaatagttgggattcctgcaggtatagatcaaaggaaaaagatatagatcaaaggaaaatcgtatagatcaaaggaaaagactatagatcaaaggaaaactatatagatcaaaggaaaaacttatagatcaaaggaaaatgcggcgcgccatgcttcatcagactct

SEQ ID NO: 1041 - DNA, 191 bp, Artificial Sequence; identical to SEQ ID NO: 1040
  Synthetic polynucleotide

SEQ ID NO: 1042 - DNA, 197 bp, Artificial Sequence
  Synthetic polynucleotide
atcatctcaccttgcctcctgtatggtccacggaagcgcctgcaggtgacctctcttgacctttagatgacctctcttgaccttttcgtgacctctcttgacctttgactgacctctcttgacctttctatgacctctcttgacctttacttgacctctcttgaccttttgcggcgcgccatgcttcatcagactct

SEQ ID NO: 1043 - DNA, 197 bp, Artificial Sequence; identical to SEQ ID NO: 1042
  Synthetic polynucleotide

SEQ ID NO: 1044 - DNA, 196 bp, Artificial Sequence
  Synthetic polynucleotide
atcatctcaccttgcctcctgtcgttagaacgcacattcctgcaggctctgattggctgagactctgattggctgtcgctctgattggctggacctctgattggctgctactctgattggctgactctctgattggctgtgcctctgattggctggtactctgattggctgggcgcgccatgcttcatcagactct

SEQ ID NO: 1045 - DNA, 196 bp, Artificial Sequence; identical to SEQ ID NO: 1044
  Synthetic polynucleotide

SEQ ID NO: 1046 - DNA, 180 bp, Artificial Sequence
  Synthetic polynucleotide
atcatctcaccttgcctcctgctacctcgaagttaactcctgcaggctgcagctgtgagactgcagctgtgtcgctgcagctgtggacctgcagctgtgctactgcagctgtgactctgcagctgtgtgcctgcagctgtggtactgcagctgtgggcgcgccatgcttcatcagactct

SEQ ID NO: 1047 - DNA, 180 bp, Artificial Sequence; identical to SEQ ID NO: 1046
  Synthetic polynucleotide

SEQ ID NO: 1048 - DNA, 197 bp, Artificial Sequence
  Synthetic polynucleotide
atcatctcaccttgcctcctgccattgggctgctttcgcctgcaggtaattacgctaattaagataattacgctaattatcgtaattacgctaattagactaattacgctaattactataattacgctaattaacttaattacgctaattatgctaattacgctaattagtaggcgcgccatgcttcatcagactct

SEQ ID NO: 1049 - DNA, 197 bp, Artificial Sequence; identical to SEQ ID NO: 1048
  Synthetic polynucleotide

SEQ ID NO: 1050 - DNA, 188 bp, Artificial Sequence
  Synthetic polynucleotide
atcatctcaccttgcctcctggagtgctgcagaatgaacctgcagggctataaatagcagagctataaatagctcggctataaatagcgacgctataaatagcctagctataaatagcactgctataaatagctgcgctataaatagcgtagctataaatagcggcgcgccatgcttcatcagactct

SEQ ID NO: 1051 - DNA, 188 bp, Artificial Sequence; identical to SEQ ID NO: 1050
  Synthetic polynucleotide

SEQ ID NO: 1052 - DNA, 191 bp, Artificial Sequence
  Synthetic polynucleotide
atcatctcaccttgcctcctgatttcttgtctagttggcctgcagggtgggctaattagttcaagagtgggctaattagttcatcggtgggctaattagttcagacgtgggctaattagttcactagtgggctaattagttcaactgtgggctaattagttcatgcggcgcgccatgcttcatcagactct

SEQ ID NO: 1053 - DNA, 191 bp, Artificial Sequence; identical to SEQ ID NO: 1052
  Synthetic polynucleotide

SEQ ID NO: 1054 - DNA, 172 bp, Artificial Sequence
  Synthetic polynucleotide
atcatctcaccttgcctcctggatgcgagttaagactgcctgcaggtcttaagtggagatcttaagtggtcgtcttaagtgggactcttaagtggctatcttaagtggacttcttaagtggtgctcttaagtgggtatcttaagtggggcgcgccatgcttcatcagactct

SEQ ID NO: 1055 - DNA, 172 bp, Artificial Sequence; identical to SEQ ID NO: 1054
  Synthetic polynucleotide

SEQ ID NO: 1056 - DNA, 196 bp, Artificial Sequence
  Synthetic polynucleotide
atcatctcaccttgcctcctgagcgtacccattctggtcctgcaggagcccaaggtcacagaagcccaaggtcactcgagcccaaggtcacgacagcccaaggtcacctaagcccaaggtcacactagcccaaggtcactgcagcccaaggtcacgtaagcccaaggtcacggcgcgccatgcttcatcagactct

SEQ ID NO: 1057 - DNA, 196 bp, Artificial Sequence; identical to SEQ ID NO: 1056
  Synthetic polynucleotide

SEQ ID NO: 1058 - DNA, 185 bp, Artificial Sequence
  Synthetic polynucleotide
atcatctcaccttgcctcctgaccaacttagttctaagcctgcagggcggcggcagcggggcagagcggcggcagcggggctcggcggcggcagcggggcgacgcggcggcagcggggcctagcggcggcagcggggcactgcggcggcagcggggctgcggcgcgccatgcttcatcagactct

SEQ ID NO: 1059 - DNA, 185 bp, Artificial Sequence; identical to SEQ ID NO: 1058
  Synthetic polynucleotide

SEQ ID NO: 1060 - DNA, 188 bp, Artificial Sequence
  Synthetic polynucleotide
atcatctcaccttgcctcctggtgtcgttgtcactcatcctgcaggatttttacgaccagaatttttacgacctcgatttttacgaccgacatttttacgaccctaatttttacgaccactatttttacgacctgcatttttacgaccgtaatttttacgaccggcgcgccatgcttcatcagactct

SEQ ID NO: 1061 - DNA, 188 bp, Artificial Sequence; identical to SEQ ID NO: 1060
  Synthetic polynucleotide

SEQ ID NO: 1062 - DNA, 180 bp, Artificial Sequence
  Synthetic polynucleotide
atcatctcaccttgcctcctgaggcaacatatctcctgcctgcaggtcgcgccaaacagatcgcgccaaactcgtcgcgccaaacgactcgcgccaaacctatcgcgccaaacacttcgcgccaaactgctcgcgccaaacgtatcgcgccaaacggcgcgccatgcttcatcagactct

SEQ ID NO: 1063 - DNA, 180 bp, Artificial Sequence; identical to SEQ ID NO: 1062
  Synthetic polynucleotide

SEQ ID NO: 1064 - DNA, 172 bp, Artificial Sequence
  Synthetic polynucleotide
atcatctcaccttgcctcctgtaacttaaccaccatcccctgcaggtttattgcggagatttattgcggtcgtttattgcgggactttattgcggctatttattgcggacttttattgcggtgctttattgcgggtatttattgcggggcgcgccatgcttcatcagactct

SEQ ID NO: 1065 - DNA, 172 bp, Artificial Sequence; identical to SEQ ID NO: 1064
  Synthetic polynucleotide

SEQ ID NO: 1066 - DNA, 180 bp, Artificial Sequence
  Synthetic polynucleotide
atcatctcaccttgcctcctggaactgcaaatactgcccctgcaggacgcccacgcaagaacgcccacgcatcgacgcccacgcagacacgcccacgcactaacgcccacgcaactacgcccacgcatgcacgcccacgcagtaacgcccacgcaggcgcgccatgcttcatcagactct

SEQ ID NO: 1067 - DNA, 180 bp, Artificial Sequence; identical to SEQ ID NO: 1066
  Synthetic polynucleotide

SEQ ID NO: 1068 - DNA, 191 bp, Artificial Sequence
  Synthetic polynucleotide
atcatctcaccttgcctcctgttcgcgcatattgtagacctgcagggttgacctttgacctttagagttgacctttgaccttttcggttgacctttgacctttgacgttgacctttgacctttctagttgacctttgacctttactgttgacctttgaccttttgcggcgcgccatgcttcatcagactct

SEQ ID NO: 1069 - DNA, 191 bp, Artificial Sequence; identical to SEQ ID NO: 1068
  Synthetic polynucleotide

SEQ ID NO: 1070 - DNA, 132 bp, Artificial Sequence
  Synthetic polynucleotide
atcatctcaccttgcctcctgagtacgtggaagagaatcctgcaggtatccagatatcctcgtatccgactatccctatatccacttatcctgctatccgtatatccggcgcgccatgcttcatcagactct

SEQ ID NO: 1071 - DNA, 132 bp, Artificial Sequence; identical to SEQ ID NO: 1070
  Synthetic polynucleotide

SEQ ID NO: 1072 - DNA, 197 bp, Artificial Sequence
  Synthetic polynucleotide
atcatctcaccttgcctcctgcaaatttcccaggcgaacctgcaggctggggggggcagataagagactggggggggcagataagtcgctggggggggcagataaggacctggggggggcagataagctactggggggggcagataagactctggggggggcagataagtgcggcgcgccatgcttcatcagactct

SEQ ID NO: 1073 - DNA, 197 bp, Artificial Sequence; identical to SEQ ID NO: 1072
  Synthetic polynucleotide

SEQ ID NO: 1074 - DNA, 132 bp, Artificial Sequence
  Synthetic polynucleotide
atcatctcaccttgcctcctggatgtatctatcggcttcctgcaggtatcaagatatcatcgtatcagactatcactatatcaacttatcatgctatcagtatatcaggcgcgccatgcttcatcagactct

SEQ ID NO: 1075 - DNA, 132 bp, Artificial Sequence; identical to SEQ ID NO: 1074
  Synthetic polynucleotide

SEQ ID NO: 1076 - DNA, 172 bp, Artificial Sequence
  Synthetic polynucleotide
atcatctcaccttgcctcctgggtctcgggctatagctcctgcagggtacgtgaccagagtacgtgacctcggtacgtgaccgacgtacgtgaccctagtacgtgaccactgtacgtgacctgcgtacgtgaccgtagtacgtgaccggcgcgccatgcttcatcagactct

SEQ ID NO: 1077 - DNA, 172 bp, Artificial Sequence; identical to SEQ ID NO: 1076
  Synthetic polynucleotide

SEQ ID NO: 1078 - DNA, 191 bp, Artificial Sequence
  Synthetic polynucleotide
atcatctcaccttgcctcctgcaattacgttggtgaatcctgcaggcccacctgccatctaggagacccacctgccatctaggtcgcccacctgccatctagggaccccacctgccatctaggctacccacctgccatctaggactcccacctgccatctaggtgcggcgcgccatgcttcatcagactct

SEQ ID NO: 1079 - DNA, 191 bp, Artificial Sequence; identical to SEQ ID NO: 1078
  Synthetic polynucleotide

SEQ ID NO: 1080 - DNA, 185 bp, Artificial Sequence
  Synthetic polynucleotide
atcatctcaccttgcctcctgtgcaatgttccggcctccctgcaggctactaattaatgctgagactactaattaatgctgtcgctactaattaatgctggacctactaattaatgctgctactactaattaatgctgactctactaattaatgctgtgcggcgcgccatgcttcatcagactct

SEQ ID NO: 1081 - DNA, 185 bp, Artificial Sequence; identical to SEQ ID NO: 1080
  Synthetic polynucleotide

SEQ ID NO: 1082 - DNA, 164 bp, Artificial Sequence
  Synthetic polynucleotide
atcatctcaccttgcctcctgtgagatgcatgacagatcctgcagggaaaacaatagagaaaacaattcggaaaacaatgacgaaaacaatctagaaaacaatactgaaaacaattgcgaaaacaatgtagaaaacaatggcgcgccatgcttcatcagactct

SEQ ID NO: 1083 - DNA, 164 bp, Artificial Sequence; identical to SEQ ID NO: 1082
  Synthetic polynucleotide

SEQ ID NO: 1084 - DNA, 172 bp, Artificial Sequence
  Synthetic polynucleotide
atcatctcaccttgcctcctgacaaatctttggtcgcgcctgcaggcgcagctgcgagacgcagctgcgtcgcgcagctgcggaccgcagctgcgctacgcagctgcgactcgcagctgcgtgccgcagctgcggtacgcagctgcgggcgcgccatgcttcatcagactct

SEQ ID NO: 1085 - DNA, 172 bp, Artificial Sequence; identical to SEQ ID NO: 1084
  Synthetic polynucleotide

SEQ ID NO: 1086 - DNA, 164 bp, Artificial Sequence
  Synthetic polynucleotide
atcatctcaccttgcctcctgaaattagtcagcgtgctcctgcaggttgcgcacgagattgcgcacgtcgttgcgcacggacttgcgcacgctattgcgcacgactttgcgcacgtgcttgcgcacggtattgcgcacgggcgcgccatgcttcatcagactct

SEQ ID NO: 1087 - DNA, 164 bp, Artificial Sequence; identical to SEQ ID NO: 1086
  Synthetic polynucleotide

SEQ ID NO: 1088 - DNA, 180 bp, Artificial Sequence
  Synthetic polynucleotide
atcatctcaccttgcctcctgagcctatattagggtcacctgcagggccctgacctcagagccctgacctctcggccctgacctcgacgccctgacctcctagccctgacctcactgccctgacctctgcgccctgacctcgtagccctgacctcggcgcgccatgcttcatcagactct

SEQ ID NO: 1089 - DNA, 180 bp, Artificial Sequence; identical to SEQ ID NO: 1088
  Synthetic polynucleotide

SEQ ID NO: 1090 - DNA, 185 bp, Artificial Sequence
  Synthetic polynucleotide
atcatctcaccttgcctcctgagtcctcatatgaccaccctgcaggtcagcaccatggacagagatcagcaccatggacagtcgtcagcaccatggacaggactcagcaccatggacagctatcagcaccatggacagacttcagcaccatggacagtgcggcgcgccatgcttcatcagactct

SEQ ID NO: 1091 - DNA, 185 bp, Artificial Sequence; identical to SEQ ID NO: 1090
  Synthetic polynucleotide

SEQ ID NO: 1092 - DNA, 164 bp, Artificial Sequence
  Synthetic polynucleotide
atcatctcaccttgcctcctgaagacgtctcgtgtgcccctgcaggttatcttgtagattatcttgttcgttatcttgtgacttatcttgtctattatcttgtactttatcttgttgcttatcttgtgtattatcttgtggcgcgccatgcttcatcagactct

SEQ ID NO: 1093 - DNA, 164 bp, Artificial Sequence; identical to SEQ ID NO: 1092
  Synthetic polynucleotide

SEQ ID NO: 1094 - DNA, 188 bp, Artificial Sequence
  Synthetic polynucleotide
atcatctcaccttgcctcctgctttgcataagcaagtgcctgcaggcccggtgaacccagacccggtgaaccctcgcccggtgaacccgaccccggtgaacccctacccggtgaacccactcccggtgaaccctgccccggtgaacccgtacccggtgaacccggcgcgccatgcttcatcagactct

SEQ ID NO: 1095 - DNA, 188 bp, Artificial Sequence; identical to SEQ ID NO: 1094
  Synthetic polynucleotide

SEQ ID NO: 1096 - DNA, 185 bp, Artificial Sequence
  Synthetic polynucleotide
atcatctcaccttgcctcctgcccagttcgcctattcgcctgcaggaaggtaattagctcatagaaaggtaattagctcattcgaaggtaattagctcatgacaaggtaattagctcatctaaaggtaattagctcatactaaggtaattagctcattgcggcgcgccatgcttcatcagactct

SEQ ID NO: 1097 - DNA, 185 bp, Artificial Sequence; identical to SEQ ID NO: 1096
  Synthetic polynucleotide

SEQ ID NO: 1098 - DNA, 190 bp, Artificial Sequence
  Synthetic polynucleotide
atcatctcaccttgcctcctgctcagtaatccgcgatccctgcaggaggagggggcagtgagaaggagggggcagtgtcgaggagggggcagtggacaggagggggcagtgctaaggagggggcagtgactaggagggggcagtgtgcaggagggggcagtggtaggcgcgccatgcttcatcagactct

SEQ ID NO: 1099 - DNA, 190 bp, Artificial Sequence; identical to SEQ ID NO: 1098
  Synthetic polynucleotide

SEQ ID NO: 1100 - DNA, 180 bp, Artificial Sequence
  Synthetic polynucleotide
atcatctcaccttgcctcctgattcaggttgcataaagcctgcaggcgatgacgtcaagacgatgacgtcatcgcgatgacgtcagaccgatgacgtcactacgatgacgtcaactcgatgacgtcatgccgatgacgtcagtacgatgacgtcaggcgcgccatgcttcatcagactct

SEQ ID NO: 1101 - DNA, 180 bp, Artificial Sequence; identical to SEQ ID NO: 1100
  Synthetic polynucleotide

SEQ ID NO: 1102 - DNA, 196 bp, Artificial Sequence
  Synthetic polynucleotide
atcatctcaccttgcctcctgctcaagatagctcggttcctgcaggtgtttgtttacctagatgtttgtttaccttcgtgtttgtttacctgactgtttgtttacctctatgtttgtttacctacttgtttgtttaccttgctgtttgtttacctgtatgtttgtttacctggcgcgccatgcttcatcagactct

SEQ ID NO: 1103 - DNA, 196 bp, Artificial Sequence; identical to SEQ ID NO: 1102
  Synthetic polynucleotide

SEQ ID NO: 1104 - DNA, 200 bp, Artificial Sequence
  Synthetic polynucleotide
atcatctcaccttgcctcctgggtgattgcacaaggtgcctgcaggccgcggttgccatggcaacagaccgcggttgccatggcaactcgccgcggttgccatggcaacgacccgcggttgccatggcaacctaccgcggttgccatggcaacactccgcggttgccatggcaacggcgcgccatgcttcatcagactct

SEQ ID NO: 1105 - DNA, 200 bp, Artificial Sequence; identical to SEQ ID NO: 1104
  Synthetic polynucleotide

SEQ ID NO: 1106 - DNA, 180 bp, Artificial Sequence
  Synthetic polynucleotide
atcatctcaccttgcctcctgcctcaccatctcacaagcctgcaggctgcagctgttagactgcagctgtttcgctgcagctgttgacctgcagctgttctactgcagctgttactctgcagctgtttgcctgcagctgttgtactgcagctgttggcgcgccatgcttcatcagactct

SEQ ID NO: 1107 - DNA, 180 bp, Artificial Sequence; identical to SEQ ID NO: 1106
  Synthetic polynucleotide

SEQ ID NO: 1108 - DNA, 156 bp, Artificial Sequence
  Synthetic polynucleotide
atcatctcaccttgcctcctgatccaagatgtcctaagcctgcaggatagcaacagaatagcaactcgatagcaacgacatagcaacctaatagcaacactatagcaactgcatagcaacgtaatagcaacggcgcgccatgcttcatcagactct

SEQ ID NO: 1109 - DNA, 156 bp, Artificial Sequence; identical to SEQ ID NO: 1108
  Synthetic polynucleotide

SEQ ID NO: 1110 - DNA, 185 bp, Artificial Sequence
  Synthetic polynucleotide
atcatctcaccttgcctcctgtctacctggtttatcaacctgcaggggggtcaaagtccaatagaggggtcaaagtccaattcgggggtcaaagtccaatgacggggtcaaagtccaatctaggggtcaaagtccaatactggggtcaaagtccaattgcggcgcgccatgcttcatcagactct

SEQ ID NO: 1111 - DNA, 185 bp, Artificial Sequence; identical to SEQ ID NO: 1110
  Synthetic polynucleotide

SEQ ID NO: 1112 - DNA, 156 bp, Artificial Sequence
  Synthetic polynucleotide
atcatctcaccttgcctcctgactttatattctgccgacctgcaggtttaatggagatttaatggtcgtttaatgggactttaatggctatttaatggacttttaatggtgctttaatgggtatttaatggggcgcgccatgcttcatcagactct

SEQ ID NO: 1113 - DNA, 156 bp, Artificial Sequence; identical to SEQ ID NO: 1112
  Synthetic polynucleotide

SEQ ID NO: 1114 - DNA, 191 bp, Artificial Sequence
  Synthetic polynucleotide
atcatctcaccttgcctcctgtccaactactcgcccaccctgcaggcgcgttaattaattatgagacgcgttaattaattatgtcgcgcgttaattaattatggaccgcgttaattaattatgctacgcgttaattaattatgactcgcgttaattaattatgtgcggcgcgccatgcttcatcagactct

SEQ ID NO: 1115 - DNA, 191 bp, Artificial Sequence; identical to SEQ ID NO: 1114
  Synthetic polynucleotide

SEQ ID NO: 1116 - DNA, 164 bp, Artificial Sequence
  Synthetic polynucleotide
atcatctcaccttgcctcctggggtagttctcgccttacctgcaggtcatgtaatagatcatgtaattcgtcatgtaatgactcatgtaatctatcatgtaatacttcatgtaattgctcatgtaatgtatcatgtaatggcgcgccatgcttcatcagactct

SEQ ID NO: 1117 - DNA, 164 bp, Artificial Sequence; identical to SEQ ID NO: 1116
  Synthetic polynucleotide

SEQ ID NO: 1118 - DNA, 196 bp, Artificial Sequence
  Synthetic polynucleotide
atcatctcaccttgcctcctgggtaacttcgtagacctcctgcagggcaaagcaaacaaagagcaaagcaaacaatcggcaaagcaaacaagacgcaaagcaaacaactagcaaagcaaacaaactgcaaagcaaacaatgcgcaaagcaaacaagtagcaaagcaaacaaggcgcgccatgcttcatcagactct

SEQ ID NO: 1119 - DNA, 196 bp, Artificial Sequence; identical to SEQ ID NO: 1118
  Synthetic polynucleotide

SEQ ID NO: 1120 - DNA, 185 bp, Artificial Sequence
  Synthetic polynucleotide
atcatctcaccttgcctcctgttacgcacttatgtggtcctgcagggtgaacacctgttattagagtgaacacctgttatttcggtgaacacctgttattgacgtgaacacctgttattctagtgaacacctgttattactgtgaacacctgttatttgcggcgcgccatgcttcatcagactct

SEQ ID NO: 1121 - DNA, 185 bp, Artificial Sequence; identical to SEQ ID NO: 1120
  Synthetic polynucleotide

SEQ ID NO: 1122 - DNA, 191 bp, Artificial Sequence
  Synthetic polynucleotide
atcatctcaccttgcctcctggctggatgactgtaactcctgcaggtttttagttaactaagtagatttttagttaactaagttcgtttttagttaactaagtgactttttagttaactaagtctatttttagttaactaagtacttttttagttaactaagttgcggcgcgccatgcttcatcagactct

SEQ ID NO: 1123 - DNA, 191 bp, Artificial Sequence; identical to SEQ ID NO: 1122
  Synthetic polynucleotide

SEQ ID NO: 1124 - DNA, 156 bp, Artificial Sequence
  Synthetic polynucleotide
atcatctcaccttgcctcctggggtttcagcacaaattcctgcaggtttaatgaagatttaatgatcgtttaatgagactttaatgactatttaatgaacttttaatgatgctttaatgagtatttaatgaggcgcgccatgcttcatcagactct

SEQ ID NO: 1125 - DNA, 156 bp, Artificial Sequence; identical to SEQ ID NO: 1124
  Synthetic polynucleotide

SEQ ID NO: 1126 - DNA, 148 bp, Artificial Sequence
  Synthetic polynucleotide
atcatctcaccttgcctcctgcacggacccatttacgtcctgcaggacaattaagaacaattatcgacaattagacacaattactaacaattaactacaattatgcacaattagtaacaattaggcgcgccatgcttcatcagactct

SEQ ID NO: 1127 - DNA, 148 bp, Artificial Sequence; identical to SEQ ID NO: 1126
  Synthetic polynucleotide

SEQ ID NO: 1128 - DNA, 180 bp, Artificial Sequence
  Synthetic polynucleotide
atcatctcaccttgcctcctgtatgactctggtgagaccctgcagggatgactcacgagagatgactcacgtcggatgactcacggacgatgactcacgctagatgactcacgactgatgactcacgtgcgatgactcacggtagatgactcacgggcgcgccatgcttcatcagactct

SEQ ID NO: 1129 - DNA, 180 bp, Artificial Sequence; identical to SEQ ID NO: 1128
  Synthetic polynucleotide

SEQ ID NO: 1130 - DNA, 172 bp, Artificial Sequence
  Synthetic polynucleotide
atcatctcaccttgcctcctggaactagttgctgttgtcctgcaggaaaggtcaagagaaaaggtcaagtcgaaaggtcaaggacaaaggtcaagctaaaaggtcaagactaaaggtcaagtgcaaaggtcaaggtaaaaggtcaagggcgcgccatgcttcatcagactct

SEQ ID NO: 1131 - DNA, 172 bp, Artificial Sequence; identical to SEQ ID NO: 1130
  Synthetic polynucleotide

SEQ ID NO: 1132 - DNA, 172 bp, Artificial Sequence
  Synthetic polynucleotide
atcatctcaccttgcctcctgaactggacagataaactcctgcaggtatgcgggtaagatatgcgggtatcgtatgcgggtagactatgcgggtactatatgcgggtaacttatgcgggtatgctatgcgggtagtatatgcgggtaggcgcgccatgcttcatcagactct

SEQ ID NO: 1133 - DNA, 172 bp, Artificial Sequence; identical to SEQ ID NO: 1132
  Synthetic polynucleotide

SEQ ID NO: 1134 - DNA, 191 bp, Artificial Sequence
  Synthetic polynucleotide
atcatctcaccttgcctcctggggcatagggcaataaccctgcaggtaatgccacgtgcccccagataatgccacgtgccccctcgtaatgccacgtgcccccgactaatgccacgtgcccccctataatgccacgtgcccccacttaatgccacgtgccccctgcggcgcgccatgcttcatcagactct

SEQ ID NO: 1135 - DNA, 191 bp, Artificial Sequence; identical to SEQ ID NO: 1134
  Synthetic polynucleotide

SEQ ID NO: 1136 - DNA, 196 bp, Artificial Sequence
  Synthetic polynucleotide
atcatctcaccttgcctcctgctacaggccatacgctacctgcagggggtcaaaggtcaagagggtcaaaggtcatcggggtcaaaggtcagacgggtcaaaggtcactagggtcaaaggtcaactgggtcaaaggtcatgcgggtcaaaggtcagtagggtcaaaggtcaggcgcgccatgcttcatcagactct

SEQ ID NO: 1137 - DNA, 196 bp, Artificial Sequence; identical to SEQ ID NO: 1136
  Synthetic polynucleotide

SEQ ID NO: 1138 - DNA, 156 bp, Artificial Sequence
  Synthetic polynucleotide
atcatctcaccttgcctcctgtattgcgatggagccaacctgcaggtttgtggtagatttgtggttcgtttgtggtgactttgtggtctatttgtggtacttttgtggttgctttgtggtgtatttgtggtggcgcgccatgcttcatcagactct

SEQ ID NO: 1139 - DNA, 156 bp, Artificial Sequence; identical to SEQ ID NO: 1138
  Synthetic polynucleotide

SEQ ID NO: 1140 - DNA, 180 bp, Artificial Sequence
  Synthetic polynucleotide
atcatctcaccttgcctcctgtgcacacgtacgacaatcctgcaggacaaaccacagagaacaaaccacagtcgacaaaccacaggacacaaaccacagctaacaaaccacagactacaaaccacagtgcacaaaccacaggtaacaaaccacagggcgcgccatgcttcatcagactct

SEQ ID NO: 1141 - DNA, 180 bp, Artificial Sequence; identical to SEQ ID NO: 1140
  Synthetic polynucleotide

SEQ ID NO: 1142 - DNA, 197 bp, Artificial Sequence
  Synthetic polynucleotide
atcatctcaccttgcctcctgccgagactgagtcttgccctgcagggctgttgccagggagagagctgttgccagggagtcggctgttgccagggaggacgctgttgccagggagctagctgttgccagggagactgctgttgccagggagtgcgctgttgccagggaggtaggcgcgccatgcttcatcagactct

SEQ ID NO: 1143 - DNA, 197 bp, Artificial Sequence; identical to SEQ ID NO: 1142
  Synthetic polynucleotide

SEQ ID NO: 1144 - DNA, 180 bp, Artificial Sequence
  Synthetic polynucleotide
atcatctcaccttgcctcctgatcctaatctgaaccgtcctgcaggtatgtgggtcaagatatgtgggtcatcgtatgtgggtcagactatgtgggtcactatatgtgggtcaacttatgtgggtcatgctatgtgggtcagtatatgtgggtcaggcgcgccatgcttcatcagactct

SEQ ID NO: 1145 - DNA, 180 bp, Artificial Sequence; identical to SEQ ID NO: 1144
  Synthetic polynucleotide

SEQ ID NO: 1146 - DNA, 196 bp, Artificial Sequence
  Synthetic polynucleotide
atcatctcaccttgcctcctgttgtcccatgagtcgtgcctgcagggattaattaatttagagattaattaattttcggattaattaatttgacgattaattaatttctagattaattaatttactgattaattaattttgcgattaattaatttgtagattaattaatttggcgcgccatgcttcatcagactct

SEQ ID NO: 1147 - DNA, 196 bp, Artificial Sequence; identical to SEQ ID NO: 1146
  Synthetic polynucleotide

SEQ ID NO: 1148 - DNA, 164 bp, Artificial Sequence
  Synthetic polynucleotide
atcatctcaccttgcctcctgtaggaccggagtatacacctgcaggtcagcatttagatcagcattttcgtcagcatttgactcagcatttctatcagcatttacttcagcattttgctcagcatttgtatcagcatttggcgcgccatgcttcatcagactct

SEQ ID NO: 1149 - DNA, 164 bp, Artificial Sequence; identical to SEQ ID NO: 1148
  Synthetic polynucleotide

SEQ ID NO: 1150 - DNA, 156 bp, Artificial Sequence
  Synthetic polynucleotide
atcatctcaccttgcctcctgatgagaggtgccttcaccctgcaggatgactcaagaatgactcatcgatgactcagacatgactcactaatgactcaactatgactcatgcatgactcagtaatgactcaggcgcgccatgcttcatcagactct

SEQ ID NO: 1151 - DNA, 156 bp, Artificial Sequence; identical to SEQ ID NO: 1150
  Synthetic polynucleotide

SEQ ID NO: 1152 - DNA, 190 bp, Artificial Sequence
  Synthetic polynucleotide
atcatctcaccttgcctcctgggtaggacttcagacaacctgcaggtaattatgcaatgtagataattatgcaatgttcgtaattatgcaatgtgactaattatgcaatgtctataattatgcaatgtacttaattatgcaatgttgctaattatgcaatgtgtaggcgcgccatgcttcatcagactct

SEQ ID NO: 1153 - DNA, 190 bp, Artificial Sequence; identical to SEQ ID NO: 1152
  Synthetic polynucleotide

SEQ ID NO: 1154 - DNA, 188 bp, Artificial Sequence
  Synthetic polynucleotide
atcatctcaccttgcctcctgctccaagtgaatcctcccctgcaggaacagatggtcgagaaacagatggtcgtcgaacagatggtcggacaacagatggtcgctaaacagatggtcgactaacagatggtcgtgcaacagatggtcggtaaacagatggtcgggcgcgccatgcttcatcagactct

SEQ ID NO: 1155 - DNA, 188 bp, Artificial Sequence; identical to SEQ ID NO: 1154
  Synthetic polynucleotide

SEQ ID NO: 1156 - DNA, 172 bp, Artificial Sequence
  Synthetic polynucleotide
atcatctcaccttgcctcctgccagatgtcgctagaatcctgcaggccccccccacagaccccccccactcgccccccccacgacccccccccacctaccccccccacactccccccccactgcccccccccacgtaccccccccacggcgcgccatgcttcatcagactct

SEQ ID NO: 1157 - DNA, 172 bp, Artificial Sequence; identical to SEQ ID NO: 1156
  Synthetic polynucleotide

SEQ ID NO: 1158 - DNA, 197 bp, Artificial Sequence
  Synthetic polynucleotide
atcatctcaccttgcctcctgcctaaaggtgagcgatacctgcaggccttggaaatcccctagaccttggaaatccccttcgccttggaaatcccctgacccttggaaatcccctctaccttggaaatcccctactccttggaaatccccttgcccttggaaatcccctgtaggcgcgccatgcttcatcagactct

SEQ ID NO: 1159 - DNA, 197 bp, Artificial Sequence; identical to SEQ ID NO: 1158
  Synthetic polynucleotide

SEQ ID NO: 1160 - DNA, 164 bp, Artificial Sequence
  Synthetic polynucleotide
atcatctcaccttgcctcctgctcttacacggaaagaccctgcagggatcacgtgagagatcacgtgtcggatcacgtggacgatcacgtgctagatcacgtgactgatcacgtgtgcgatcacgtggtagatcacgtgggcgcgccatgcttcatcagactct

SEQ ID NO: 1161 - DNA, 164 bp, Artificial Sequence; identical to SEQ ID NO: 1160
  Synthetic polynucleotide

SEQ ID NO: 1162 - DNA, 164 bp, Artificial Sequence
  Synthetic polynucleotide
atcatctcaccttgcctcctggatgcatgaacttgggacctgcagggtaaacaatagagtaaacaattcggtaaacaatgacgtaaacaatctagtaaacaatactgtaaacaattgcgtaaacaatgtagtaaacaatggcgcgccatgcttcatcagactct

SEQ ID NO: 1163 - DNA, 164 bp, Artificial Sequence; identical to SEQ ID NO: 1162
  Synthetic polynucleotide

SEQ ID NO: 1164 - DNA, 188 bp, Artificial Sequence
  Synthetic polynucleotide
atcatctcaccttgcctcctggggtgcgtcatacgagacctgcaggttatgttaacatagattatgttaacattcgttatgttaacatgacttatgttaacatctattatgttaacatactttatgttaacattgcttatgttaacatgtattatgttaacatggcgcgccatgcttcatcagactct

SEQ ID NO: 1165 - DNA, 188 bp, Artificial Sequence; identical to SEQ ID NO: 1164
  Synthetic polynucleotide

SEQ ID NO: 1166 - DNA, 188 bp, Artificial Sequence
  Synthetic polynucleotide
atcatctcaccttgcctcctgcatcgtgaagagaagaacctgcaggatggcggcatggagaatggcggcatggtcgatggcggcatgggacatggcggcatggctaatggcggcatggactatggcggcatggtgcatggcggcatgggtaatggcggcatggggcgcgccatgcttcatcagactct

SEQ ID NO: 1167 - DNA, 188 bp, Artificial Sequence; identical to SEQ ID NO: 1166
  Synthetic polynucleotide

SEQ ID NO: 1168 - DNA, 172 bp, Artificial Sequence
  Synthetic polynucleotide
atcatctcaccttgcctcctgtggtcacactggtaggccctgcaggtaggaacataagataggaacatatcgtaggaacatagactaggaacatactataggaacataacttaggaacatatgctaggaacatagtataggaacataggcgcgccatgcttcatcagactct

SEQ ID NO: 1169 - DNA, 172 bp, Artificial Sequence; identical to SEQ ID NO: 1168
  Synthetic polynucleotide

SEQ ID NO: 1170 - DNA, 196 bp, Artificial Sequence
  Synthetic polynucleotide
atcatctcaccttgcctcctggttaagactttcctcgacctgcaggtcgtaacaaagagagatcgtaacaaagagtcgtcgtaacaaagaggactcgtaacaaagagctatcgtaacaaagagacttcgtaacaaagagtgctcgtaacaaagaggtatcgtaacaaagagggcgcgccatgcttcatcagactct

SEQ ID NO: 1171 - DNA, 196 bp, Artificial Sequence; identical to SEQ ID NO: 1170
  Synthetic polynucleotide

SEQ ID NO: 1172 - DNA, 164 bp, Artificial Sequence
  Synthetic polynucleotide
atcatctcaccttgcctcctgaggataccgacttgtagcctgcagggtaaacaaaagagtaaacaaatcggtaaacaaagacgtaaacaaactagtaaacaaaactgtaaacaaatgcgtaaacaaagtagtaaacaaaggcgcgccatgcttcatcagactct

SEQ ID NO: 1173 - DNA, 164 bp, Artificial Sequence; identical to SEQ ID NO: 1172
  Synthetic polynucleotide

SEQ ID NO: 1174 - DNA, 191 bp, Artificial Sequence
  Synthetic polynucleotide
atcatctcaccttgcctcctgcagtttcggcgaagtgtcctgcaggtcaggggtcaaaggtcacccgagatcaggggtcaaaggtcacccgtcgtcaggggtcaaaggtcacccggactcaggggtcaaaggtcacccgctatcaggggtcaaaggtcacccgactggcgcgccatgcttcatcagactct

SEQ ID NO: 1175 - DNA, 191 bp, Artificial Sequence; identical to SEQ ID NO: 1174
  Synthetic polynucleotide

SEQ ID NO: 1176 - DNA, 164 bp, Artificial Sequence
  Synthetic polynucleotide
atcatctcaccttgcctcctgtgtggaccctactcaaacctgcagggtaaacaacagagtaaacaactcggtaaacaacgacgtaaacaacctagtaaacaacactgtaaacaactgcgtaaacaacgtagtaaacaacggcgcgccatgcttcatcagactct

SEQ ID NO: 1177 - DNA, 164 bp, Artificial Sequence; identical to SEQ ID NO: 1176
  Synthetic polynucleotide

SEQ ID NO: 1178 - DNA, 190 bp, Artificial Sequence
  Synthetic polynucleotide
atcatctcaccttgcctcctgccgtacatctttatgaccctgcaggtctcgcgagatttgagatctcgcgagatttgtcgtctcgcgagatttggactctcgcgagatttgctatctcgcgagatttgacttctcgcgagatttgtgctctcgcgagatttggtaggcgcgccatgcttcatcagactct

SEQ ID NO: 1179 - DNA, 190 bp, Artificial Sequence; identical to SEQ ID NO: 1178
  Synthetic polynucleotide

SEQ ID NO: 1180 - DNA, 185 bp, Artificial Sequence
  Synthetic polynucleotide
atcatctcaccttgcctcctgccattaaacgcgaatcgcctgcaggaaattaattggttttgagaaaattaattggttttgtcgaaattaattggttttggacaaattaattggttttgctaaaattaattggttttgactaaattaattggttttgtgcggcgcgccatgcttcatcagactct

SEQ ID NO: 1181 - DNA, 185 bp, Artificial Sequence; identical to SEQ ID NO: 1180
  Synthetic polynucleotide

SEQ ID NO: 1182 - DNA, 190 bp, Artificial Sequence
  Synthetic polynucleotide
atcatctcaccttgcctcctgctacaatatccagctaacctgcaggaaaccacgtggtttagaaaaccacgtggttttcgaaaccacgtggtttgacaaaccacgtggtttctaaaaccacgtggtttactaaaccacgtggttttgcaaaccacgtggtttgtaggcgcgccatgcttcatcagactct

SEQ ID NO: 1183 - DNA, 190 bp, Artificial Sequence; identical to SEQ ID NO: 1182
  Synthetic polynucleotide

SEQ ID NO: 1184 - DNA, 197 bp, Artificial Sequence
  Synthetic polynucleotide
atcatctcaccttgcctcctgtcgcacttgggagataccctgcaggcgtcacgcatgagtgctcagacgtcacgcatgagtgctctcgcgtcacgcatgagtgctcgaccgtcacgcatgagtgctcctacgtcacgcatgagtgctcactcgtcacgcatgagtgctctgcggcgcgccatgcttcatcagactct

SEQ ID NO: 1185 - DNA, 197 bp, Artificial Sequence; identical to SEQ ID NO: 1184
  Synthetic polynucleotide

SEQ ID NO: 1186 - DNA, 140 bp, Artificial Sequence
  Synthetic polynucleotide
atcatctcaccttgcctcctgcgctacggccctgtattcctgcaggtgccccagatgcccctcgtgccccgactgccccctatgccccacttgcccctgctgccccgtatgccccggcgcgccatgcttcatcagactct

SEQ ID NO: 1187 - DNA, 140 bp, Artificial Sequence; identical to SEQ ID NO: 1186
  Synthetic polynucleotide

SEQ ID NO: 1188 - DNA, 185 bp, Artificial Sequence
  Synthetic polynucleotide
atcatctcaccttgcctcctgacatccttcttggaacgcctgcaggaacactgcacattgttagaaacactgcacattgtttcgaacactgcacattgttgacaacactgcacattgttctaaacactgcacattgttactaacactgcacattgtttgcggcgcgccatgcttcatcagactct

SEQ ID NO: 1189 - DNA, 185 bp, Artificial Sequence; identical to SEQ ID NO: 1188
  Synthetic polynucleotide

SEQ ID NO: 1190 - DNA, 197 bp, Artificial Sequence
  Synthetic polynucleotide
atcatctcaccttgcctcctgtccaaggcagctggtctcctgcaggttggcaccgtgccaaagattggcaccgtgccaatcgttggcaccgtgccaagacttggcaccgtgccaactattggcaccgtgccaaactttggcaccgtgccaatgcttggcaccgtgccaagtaggcgcgccatgcttcatcagactct

SEQ ID NO: 1191 - DNA, 197 bp, Artificial Sequence; identical to SEQ ID NO: 1190
  Synthetic polynucleotide

SEQ ID NO: 1192 - DNA, 180 bp, Artificial Sequence
  Synthetic polynucleotide
atcatctcaccttgcctcctgagacgagtggttggctgcctgcaggtttttatggccagatttttatggcctcgtttttatggccgactttttatggccctatttttatggccacttttttatggcctgctttttatggccgtatttttatggccggcgcgccatgcttcatcagactct

SEQ ID NO: 1193 - DNA, 180 bp, Artificial Sequence; identical to SEQ ID NO: 1192
  Synthetic polynucleotide

SEQ ID NO: 1194 - DNA, 191 bp, Artificial Sequence
  Synthetic polynucleotide
atcatctcaccttgcctcctggaacacgttatacccggcctgcaggatcgatcagttatcgatagaatcgatcagttatcgattcgatcgatcagttatcgatgacatcgatcagttatcgatctaatcgatcagttatcgatactatcgatcagttatcgattgcggcgcgccatgcttcatcagactct

SEQ ID NO: 1195 - DNA, 191 bp, Artificial Sequence; identical to SEQ ID NO: 1194
  Synthetic polynucleotide

SEQ ID NO: 1196 - DNA, 185 bp, Artificial Sequence
  Synthetic polynucleotide
atcatctcaccttgcctcctgtagttcatcgactgtgtcctgcaggcccacggttactgccgagacccacggttactgccgtcgcccacggttactgccggaccccacggttactgccgctacccacggttactgccgactcccacggttactgccgtgcggcgcgccatgcttcatcagactct

SEQ ID NO: 1197 - DNA, 185 bp, Artificial Sequence; identical to SEQ ID NO: 1196
  Synthetic polynucleotide

SEQ ID NO: 1198 - DNA, 185 bp, Artificial Sequence
  Synthetic polynucleotide
atcatctcaccttgcctcctgcagtcgacctttacgatcctgcaggcggcgccccctggtggagacggcgccccctggtggtcgcggcgccccctggtgggaccggcgccccctggtggctacggcgccccctggtggactcggcgccccctggtggtgcggcgcgccatgcttcatcagactct

SEQ ID NO: 1199 - DNA, 185 bp, Artificial Sequence; identical to SEQ ID NO: 1198
  Synthetic polynucleotide

SEQ ID NO: 1200 - DNA, 172 bp, Artificial Sequence
  Synthetic polynucleotide
atcatctcaccttgcctcctgcttatcaggcatttctgcctgcaggttacgtaataagattacgtaatatcgttacgtaatagacttacgtaatactattacgtaataactttacgtaatatgcttacgtaatagtattacgtaataggcgcgccatgcttcatcagactct

SEQ ID NO: 1201 - DNA, 172 bp, Artificial Sequence; identical to SEQ ID NO: 1200
  Synthetic polynucleotide

SEQ ID NO: 1202 - DNA, 156 bp, Artificial Sequence
  Synthetic polynucleotide
atcatctcaccttgcctcctgtacacactaggatcctgcctgcaggcagatggcagacagatggctcgcagatggcgaccagatggcctacagatggcactcagatggctgccagatggcgtacagatggcggcgcgccatgcttcatcagactct

SEQ ID NO: 1203 - DNA, 156 bp, Artificial Sequence; identical to SEQ ID NO: 1202
  Synthetic polynucleotide

SEQ ID NO: 1204 - DNA, 148 bp, Artificial Sequence
  Synthetic polynucleotide
atcatctcaccttgcctcctgcaaggcacagagcgtaacctgcaggacttcctagaacttccttcgacttcctgacacttcctctaacttcctactacttccttgcacttcctgtaacttcctggcgcgccatgcttcatcagactct

SEQ ID NO: 1205 - DNA, 148 bp, Artificial Sequence; identical to SEQ ID NO: 1204
  Synthetic polynucleotide

SEQ ID NO: 1206 - DNA, 197 bp, Artificial Sequence
  Synthetic polynucleotide
atcatctcaccttgcctcctgaggtgcggtaataagcccctgcaggttgccttatttgggcatgagattgccttatttgggcatgtcgttgccttatttgggcatggacttgccttatttgggcatgctattgccttatttgggcatgactttgccttatttgggcatgtgcggcgcgccatgcttcatcagactct

SEQ ID NO: 1207 - DNA, 197 bp, Artificial Sequence; identical to SEQ ID NO: 1206
  Synthetic polynucleotide

SEQ ID NO: 1208 - DNA, 191 bp, Artificial Sequence
  Synthetic polynucleotide
atcatctcaccttgcctcctgatctaacgacccgttcccctgcaggtatatacatgtaaaattagatatatacatgtaaaatttcgtatatacatgtaaaattgactatatacatgtaaaattctatatatacatgtaaaattacttatatacatgtaaaatttgcggcgcgccatgcttcatcagactct

SEQ ID NO: 1209 - DNA, 191 bp, Artificial Sequence; identical to SEQ ID NO: 1208
  Synthetic polynucleotide

SEQ ID NO: 1210 - DNA, 197 bp, Artificial Sequence
  Synthetic polynucleotide
atcatctcaccttgcctcctgttgagcagattcgcccacctgcaggttaaccaatataaccaatagattaaccaatataaccaattcgttaaccaatataaccaatgacttaaccaatataaccaatctattaaccaatataaccaatactttaaccaatataaccaattgcggcgcgccatgcttcatcagactct

SEQ ID NO: 1211 - DNA, 197 bp, Artificial Sequence; identical to SEQ ID NO: 1210
  Synthetic polynucleotide

SEQ ID NO: 1212 - DNA, 172 bp, Artificial Sequence
  Synthetic polynucleotide
atcatctcaccttgcctcctgttaataccgggtcggtacctgcaggggtgacctctagaggtgacctcttcgggtgacctctgacggtgacctctctaggtgacctctactggtgacctcttgcggtgacctctgtaggtgacctctggcgcgccatgcttcatcagactct

SEQ ID NO: 1213 - DNA, 172 bp, Artificial Sequence; identical to SEQ ID NO: 1212
  Synthetic polynucleotide

SEQ ID NO: 1214 - DNA, 180 bp, Artificial Sequence
  Synthetic polynucleotide
atcatctcaccttgcctcctgttctaagttcaccagagcctgcagggtcacgtgatcagagtcacgtgatctcggtcacgtgatcgacgtcacgtgatcctagtcacgtgatcactgtcacgtgatctgcgtcacgtgatcgtagtcacgtgatcggcgcgccatgcttcatcagactct

SEQ ID NO: 1215 - DNA, 180 bp, Artificial Sequence; identical to SEQ ID NO: 1214
  Synthetic polynucleotide

SEQ ID NO: 1216 - DNA, 183 bp, Artificial Sequence
  Synthetic polynucleotide
atcatctcaccttgcctcctgacccttaacgagtagctcctgcagggcggggcattctgggaattgtagttagagcggggcattctgggaattgtagtttcggcggggcattctgggaattgtagttgacgcggggcattctgggaattgtagttctaggcgcgccatgcttcatcagactct

SEQ ID NO: 1217 - DNA, 183 bp, Artificial Sequence; identical to SEQ ID NO: 1216
  Synthetic polynucleotide

SEQ ID NO: 1218 - DNA, 172 bp, Artificial Sequence
  Synthetic polynucleotide
atcatctcaccttgcctcctggttcttggttaggttgccctgcaggattgcacaatagaattgcacaattcgattgcacaatgacattgcacaatctaattgcacaatactattgcacaattgcattgcacaatgtaattgcacaatggcgcgccatgcttcatcagactct

SEQ ID NO: 1219 - DNA, 172 bp, Artificial Sequence; identical to SEQ ID NO: 1218
  Synthetic polynucleotide

SEQ ID NO: 1220 - DNA, 180 bp, Artificial Sequence
  Synthetic polynucleotide
atcatctcaccttgcctcctgtagtaagcgtatcacctcctgcagggcgggcgctggagagcgggcgctggtcggcgggcgctgggacgcgggcgctggctagcgggcgctggactgcgggcgctggtgcgcgggcgctgggtagcgggcgctggggcgcgccatgcttcatcagactct

SEQ ID NO: 1221 - DNA, 180 bp, Artificial Sequence; identical to SEQ ID NO: 1220
  Synthetic polynucleotide

SEQ ID NO: 1222 - DNA, 197 bp, Artificial Sequence
  Synthetic polynucleotide
atcatctcaccttgcctcctgcccggtgagtgtctaatcctgcaggtagtgatcatcattaagatagtgatcatcattatcgtagtgatcatcattagactagtgatcatcattactatagtgatcatcattaacttagtgatcatcattatgctagtgatcatcattagtaggcgcgccatgcttcatcagactct

SEQ ID NO: 1223 - DNA, 197 bp, Artificial Sequence; identical to SEQ ID NO: 1222
  Synthetic polynucleotide

SEQ ID NO: 1224 - DNA, 190 bp, Artificial Sequence
  Synthetic polynucleotide
atcatctcaccttgcctcctgggcgcagcagttgatatcctgcagggttgccatggcaacagagttgccatggcaactcggttgccatggcaacgacgttgccatggcaacctagttgccatggcaacactgttgccatggcaactgcgttgccatggcaacgtaggcgcgccatgcttcatcagactct

SEQ ID NO: 1225 - DNA, 190 bp, Artificial Sequence; identical to SEQ ID NO: 1224
  Synthetic polynucleotide

SEQ ID NO: 1226 - DNA, 191 bp, Artificial Sequence
  Synthetic polynucleotide
atcatctcaccttgcctcctgcacatccttcagaatgccctgcagggacaattaatccctacaagagacaattaatccctacatcggacaattaatccctacagacgacaattaatccctacactagacaattaatccctacaactgacaattaatccctacatgcggcgcgccatgcttcatcagactct

SEQ ID NO: 1227 - DNA, 191 bp, Artificial Sequence; identical to SEQ ID NO: 1226
  Synthetic polynucleotide

SEQ ID NO: 1228 - DNA, 185 bp, Artificial Sequence
  Synthetic polynucleotide
atcatctcaccttgcctcctgtcaagattaccgtgaaacctgcaggaggggtcaagggttcaagaaggggtcaagggttcatcgaggggtcaagggttcagacaggggtcaagggttcactaaggggtcaagggttcaactaggggtcaagggttcatgcggcgcgccatgcttcatcagactct

SEQ ID NO: 1229 - DNA, 185 bp, Artificial Sequence; identical to SEQ ID NO: 1228
  Synthetic polynucleotide

SEQ ID NO: 1230 - DNA, 185 bp, Artificial Sequence
  Synthetic polynucleotide
atcatctcaccttgcctcctggaaacacacgtaataagcctgcaggaaaatggcgccattttagaaaaatggcgccatttttcgaaaatggcgccattttgacaaaatggcgccattttctaaaaatggcgccattttactaaaatggcgccatttttgcggcgcgccatgcttcatcagactct

SEQ ID NO: 1231 - DNA, 185 bp, Artificial Sequence; identical to SEQ ID NO: 1230
  Synthetic polynucleotide

SEQ ID NO: 1232 - DNA, 172 bp, Artificial Sequence
  Synthetic polynucleotide
atcatctcaccttgcctcctggaaactccaagtggtcacctgcaggtcatttccttagatcatttcctttcgtcatttccttgactcatttccttctatcatttccttacttcatttcctttgctcatttccttgtatcatttccttggcgcgccatgcttcatcagactct

SEQ ID NO: 1233 - DNA, 172 bp, Artificial Sequence; identical to SEQ ID NO: 1232
  Synthetic polynucleotide

SEQ ID NO: 1234 - DNA, 197 bp, Artificial Sequence
  Synthetic polynucleotide
atcatctcaccttgcctcctgggattaccctggtgtgtcctgcaggtggccaccagggggcgccagatggccaccagggggcgcctcgtggccaccagggggcgccgactggccaccagggggcgccctatggccaccagggggcgccacttggccaccagggggcgcctgcggcgcgccatgcttcatcagactct

SEQ ID NO: 1235 - DNA, 197 bp, Artificial Sequence; identical to SEQ ID NO: 1234
  Synthetic polynucleotide

SEQ ID NO: 1236 - DNA, 188 bp, Artificial Sequence
  Synthetic polynucleotide
atcatctcaccttgcctcctgcactacgatactctctgcctgcagggaggggggcggaagagaggggggcggatcggaggggggcggagacgaggggggcggactagaggggggcggaactgaggggggcggatgcgaggggggcggagtagaggggggcggaggcgcgccatgcttcatcagactct

SEQ ID NO: 1237 - DNA, 188 bp, Artificial Sequence; identical to SEQ ID NO: 1236
  Synthetic polynucleotide

SEQ ID NO: 1238 - DNA, 200 bp, Artificial Sequence
  Synthetic polynucleotide
atcatctcaccttgcctcctgaacgttccatctgctgtcctgcaggtggaggcgaccactaatggggaagttggcaagatggaggcgaccactaatggggaagttggcatcgtggaggcgaccactaatggggaagttggcagactggaggcgaccactaatggggaagttggcaggcgcgccatgcttcatcagactct

SEQ ID NO: 1239 - DNA, 200 bp, Artificial Sequence; identical to SEQ ID NO: 1238
  Synthetic polynucleotide

SEQ ID NO: 1240 - DNA, 172 bp, Artificial Sequence
  Synthetic polynucleotide
atcatctcaccttgcctcctgcgactgcgttccttctccctgcaggattgcacaacagaattgcacaactcgattgcacaacgacattgcacaacctaattgcacaacactattgcacaactgcattgcacaacgtaattgcacaacggcgcgccatgcttcatcagactct

SEQ ID NO: 1241 - DNA, 172 bp, Artificial Sequence; identical to SEQ ID NO: 1240
  Synthetic polynucleotide

SEQ ID NO: 1242 - DNA, 148 bp, Artificial Sequence
  Synthetic polynucleotide
atcatctcaccttgcctcctgtctccttagtatcatgtcctgcaggttaatgaagattaatgatcgttaatgagacttaatgactattaatgaactttaatgatgcttaatgagtattaatgaggcgcgccatgcttcatcagactct

SEQ ID NO: 1243 - DNA, 148 bp, Artificial Sequence; identical to SEQ ID NO: 1242
  Synthetic polynucleotide

SEQ ID NO: 1244 - DNA, 188 bp, Artificial Sequence
  Synthetic polynucleotide
atcatctcaccttgcctcctgtatggtaggaagcactccctgcaggaccgttaaacggagaaccgttaaacggtcgaccgttaaacgggacaccgttaaacggctaaccgttaaacggactaccgttaaacggtgcaccgttaaacgggtaaccgttaaacggggcgcgccatgcttcatcagactct

SEQ ID NO: 1245 - DNA, 188 bp, Artificial Sequence; identical to SEQ ID NO: 1244
  Synthetic polynucleotide

SEQ ID NO: 1246 - DNA, 197 bp, Artificial Sequence
  Synthetic polynucleotide
atcatctcaccttgcctcctggcagcagtgtccatgatcctgcaggaaaaaaaaaaaaaccagaaaaaaaaaaaaaacctcgaaaaaaaaaaaaaccgacaaaaaaaaaaaaaccctaaaaaaaaaaaaaaccactaaaaaaaaaaaaacctgcaaaaaaaaaaaaaccgtaggcgcgccatgcttcatcagactct

SEQ ID NO: 1247 - DNA, 197 bp, Artificial Sequence; identical to SEQ ID NO: 1246
  Synthetic polynucleotide

SEQ ID NO: 1248 - DNA, 185 bp, Artificial Sequence
  Synthetic polynucleotide
atcatctcaccttgcctcctgctttataatcatgaccccctgcaggggaataattacttcagagaggaataattacttcagtcgggaataattacttcaggacggaataattacttcagctaggaataattacttcagactggaataattacttcagtgcggcgcgccatgcttcatcagactct

SEQ ID NO: 1249 - DNA, 185 bp, Artificial Sequence; identical to SEQ ID NO: 1248
  Synthetic polynucleotide

SEQ ID NO: 1250 - DNA, 198 bp, Artificial Sequence
  Synthetic polynucleotide
atcatctcaccttgcctcctgctcctcctaacagtgctcctgcaggaagtaggtcacggtgacctacttagaaagtaggtcacggtgacctactttcgaagtaggtcacggtgacctacttgacaagtaggtcacggtgacctacttctaaagtaggtcacggtgacctacttggcgcgccatgcttcatcagactct

SEQ ID NO: 1251 - DNA, 198 bp, Artificial Sequence; identical to SEQ ID NO: 1250
  Synthetic polynucleotide

SEQ ID NO: 1252 - DNA, 164 bp, Artificial Sequence
  Synthetic polynucleotide
atcatctcaccttgcctcctgattgtggagatatctgacctgcagggcaataaaaagagcaataaaatcggcaataaaagacgcaataaaactagcaataaaaactgcaataaaatgcgcaataaaagtagcaataaaaggcgcgccatgcttcatcagactct

SEQ ID NO: 1253 - DNA, 164 bp, Artificial Sequence; identical to SEQ ID NO: 1252
  Synthetic polynucleotide

SEQ ID NO: 1254 - DNA, 197 bp, Artificial Sequence
  Synthetic polynucleotide
atcatctcaccttgcctcctgtaccgtcaatctgtagtcctgcaggtgacccggaagtggtagatgacccggaagtggttcgtgacccggaagtggtgactgacccggaagtggtctatgacccggaagtggtacttgacccggaagtggttgctgacccggaagtggtgtaggcgcgccatgcttcatcagactct

SEQ ID NO: 1255 - DNA, 197 bp, Artificial Sequence; identical to SEQ ID NO: 1254
  Synthetic polynucleotide

SEQ ID NO: 1256 - DNA, 172 bp, Artificial Sequence
  Synthetic polynucleotide
atcatctcaccttgcctcctgagtttaatcatgtcacccctgcagggccccacccaagagccccacccatcggccccacccagacgccccacccactagccccacccaactgccccacccatgcgccccacccagtagccccacccaggcgcgccatgcttcatcagactct

SEQ ID NO: 1257 - DNA, 172 bp, Artificial Sequence; identical to SEQ ID NO: 1256
  Synthetic polynucleotide

SEQ ID NO: 1258 - DNA, 196 bp, Artificial Sequence
  Synthetic polynucleotide
atcatctcaccttgcctcctgcgtagtcctcatcgctgcctgcaggacttgggaataccagaacttgggaatacctcgacttgggaataccgacacttgggaataccctaacttgggaataccactacttgggaatacctgcacttgggaataccgtaacttgggaataccggcgcgccatgcttcatcagactct

SEQ ID NO: 1259 - DNA, 196 bp, Artificial Sequence; identical to SEQ ID NO: 1258
  Synthetic polynucleotide

SEQ ID NO: 1260 - DNA, 172 bp, Artificial Sequence
  Synthetic polynucleotide
atcatctcaccttgcctcctgtctggcagtctctctgacctgcaggtccagctgctagatccagctgcttcgtccagctgctgactccagctgctctatccagctgctacttccagctgcttgctccagctgctgtatccagctgctggcgcgccatgcttcatcagactct

SEQ ID NO: 1261 - DNA, 172 bp, Artificial Sequence; identical to SEQ ID NO: 1260
  Synthetic polynucleotide

SEQ ID NO: 1262 - DNA, 196 bp, Artificial Sequence
  Synthetic polynucleotide
atcatctcaccttgcctcctgcgtaactgtgttagaggcctgcaggtgccccgggggcaagatgccccgggggcatcgtgccccgggggcagactgccccgggggcactatgccccgggggcaacttgccccgggggcatgctgccccgggggcagtatgccccgggggcaggcgcgccatgcttcatcagactct

SEQ ID NO: 1263 - DNA, 196 bp, Artificial Sequence; identical to SEQ ID NO: 1262
  Synthetic polynucleotide

SEQ ID NO: 1264 - DNA, 191 bp, Artificial Sequence
  Synthetic polynucleotide
atcatctcaccttgcctcctgaaagccctgagttgattcctgcaggtacattaattaacgctcagatacattaattaacgctctcgtacattaattaacgctcgactacattaattaacgctcctatacattaattaacgctcacttacattaattaacgctctgcggcgcgccatgcttcatcagactct

SEQ ID NO: 1265 - DNA, 191 bp, Artificial Sequence; identical to SEQ ID NO: 1264
  Synthetic polynucleotide

SEQ ID NO: 1266 - DNA, 190 bp, Artificial Sequence
  Synthetic polynucleotide
atcatctcaccttgcctcctggacaaacgagcagccgtcctgcaggactaaccaatcagaagaactaaccaatcagatcgactaaccaatcagagacactaaccaatcagactaactaaccaatcagaactactaaccaatcagatgcactaaccaatcagagtaggcgcgccatgcttcatcagactct

SEQ ID NO: 1267 - DNA, 190 bp, Artificial Sequence; identical to SEQ ID NO: 1266
  Synthetic polynucleotide

SEQ ID NO: 1268 - DNA, 191 bp, Artificial Sequence
  Synthetic polynucleotide
atcatctcaccttgcctcctgggtgtgatagctcaacacctgcaggacagcgccccctggtggccacagaacagcgccccctggtggccactcgacagcgccccctggtggccacgacacagcgccccctggtggccacctaacagcgccccctggtggccacactggcgcgccatgcttcatcagactct

SEQ ID NO: 1269 - DNA, 191 bp, Artificial Sequence; identical to SEQ ID NO: 1268
  Synthetic polynucleotide

SEQ ID NO: 1270 - DNA, 190 bp, Artificial Sequence
  Synthetic polynucleotide
atcatctcaccttgcctcctgctcgcattccaatgtagcctgcaggttggcatggtgccaagattggcatggtgccatcgttggcatggtgccagacttggcatggtgccactattggcatggtgccaactttggcatggtgccatgcttggcatggtgccagtaggcgcgccatgcttcatcagactct

SEQ ID NO: 1271 - DNA, 190 bp, Artificial Sequence; identical to SEQ ID NO: 1270
  Synthetic polynucleotide

SEQ ID NO: 1272 - DNA, 197 bp, Artificial Sequence
  Synthetic polynucleotide
atcatctcaccttgcctcctgcggtttatcggtcagatcctgcagggggggcaaaggtcacagagggggcaaaggtcactcggggggcaaaggtcacgacgggggcaaaggtcacctagggggcaaaggtcacactgggggcaaaggtcactgcgggggcaaaggtcacgtaggcgcgccatgcttcatcagactct

SEQ ID NO: 1273 - DNA, 197 bp, Artificial Sequence; identical to SEQ ID NO: 1272
  Synthetic polynucleotide

SEQ ID NO: 1274 - DNA, 191 bp, Artificial Sequence
  Synthetic polynucleotide
atcatctcaccttgcctcctgatttccgctacgggatccctgcaggtcgcatgaccttgaataagatcgcatgaccttgaatatcgtcgcatgaccttgaatagactcgcatgaccttgaatactatcgcatgaccttgaataacttcgcatgaccttgaatatgcggcgcgccatgcttcatcagactct

SEQ ID NO: 1275 - DNA, 191 bp, Artificial Sequence; identical to SEQ ID NO: 1274
  Synthetic polynucleotide

SEQ ID NO: 1276 - DNA, 180 bp, Artificial Sequence
  Synthetic polynucleotide
atcatctcaccttgcctcctgggacgtcaagacaatgacctgcaggagatgcttatcagaagatgcttatctcgagatgcttatcgacagatgcttatcctaagatgcttatcactagatgcttatctgcagatgcttatcgtaagatgcttatcggcgcgccatgcttcatcagactct

SEQ ID NO: 1277 - DNA, 180 bp, Artificial Sequence; identical to SEQ ID NO: 1276
  Synthetic polynucleotide

SEQ ID NO: 1278 - DNA, 180 bp, Artificial Sequence
  Synthetic polynucleotide
atcatctcaccttgcctcctgaacgggacatattactacctgcaggtttcccggaaaagatttcccggaaatcgtttcccggaaagactttcccggaaactatttcccggaaaacttttcccggaaatgctttcccggaaagtatttcccggaaaggcgcgccatgcttcatcagactct

SEQ ID NO: 1279 - DNA, 180 bp, Artificial Sequence; identical to SEQ ID NO: 1278
  Synthetic polynucleotide

SEQ ID NO: 1280 - DNA, 197 bp, Artificial Sequence
  Synthetic polynucleotide
atcatctcaccttgcctcctgggtacagatatccttaacctgcaggccctaagtaaacaaaagaccctaagtaaacaaatcgccctaagtaaacaaagacccctaagtaaacaaactaccctaagtaaacaaaactccctaagtaaacaaatgcccctaagtaaacaaagtaggcgcgccatgcttcatcagactct

SEQ ID NO: 1281 - DNA, 197 bp, Artificial Sequence; identical to SEQ ID NO: 1280
  Synthetic polynucleotide

SEQ ID NO: 1282 - DNA, 197 bp, Artificial Sequence
  Synthetic polynucleotide
atcatctcaccttgcctcctgtccaggagcattaagagcctgcaggttgcaaaacaaaggcagattgcaaaacaaaggctcgttgcaaaacaaaggcgacttgcaaaacaaaggcctattgcaaaacaaaggcactttgcaaaacaaaggctgcttgcaaaacaaaggcgtaggcgcgccatgcttcatcagactct

SEQ ID NO: 1283 - DNA, 197 bp, Artificial Sequence; identical to SEQ ID NO: 1282
  Synthetic polynucleotide

SEQ ID NO: 1284 - DNA, 156 bp, Artificial Sequence
  Synthetic polynucleotide
atcatctcaccttgcctcctgaatcaagtggatccgcgcctgcaggtcgcacttagatcgcactttcgtcgcacttgactcgcacttctatcgcacttacttcgcactttgctcgcacttgtatcgcacttggcgcgccatgcttcatcagactct

SEQ ID NO: 1285 - DNA, 156 bp, Artificial Sequence; identical to SEQ ID NO: 1284
  Synthetic polynucleotide

SEQ ID NO: 1286 - DNA, 197 bp, Artificial Sequence
  Synthetic polynucleotide
atcatctcaccttgcctcctgacacacaagtcctgcgccctgcaggtccaggtcaccctgacctagatccaggtcaccctgaccttcgtccaggtcaccctgacctgactccaggtcaccctgacctctatccaggtcaccctgacctacttccaggtcaccctgaccttgcggcgcgccatgcttcatcagactct

SEQ ID NO: 1287 - DNA, 197 bp, Artificial Sequence; identical to SEQ ID NO: 1286
  Synthetic polynucleotide

SEQ ID NO: 1288 - DNA, 156 bp, Artificial Sequence
  Synthetic polynucleotide
atcatctcaccttgcctcctgagtgctcaccatatgtccctgcaggtattgttaagatattgttatcgtattgttagactattgttactatattgttaacttattgttatgctattgttagtatattgttaggcgcgccatgcttcatcagactct

SEQ ID NO: 1289 - DNA, 156 bp, Artificial Sequence; identical to SEQ ID NO: 1288
  Synthetic polynucleotide

SEQ ID NO: 1290 - DNA, 180 bp, Artificial Sequence
  Synthetic polynucleotide
atcatctcaccttgcctcctggttaaatttacatgcgccctgcagggtgagttccagagagtgagttccagtcggtgagttccaggacgtgagttccagctagtgagttccagactgtgagttccagtgcgtgagttccaggtagtgagttccagggcgcgccatgcttcatcagactct

SEQ ID NO: 1291 - DNA, 180 bp, Artificial Sequence; identical to SEQ ID NO: 1290
  Synthetic polynucleotide

SEQ ID NO: 1292 - DNA, 156 bp, Artificial Sequence
  Synthetic polynucleotide
atcatctcaccttgcctcctggttactgggctacccgacctgcaggtattgttcagatattgttctcgtattgttcgactattgttcctatattgttcacttattgttctgctattgttcgtatattgttcggcgcgccatgcttcatcagactct

SEQ ID NO: 1293 - DNA, 156 bp, Artificial Sequence; identical to SEQ ID NO: 1292
  Synthetic polynucleotide

SEQ ID NO: 1294 - DNA, 196 bp, Artificial Sequence
  Synthetic polynucleotide
atcatctcaccttgcctcctgtaactcccggtagcagtcctgcaggggccgccatcttgagaggccgccatcttgtcgggccgccatcttggacggccgccatcttgctaggccgccatcttgactggccgccatcttgtgcggccgccatcttggtaggccgccatcttgggcgcgccatgcttcatcagactct

SEQ ID NO: 1295 - DNA, 196 bp, Artificial Sequence; identical to SEQ ID NO: 1294
  Synthetic polynucleotide

SEQ ID NO: 1296 - DNA, 148 bp, Artificial Sequence
  Synthetic polynucleotide
atcatctcaccttgcctcctggccctcacagttacatccctgcaggatataaaagaatataaatcgatataaagacatataaactaatataaaactatataaatgcatataaagtaatataaaggcgcgccatgcttcatcagactct

SEQ ID NO: 1297 - DNA, 148 bp, Artificial Sequence; identical to SEQ ID NO: 1296
  Synthetic polynucleotide

SEQ ID NO: 1298 - DNA, 197 bp, Artificial Sequence
  Synthetic polynucleotide
atcatctcaccttgcctcctggacatcgatgattacttcctgcaggggcaccagctgcgccagaggcaccagctgcgcctcgggcaccagctgcgccgacggcaccagctgcgccctaggcaccagctgcgccactggcaccagctgcgcctgcggcaccagctgcgccgtaggcgcgccatgcttcatcagactct

SEQ ID NO: 1299 - DNA, 197 bp, Artificial Sequence; identical to SEQ ID NO: 1298
  Synthetic polynucleotide

SEQ ID NO: 1300 - DNA, 197 bp, Artificial Sequence
  Synthetic polynucleotide
atcatctcaccttgcctcctgtcaatggctgggtaatccctgcaggcccccggctagcgtgagaagacccccggctagcgtgagatcgcccccggctagcgtgagagaccccccggctagcgtgagactacccccggctagcgtgagaactcccccggctagcgtgagatgcggcgcgccatgcttcatcagactct

SEQ ID NO: 1301 - DNA, 197 bp, Artificial Sequence; identical to SEQ ID NO: 1300
  Synthetic polynucleotide

SEQ ID NO: 1302 - DNA, 191 bp, Artificial Sequence
  Synthetic polynucleotide
atcatctcaccttgcctcctgacatgctgagtgccaggcctgcaggcaaatccagacatcagaagacaaatccagacatcagatcgcaaatccagacatcagagaccaaatccagacatcagactacaaatccagacatcagaactcaaatccagacatcagatgcggcgcgccatgcttcatcagactct

SEQ ID NO: 1303 - DNA, 191 bp, Artificial Sequence; identical to SEQ ID NO: 1302
  Synthetic polynucleotide

SEQ ID NO: 1304 - DNA, 200 bp, Artificial Sequence
  Synthetic polynucleotide
atcatctcaccttgcctcctgatagttgggctcctacccctgcagggaccacagatatccgtgttagagaccacagatatccgtgtttcggaccacagatatccgtgttgacgaccacagatatccgtgttctagaccacagatatccgtgttactgaccacagatatccgtgttggcgcgccatgcttcatcagactct

SEQ ID NO: 1305 - DNA, 200 bp, Artificial Sequence; identical to SEQ ID NO: 1304
  Synthetic polynucleotide

SEQ ID NO: 1306 - DNA, 197 bp, Artificial Sequence
  Synthetic polynucleotide
atcatctcaccttgcctcctgatcaactcgtaagacaacctgcaggtcaagtgaactttgtcctagatcaagtgaactttgtccttcgtcaagtgaactttgtcctgactcaagtgaactttgtcctctatcaagtgaactttgtcctacttcaagtgaactttgtccttgcggcgcgccatgcttcatcagactct

SEQ ID NO: 1307 - DNA, 197 bp, Artificial Sequence; identical to SEQ ID NO: 1306
  Synthetic polynucleotide

SEQ ID NO: 1308 - DNA, 197 bp, Artificial Sequence
  Synthetic polynucleotide
atcatctcaccttgcctcctggcatttgtacgactaggcctgcaggagtacttccgggtcaagaagtacttccgggtcatcgagtacttccgggtcagacagtacttccgggtcactaagtacttccgggtcaactagtacttccgggtcatgcagtacttccgggtcagtaggcgcgccatgcttcatcagactct

SEQ ID NO: 1309 - DNA, 197 bp, Artificial Sequence; identical to SEQ ID NO: 1308
  Synthetic polynucleotide

SEQ ID NO: 1310 - DNA, 172 bp, Artificial Sequence
  Synthetic polynucleotide
atcatctcaccttgcctcctggaccagtgcctcttgcacctgcaggaccagctgagagaaccagctgagtcgaccagctgaggacaccagctgagctaaccagctgagactaccagctgagtgcaccagctgaggtaaccagctgagggcgcgccatgcttcatcagactct

SEQ ID NO: 1311 - DNA, 172 bp, Artificial Sequence; identical to SEQ ID NO: 1310
  Synthetic polynucleotide

SEQ ID NO: 1312 - DNA, 191 bp, Artificial Sequence
  Synthetic polynucleotide
atcatctcaccttgcctcctgttactcatgatcctcaccctgcagggatgaatttcagtcatgagagatgaatttcagtcatgtcggatgaatttcagtcatggacgatgaatttcagtcatgctagatgaatttcagtcatgactgatgaatttcagtcatgtgcggcgcgccatgcttcatcagactct

SEQ ID NO: 1313 - DNA, 191 bp, Artificial Sequence; identical to SEQ ID NO: 1312
  Synthetic polynucleotide

SEQ ID NO: 1314 - DNA, 196 bp, Artificial Sequence
  Synthetic polynucleotide
atcatctcaccttgcctcctgtcgcgatccatgtcagtcctgcagggacttttctgggaagagacttttctgggatcggacttttctgggagacgacttttctgggactagacttttctgggaactgacttttctgggatgcgacttttctgggagtagacttttctgggaggcgcgccatgcttcatcagactct

SEQ ID NO: 1315 - DNA, 196 bp, Artificial Sequence; identical to SEQ ID NO: 1314
  Synthetic polynucleotide

SEQ ID NO: 1316 - DNA, 196 bp, Artificial Sequence
  Synthetic polynucleotide
atcatctcaccttgcctcctgagtggttggagccctttcctgcaggcataattgctgagtcattttagagacataattgctgagtcattttagtcgcataattgctgagtcattttaggaccataattgctgagtcattttagctacataattgctgagtcattttagactggcgcgccatgcttcatcagactct

SEQ ID NO: 1317 - DNA, 196 bp, Artificial Sequence; identical to SEQ ID NO: 1316
  Synthetic polynucleotide

SEQ ID NO: 1318 - DNA, 185 bp, Artificial Sequence
  Synthetic polynucleotide
atcatctcaccttgcctcctggaggtaatccgacgctccctgcaggacggtaattagctcatagaacggtaattagctcattcgacggtaattagctcatgacacggtaattagctcatctaacggtaattagctcatactacggtaattagctcattgcggcgcgccatgcttcatcagactct

SEQ ID NO: 1319 - DNA, 185 bp, Artificial Sequence; identical to SEQ ID NO: 1318
  Synthetic polynucleotide

SEQ ID NO: 1320 - DNA, 190 bp, Artificial Sequence
  Synthetic polynucleotide
atcatctcaccttgcctcctggtactacaacacgacaacctgcaggttttccatggaaaaagattttccatggaaaatcgttttccatggaaaagacttttccatggaaaactattttccatggaaaaactttttccatggaaaatgcttttccatggaaaagtaggcgcgccatgcttcatcagactct

SEQ ID NO: 1321 - DNA, 190 bp, Artificial Sequence; identical to SEQ ID NO: 1320
  Synthetic polynucleotide

SEQ ID NO: 1322 - DNA, 197 bp, Artificial Sequence
  Synthetic polynucleotide
atcatctcaccttgcctcctgcgtgggttcgtttcaagcctgcaggcccccaaccgccgttgggagacccccaaccgccgttgggtcgcccccaaccgccgttggggaccccccaaccgccgttgggctacccccaaccgccgttgggactcccccaaccgccgttgggtgcggcgcgccatgcttcatcagactct

SEQ ID NO: 1323 - DNA, 197 bp, Artificial Sequence; identical to SEQ ID NO: 1322
  Synthetic polynucleotide

SEQ ID NO: 1324 - DNA, 185 bp, Artificial Sequence
  Synthetic polynucleotide
atcatctcaccttgcctcctgctgttataagtcataggcctgcaggttacgcccacgcatttagattacgcccacgcattttcgttacgcccacgcatttgacttacgcccacgcatttctattacgcccacgcatttactttacgcccacgcattttgcggcgcgccatgcttcatcagactct

SEQ ID NO: 1325 - DNA, 185 bp, Artificial Sequence; identical to SEQ ID NO: 1324
  Synthetic polynucleotide

SEQ ID NO: 1326 - DNA, 197 bp, Artificial Sequence
  Synthetic polynucleotide
atcatctcaccttgcctcctgctgtaaacaaggtagtccctgcaggggtgtgaaatttcacaccagaggtgtgaaatttcacacctcgggtgtgaaatttcacaccgacggtgtgaaatttcacaccctaggtgtgaaatttcacaccactggtgtgaaatttcacacctgcggcgcgccatgcttcatcagactct

SEQ ID NO: 1327 - DNA, 197 bp, Artificial Sequence; identical to SEQ ID NO: 1326
  Synthetic polynucleotide

SEQ ID NO: 1328 - DNA, 185 bp, Artificial Sequence
  Synthetic polynucleotide
atcatctcaccttgcctcctgtctggcaaatcagtctccctgcaggaatgatgcgggtacgaagaaatgatgcgggtacgatcgaatgatgcgggtacgagacaatgatgcgggtacgactaaatgatgcgggtacgaactaatgatgcgggtacgatgcggcgcgccatgcttcatcagactct

SEQ ID NO: 1329 - DNA, 185 bp, Artificial Sequence; identical to SEQ ID NO: 1328
  Synthetic polynucleotide

SEQ ID NO: 1330 - DNA, 196 bp, Artificial Sequence
  Synthetic polynucleotide
atcatctcaccttgcctcctgtgggtgccatgatcgtgcctgcaggctatcgcgacataagactatcgcgacatatcgctatcgcgacatagacctatcgcgacatactactatcgcgacataactctatcgcgacatatgcctatcgcgacatagtactatcgcgacataggcgcgccatgcttcatcagactct

SEQ ID NO: 1331 - DNA, 196 bp, Artificial Sequence; identical to SEQ ID NO: 1330
  Synthetic polynucleotide

SEQ ID NO: 1332 - DNA, 185 bp, Artificial Sequence
  Synthetic polynucleotide
atcatctcaccttgcctcctgcggcaaagagggtttatcctgcaggccaccagggggcgccgagaccaccagggggcgccgtcgccaccagggggcgccggacccaccagggggcgccgctaccaccagggggcgccgactccaccagggggcgccgtgcggcgcgccatgcttcatcagactct

SEQ ID NO: 1333 - DNA, 185 bp, Artificial Sequence; identical to SEQ ID NO: 1332
  Synthetic polynucleotide

SEQ ID NO: 1334 - DNA, 156 bp, Artificial Sequence
  Synthetic polynucleotide
atcatctcaccttgcctcctgttgctccagcaccctatcctgcaggtacttaccagatacttacctcgtacttaccgactacttaccctatacttaccacttacttacctgctacttaccgtatacttaccggcgcgccatgcttcatcagactct

SEQ ID NO: 1335 - DNA, 156 bp, Artificial Sequence; identical to SEQ ID NO: 1334
  Synthetic polynucleotide

SEQ ID NO: 1336 - DNA, 164 bp, Artificial Sequence
  Synthetic polynucleotide
atcatctcaccttgcctcctgcaaacaaaggtgtgctccctgcaggttgcgtcatagattgcgtcattcgttgcgtcatgacttgcgtcatctattgcgtcatactttgcgtcattgcttgcgtcatgtattgcgtcatggcgcgccatgcttcatcagactct

SEQ ID NO: 1337 - DNA, 164 bp, Artificial Sequence; identical to SEQ ID NO: 1336
  Synthetic polynucleotide

SEQ ID NO: 1338 - DNA, 190 bp, Artificial Sequence
  Synthetic polynucleotide
atcatctcaccttgcctcctggcagaatcaactggatccctgcaggcctggaaatcccctagacctggaaatccccttcgcctggaaatcccctgaccctggaaatcccctctacctggaaatcccctactcctggaaatccccttgccctggaaatcccctgtaggcgcgccatgcttcatcagactct

SEQ ID NO: 1339 - DNA, 190 bp, Artificial Sequence; identical to SEQ ID NO: 1338
  Synthetic polynucleotide

SEQ ID NO: 1340 - DNA, 172 bp, Artificial Sequence
  Synthetic polynucleotide
atcatctcaccttgcctcctgttcagccttaggcgtaacctgcagggacgcgtgccagagacgcgtgcctcggacgcgtgccgacgacgcgtgccctagacgcgtgccactgacgcgtgcctgcgacgcgtgccgtagacgcgtgccggcgcgccatgcttcatcagactct

SEQ ID NO: 1341 - DNA, 172 bp, Artificial Sequence; identical to SEQ ID NO: 1340
  Synthetic polynucleotide

SEQ ID NO: 1342 - DNA, 185 bp, Artificial Sequence
  Synthetic polynucleotide
atcatctcaccttgcctcctgttcgcccggtaaactcacctgcaggacggtaattagctcagagaacggtaattagctcagtcgacggtaattagctcaggacacggtaattagctcagctaacggtaattagctcagactacggtaattagctcagtgcggcgcgccatgcttcatcagactct

SEQ ID NO: 1343 - DNA, 185 bp, Artificial Sequence; identical to SEQ ID NO: 1342
  Synthetic polynucleotide

SEQ ID NO: 1344 - DNA, 190 bp, Artificial Sequence
  Synthetic polynucleotide
atcatctcaccttgcctcctgaaagggcgaagccgtaacctgcaggtctgcacacggcccagatctgcacacggccctcgtctgcacacggcccgactctgcacacggcccctatctgcacacggcccacttctgcacacggccctgctctgcacacggcccgtaggcgcgccatgcttcatcagactct

SEQ ID NO: 1345 - DNA, 190 bp, Artificial Sequence; identical to SEQ ID NO: 1344
  Synthetic polynucleotide

SEQ ID NO: 1346 - DNA, 172 bp, Artificial Sequence
  Synthetic polynucleotide
atcatctcaccttgcctcctgtacttccgtactggcggcctgcaggcttaattagtagacttaattagttcgcttaattagtgaccttaattagtctacttaattagtactcttaattagttgccttaattagtgtacttaattagtggcgcgccatgcttcatcagactct

SEQ ID NO: 1347 - DNA, 172 bp, Artificial Sequence; identical to SEQ ID NO: 1346
  Synthetic polynucleotide

SEQ ID NO: 1348 - DNA, 200 bp, Artificial Sequence
  Synthetic polynucleotide
atcatctcaccttgcctcctgccaagacgcgtagctttcctgcaggagaggagaggagaagaggagggaggaagagagaagaggagaggagaagaggagggaggaagagtcgagaggagaggagaagaggagggaggaagaggacagaggagaggagaagaggagggaggaagagggcgcgccatgcttcatcagactct

SEQ ID NO: 1349 - DNA, 200 bp, Artificial Sequence; identical to SEQ ID NO: 1348
  Synthetic polynucleotide

SEQ ID NO: 1350 - DNA, 164 bp, Artificial Sequence
  Synthetic polynucleotide
atcatctcaccttgcctcctgggtgcgtgtaactatggcctgcaggtaggccacaagataggccacatcgtaggccacagactaggccacactataggccacaacttaggccacatgctaggccacagtataggccacaggcgcgccatgcttcatcagactct

SEQ ID NO: 1351 - DNA, 164 bp, Artificial Sequence; identical to SEQ ID NO: 1350
  Synthetic polynucleotide

SEQ ID NO: 1352 - DNA, 180 bp, Artificial Sequence
  Synthetic polynucleotide
atcatctcaccttgcctcctggcccgttactctagcctcctgcaggagccactcaagagaagccactcaagtcgagccactcaaggacagccactcaagctaagccactcaagactagccactcaagtgcagccactcaaggtaagccactcaagggcgcgccatgcttcatcagactct

SEQ ID NO: 1353 - DNA, 180 bp, Artificial Sequence; identical to SEQ ID NO: 1352
  Synthetic polynucleotide

SEQ ID NO: 1354 - DNA, 191 bp, Artificial Sequence
  Synthetic polynucleotide
atcatctcaccttgcctcctgccagagtatagttagtgcctgcaggtgcgctaattagtgggaagatgcgctaattagtgggatcgtgcgctaattagtgggagactgcgctaattagtgggactatgcgctaattagtgggaacttgcgctaattagtgggatgcggcgcgccatgcttcatcagactct

SEQ ID NO: 1355 - DNA, 191 bp, Artificial Sequence; identical to SEQ ID NO: 1354
  Synthetic polynucleotide

SEQ ID NO: 1356 - DNA, 156 bp, Artificial Sequence
  Synthetic polynucleotide
atcatctcaccttgcctcctgaggcaatactcgagcatcctgcaggttttattaagattttattatcgttttattagacttttattactattttattaactttttattatgcttttattagtattttattaggcgcgccatgcttcatcagactct

SEQ ID NO: 1357 - DNA, 156 bp, Artificial Sequence; identical to SEQ ID NO: 1356
  Synthetic polynucleotide

SEQ ID NO: 1358 - DNA, 196 bp, Artificial Sequence
  Synthetic polynucleotide
atcatctcaccttgcctcctgtaccctgacgtagccaacctgcaggggctctatcatctagaggctctatcatcttcgggctctatcatctgacggctctatcatctctaggctctatcatctactggctctatcatcttgcggctctatcatctgtaggctctatcatctggcgcgccatgcttcatcagactct

SEQ ID NO: 1359 - DNA, 196 bp, Artificial Sequence; identical to SEQ ID NO: 1358
  Synthetic polynucleotide

SEQ ID NO: 1360 - DNA, 172 bp, Artificial Sequence
  Synthetic polynucleotide
atcatctcaccttgcctcctgaacgaactcggcacgtccctgcaggaattgactttagaaattgacttttcgaattgactttgacaattgactttctaaattgactttactaattgacttttgcaattgactttgtaaattgactttggcgcgccatgcttcatcagactct

SEQ ID NO: 1361 - DNA, 172 bp, Artificial Sequence; identical to SEQ ID NO: 1360
  Synthetic polynucleotide

SEQ ID NO: 1362 - DNA, 197 bp, Artificial Sequence
  Synthetic polynucleotide
atcatctcaccttgcctcctggatagcggagtaacctgcctgcaggcccatcaatcaaattagacccatcaatcaaatttcgcccatcaatcaaattgaccccatcaatcaaattctacccatcaatcaaattactcccatcaatcaaatttgccccatcaatcaaattgtaggcgcgccatgcttcatcagactct

SEQ ID NO: 1363 - DNA, 197 bp, Artificial Sequence; identical to SEQ ID NO: 1362
  Synthetic polynucleotide

SEQ ID NO: 1364 - DNA, 185 bp, Artificial Sequence
  Synthetic polynucleotide
atcatctcaccttgcctcctgcttaggcgatttccttgcctgcaggcctttgttatgcaaatagacctttgttatgcaaattcgcctttgttatgcaaatgaccctttgttatgcaaatctacctttgttatgcaaatactcctttgttatgcaaattgcggcgcgccatgcttcatcagactct

SEQ ID NO: 1365 - DNA, 185 bp, Artificial Sequence; identical to SEQ ID NO: 1364
  Synthetic polynucleotide

SEQ ID NO: 1366 - DNA, 185 bp, Artificial Sequence
  Synthetic polynucleotide
atcatctcaccttgcctcctgccacggcaccagagattcctgcaggatattgacaggtgcttagaatattgacaggtgctttcgatattgacaggtgcttgacatattgacaggtgcttctaatattgacaggtgcttactatattgacaggtgctttgcggcgcgccatgcttcatcagactct

SEQ ID NO: 1367 - DNA, 185 bp, Artificial Sequence; identical to SEQ ID NO: 1366
  Synthetic polynucleotide

SEQ ID NO: 1368 - DNA, 191 bp, Artificial Sequence
  Synthetic polynucleotide
atcatctcaccttgcctcctgaacagctcacactatttcctgcagggtcgtgttgtgggaaagagagtcgtgttgtgggaaagtcggtcgtgttgtgggaaaggacgtcgtgttgtgggaaagctagtcgtgttgtgggaaagactgtcgtgttgtgggaaagtgcggcgcgccatgcttcatcagactct

SEQ ID NO: 1369 - DNA, 191 bp, Artificial Sequence; identical to SEQ ID NO: 1368
  Synthetic polynucleotide

SEQ ID NO: 1370 - DNA, 172 bp, Artificial Sequence
  Synthetic polynucleotide
atcatctcaccttgcctcctgtgtgtcacacttaattgcctgcaggcttaattagcagacttaattagctcgcttaattagcgaccttaattagcctacttaattagcactcttaattagctgccttaattagcgtacttaattagcggcgcgccatgcttcatcagactct

SEQ ID NO: 1371 - DNA, 172 bp, Artificial Sequence; identical to SEQ ID NO: 1370
  Synthetic polynucleotide

SEQ ID NO: 1372 - DNA, 197 bp, Artificial Sequence
  Synthetic polynucleotide
atcatctcaccttgcctcctgcaacagcgctgcattgacctgcaggtggccaccagggggcgctagatggccaccagggggcgcttcgtggccaccagggggcgctgactggccaccagggggcgctctatggccaccagggggcgctacttggccaccagggggcgcttgcggcgcgccatgcttcatcagactct

SEQ ID NO: 1373 - DNA, 197 bp, Artificial Sequence; identical to SEQ ID NO: 1372
  Synthetic polynucleotide

SEQ ID NO: 1374 - DNA, 190 bp, Artificial Sequence
  Synthetic polynucleotide
atcatctcaccttgcctcctgtcttgtttccgctgtcgcctgcaggtcataaaactgtcaagatcataaaactgtcatcgtcataaaactgtcagactcataaaactgtcactatcataaaactgtcaacttcataaaactgtcatgctcataaaactgtcagtaggcgcgccatgcttcatcagactct

SEQ ID NO: 1375 - DNA, 190 bp, Artificial Sequence; identical to SEQ ID NO: 1374
  Synthetic polynucleotide

SEQ ID NO: 1376 - DNA, 188 bp, Artificial Sequence
  Synthetic polynucleotide
atcatctcaccttgcctcctgttatatgtatccggagtcctgcaggggtcgtaaaattagaggtcgtaaaatttcgggtcgtaaaattgacggtcgtaaaattctaggtcgtaaaattactggtcgtaaaatttgcggtcgtaaaattgtaggtcgtaaaattggcgcgccatgcttcatcagactct

SEQ ID NO: 1377 - DNA, 188 bp, Artificial Sequence; identical to SEQ ID NO: 1376
  Synthetic polynucleotide

SEQ ID NO: 1378 - DNA, 172 bp, Artificial Sequence
  Synthetic polynucleotide
atcatctcaccttgcctcctggcggtttcccattgttacctgcaggggaaattcccagaggaaattccctcgggaaattcccgacggaaattcccctaggaaattcccactggaaattccctgcggaaattcccgtaggaaattcccggcgcgccatgcttcatcagactct

SEQ ID NO: 1379 - DNA, 172 bp, Artificial Sequence; identical to SEQ ID NO: 1378
  Synthetic polynucleotide

SEQ ID NO: 1380 - DNA, 197 bp, Artificial Sequence
  Synthetic polynucleotide
atcatctcaccttgcctcctgcgaatcctaccgctgtccctgcaggctgggaattgtagtcagactgggaattgtagtctcgctgggaattgtagtcgacctgggaattgtagtcctactgggaattgtagtcactctgggaattgtagtctgcctgggaattgtagtcgtaggcgcgccatgcttcatcagactct

SEQ ID NO: 1381 - DNA, 197 bp, Artificial Sequence; identical to SEQ ID NO: 1380
  Synthetic polynucleotide

SEQ ID NO: 1382 - DNA, 196 bp, Artificial Sequence
  Synthetic polynucleotide
atcatctcaccttgcctcctgatgttattcagcgtagacctgcagggcaggtgagggggagagcaggtgagggggtcggcaggtgaggggggacgcaggtgagggggctagcaggtgagggggactgcaggtgagggggtgcgcaggtgaggggggtagcaggtgagggggggcgcgccatgcttcatcagactct

SEQ ID NO: 1383 - DNA, 196 bp, Artificial Sequence; identical to SEQ ID NO: 1382
  Synthetic polynucleotide

SEQ ID NO: 1384 - DNA, 190 bp, Artificial Sequence
  Synthetic polynucleotide
atcatctcaccttgcctcctgtatattaccatgcccgtcctgcagggcacctgcctgtggagagcacctgcctgtggtcggcacctgcctgtgggacgcacctgcctgtggctagcacctgcctgtggactgcacctgcctgtggtgcgcacctgcctgtgggtaggcgcgccatgcttcatcagactct

SEQ ID NO: 1385 - DNA, 190 bp, Artificial Sequence; identical to SEQ ID NO: 1384
  Synthetic polynucleotide

SEQ ID NO: 1386 - DNA, 185 bp, Artificial Sequence
  Synthetic polynucleotide
atcatctcaccttgcctcctgttggatgtctcgctactcctgcaggtatacataaacaagatagatatacataaacaagattcgtatacataaacaagatgactatacataaacaagatctatatacataaacaagatacttatacataaacaagattgcggcgcgccatgcttcatcagactct

SEQ ID NO: 1387 - DNA, 185 bp, Artificial Sequence; identical to SEQ ID NO: 1386
  Synthetic polynucleotide

SEQ ID NO: 1388 - DNA, 180 bp, Artificial Sequence
  Synthetic polynucleotide
atcatctcaccttgcctcctggtcatgtacaagtgttacctgcaggtttccgggaaaagatttccgggaaatcgtttccgggaaagactttccgggaaactatttccgggaaaacttttccgggaaatgctttccgggaaagtatttccgggaaaggcgcgccatgcttcatcagactct

SEQ ID NO: 1389 - DNA, 180 bp, Artificial Sequence; identical to SEQ ID NO: 1388
  Synthetic polynucleotide

SEQ ID NO: 1390 - DNA, 197 bp, Artificial Sequence
  Synthetic polynucleotide
atcatctcaccttgcctcctgtcgtattgaggttgccacctgcaggaggtggctgccccacagaaggtggctgccccactcgaggtggctgccccacgacaggtggctgccccacctaaggtggctgccccacactaggtggctgccccactgcaggtggctgccccacgtaggcgcgccatgcttcatcagactct

SEQ ID NO: 1391 - DNA, 197 bp, Artificial Sequence; identical to SEQ ID NO: 1390
  Synthetic polynucleotide

SEQ ID NO: 1392 - DNA, 185 bp, Artificial Sequence
  Synthetic polynucleotide
atcatctcaccttgcctcctgtctctctctgagcaggccctgcaggaatcaattcaataattagaaatcaattcaataatttcgaatcaattcaataattgacaatcaattcaataattctaaatcaattcaataattactaatcaattcaataatttgcggcgcgccatgcttcatcagactct

SEQ ID NO: 1393 - DNA, 185 bp, Artificial Sequence; identical to SEQ ID NO: 1392
  Synthetic polynucleotide

SEQ ID NO: 1394 - DNA, 148 bp, Artificial Sequence
  Synthetic polynucleotide
atcatctcaccttgcctcctgagcccgtttctgtcagtcctgcaggacatcctagaacatccttcgacatcctgacacatcctctaacatcctactacatccttgcacatcctgtaacatcctggcgcgccatgcttcatcagactct

SEQ ID NO: 1395 - DNA, 148 bp, Artificial Sequence; identical to SEQ ID NO: 1394
  Synthetic polynucleotide

SEQ ID NO: 1396 - DNA, 191 bp, Artificial Sequence
  Synthetic polynucleotide
atcatctcaccttgcctcctgcttcgtgccatgggttgcctgcaggggggtcagtagaggtcaagaggggtcagtagaggtcatcgggggtcagtagaggtcagacggggtcagtagaggtcactaggggtcagtagaggtcaactggggtcagtagaggtcatgcggcgcgccatgcttcatcagactct

SEQ ID NO: 1397 - DNA, 191 bp, Artificial Sequence; identical to SEQ ID NO: 1396
  Synthetic polynucleotide

SEQ ID NO: 1398 - DNA, 191 bp, Artificial Sequence
  Synthetic polynucleotide
atcatctcaccttgcctcctgaacgtcccaagagtgttcctgcaggggtaattaattaatgcgagaggtaattaattaatgcgtcgggtaattaattaatgcggacggtaattaattaatgcgctaggtaattaattaatgcgactggtaattaattaatgcgtgcggcgcgccatgcttcatcagactct

SEQ ID NO: 1399 - DNA, 191 bp, Artificial Sequence; identical to SEQ ID NO: 1398
  Synthetic polynucleotide

SEQ ID NO: 1400 - DNA, 156 bp, Artificial Sequence
  Synthetic polynucleotide
atcatctcaccttgcctcctgtcagtagggctaacgctcctgcagggacacgtgagagacacgtgtcggacacgtggacgacacgtgctagacacgtgactgacacgtgtgcgacacgtggtagacacgtgggcgcgccatgcttcatcagactct

SEQ ID NO: 1401 - DNA, 156 bp, Artificial Sequence; identical to SEQ ID NO: 1400
  Synthetic polynucleotide

SEQ ID NO: 1402 - DNA, 148 bp, Artificial Sequence
  Synthetic polynucleotide
atcatctcaccttgcctcctggatatcaaggtctcccacctgcaggtttatgaagatttatgatcgtttatgagactttatgactatttatgaacttttatgatgctttatgagtatttatgaggcgcgccatgcttcatcagactct

SEQ ID NO: 1403 - DNA, 148 bp, Artificial Sequence; identical to SEQ ID NO: 1402
  Synthetic polynucleotide

SEQ ID NO: 1404 - DNA, 196 bp, Artificial Sequence
  Synthetic polynucleotide
atcatctcaccttgcctcctgctaccatcctcatacatcctgcaggctgctgagtcatgagactgctgagtcatgtcgctgctgagtcatggacctgctgagtcatgctactgctgagtcatgactctgctgagtcatgtgcctgctgagtcatggtactgctgagtcatgggcgcgccatgcttcatcagactct

SEQ ID NO: 1405 - DNA, 196 bp, Artificial Sequence; identical to SEQ ID NO: 1404
  Synthetic polynucleotide

SEQ ID NO: 1406 - DNA, 148 bp, Artificial Sequence
  Synthetic polynucleotide
atcatctcaccttgcctcctgaaggcgcgagttgtattcctgcaggttaatccagattaatcctcgttaatccgacttaatccctattaatccactttaatcctgcttaatccgtattaatccggcgcgccatgcttcatcagactct

SEQ ID NO: 1407 - DNA, 148 bp, Artificial Sequence; identical to SEQ ID NO: 1406
  Synthetic polynucleotide

SEQ ID NO: 1408 - DNA, 164 bp, Artificial Sequence
  Synthetic polynucleotide
atcatctcaccttgcctcctgcttaggaaaccaaatcgcctgcaggccacttgagagaccacttgagtcgccacttgaggacccacttgagctaccacttgagactccacttgagtgcccacttgaggtaccacttgagggcgcgccatgcttcatcagactct

SEQ ID NO: 1409 - DNA, 164 bp, Artificial Sequence; identical to SEQ ID NO: 1408
  Synthetic polynucleotide

SEQ ID NO: 1410 - DNA, 185 bp, Artificial Sequence
  Synthetic polynucleotide
atcatctcaccttgcctcctgtctacacttacgagcagcctgcaggctttgctactgtacatagactttgctactgtacattcgctttgctactgtacatgacctttgctactgtacatctactttgctactgtacatactctttgctactgtacattgcggcgcgccatgcttcatcagactct

SEQ ID NO: 1411 - DNA, 185 bp, Artificial Sequence; identical to SEQ ID NO: 1410
  Synthetic polynucleotide

SEQ ID NO: 1412 - DNA, 180 bp, Artificial Sequence
  Synthetic polynucleotide
atcatctcaccttgcctcctgacctctagaaacgcgcgcctgcaggtgcataaattaagatgcataaattatcgtgcataaattagactgcataaattactatgcataaattaacttgcataaattatgctgcataaattagtatgcataaattaggcgcgccatgcttcatcagactct

SEQ ID NO: 1413 - DNA, 180 bp, Artificial Sequence; identical to SEQ ID NO: 1412
  Synthetic polynucleotide

SEQ ID NO: 1414 - DNA, 196 bp, Artificial Sequence
  Synthetic polynucleotide
atcatctcaccttgcctcctgagaaactccacaactaccctgcaggatatgcaaatgagagaatatgcaaatgagtcgatatgcaaatgaggacatatgcaaatgagctaatatgcaaatgagactatatgcaaatgagtgcatatgcaaatgaggtaatatgcaaatgagggcgcgccatgcttcatcagactct

SEQ ID NO: 1415 - DNA, 196 bp, Artificial Sequence; identical to SEQ ID NO: 1414
  Synthetic polynucleotide

SEQ ID NO: 1416 - DNA, 191 bp, Artificial Sequence
  Synthetic polynucleotide
atcatctcaccttgcctcctgtagtgtccattgcctatcctgcaggtcctttgttatgcaaatagatcctttgttatgcaaattcgtcctttgttatgcaaatgactcctttgttatgcaaatctatcctttgttatgcaaatacttcctttgttatgcaaattgcggcgcgccatgcttcatcagactct

SEQ ID NO: 1417 - DNA, 191 bp, Artificial Sequence; identical to SEQ ID NO: 1416
  Synthetic polynucleotide

SEQ ID NO: 1418 - DNA, 156 bp, Artificial Sequence
  Synthetic polynucleotide
atcatctcaccttgcctcctgcctagaggctctaatcccctgcagggattaattagagattaatttcggattaattgacgattaattctagattaattactgattaatttgcgattaattgtagattaattggcgcgccatgcttcatcagactct

SEQ ID NO: 1419 - DNA, 156 bp, Artificial Sequence; identical to SEQ ID NO: 1418
  Synthetic polynucleotide

SEQ ID NO: 1420 - DNA, 196 bp, Artificial Sequence
  Synthetic polynucleotide
atcatctcaccttgcctcctgtagcattgttaagccgtcctgcaggatatgcaaatgaaagaatatgcaaatgaatcgatatgcaaatgaagacatatgcaaatgaactaatatgcaaatgaaactatatgcaaatgaatgcatatgcaaatgaagtaatatgcaaatgaaggcgcgccatgcttcatcagactct

SEQ ID NO: 1421 - DNA, 196 bp, Artificial Sequence; identical to SEQ ID NO: 1420
  Synthetic polynucleotide

SEQ ID NO: 1422 - DNA, 164 bp, Artificial Sequence
  Synthetic polynucleotide
atcatctcaccttgcctcctgagctttcggacgcggatcctgcaggccacttgaaagaccacttgaatcgccacttgaagacccacttgaactaccacttgaaactccacttgaatgcccacttgaagtaccacttgaaggcgcgccatgcttcatcagactct

SEQ ID NO: 1423 - DNA, 164 bp, Artificial Sequence; identical to SEQ ID NO: 1422
  Synthetic polynucleotide

SEQ ID NO: 1424 - DNA, 132 bp, Artificial Sequence
  Synthetic polynucleotide
atcatctcaccttgcctcctgctaaatcccacggctgccctgcaggaaacaagaaaacatcgaaacagacaaacactaaaacaactaaacatgcaaacagtaaaacaggcgcgccatgcttcatcagactct

SEQ ID NO: 1425 - DNA, 132 bp, Artificial Sequence; identical to SEQ ID NO: 1424
  Synthetic polynucleotide

SEQ ID NO: 1426 - DNA, 191 bp, Artificial Sequence
  Synthetic polynucleotide
atcatctcaccttgcctcctgcgtctccttcccatcgtcctgcaggtgacctttgcatgacctagatgacctttgcatgaccttcgtgacctttgcatgacctgactgacctttgcatgacctctatgacctttgcatgacctacttgacctttgcatgaccttgcggcgcgccatgcttcatcagactct

SEQ ID NO: 1427 - DNA, 191 bp, Artificial Sequence; identical to SEQ ID NO: 1426
  Synthetic polynucleotide

SEQ ID NO: 1428 - DNA, 191 bp, Artificial Sequence
  Synthetic polynucleotide
atcatctcaccttgcctcctgtccacacatccactggacctgcaggataaacaagtgtaaacaagaataaacaagtgtaaacatcgataaacaagtgtaaacagacataaacaagtgtaaacactaataaacaagtgtaaacaactataaacaagtgtaaacatgcggcgcgccatgcttcatcagactct

SEQ ID NO: 1429 - DNA, 191 bp, Artificial Sequence; identical to SEQ ID NO: 1428
  Synthetic polynucleotide

SEQ ID NO: 1430 - DNA, 190 bp, Artificial Sequence
  Synthetic polynucleotide
atcatctcaccttgcctcctggacaatacttcgccgtgcctgcaggaacgtaaacaacacagaaacgtaaacaacactcgaacgtaaacaacacgacaacgtaaacaacacctaaacgtaaacaacacactaacgtaaacaacactgcaacgtaaacaacacgtaggcgcgccatgcttcatcagactct

SEQ ID NO: 1431 - DNA, 190 bp, Artificial Sequence; identical to SEQ ID NO: 1430
  Synthetic polynucleotide

SEQ ID NO: 1432 - DNA, 156 bp, Artificial Sequence
  Synthetic polynucleotide
atcatctcaccttgcctcctgcttctatccaaggagggcctgcaggctggtggcagactggtggctcgctggtggcgacctggtggcctactggtggcactctggtggctgcctggtggcgtactggtggcggcgcgccatgcttcatcagactct

SEQ ID NO: 1433 - DNA, 156 bp, Artificial Sequence; identical to SEQ ID NO: 1432
  Synthetic polynucleotide

SEQ ID NO: 1434 - DNA, 172 bp, Artificial Sequence
  Synthetic polynucleotide
atcatctcaccttgcctcctgtagccgcagtttattcccctgcaggtgagtcatcaagatgagtcatcatcgtgagtcatcagactgagtcatcactatgagtcatcaacttgagtcatcatgctgagtcatcagtatgagtcatcaggcgcgccatgcttcatcagactct

SEQ ID NO: 1435 - DNA, 172 bp, Artificial Sequence; identical to SEQ ID NO: 1434
  Synthetic polynucleotide

SEQ ID NO: 1436 - DNA, 185 bp, Artificial Sequence
  Synthetic polynucleotide
atcatctcaccttgcctcctgagtctctcagaaggctccctgcaggaaaaataaatataaggagaaaaaataaatataaggtcgaaaaataaatataagggacaaaaataaatataaggctaaaaaataaatataaggactaaaaataaatataaggtgcggcgcgccatgcttcatcagactct

SEQ ID NO: 1437 - DNA, 185 bp, Artificial Sequence; identical to SEQ ID NO: 1436
  Synthetic polynucleotide

SEQ ID NO: 1438 - DNA, 197 bp, Artificial Sequence
  Synthetic polynucleotide
atcatctcaccttgcctcctgttagacccgaatctgagcctgcaggggcggcgccggctgcagaggcggcgccggctgctcgggcggcgccggctgcgacggcggcgccggctgcctaggcggcgccggctgcactggcggcgccggctgctgcggcggcgccggctgcgtaggcgcgccatgcttcatcagactct

SEQ ID NO: 1439 - DNA, 197 bp, Artificial Sequence; identical to SEQ ID NO: 1438
  Synthetic polynucleotide

SEQ ID NO: 1440 - DNA, 180 bp, Artificial Sequence
  Synthetic polynucleotide
atcatctcaccttgcctcctgacaagatctagcacgctcctgcaggggaaccacgtgagaggaaccacgtgtcgggaaccacgtggacggaaccacgtgctaggaaccacgtgactggaaccacgtgtgcggaaccacgtggtaggaaccacgtgggcgcgccatgcttcatcagactct

SEQ ID NO: 1441 - DNA, 180 bp, Artificial Sequence; identical to SEQ ID NO: 1440
  Synthetic polynucleotide

SEQ ID NO: 1442 - DNA, 197 bp, Artificial Sequence
  Synthetic polynucleotide
atcatctcaccttgcctcctgagcggacagacgatacacctgcaggataagggcgcgcgatagaataagggcgcgcgattcgataagggcgcgcgatgacataagggcgcgcgatctaataagggcgcgcgatactataagggcgcgcgattgcataagggcgcgcgatgtaggcgcgccatgcttcatcagactct

SEQ ID NO: 1443 - DNA, 197 bp, Artificial Sequence; identical to SEQ ID NO: 1442
  Synthetic polynucleotide

SEQ ID NO: 1444 - DNA, 185 bp, Artificial Sequence
  Synthetic polynucleotide
atcatctcaccttgcctcctggtgcgtagtaaacgcgccctgcaggtggcgtgacctcaatcagatggcgtgacctcaatctcgtggcgtgacctcaatcgactggcgtgacctcaatcctatggcgtgacctcaatcacttggcgtgacctcaatctgcggcgcgccatgcttcatcagactct

SEQ ID NO: 1445 - DNA, 185 bp, Artificial Sequence; identical to SEQ ID NO: 1444
  Synthetic polynucleotide

SEQ ID NO: 1446 - DNA, 180 bp, Artificial Sequence
  Synthetic polynucleotide
atcatctcaccttgcctcctgggaaggccctttagtatcctgcaggagccacgtggtagaagccacgtggttcgagccacgtggtgacagccacgtggtctaagccacgtggtactagccacgtggttgcagccacgtggtgtaagccacgtggtggcgcgccatgcttcatcagactct

SEQ ID NO: 1447 - DNA, 180 bp, Artificial Sequence; identical to SEQ ID NO: 1446
  Synthetic polynucleotide

SEQ ID NO: 1448 - DNA, 196 bp, Artificial Sequence
  Synthetic polynucleotide
atcatctcaccttgcctcctgttacacaccagaggctgcctgcagggaaacacagtagcagagaaacacagtagctcggaaacacagtagcgacgaaacacagtagcctagaaacacagtagcactgaaacacagtagctgcgaaacacagtagcgtagaaacacagtagcggcgcgccatgcttcatcagactct

SEQ ID NO: 1449 - DNA, 196 bp, Artificial Sequence; identical to SEQ ID NO: 1448
  Synthetic polynucleotide

SEQ ID NO: 1450 - DNA, 191 bp, Artificial Sequence
  Synthetic polynucleotide
atcatctcaccttgcctcctgttaatttcaggcgtgcccctgcaggaatatacatgtaaaacaagaaatatacatgtaaaacatcgaatatacatgtaaaacagacaatatacatgtaaaacactaaatatacatgtaaaacaactaatatacatgtaaaacatgcggcgcgccatgcttcatcagactct

SEQ ID NO: 1451 - DNA, 191 bp, Artificial Sequence; identical to SEQ ID NO: 1450
  Synthetic polynucleotide

SEQ ID NO: 1452 - DNA, 185 bp, Artificial Sequence
  Synthetic polynucleotide
atcatctcaccttgcctcctgcacgtattcatgattggcctgcaggagtaattaattacttcagaagtaattaattacttctcgagtaattaattacttcgacagtaattaattacttcctaagtaattaattacttcactagtaattaattacttctgcggcgcgccatgcttcatcagactct

SEQ ID NO: 1453 - DNA, 185 bp, Artificial Sequence; identical to SEQ ID NO: 1452
  Synthetic polynucleotide

SEQ ID NO: 1454 - DNA, 164 bp, Artificial Sequence
  Synthetic polynucleotide
atcatctcaccttgcctcctgtctcgtagctcatcacgcctgcaggtgtttgtttagatgtttgttttcgtgtttgtttgactgtttgtttctatgtttgtttacttgtttgttttgctgtttgtttgtatgtttgtttggcgcgccatgcttcatcagactct

SEQ ID NO: 1455 - DNA, 164 bp, Artificial Sequence; identical to SEQ ID NO: 1454
  Synthetic polynucleotide

SEQ ID NO: 1456 - DNA, 185 bp, Artificial Sequence
  Synthetic polynucleotide
atcatctcaccttgcctcctgcggaggcgtgaatattccctgcagggggtcacgtgaccgcgagagggtcacgtgaccgcgtcggggtcacgtgaccgcggacgggtcacgtgaccgcgctagggtcacgtgaccgcgactgggtcacgtgaccgcgtgcggcgcgccatgcttcatcagactct

SEQ ID NO: 1457 - DNA, 185 bp, Artificial Sequence; identical to SEQ ID NO: 1456
  Synthetic polynucleotide

SEQ ID NO: 1458 - DNA, 188 bp, Artificial Sequence
  Synthetic polynucleotide
atcatctcaccttgcctcctggcttcccttggccgatacctgcaggcccaggaagtgcagacccaggaagtgctcgcccaggaagtgcgaccccaggaagtgcctacccaggaagtgcactcccaggaagtgctgccccaggaagtgcgtacccaggaagtgcggcgcgccatgcttcatcagactct

SEQ ID NO: 1459 - DNA, 188 bp, Artificial Sequence; identical to SEQ ID NO: 1458
  Synthetic polynucleotide

SEQ ID NO: 1460 - DNA, 185 bp, Artificial Sequence
  Synthetic polynucleotide
atcatctcaccttgcctcctggaaagtctcaacggctacctgcaggttgaccttttgaccttagattgaccttttgacctttcgttgaccttttgaccttgacttgaccttttgaccttctattgaccttttgaccttactttgaccttttgacctttgcggcgcgccatgcttcatcagactct

SEQ ID NO: 1461 - DNA, 185 bp, Artificial Sequence; identical to SEQ ID NO: 1460
  Synthetic polynucleotide

SEQ ID NO: 1462 - DNA, 180 bp, Artificial Sequence
  Synthetic polynucleotide
atcatctcaccttgcctcctgtacccagtttgcgtatacctgcaggaccaattaaaaagaaccaattaaaatcgaccaattaaaagacaccaattaaaactaaccaattaaaaactaccaattaaaatgcaccaattaaaagtaaccaattaaaaggcgcgccatgcttcatcagactct

SEQ ID NO: 1463 - DNA, 180 bp, Artificial Sequence; identical to SEQ ID NO: 1462
  Synthetic polynucleotide

SEQ ID NO: 1464 - DNA, 191 bp, Artificial Sequence
  Synthetic polynucleotide
atcatctcaccttgcctcctggtgttcaatggcccgaccctgcaggatttcccatcatgccttgcgaagaatttcccatcatgccttgcgatcgatttcccatcatgccttgcgagacatttcccatcatgccttgcgactaatttcccatcatgccttgcgaactggcgcgccatgcttcatcagactct

SEQ ID NO: 1465 - DNA, 191 bp, Artificial Sequence; identical to SEQ ID NO: 1464
  Synthetic polynucleotide

SEQ ID NO: 1466 - DNA, 191 bp, Artificial Sequence
  Synthetic polynucleotide
atcatctcaccttgcctcctgtgataacgttggcatttcctgcaggcgcgctaattaggtatcagacgcgctaattaggtatctcgcgcgctaattaggtatcgaccgcgctaattaggtatcctacgcgctaattaggtatcactcgcgctaattaggtatctgcggcgcgccatgcttcatcagactct

SEQ ID NO: 1467 - DNA, 191 bp, Artificial Sequence; identical to SEQ ID NO: 1466
  Synthetic polynucleotide

SEQ ID NO: 1468 - DNA, 197 bp, Artificial Sequence
  Synthetic polynucleotide
atcatctcaccttgcctcctgctccggaaggacattgccctgcaggctttgtttacttttgagactttgtttacttttgtcgctttgtttacttttggacctttgtttacttttgctactttgtttacttttgactctttgtttacttttgtgcctttgtttacttttggtaggcgcgccatgcttcatcagactct

SEQ ID NO: 1469 - DNA, 197 bp, Artificial Sequence; identical to SEQ ID NO: 1468
  Synthetic polynucleotide

SEQ ID NO: 1470 - DNA, 185 bp, Artificial Sequence
  Synthetic polynucleotide
atcatctcaccttgcctcctgagtaatgagatcggccgcctgcaggttgaccttttgacctcagattgaccttttgacctctcgttgaccttttgacctcgacttgaccttttgacctcctattgaccttttgacctcactttgaccttttgacctctgcggcgcgccatgcttcatcagactct

SEQ ID NO: 1471 - DNA, 185 bp, Artificial Sequence; identical to SEQ ID NO: 1470
  Synthetic polynucleotide

SEQ ID NO: 1472 - DNA, 172 bp, Artificial Sequence
  Synthetic polynucleotide
atcatctcaccttgcctcctgttgccgggatttccacacctgcaggaaagcaaacaagaaaagcaaacatcgaaagcaaacagacaaagcaaacactaaaagcaaacaactaaagcaaacatgcaaagcaaacagtaaaagcaaacaggcgcgccatgcttcatcagactct

SEQ ID NO: 1473 - DNA, 172 bp, Artificial Sequence; identical to SEQ ID NO: 1472
  Synthetic polynucleotide

SEQ ID NO: 1474 - DNA, 191 bp, Artificial Sequence
  Synthetic polynucleotide
atcatctcaccttgcctcctgttcagtggtagaccgtccctgcagggtgatctagaaccttagagagtgatctagaaccttagtcggtgatctagaaccttaggacgtgatctagaaccttagctagtgatctagaaccttagactgtgatctagaaccttagtgcggcgcgccatgcttcatcagactct

SEQ ID NO: 1475 - DNA, 191 bp, Artificial Sequence; identical to SEQ ID NO: 1474
  Synthetic polynucleotide

SEQ ID NO: 1476 - DNA, 188 bp, Artificial Sequence
  Synthetic polynucleotide
atcatctcaccttgcctcctgaacttacccgctgactccctgcaggctacatgacaaaagactacatgacaaatcgctacatgacaaagacctacatgacaaactactacatgacaaaactctacatgacaaatgcctacatgacaaagtactacatgacaaaggcgcgccatgcttcatcagactct

SEQ ID NO: 1477 - DNA, 188 bp, Artificial Sequence; identical to SEQ ID NO: 1476
  Synthetic polynucleotide

SEQ ID NO: 1478 - DNA, 197 bp, Artificial Sequence
  Synthetic polynucleotide
atcatctcaccttgcctcctgacttgtaggcaaacccgcctgcaggttgctgagtcagcaaagattgctgagtcagcaatcgttgctgagtcagcaagacttgctgagtcagcaactattgctgagtcagcaaactttgctgagtcagcaatgcttgctgagtcagcaagtaggcgcgccatgcttcatcagactct

SEQ ID NO: 1479 - DNA, 197 bp, Artificial Sequence; identical to SEQ ID NO: 1478
  Synthetic polynucleotide

SEQ ID NO: 1480 - DNA, 156 bp, Artificial Sequence
  Synthetic polynucleotide
atcatctcaccttgcctcctgtggaacacgatcctcctcctgcaggggtaagtaagaggtaagtatcgggtaagtagacggtaagtactaggtaagtaactggtaagtatgcggtaagtagtaggtaagtaggcgcgccatgcttcatcagactct

SEQ ID NO: 1481 - DNA, 156 bp, Artificial Sequence; identical to SEQ ID NO: 1480
  Synthetic polynucleotide

SEQ ID NO: 1482 - DNA, 188 bp, Artificial Sequence
  Synthetic polynucleotide
atcatctcaccttgcctcctggtcatcaccgtatatgacctgcaggatttttcctctgagaatttttcctctgtcgatttttcctctggacatttttcctctgctaatttttcctctgactatttttcctctgtgcatttttcctctggtaatttttcctctgggcgcgccatgcttcatcagactct

SEQ ID NO: 1483 - DNA, 188 bp, Artificial Sequence; identical to SEQ ID NO: 1482
  Synthetic polynucleotide

SEQ ID NO: 1484 - DNA, 190 bp, Artificial Sequence
  Synthetic polynucleotide
atcatctcaccttgcctcctggccacggtcgaactcttcctgcaggtgactgcacattcaagatgactgcacattcatcgtgactgcacattcagactgactgcacattcactatgactgcacattcaacttgactgcacattcatgctgactgcacattcagtaggcgcgccatgcttcatcagactct

SEQ ID NO: 1485 - DNA, 190 bp, Artificial Sequence; identical to SEQ ID NO: 1484
  Synthetic polynucleotide

SEQ ID NO: 1486 - DNA, 197 bp, Artificial Sequence
  Synthetic polynucleotide
atcatctcaccttgcctcctgtcctaaagtcccgggttcctgcagggctgtccatggtgctagagctgtccatggtgcttcggctgtccatggtgctgacgctgtccatggtgctctagctgtccatggtgctactgctgtccatggtgcttgcgctgtccatggtgctgtaggcgcgccatgcttcatcagactct

SEQ ID NO: 1487 - DNA, 197 bp, Artificial Sequence; identical to SEQ ID NO: 1486
  Synthetic polynucleotide

SEQ ID NO: 1488 - DNA, 190 bp, Artificial Sequence
  Synthetic polynucleotide
atcatctcaccttgcctcctggtccgatatgctcgggtcctgcaggaaaaagaggaagtaagaaaaaagaggaagtatcgaaaaagaggaagtagacaaaaagaggaagtactaaaaaagaggaagtaactaaaaagaggaagtatgcaaaaagaggaagtagtaggcgcgccatgcttcatcagactct

SEQ ID NO: 1489 - DNA, 190 bp, Artificial Sequence; identical to SEQ ID NO: 1488
  Synthetic polynucleotide

SEQ ID NO: 1490 - DNA, 196 bp, Artificial Sequence
  Synthetic polynucleotide
atcatctcaccttgcctcctgtctgatcgtccctaagacctgcagggttaatgattaacagagttaatgattaactcggttaatgattaacgacgttaatgattaacctagttaatgattaacactgttaatgattaactgcgttaatgattaacgtagttaatgattaacggcgcgccatgcttcatcagactct

SEQ ID NO: 1491 - DNA, 196 bp, Artificial Sequence; identical to SEQ ID NO: 1490
  Synthetic polynucleotide

SEQ ID NO: 1492 - DNA, 191 bp, Artificial Sequence
  Synthetic polynucleotide
atcatctcaccttgcctcctgagaaactactggaatgccctgcaggaggtcacagtttgacctagaaggtcacagtttgaccttcgaggtcacagtttgacctgacaggtcacagtttgacctctaaggtcacagtttgacctactaggtcacagtttgaccttgcggcgcgccatgcttcatcagactct

SEQ ID NO: 1493 - DNA, 191 bp, Artificial Sequence; identical to SEQ ID NO: 1492
  Synthetic polynucleotide

SEQ ID NO: 1494 - DNA, 185 bp, Artificial Sequence
  Synthetic polynucleotide
atcatctcaccttgcctcctgacagcttatacgtcgcacctgcagggggttactggcggtcaagagggttactggcggtcatcggggttactggcggtcagacgggttactggcggtcactagggttactggcggtcaactgggttactggcggtcatgcggcgcgccatgcttcatcagactct

SEQ ID NO: 1495 - DNA, 185 bp, Artificial Sequence; identical to SEQ ID NO: 1494
  Synthetic polynucleotide

SEQ ID NO: 1496 - DNA, 198 bp, Artificial Sequence
  Synthetic polynucleotide
atcatctcaccttgcctcctgtattattggagtgcgggcctgcaggatataattatgcaaattaaaagaagaatataattatgcaaattaaaagatcgatataattatgcaaattaaaagagacatataattatgcaaattaaaagactaatataattatgcaaattaaaagaggcgcgccatgcttcatcagactct

SEQ ID NO: 1497 - DNA, 198 bp, Artificial Sequence; identical to SEQ ID NO: 1496
  Synthetic polynucleotide

SEQ ID NO: 1498 - DNA, 172 bp, Artificial Sequence
  Synthetic polynucleotide
atcatctcaccttgcctcctgatagggaccttattctgcctgcaggggcggcgcggagaggcggcgcggtcgggcggcgcgggacggcggcgcggctaggcggcgcggactggcggcgcggtgcggcggcgcgggtaggcggcgcggggcgcgccatgcttcatcagactct

SEQ ID NO: 1499 - DNA, 172 bp, Artificial Sequence; identical to SEQ ID NO: 1498
  Synthetic polynucleotide

SEQ ID NO: 1500 - DNA, 172 bp, Artificial Sequence
  Synthetic polynucleotide
atcatctcaccttgcctcctgtgattgaagccatttcacctgcaggttcaagtggtagattcaagtggttcgttcaagtggtgacttcaagtggtctattcaagtggtactttcaagtggttgcttcaagtggtgtattcaagtggtggcgcgccatgcttcatcagactct

SEQ ID NO: 1501 - DNA, 172 bp, Artificial Sequence; identical to SEQ ID NO: 1500
  Synthetic polynucleotide

SEQ ID NO: 1502 - DNA, 172 bp, Artificial Sequence
  Synthetic polynucleotide
atcatctcaccttgcctcctgaagaacatacctggcaccctgcaggcagggggcgcagacagggggcgctcgcagggggcgcgaccagggggcgcctacagggggcgcactcagggggcgctgccagggggcgcgtacagggggcgcggcgcgccatgcttcatcagactct

SEQ ID NO: 1503 - DNA, 172 bp, Artificial Sequence; identical to SEQ ID NO: 1502
  Synthetic polynucleotide

SEQ ID NO: 1504 - DNA, 191 bp, Artificial Sequence
  Synthetic polynucleotide
atcatctcaccttgcctcctgaggtcgagcgcatatttcctgcaggttagccccgcccccctcagattagccccgcccccctctcgttagccccgcccccctcgacttagccccgcccccctcctattagccccgcccccctcactttagccccgcccccctctgcggcgcgccatgcttcatcagactct

SEQ ID NO: 1505 - DNA, 191 bp, Artificial Sequence; identical to SEQ ID NO: 1504
  Synthetic polynucleotide

SEQ ID NO: 1506 - DNA, 172 bp, Artificial Sequence
  Synthetic polynucleotide
atcatctcaccttgcctcctgtcatagttcaccgttatcctgcagggccggaagcgagagccggaagcgtcggccggaagcggacgccggaagcgctagccggaagcgactgccggaagcgtgcgccggaagcggtagccggaagcgggcgcgccatgcttcatcagactct

SEQ ID NO: 1507 - DNA, 172 bp, Artificial Sequence; identical to SEQ ID NO: 1506
  Synthetic polynucleotide

SEQ ID NO: 1508 - DNA, 197 bp, Artificial Sequence
  Synthetic polynucleotide
atcatctcaccttgcctcctgtggcccacgccttatgacctgcaggtccccccccccccccagatcccccccccccccctcgtccccccccccccccgactccccccccccccccctatccccccccccccccacttcccccccccccccctgctccccccccccccccgtaggcgcgccatgcttcatcagactct

SEQ ID NO: 1509 - DNA, 197 bp, Artificial Sequence; identical to SEQ ID NO: 1508
  Synthetic polynucleotide

SEQ ID NO: 1510 - DNA, 172 bp, Artificial Sequence
  Synthetic polynucleotide
atcatctcaccttgcctcctgagtgcattcgtcttgcccctgcaggaccacgtgtcagaaccacgtgtctcgaccacgtgtcgacaccacgtgtcctaaccacgtgtcactaccacgtgtctgcaccacgtgtcgtaaccacgtgtcggcgcgccatgcttcatcagactct

SEQ ID NO: 1511 - DNA, 172 bp, Artificial Sequence; identical to SEQ ID NO: 1510
  Synthetic polynucleotide

SEQ ID NO: 1512 - DNA, 183 bp, Artificial Sequence
  Synthetic polynucleotide
atcatctcaccttgcctcctgatagtatcaggcaggtacctgcaggaactacaattcccagaatgccccgcagaaactacaattcccagaatgccccgctcgaactacaattcccagaatgccccgcgacaactacaattcccagaatgccccgcctaggcgcgccatgcttcatcagactct

SEQ ID NO: 1513 - DNA, 183 bp, Artificial Sequence; identical to SEQ ID NO: 1512
  Synthetic polynucleotide

SEQ ID NO: 1514 - DNA, 190 bp, Artificial Sequence
  Synthetic polynucleotide
atcatctcaccttgcctcctggacgtataagtatctggcctgcaggctgcacccgctgccagactgcacccgctgcctcgctgcacccgctgccgacctgcacccgctgccctactgcacccgctgccactctgcacccgctgcctgcctgcacccgctgccgtaggcgcgccatgcttcatcagactct

SEQ ID NO: 1515 - DNA, 190 bp, Artificial Sequence; identical to SEQ ID NO: 1514
  Synthetic polynucleotide

SEQ ID NO: 1516 - DNA, 156 bp, Artificial Sequence
  Synthetic polynucleotide
atcatctcaccttgcctcctgcggctatcgttgttcgacctgcaggagaacagaagaagaacagatcgagaacagagacagaacagactaagaacagaactagaacagatgcagaacagagtaagaacagaggcgcgccatgcttcatcagactct

SEQ ID NO: 1517 - DNA, 156 bp, Artificial Sequence; identical to SEQ ID NO: 1516
  Synthetic polynucleotide

SEQ ID NO: 1518 - DNA, 185 bp, Artificial Sequence
  Synthetic polynucleotide
atcatctcaccttgcctcctggcaaatgcaagtttaagcctgcaggctacgcccactcaattagactacgcccactcaatttcgctacgcccactcaattgacctacgcccactcaattctactacgcccactcaattactctacgcccactcaatttgcggcgcgccatgcttcatcagactct

SEQ ID NO: 1519 - DNA, 185 bp, Artificial Sequence; identical to SEQ ID NO: 1518
  Synthetic polynucleotide

SEQ ID NO: 1520 - DNA, 197 bp, Artificial Sequence
  Synthetic polynucleotide
atcatctcaccttgcctcctgttgagactctgtccgggcctgcaggtggaccaatcagcactctagatggaccaatcagcactcttcgtggaccaatcagcactctgactggaccaatcagcactctctatggaccaatcagcactctacttggaccaatcagcactcttgcggcgcgccatgcttcatcagactct

SEQ ID NO: 1521 - DNA, 197 bp, Artificial Sequence; identical to SEQ ID NO: 1520
  Synthetic polynucleotide

SEQ ID NO: 1522 - DNA, 180 bp, Artificial Sequence
  Synthetic polynucleotide
atcatctcaccttgcctcctgcccagagtacctactttcctgcagggggtgagtcatagagggtgagtcattcggggtgagtcatgacgggtgagtcatctagggtgagtcatactgggtgagtcattgcgggtgagtcatgtagggtgagtcatggcgcgccatgcttcatcagactct

SEQ ID NO: 1523 - DNA, 180 bp, Artificial Sequence; identical to SEQ ID NO: 1522
  Synthetic polynucleotide

SEQ ID NO: 1524 - DNA, 191 bp, Artificial Sequence
  Synthetic polynucleotide
atcatctcaccttgcctcctgtcctatcctcggtcagccctgcagggataattaatccctcttagagataattaatccctctttcggataattaatccctcttgacgataattaatccctcttctagataattaatccctcttactgataattaatccctctttgcggcgcgccatgcttcatcagactct

SEQ ID NO: 1525 - DNA, 191 bp, Artificial Sequence; identical to SEQ ID NO: 1524
  Synthetic polynucleotide

SEQ ID NO: 1526 - DNA, 172 bp, Artificial Sequence
  Synthetic polynucleotide
atcatctcaccttgcctcctgcctactcgtttgtctaacctgcaggccatgtgcttagaccatgtgctttcgccatgtgcttgacccatgtgcttctaccatgtgcttactccatgtgctttgcccatgtgcttgtaccatgtgcttggcgcgccatgcttcatcagactct

SEQ ID NO: 1527 - DNA, 172 bp, Artificial Sequence; identical to SEQ ID NO: 1526
  Synthetic polynucleotide

SEQ ID NO: 1528 - DNA, 148 bp, Artificial Sequence
  Synthetic polynucleotide
atcatctcaccttgcctcctgggctacgagttagattacctgcagggcacgtgagagcacgtgtcggcacgtggacgcacgtgctagcacgtgactgcacgtgtgcgcacgtggtagcacgtgggcgcgccatgcttcatcagactct

SEQ ID NO: 1529 - DNA, 148 bp, Artificial Sequence; identical to SEQ ID NO: 1528
  Synthetic polynucleotide

SEQ ID NO: 1530 - DNA, 188 bp, Artificial Sequence
  Synthetic polynucleotide
atcatctcaccttgcctcctgtatgtagcaaaccaacccctgcagggaatgtttgtttagagaatgtttgttttcggaatgtttgtttgacgaatgtttgtttctagaatgtttgtttactgaatgtttgttttgcgaatgtttgtttgtagaatgtttgtttggcgcgccatgcttcatcagactct

SEQ ID NO: 1531 - DNA, 188 bp, Artificial Sequence; identical to SEQ ID NO: 1530
  Synthetic polynucleotide

SEQ ID NO: 1532 - DNA, 172 bp, Artificial Sequence
  Synthetic polynucleotide
atcatctcaccttgcctcctggggctggaattcggatccctgcaggcatgaccaccagacatgaccacctcgcatgaccaccgaccatgaccaccctacatgaccaccactcatgaccacctgccatgaccaccgtacatgaccaccggcgcgccatgcttcatcagactct

SEQ ID NO: 1533 - DNA, 172 bp, Artificial Sequence; identical to SEQ ID NO: 1532
  Synthetic polynucleotide

SEQ ID NO: 1534 - DNA, 164 bp, Artificial Sequence
  Synthetic polynucleotide
atcatctcaccttgcctcctgtggccgtacgaaacatacctgcaggagagataagagaagagataagtcgagagataaggacagagataagctaagagataagactagagataagtgcagagataaggtaagagataagggcgcgccatgcttcatcagactct

SEQ ID NO: 1535 - DNA, 164 bp, Artificial Sequence; identical to SEQ ID NO: 1534
  Synthetic polynucleotide

SEQ ID NO: 1536 - DNA, 190 bp, Artificial Sequence
  Synthetic polynucleotide
atcatctcaccttgcctcctgacgggattaatgcggatcctgcaggaacgtaaacaacatagaaacgtaaacaacattcgaacgtaaacaacatgacaacgtaaacaacatctaaacgtaaacaacatactaacgtaaacaacattgcaacgtaaacaacatgtaggcgcgccatgcttcatcagactct

SEQ ID NO: 1537 - DNA, 190 bp, Artificial Sequence; identical to SEQ ID NO: 1536
  Synthetic polynucleotide

SEQ ID NO: 1538 - DNA, 172 bp, Artificial Sequence
  Synthetic polynucleotide
atcatctcaccttgcctcctgctgccactgtcttaacacctgcaggcttaattaccagacttaattacctcgcttaattaccgaccttaattaccctacttaattaccactcttaattacctgccttaattaccgtacttaattaccggcgcgccatgcttcatcagactct

SEQ ID NO: 1539 - DNA, 172 bp, Artificial Sequence; identical to SEQ ID NO: 1538
  Synthetic polynucleotide

SEQ ID NO: 1540 - DNA, 191 bp, Artificial Sequence
  Synthetic polynucleotide
atcatctcaccttgcctcctggtgttgtatagcattctcctgcaggtaaaaggtgtgaaaattagataaaaggtgtgaaaatttcgtaaaaggtgtgaaaattgactaaaaggtgtgaaaattctataaaaggtgtgaaaattacttaaaaggtgtgaaaatttgcggcgcgccatgcttcatcagactct

SEQ ID NO: 1541 - DNA, 191 bp, Artificial Sequence; identical to SEQ ID NO: 1540
  Synthetic polynucleotide

SEQ ID NO: 1542 - DNA, 164 bp, Artificial Sequence
  Synthetic polynucleotide
atcatctcaccttgcctcctggcactttcctcagctgccctgcaggcaaaggtcaagacaaaggtcatcgcaaaggtcagaccaaaggtcactacaaaggtcaactcaaaggtcatgccaaaggtcagtacaaaggtcaggcgcgccatgcttcatcagactct

SEQ ID NO: 1543 - DNA, 164 bp, Artificial Sequence; identical to SEQ ID NO: 1542
  Synthetic polynucleotide

SEQ ID NO: 1544 - DNA, 172 bp, Artificial Sequence
  Synthetic polynucleotide
atcatctcaccttgcctcctgactctgaacgtacgaggcctgcaggcaataaaactagacaataaaacttcgcaataaaactgaccaataaaactctacaataaaactactcaataaaacttgccaataaaactgtacaataaaactggcgcgccatgcttcatcagactct

SEQ ID NO: 1545 - DNA, 172 bp, Artificial Sequence; identical to SEQ ID NO: 1544
  Synthetic polynucleotide

SEQ ID NO: 1546 - DNA, 164 bp, Artificial Sequence
  Synthetic polynucleotide
atcatctcaccttgcctcctgagcagtttatcttcactcctgcagggacaatgagagagacaatgagtcggacaatgaggacgacaatgagctagacaatgagactgacaatgagtgcgacaatgaggtagacaatgagggcgcgccatgcttcatcagactct

SEQ ID NO: 1547 - DNA, 164 bp, Artificial Sequence; identical to SEQ ID NO: 1546
  Synthetic polynucleotide

SEQ ID NO: 1548 - DNA, 197 bp, Artificial Sequence
  Synthetic polynucleotide
atcatctcaccttgcctcctgtgtggcacactgcggaacctgcaggaagcctcgtggccagagaaagcctcgtggccagtcgaagcctcgtggccaggacaagcctcgtggccagctaaagcctcgtggccagactaagcctcgtggccagtgcaagcctcgtggccaggtaggcgcgccatgcttcatcagactct

SEQ ID NO: 1549 - DNA, 197 bp, Artificial Sequence; identical to SEQ ID NO: 1548
  Synthetic polynucleotide

SEQ ID NO: 1550 - DNA, 196 bp, Artificial Sequence
  Synthetic polynucleotide
atcatctcaccttgcctcctgtaagtggacgcactagtcctgcaggctctttgttacgaagactctttgttacgatcgctctttgttacgagacctctttgttacgactactctttgttacgaactctctttgttacgatgcctctttgttacgagtactctttgttacgaggcgcgccatgcttcatcagactct

SEQ ID NO: 1551 - DNA, 196 bp, Artificial Sequence; identical to SEQ ID NO: 1550
  Synthetic polynucleotide

SEQ ID NO: 1552 - DNA, 190 bp, Artificial Sequence
  Synthetic polynucleotide
atcatctcaccttgcctcctggcaactgctcgagttatcctgcaggcctcggacagctgcagacctcggacagctgctcgcctcggacagctgcgaccctcggacagctgcctacctcggacagctgcactcctcggacagctgctgccctcggacagctgcgtaggcgcgccatgcttcatcagactct

SEQ ID NO: 1553 - DNA, 190 bp, Artificial Sequence; identical to SEQ ID NO: 1552
  Synthetic polynucleotide

SEQ ID NO: 1554 - DNA, 190 bp, Artificial Sequence
  Synthetic polynucleotide
atcatctcaccttgcctcctgacgggatatttagagttcctgcaggaaatggcgggaaacagaaaatggcgggaaactcgaaatggcgggaaacgacaaatggcgggaaacctaaaatggcgggaaacactaaatggcgggaaactgcaaatggcgggaaacgtaggcgcgccatgcttcatcagactct

SEQ ID NO: 1555 - DNA, 190 bp, Artificial Sequence; identical to SEQ ID NO: 1554
  Synthetic polynucleotide

SEQ ID NO: 1556 - DNA, 197 bp, Artificial Sequence
  Synthetic polynucleotide
atcatctcaccttgcctcctgtgtaaacgaatcacagccctgcaggcttatctgtccccaccagagacttatctgtccccaccagtcgcttatctgtccccaccaggaccttatctgtccccaccagctacttatctgtccccaccagactcttatctgtccccaccagtgcggcgcgccatgcttcatcagactct

SEQ ID NO: 1557 - DNA, 197 bp, Artificial Sequence; identical to SEQ ID NO: 1556
  Synthetic polynucleotide

SEQ ID NO: 1558 - DNA, 180 bp, Artificial Sequence
  Synthetic polynucleotide
atcatctcaccttgcctcctggttggccatgactcactcctgcaggtcctgtttacaagatcctgtttacatcgtcctgtttacagactcctgtttacactatcctgtttacaacttcctgtttacatgctcctgtttacagtatcctgtttacaggcgcgccatgcttcatcagactct

SEQ ID NO: 1559 - DNA, 180 bp, Artificial Sequence; identical to SEQ ID NO: 1558
  Synthetic polynucleotide

SEQ ID NO: 1560 - DNA, 197 bp, Artificial Sequence
  Synthetic polynucleotide
atcatctcaccttgcctcctgtgagctatccacatccacctgcaggaatgtggaaatgagtcagagaaatgtggaaatgagtcagtcgaatgtggaaatgagtcaggacaatgtggaaatgagtcagctaaatgtggaaatgagtcagactaatgtggaaatgagtcagtgcggcgcgccatgcttcatcagactct

SEQ ID NO: 1561 - DNA, 197 bp, Artificial Sequence; identical to SEQ ID NO: 1560
  Synthetic polynucleotide

SEQ ID NO: 1562 - DNA, 172 bp, Artificial Sequence
  Synthetic polynucleotide
atcatctcaccttgcctcctgtagggcctagcctcaaacctgcaggttatttttagagattatttttagtcgttatttttaggacttatttttagctattatttttagactttatttttagtgcttatttttaggtattatttttagggcgcgccatgcttcatcagactct

SEQ ID NO: 1563 - DNA, 172 bp, Artificial Sequence; identical to SEQ ID NO: 1562
  Synthetic polynucleotide

SEQ ID NO: 1564 - DNA, 190 bp, Artificial Sequence
  Synthetic polynucleotide
atcatctcaccttgcctcctgtcgggcatgttatgacgcctgcaggaccggatttccggtagaaccggatttccggttcgaccggatttccggtgacaccggatttccggtctaaccggatttccggtactaccggatttccggttgcaccggatttccggtgtaggcgcgccatgcttcatcagactct

SEQ ID NO: 1565 - DNA, 190 bp, Artificial Sequence; identical to SEQ ID NO: 1564
  Synthetic polynucleotide

SEQ ID NO: 1566 - DNA, 180 bp, Artificial Sequence
  Synthetic polynucleotide
atcatctcaccttgcctcctgggaagcaccagccattccctgcaggtattgtgcaatagatattgtgcaattcgtattgtgcaatgactattgtgcaatctatattgtgcaatacttattgtgcaattgctattgtgcaatgtatattgtgcaatggcgcgccatgcttcatcagactct

SEQ ID NO: 1567 - DNA, 180 bp, Artificial Sequence; identical to SEQ ID NO: 1566
  Synthetic polynucleotide

SEQ ID NO: 1568 - DNA, 188 bp, Artificial Sequence
  Synthetic polynucleotide
atcatctcaccttgcctcctggatcatcgagcgactctcctgcagggtaaacaatagaagagtaaacaatagatcggtaaacaatagagacgtaaacaatagactagtaaacaatagaactgtaaacaatagatgcgtaaacaatagagtagtaaacaatagaggcgcgccatgcttcatcagactct

SEQ ID NO: 1569 - DNA, 188 bp, Artificial Sequence; identical to SEQ ID NO: 1568
  Synthetic polynucleotide

SEQ ID NO: 1570 - DNA, 180 bp, Artificial Sequence
  Synthetic polynucleotide
atcatctcaccttgcctcctgctagttaattcagcagtcctgcaggattgcacaataagaattgcacaatatcgattgcacaatagacattgcacaatactaattgcacaataactattgcacaatatgcattgcacaatagtaattgcacaataggcgcgccatgcttcatcagactct

SEQ ID NO: 1571 - DNA, 180 bp, Artificial Sequence; identical to SEQ ID NO: 1570
  Synthetic polynucleotide

SEQ ID NO: 1572 - DNA, 196 bp, Artificial Sequence
  Synthetic polynucleotide
atcatctcaccttgcctcctggtaatagtgtcaatgcgcctgcaggggtttcacttttcagaggtttcacttttctcgggtttcacttttcgacggtttcacttttcctaggtttcacttttcactggtttcacttttctgcggtttcacttttcgtaggtttcacttttcggcgcgccatgcttcatcagactct

SEQ ID NO: 1573 - DNA, 196 bp, Artificial Sequence; identical to SEQ ID NO: 1572
  Synthetic polynucleotide

SEQ ID NO: 1574 - DNA, 197 bp, Artificial Sequence
  Synthetic polynucleotide
atcatctcaccttgcctcctggtgggattggttgagtccctgcaggccactaggtggcactagaccactaggtggcacttcgccactaggtggcactgacccactaggtggcactctaccactaggtggcactactccactaggtggcacttgcccactaggtggcactgtaggcgcgccatgcttcatcagactct

SEQ ID NO: 1575 - DNA, 197 bp, Artificial Sequence; identical to SEQ ID NO: 1574
  Synthetic polynucleotide

SEQ ID NO: 1576 - DNA, 188 bp, Artificial Sequence
  Synthetic polynucleotide
atcatctcaccttgcctcctggtagtgctcggatgcgacctgcaggtgccccctgacaagatgccccctgacatcgtgccccctgacagactgccccctgacactatgccccctgacaacttgccccctgacatgctgccccctgacagtatgccccctgacaggcgcgccatgcttcatcagactct

SEQ ID NO: 1577 - DNA, 188 bp, Artificial Sequence; identical to SEQ ID NO: 1576
  Synthetic polynucleotide

SEQ ID NO: 1578 - DNA, 172 bp, Artificial Sequence
  Synthetic polynucleotide
atcatctcaccttgcctcctgggttgtctacgtacaggcctgcagggttatgcaacagagttatgcaactcggttatgcaacgacgttatgcaacctagttatgcaacactgttatgcaactgcgttatgcaacgtagttatgcaacggcgcgccatgcttcatcagactct

SEQ ID NO: 1579 - DNA, 172 bp, Artificial Sequence; identical to SEQ ID NO: 1578
  Synthetic polynucleotide

SEQ ID NO: 1580 - DNA, 190 bp, Artificial Sequence
  Synthetic polynucleotide
atcatctcaccttgcctcctggcgatattcgagccgctcctgcaggcggggatacgaaatagacggggatacgaaattcgcggggatacgaaatgaccggggatacgaaatctacggggatacgaaatactcggggatacgaaattgccggggatacgaaatgtaggcgcgccatgcttcatcagactct

SEQ ID NO: 1581 - DNA, 190 bp, Artificial Sequence; identical to SEQ ID NO: 1580
  Synthetic polynucleotide

SEQ ID NO: 1582 - DNA, 185 bp, Artificial Sequence
  Synthetic polynucleotide
atcatctcaccttgcctcctgtgcgaagaccactcctgcctgcaggccttatatttatttttagaccttatatttattttttcgccttatatttatttttgacccttatatttatttttctaccttatatttatttttactccttatatttattttttgcggcgcgccatgcttcatcagactct

SEQ ID NO: 1583 - DNA, 185 bp, Artificial Sequence; identical to SEQ ID NO: 1582
  Synthetic polynucleotide

SEQ ID NO: 1584 - DNA, 180 bp, Artificial Sequence
  Synthetic polynucleotide
atcatctcaccttgcctcctggcagccgtaatccaatacctgcaggggggcgggaagagaggggcgggaagtcgggggcgggaaggacggggcgggaagctaggggcgggaagactggggcgggaagtgcggggcgggaaggtaggggcgggaagggcgcgccatgcttcatcagactct

SEQ ID NO: 1585 - DNA, 180 bp, Artificial Sequence; identical to SEQ ID NO: 1584
  Synthetic polynucleotide

SEQ ID NO: 1586 - DNA, 164 bp, Artificial Sequence
  Synthetic polynucleotide
atcatctcaccttgcctcctgatcacaatgacggattccctgcaggtttattgccagatttattgcctcgtttattgccgactttattgccctatttattgccacttttattgcctgctttattgccgtatttattgccggcgcgccatgcttcatcagactct

SEQ ID NO: 1587 - DNA, 164 bp, Artificial Sequence; identical to SEQ ID NO: 1586
  Synthetic polynucleotide

SEQ ID NO: 1588 - DNA, 156 bp, Artificial Sequence
  Synthetic polynucleotide
atcatctcaccttgcctcctggtgtcattcaacccgcacctgcaggatgacctcagaatgacctctcgatgacctcgacatgacctcctaatgacctcactatgacctctgcatgacctcgtaatgacctcggcgcgccatgcttcatcagactct

SEQ ID NO: 1589 - DNA, 156 bp, Artificial Sequence; identical to SEQ ID NO: 1588
  Synthetic polynucleotide

SEQ ID NO: 1590 - DNA, 190 bp, Artificial Sequence
  Synthetic polynucleotide
atcatctcaccttgcctcctgtgggatgtacatgcacgcctgcaggcaacaatgtaacaaagacaacaatgtaacaatcgcaacaatgtaacaagaccaacaatgtaacaactacaacaatgtaacaaactcaacaatgtaacaatgccaacaatgtaacaagtaggcgcgccatgcttcatcagactct

SEQ ID NO: 1591 - DNA, 190 bp, Artificial Sequence; identical to SEQ ID NO: 1590
  Synthetic polynucleotide

SEQ ID NO: 1592 - DNA, 180 bp, Artificial Sequence
  Synthetic polynucleotide
atcatctcaccttgcctcctgagataccgagagaaggtcctgcaggattgcacaattagaattgcacaatttcgattgcacaattgacattgcacaattctaattgcacaattactattgcacaatttgcattgcacaattgtaattgcacaattggcgcgccatgcttcatcagactct

SEQ ID NO: 1593 - DNA, 180 bp, Artificial Sequence; identical to SEQ ID NO: 1592
  Synthetic polynucleotide

SEQ ID NO: 1594 - DNA, 156 bp, Artificial Sequence
  Synthetic polynucleotide
atcatctcaccttgcctcctgactgtagcgccaccgttcctgcaggcactaggtagacactaggttcgcactaggtgaccactaggtctacactaggtactcactaggttgccactaggtgtacactaggtggcgcgccatgcttcatcagactct

SEQ ID NO: 1595 - DNA, 156 bp, Artificial Sequence; identical to SEQ ID NO: 1594
  Synthetic polynucleotide

SEQ ID NO: 1596 - DNA, 196 bp, Artificial Sequence
  Synthetic polynucleotide
atcatctcaccttgcctcctgacaccatgtatacgaaccctgcagggattgtttatttaagagattgtttatttatcggattgtttatttagacgattgtttatttactagattgtttatttaactgattgtttatttatgcgattgtttatttagtagattgtttatttaggcgcgccatgcttcatcagactct

SEQ ID NO: 1597 - DNA, 196 bp, Artificial Sequence; identical to SEQ ID NO: 1596
  Synthetic polynucleotide

SEQ ID NO: 1598 - DNA, 180 bp, Artificial Sequence
  Synthetic polynucleotide
atcatctcaccttgcctcctgtatcatagggttcgaagcctgcaggtcatttcctgcagatcatttcctgctcgtcatttcctgcgactcatttcctgcctatcatttcctgcacttcatttcctgctgctcatttcctgcgtatcatttcctgcggcgcgccatgcttcatcagactct

SEQ ID NO: 1599 - DNA, 180 bp, Artificial Sequence; identical to SEQ ID NO: 1598
  Synthetic polynucleotide

SEQ ID NO: 1600 - DNA, 190 bp, Artificial Sequence
  Synthetic polynucleotide
atcatctcaccttgcctcctgatccagtaccggtgaatcctgcaggacattgcacaatctagaacattgcacaatcttcgacattgcacaatctgacacattgcacaatctctaacattgcacaatctactacattgcacaatcttgcacattgcacaatctgtaggcgcgccatgcttcatcagactct

SEQ ID NO: 1601 - DNA, 190 bp, Artificial Sequence; identical to SEQ ID NO: 1600
  Synthetic polynucleotide

SEQ ID NO: 1602 - DNA, 188 bp, Artificial Sequence
  Synthetic polynucleotide
atcatctcaccttgcctcctgagagcacgatgccaaaccctgcaggccaataatcgatagaccaataatcgattcgccaataatcgatgacccaataatcgatctaccaataatcgatactccaataatcgattgcccaataatcgatgtaccaataatcgatggcgcgccatgcttcatcagactct

SEQ ID NO: 1603 - DNA, 188 bp, Artificial Sequence; identical to SEQ ID NO: 1602
  Synthetic polynucleotide

SEQ ID NO: 1604 - DNA, 156 bp, Artificial Sequence
  Synthetic polynucleotide
atcatctcaccttgcctcctgcaggatccaccttctgccctgcaggaatttagaagaaatttagatcgaatttagagacaatttagactaaatttagaactaatttagatgcaatttagagtaaatttagaggcgcgccatgcttcatcagactct

SEQ ID NO: 1605 - DNA, 156 bp, Artificial Sequence; identical to SEQ ID NO: 1604
  Synthetic polynucleotide

SEQ ID NO: 1606 - DNA, 196 bp, Artificial Sequence
  Synthetic polynucleotide
atcatctcaccttgcctcctgagagagcacaagagaaccctgcaggcagtcacgtggtcagacagtcacgtggtctcgcagtcacgtggtcgaccagtcacgtggtcctacagtcacgtggtcactcagtcacgtggtctgccagtcacgtggtcgtacagtcacgtggtcggcgcgccatgcttcatcagactct

SEQ ID NO: 1607 - DNA, 196 bp, Artificial Sequence; identical to SEQ ID NO: 1606
  Synthetic polynucleotide

SEQ ID NO: 1608 - DNA, 188 bp, Artificial Sequence
  Synthetic polynucleotide
atcatctcaccttgcctcctggctcgttcccgattaatcctgcagggcgctttgttctagagcgctttgttcttcggcgctttgttctgacgcgctttgttctctagcgctttgttctactgcgctttgttcttgcgcgctttgttctgtagcgctttgttctggcgcgccatgcttcatcagactct

SEQ ID NO: 1609 - DNA, 188 bp, Artificial Sequence; identical to SEQ ID NO: 1608
  Synthetic polynucleotide

SEQ ID NO: 1610 - DNA, 197 bp, Artificial Sequence
  Synthetic polynucleotide
atcatctcaccttgcctcctgactaggccgtggatcgtcctgcaggccaccagagggcgctataagaccaccagagggcgctatatcgccaccagagggcgctatagacccaccagagggcgctatactaccaccagagggcgctataactccaccagagggcgctatatgcggcgcgccatgcttcatcagactct

SEQ ID NO: 1611 - DNA, 197 bp, Artificial Sequence; identical to SEQ ID NO: 1610
  Synthetic polynucleotide

SEQ ID NO: 1612 - DNA, 197 bp, Artificial Sequence
  Synthetic polynucleotide
atcatctcaccttgcctcctgaaacgttgacccagctgcctgcaggagagtgctgattggtccaagaagagtgctgattggtccatcgagagtgctgattggtccagacagagtgctgattggtccactaagagtgctgattggtccaactagagtgctgattggtccatgcggcgcgccatgcttcatcagactct

SEQ ID NO: 1613 - DNA, 197 bp, Artificial Sequence; identical to SEQ ID NO: 1612
  Synthetic polynucleotide

SEQ ID NO: 1614 - DNA, 197 bp, Artificial Sequence
  Synthetic polynucleotide
atcatctcaccttgcctcctggatatcttaaggcgtaccctgcaggactgttaattattaaccaagaactgttaattattaaccatcgactgttaattattaaccagacactgttaattattaaccactaactgttaattattaaccaactactgttaattattaaccatgcggcgcgccatgcttcatcagactct

SEQ ID NO: 1615 - DNA, 197 bp, Artificial Sequence; identical to SEQ ID NO: 1614
  Synthetic polynucleotide

SEQ ID NO: 1616 - DNA, 191 bp, Artificial Sequence
  Synthetic polynucleotide
atcatctcaccttgcctcctggtgtctctctacaccggcctgcaggtcctcacttcctgtggcagatcctcacttcctgtggctcgtcctcacttcctgtggcgactcctcacttcctgtggcctatcctcacttcctgtggcacttcctcacttcctgtggctgcggcgcgccatgcttcatcagactct

SEQ ID NO: 1617 - DNA, 191 bp, Artificial Sequence; identical to SEQ ID NO: 1616
  Synthetic polynucleotide

SEQ ID NO: 1618 - DNA, 186 bp, Artificial Sequence
  Synthetic polynucleotide
atcatctcaccttgcctcctgcttatgaaagccgccatcctgcaggtcacaccttctaaggtgtgaagatcacaccttctaaggtgtgatcgtcacaccttctaaggtgtgagactcacaccttctaaggtgtgactatcacaccttctaaggtgtgaactggcgcgccatgcttcatcagactct

SEQ ID NO: 1619 - DNA, 186 bp, Artificial Sequence; identical to SEQ ID NO: 1618
  Synthetic polynucleotide

SEQ ID NO: 1620 - DNA, 148 bp, Artificial Sequence
  Synthetic polynucleotide
atcatctcaccttgcctcctgtacccataccaggccttcctgcagggtgttgtagagtgttgttcggtgttgtgacgtgttgtctagtgttgtactgtgttgttgcgtgttgtgtagtgttgtggcgcgccatgcttcatcagactct

SEQ ID NO: 1621 - DNA, 148 bp, Artificial Sequence; identical to SEQ ID NO: 1620
  Synthetic polynucleotide

SEQ ID NO: 1622 - DNA, 172 bp, Artificial Sequence
  Synthetic polynucleotide
atcatctcaccttgcctcctgcacggctaattggtctccctgcaggaattttccacagaaattttccactcgaattttccacgacaattttccacctaaattttccacactaattttccactgcaattttccacgtaaattttccacggcgcgccatgcttcatcagactct

SEQ ID NO: 1623 - DNA, 172 bp, Artificial Sequence; identical to SEQ ID NO: 1622
  Synthetic polynucleotide

SEQ ID NO: 1624 - DNA, 197 bp, Artificial Sequence
  Synthetic polynucleotide
atcatctcaccttgcctcctggtaatgtctgcgctccccctgcaggggcgcaggtgtttttagaggcgcaggtgttttttcgggcgcaggtgtttttgacggcgcaggtgtttttctaggcgcaggtgtttttactggcgcaggtgttttttgcggcgcaggtgtttttgtaggcgcgccatgcttcatcagactct

SEQ ID NO: 1625 - DNA, 197 bp, Artificial Sequence; identical to SEQ ID NO: 1624
  Synthetic polynucleotide

SEQ ID NO: 1626 - DNA, 191 bp, Artificial Sequence
  Synthetic polynucleotide
atcatctcaccttgcctcctgtatccaacaaagtaaggcctgcaggagtaattaattaattcgagaagtaattaattaattcgtcgagtaattaattaattcggacagtaattaattaattcgctaagtaattaattaattcgactagtaattaattaattcgtgcggcgcgccatgcttcatcagactct

SEQ ID NO: 1627 - DNA, 191 bp, Artificial Sequence; identical to SEQ ID NO: 1626
  Synthetic polynucleotide

SEQ ID NO: 1628 - DNA, 180 bp, Artificial Sequence
  Synthetic polynucleotide
atcatctcaccttgcctcctgattgcgagatctctgtgcctgcaggttgcacttcctagattgcacttccttcgttgcacttcctgacttgcacttcctctattgcacttcctactttgcacttccttgcttgcacttcctgtattgcacttcctggcgcgccatgcttcatcagactct

SEQ ID NO: 1629 - DNA, 180 bp, Artificial Sequence; identical to SEQ ID NO: 1628
  Synthetic polynucleotide

SEQ ID NO: 1630 - DNA, 191 bp, Artificial Sequence
  Synthetic polynucleotide
atcatctcaccttgcctcctggtcagtcaagtaagtaccctgcaggaagttattaattaattaagaaagttattaattaattatcgaagttattaattaattagacaagttattaattaattactaaagttattaattaattaactaagttattaattaattatgcggcgcgccatgcttcatcagactct

SEQ ID NO: 1631 - DNA, 191 bp, Artificial Sequence; identical to SEQ ID NO: 1630
  Synthetic polynucleotide

SEQ ID NO: 1632 - DNA, 185 bp, Artificial Sequence
  Synthetic polynucleotide
atcatctcaccttgcctcctggcggaaggtggataatacctgcaggctgtgggaaacgagatagactgtgggaaacgagattcgctgtgggaaacgagatgacctgtgggaaacgagatctactgtgggaaacgagatactctgtgggaaacgagattgcggcgcgccatgcttcatcagactct

SEQ ID NO: 1633 - DNA, 185 bp, Artificial Sequence; identical to SEQ ID NO: 1632
  Synthetic polynucleotide

SEQ ID NO: 1634 - DNA, 188 bp, Artificial Sequence
  Synthetic polynucleotide
atcatctcaccttgcctcctgcacctggaacgtttgctcctgcaggaagcacgtgattagaaagcacgtgatttcgaagcacgtgattgacaagcacgtgattctaaagcacgtgattactaagcacgtgatttgcaagcacgtgattgtaaagcacgtgattggcgcgccatgcttcatcagactct

SEQ ID NO: 1635 - DNA, 188 bp, Artificial Sequence; identical to SEQ ID NO: 1634
  Synthetic polynucleotide

SEQ ID NO: 1636 - DNA, 180 bp, Artificial Sequence
  Synthetic polynucleotide
atcatctcaccttgcctcctgttgatttgcgggtgggacctgcaggggggcgggaaaagaggggcgggaaatcgggggcgggaaagacggggcgggaaactaggggcgggaaaactggggcgggaaatgcggggcgggaaagtaggggcgggaaaggcgcgccatgcttcatcagactct

SEQ ID NO: 1637 - DNA, 180 bp, Artificial Sequence; identical to SEQ ID NO: 1636
  Synthetic polynucleotide

SEQ ID NO: 1638 - DNA, 180 bp, Artificial Sequence
  Synthetic polynucleotide
atcatctcaccttgcctcctgaacaagcctagcacccacctgcaggtttcccacggtagatttcccacggttcgtttcccacggtgactttcccacggtctatttcccacggtacttttcccacggttgctttcccacggtgtatttcccacggtggcgcgccatgcttcatcagactct

SEQ ID NO: 1639 - DNA, 180 bp, Artificial Sequence; identical to SEQ ID NO: 1638
  Synthetic polynucleotide

SEQ ID NO: 1640 - DNA, 200 bp, Artificial Sequence
  Synthetic polynucleotide
atcatctcaccttgcctcctgttgctgcctcagaaactcctgcaggaaaaagaggaagtgaaactagaaaaaagaggaagtgaaacttcgaaaaagaggaagtgaaactgacaaaaagaggaagtgaaactctaaaaaagaggaagtgaaactactaaaaagaggaagtgaaactggcgcgccatgcttcatcagactct

SEQ ID NO: 1641 - DNA, 200 bp, Artificial Sequence; identical to SEQ ID NO: 1640
  Synthetic polynucleotide

SEQ ID NO: 1642 - DNA, 172 bp, Artificial Sequence
  Synthetic polynucleotide
atcatctcaccttgcctcctgctcggaatcaccatacccctgcagggttgctagggagagttgctagggtcggttgctaggggacgttgctagggctagttgctagggactgttgctagggtgcgttgctaggggtagttgctagggggcgcgccatgcttcatcagactct

SEQ ID NO: 1643 - DNA, 172 bp, Artificial Sequence; identical to SEQ ID NO: 1642
  Synthetic polynucleotide

SEQ ID NO: 1644 - DNA, 190 bp, Artificial Sequence
  Synthetic polynucleotide
atcatctcaccttgcctcctgcttggccatttccgtatcctgcaggcactgccccctcctagacactgccccctccttcgcactgccccctcctgaccactgccccctcctctacactgccccctcctactcactgccccctccttgccactgccccctcctgtaggcgcgccatgcttcatcagactct

SEQ ID NO: 1645 - DNA, 190 bp, Artificial Sequence; identical to SEQ ID NO: 1644
  Synthetic polynucleotide

SEQ ID NO: 1646 - DNA, 186 bp, Artificial Sequence
  Synthetic polynucleotide
atcatctcaccttgcctcctgtgacacctacgcaaatgcctgcaggggtgctgtccgtggtgctgaagaggtgctgtccgtggtgctgatcgggtgctgtccgtggtgctgagacggtgctgtccgtggtgctgactaggtgctgtccgtggtgctgaactggcgcgccatgcttcatcagactct

SEQ ID NO: 1647 - DNA, 186 bp, Artificial Sequence; identical to SEQ ID NO: 1646
  Synthetic polynucleotide

SEQ ID NO: 1648 - DNA, 197 bp, Artificial Sequence
  Synthetic polynucleotide
atcatctcaccttgcctcctggtggaatcaaagtgatgcctgcagggacccggaagcacttagagacccggaagcactttcggacccggaagcacttgacgacccggaagcacttctagacccggaagcacttactgacccggaagcactttgcgacccggaagcacttgtaggcgcgccatgcttcatcagactct

SEQ ID NO: 1649 - DNA, 197 bp, Artificial Sequence; identical to SEQ ID NO: 1648
  Synthetic polynucleotide

SEQ ID NO: 1650 - DNA, 172 bp, Artificial Sequence
  Synthetic polynucleotide
atcatctcaccttgcctcctgtacggaggccgtatagacctgcaggccctggcaacagaccctggcaactcgccctggcaacgacccctggcaacctaccctggcaacactccctggcaactgcccctggcaacgtaccctggcaacggcgcgccatgcttcatcagactct

SEQ ID NO: 1651 - DNA, 172 bp, Artificial Sequence; identical to SEQ ID NO: 1650
  Synthetic polynucleotide

SEQ ID NO: 1652 - DNA, 180 bp, Artificial Sequence
  Synthetic polynucleotide
atcatctcaccttgcctcctgagaccacaatctggcaacctgcaggttatgtaacgtagattatgtaacgttcgttatgtaacgtgacttatgtaacgtctattatgtaacgtactttatgtaacgttgcttatgtaacgtgtattatgtaacgtggcgcgccatgcttcatcagactct

SEQ ID NO: 1653 - DNA, 180 bp, Artificial Sequence; identical to SEQ ID NO: 1652
  Synthetic polynucleotide

SEQ ID NO: 1654 - DNA, 172 bp, Artificial Sequence
  Synthetic polynucleotide
atcatctcaccttgcctcctgctggcagtatagcataccctgcagggcacgtgaccagagcacgtgacctcggcacgtgaccgacgcacgtgaccctagcacgtgaccactgcacgtgacctgcgcacgtgaccgtagcacgtgaccggcgcgccatgcttcatcagactct

SEQ ID NO: 1655 - DNA, 172 bp, Artificial Sequence; identical to SEQ ID NO: 1654
  Synthetic polynucleotide

SEQ ID NO: 1656 - DNA, 196 bp, Artificial Sequence
  Synthetic polynucleotide
atcatctcaccttgcctcctgggagtctcaggaacgatcctgcaggtgcaatagtgccatctagtggtagatgcaatagtgccatctagtggttcgtgcaatagtgccatctagtggtgactgcaatagtgccatctagtggtctatgcaatagtgccatctagtggtactggcgcgccatgcttcatcagactct

SEQ ID NO: 1657 - DNA, 196 bp, Artificial Sequence; identical to SEQ ID NO: 1656
  Synthetic polynucleotide

SEQ ID NO: 1658 - DNA, 156 bp, Artificial Sequence
  Synthetic polynucleotide
atcatctcaccttgcctcctgcctgtggagtgagctcacctgcaggatgaccttagaatgacctttcgatgaccttgacatgaccttctaatgaccttactatgacctttgcatgaccttgtaatgaccttggcgcgccatgcttcatcagactct

SEQ ID NO: 1659 - DNA, 156 bp, Artificial Sequence; identical to SEQ ID NO: 1658
  Synthetic polynucleotide

SEQ ID NO: 1660 - DNA, 180 bp, Artificial Sequence
  Synthetic polynucleotide
atcatctcaccttgcctcctggccaatgcacactatatcctgcaggagccaatgggaagaagccaatgggatcgagccaatgggagacagccaatgggactaagccaatgggaactagccaatgggatgcagccaatgggagtaagccaatgggaggcgcgccatgcttcatcagactct

SEQ ID NO: 1661 - DNA, 180 bp, Artificial Sequence; identical to SEQ ID NO: 1660
  Synthetic polynucleotide

SEQ ID NO: 1662 - DNA, 196 bp, Artificial Sequence
  Synthetic polynucleotide
atcatctcaccttgcctcctggcctattgaaagaggtacctgcaggaaaattaattaatagaaaaattaattaattcgaaaattaattaatgacaaaattaattaatctaaaaattaattaatactaaaattaattaattgcaaaattaattaatgtaaaaattaattaatggcgcgccatgcttcatcagactct

SEQ ID NO: 1663 - DNA, 196 bp, Artificial Sequence; identical to SEQ ID NO: 1662
  Synthetic polynucleotide

SEQ ID NO: 1664 - DNA, 164 bp, Artificial Sequence
  Synthetic polynucleotide
atcatctcaccttgcctcctgacgtatagtaggtaggccctgcagggcccgggggagagcccgggggtcggcccggggggacgcccgggggctagcccgggggactgcccgggggtgcgcccggggggtagcccgggggggcgcgccatgcttcatcagactct

SEQ ID NO: 1665 - DNA, 164 bp, Artificial Sequence; identical to SEQ ID NO: 1664
  Synthetic polynucleotide

SEQ ID NO: 1666 - DNA, 186 bp, Artificial Sequence
  Synthetic polynucleotide
atcatctcaccttgcctcctggaaatctaacaacaccacctgcaggagagcactgaagcgtaaccgagaagagcactgaagcgtaaccgtcgagagcactgaagcgtaaccggacagagcactgaagcgtaaccgctaagagcactgaagcgtaaccgactggcgcgccatgcttcatcagactct

SEQ ID NO: 1667 - DNA, 186 bp, Artificial Sequence; identical to SEQ ID NO: 1666
  Synthetic polynucleotide

SEQ ID NO: 1668 - DNA, 197 bp, Artificial Sequence
  Synthetic polynucleotide
atcatctcaccttgcctcctgtcgtatgggtcggtagacctgcaggatgacgcatacccccagaatgacgcataccccctcgatgacgcatacccccgacatgacgcatacccccctaatgacgcatacccccactatgacgcataccccctgcatgacgcatacccccgtaggcgcgccatgcttcatcagactct

SEQ ID NO: 1669 - DNA, 197 bp, Artificial Sequence; identical to SEQ ID NO: 1668
  Synthetic polynucleotide

SEQ ID NO: 1670 - DNA, 185 bp, Artificial Sequence
  Synthetic polynucleotide
atcatctcaccttgcctcctgtggtctaatctgtgtcacctgcaggcggcagtaaccgtgggagacggcagtaaccgtgggtcgcggcagtaaccgtggggaccggcagtaaccgtgggctacggcagtaaccgtgggactcggcagtaaccgtgggtgcggcgcgccatgcttcatcagactct

SEQ ID NO: 1671 - DNA, 185 bp, Artificial Sequence; identical to SEQ ID NO: 1670
  Synthetic polynucleotide

SEQ ID NO: 1672 - DNA, 172 bp, Artificial Sequence
  Synthetic polynucleotide
atcatctcaccttgcctcctgcgtctcatacacttagccctgcaggtgtgggggggagatgtgggggggtcgtgtggggggggactgtgggggggctatgtgggggggacttgtgggggggtgctgtggggggggtatgtgggggggggcgcgccatgcttcatcagactct

SEQ ID NO: 1673 - DNA, 172 bp, Artificial Sequence; identical to SEQ ID NO: 1672
  Synthetic polynucleotide

SEQ ID NO: 1674 - DNA, 164 bp, Artificial Sequence
  Synthetic polynucleotide
atcatctcaccttgcctcctgtgcgtcatcttggtactcctgcagggacagctgcagagacagctgctcggacagctgcgacgacagctgcctagacagctgcactgacagctgctgcgacagctgcgtagacagctgcggcgcgccatgcttcatcagactct

SEQ ID NO: 1675 - DNA, 164 bp, Artificial Sequence; identical to SEQ ID NO: 1674
  Synthetic polynucleotide

SEQ ID NO: 1676 - DNA, 197 bp, Artificial Sequence
  Synthetic polynucleotide
atcatctcaccttgcctcctgaagtgacaatatggtcacctgcaggccaccagggggcgctagaccaccagggggcgcttcgccaccagggggcgctgacccaccagggggcgctctaccaccagggggcgctactccaccagggggcgcttgcccaccagggggcgctgtaggcgcgccatgcttcatcagactct

SEQ ID NO: 1677 - DNA, 197 bp, Artificial Sequence; identical to SEQ ID NO: 1676
  Synthetic polynucleotide

SEQ ID NO: 1678 - DNA, 191 bp, Artificial Sequence
  Synthetic polynucleotide
atcatctcaccttgcctcctggttctgcacgctatcaccctgcagggacgataatgaggttgcagagacgataatgaggttgctcggacgataatgaggttgcgacgacgataatgaggttgcctagacgataatgaggttgcactgacgataatgaggttgctgcggcgcgccatgcttcatcagactct

SEQ ID NO: 1679 - DNA, 191 bp, Artificial Sequence; identical to SEQ ID NO: 1678
  Synthetic polynucleotide

SEQ ID NO: 1680 - DNA, 132 bp, Artificial Sequence
  Synthetic polynucleotide
atcatctcaccttgcctcctgcataccaaaccgcgtaacctgcaggtaattagataatttcgtaattgactaattctataattacttaatttgctaattgtataattggcgcgccatgcttcatcagactct

SEQ ID NO: 1681 - DNA, 132 bp, Artificial Sequence; identical to SEQ ID NO: 1680
  Synthetic polynucleotide

SEQ ID NO: 1682 - DNA, 196 bp, Artificial Sequence
  Synthetic polynucleotide
atcatctcaccttgcctcctgcgtgcgaaatacgcattcctgcaggtttcagtatgactagatttcagtatgacttcgtttcagtatgactgactttcagtatgactctatttcagtatgactacttttcagtatgacttgctttcagtatgactgtatttcagtatgactggcgcgccatgcttcatcagactct

SEQ ID NO: 1683 - DNA, 196 bp, Artificial Sequence; identical to SEQ ID NO: 1682
  Synthetic polynucleotide

SEQ ID NO: 1684 - DNA, 172 bp, Artificial Sequence
  Synthetic polynucleotide
atcatctcaccttgcctcctgaatgaacttagcctggccctgcaggactgtatcaaagaactgtatcaatcgactgtatcaagacactgtatcaactaactgtatcaaactactgtatcaatgcactgtatcaagtaactgtatcaaggcgcgccatgcttcatcagactct

SEQ ID NO: 1685 - DNA, 172 bp, Artificial Sequence; identical to SEQ ID NO: 1684
  Synthetic polynucleotide

SEQ ID NO: 1686 - DNA, 197 bp, Artificial Sequence
  Synthetic polynucleotide
atcatctcaccttgcctcctgcgcagcggttatgaagacctgcaggcccccgcccacgcacagacccccgcccacgcactcgcccccgcccacgcacgaccccccgcccacgcacctacccccgcccacgcacactcccccgcccacgcactgccccccgcccacgcacgtaggcgcgccatgcttcatcagactct

SEQ ID NO: 1687 - DNA, 197 bp, Artificial Sequence; identical to SEQ ID NO: 1686
  Synthetic polynucleotide

SEQ ID NO: 1688 - DNA, 197 bp, Artificial Sequence
  Synthetic polynucleotide
atcatctcaccttgcctcctggaacaccgtcgaattagcctgcaggaaagatgatgtcatcagaaaagatgatgtcatctcgaaagatgatgtcatcgacaaagatgatgtcatcctaaaagatgatgtcatcactaaagatgatgtcatctgcaaagatgatgtcatcgtaggcgcgccatgcttcatcagactct

SEQ ID NO: 1689 - DNA, 197 bp, Artificial Sequence; identical to SEQ ID NO: 1688
  Synthetic polynucleotide

SEQ ID NO: 1690 - DNA, 164 bp, Artificial Sequence
  Synthetic polynucleotide
atcatctcaccttgcctcctgactttaagccggatgtccctgcagggatgcgggtagagatgcgggttcggatgcgggtgacgatgcgggtctagatgcgggtactgatgcgggttgcgatgcgggtgtagatgcgggtggcgcgccatgcttcatcagactct

SEQ ID NO: 1691 - DNA, 164 bp, Artificial Sequence; identical to SEQ ID NO: 1690
  Synthetic polynucleotide

SEQ ID NO: 1692 - DNA, 156 bp, Artificial Sequence
  Synthetic polynucleotide
atcatctcaccttgcctcctgcgtaacgataagtccgacctgcagggaggaagtagagaggaagttcggaggaagtgacgaggaagtctagaggaagtactgaggaagttgcgaggaagtgtagaggaagtggcgcgccatgcttcatcagactct

SEQ ID NO: 1693 - DNA, 156 bp, Artificial Sequence; identical to SEQ ID NO: 1692
  Synthetic polynucleotide

SEQ ID NO: 1694 - DNA, 156 bp, Artificial Sequence
  Synthetic polynucleotide
atcatctcaccttgcctcctgctgtacccggagtactacctgcaggctaattaaagactaattaatcgctaattaagacctaattaactactaattaaactctaattaatgcctaattaagtactaattaaggcgcgccatgcttcatcagactct

SEQ ID NO: 1695 - DNA, 156 bp, Artificial Sequence; identical to SEQ ID NO: 1694
  Synthetic polynucleotide

SEQ ID NO: 1696 - DNA, 172 bp, Artificial Sequence
  Synthetic polynucleotide
atcatctcaccttgcctcctgttcttcagctttctacccctgcaggggccagacacagaggccagacactcgggccagacacgacggccagacacctaggccagacacactggccagacactgcggccagacacgtaggccagacacggcgcgccatgcttcatcagactct

SEQ ID NO: 1697 - DNA, 172 bp, Artificial Sequence; identical to SEQ ID NO: 1696
  Synthetic polynucleotide

SEQ ID NO: 1698 - DNA, 164 bp, Artificial Sequence
  Synthetic polynucleotide
atcatctcaccttgcctcctgggatctccctaatatgacctgcaggaccgattagagaaccgattagtcgaccgattaggacaccgattagctaaccgattagactaccgattagtgcaccgattaggtaaccgattagggcgcgccatgcttcatcagactct

SEQ ID NO: 1699 - DNA, 164 bp, Artificial Sequence; identical to SEQ ID NO: 1698
  Synthetic polynucleotide

SEQ ID NO: 1700 - DNA, 156 bp, Artificial Sequence
  Synthetic polynucleotide
atcatctcaccttgcctcctgttgcaggatgatggcatcctgcaggctaattacagactaattactcgctaattacgacctaattacctactaattacactctaattactgcctaattacgtactaattacggcgcgccatgcttcatcagactct

SEQ ID NO: 1701 - DNA, 156 bp, Artificial Sequence; identical to SEQ ID NO: 1700
  Synthetic polynucleotide

SEQ ID NO: 1702 - DNA, 148 bp, Artificial Sequence
  Synthetic polynucleotide
atcatctcaccttgcctcctgcaacgggttgacgactgcctgcagggtttgctagagtttgcttcggtttgctgacgtttgctctagtttgctactgtttgcttgcgtttgctgtagtttgctggcgcgccatgcttcatcagactct

SEQ ID NO: 1703 - DNA, 148 bp, Artificial Sequence; identical to SEQ ID NO: 1702
  Synthetic polynucleotide

SEQ ID NO: 1704 - DNA, 188 bp, Artificial Sequence
  Synthetic polynucleotide
atcatctcaccttgcctcctgcacgttctcaattgctgcctgcaggaaatttggcaaaagaaaatttggcaaatcgaaatttggcaaagacaaatttggcaaactaaaatttggcaaaactaaatttggcaaatgcaaatttggcaaagtaaaatttggcaaaggcgcgccatgcttcatcagactct

SEQ ID NO: 1705 - DNA, 188 bp, Artificial Sequence; identical to SEQ ID NO: 1704
  Synthetic polynucleotide

SEQ ID NO: 1706 - DNA, 156 bp, Artificial Sequence
  Synthetic polynucleotide
atcatctcaccttgcctcctgcgtgaggtagatctgcgcctgcaggctaattagagactaattagtcgctaattaggacctaattagctactaattagactctaattagtgcctaattaggtactaattagggcgcgccatgcttcatcagactct

SEQ ID NO: 1707 - DNA, 156 bp, Artificial Sequence; identical to SEQ ID NO: 1706
  Synthetic polynucleotide

SEQ ID NO: 1708 - DNA, 172 bp, Artificial Sequence
  Synthetic polynucleotide
atcatctcaccttgcctcctgtatgtcctttctcccatcctgcaggagcacttaagagaagcacttaagtcgagcacttaaggacagcacttaagctaagcacttaagactagcacttaagtgcagcacttaaggtaagcacttaagggcgcgccatgcttcatcagactct

SEQ ID NO: 1709 - DNA, 172 bp, Artificial Sequence; identical to SEQ ID NO: 1708
  Synthetic polynucleotide

SEQ ID NO: 1710 - DNA, 164 bp, Artificial Sequence
  Synthetic polynucleotide
atcatctcaccttgcctcctgcggactcgatggtcgtacctgcaggtgctaccgtagatgctaccgttcgtgctaccgtgactgctaccgtctatgctaccgtacttgctaccgttgctgctaccgtgtatgctaccgtggcgcgccatgcttcatcagactct

SEQ ID NO: 1711 - DNA, 164 bp, Artificial Sequence; identical to SEQ ID NO: 1710
  Synthetic polynucleotide

SEQ ID NO: 1712 - DNA, 156 bp, Artificial Sequence
  Synthetic polynucleotide
atcatctcaccttgcctcctgtgagtaatttcatccgtcctgcaggtttcggttagatttcggtttcgtttcggttgactttcggttctatttcggttacttttcggtttgctttcggttgtatttcggttggcgcgccatgcttcatcagactct

SEQ ID NO: 1713 - DNA, 156 bp, Artificial Sequence; identical to SEQ ID NO: 1712
  Synthetic polynucleotide

SEQ ID NO: 1714 - DNA, 190 bp, Artificial Sequence
  Synthetic polynucleotide
atcatctcaccttgcctcctggtagattccaaactgtccctgcaggttgaactttgccccagattgaactttgcccctcgttgaactttgccccgacttgaactttgccccctattgaactttgccccactttgaactttgcccctgcttgaactttgccccgtaggcgcgccatgcttcatcagactct

SEQ ID NO: 1715 - DNA, 190 bp, Artificial Sequence; identical to SEQ ID NO: 1714
  Synthetic polynucleotide

SEQ ID NO: 1716 - DNA, 197 bp, Artificial Sequence
  Synthetic polynucleotide
atcatctcaccttgcctcctgccaccgtatgctcacttcctgcaggagaaccttctagaagagaagaaccttctagaagtcgagaaccttctagaaggacagaaccttctagaagctaagaaccttctagaagactagaaccttctagaagtgcagaaccttctagaaggtaggcgcgccatgcttcatcagactct

SEQ ID NO: 1717 - DNA, 197 bp, Artificial Sequence; identical to SEQ ID NO: 1716
  Synthetic polynucleotide

SEQ ID NO: 1718 - DNA, 188 bp, Artificial Sequence
  Synthetic polynucleotide
atcatctcaccttgcctcctgctggatgcgtggtgaaccctgcaggaaaacgattataagaaaaacgattatatcgaaaacgattatagacaaaacgattatactaaaaacgattataactaaaacgattatatgcaaaacgattatagtaaaaacgattataggcgcgccatgcttcatcagactct

SEQ ID NO: 1719 - DNA, 188 bp, Artificial Sequence; identical to SEQ ID NO: 1718
  Synthetic polynucleotide

SEQ ID NO: 1720 - DNA, 156 bp, Artificial Sequence
  Synthetic polynucleotide
atcatctcaccttgcctcctgacacctatgatgctcgacctgcaggggattcccagaggattccctcgggattcccgacggattcccctaggattcccactggattccctgcggattcccgtaggattcccggcgcgccatgcttcatcagactct

SEQ ID NO: 1721 - DNA, 156 bp, Artificial Sequence; identical to SEQ ID NO: 1720
  Synthetic polynucleotide

SEQ ID NO: 1722 - DNA, 197 bp, Artificial Sequence
  Synthetic polynucleotide
atcatctcaccttgcctcctgtccattgaggacgagatcctgcagggccccgccccctcccagagccccgccccctccctcggccccgccccctcccgacgccccgccccctcccctagccccgccccctcccactgccccgccccctccctgcgccccgccccctcccgtaggcgcgccatgcttcatcagactct

SEQ ID NO: 1723 - DNA, 197 bp, Artificial Sequence; identical to SEQ ID NO: 1722
  Synthetic polynucleotide

SEQ ID NO: 1724 - DNA, 197 bp, Artificial Sequence
  Synthetic polynucleotide
atcatctcaccttgcctcctgacctcgaatcagtttcacctgcaggccaccagggggcgccagaccaccagggggcgcctcgccaccagggggcgccgacccaccagggggcgccctaccaccagggggcgccactccaccagggggcgcctgcccaccagggggcgccgtaggcgcgccatgcttcatcagactct

SEQ ID NO: 1725 - DNA, 197 bp, Artificial Sequence; identical to SEQ ID NO: 1724
  Synthetic polynucleotide

SEQ ID NO: 1726 - DNA, 190 bp, Artificial Sequence
  Synthetic polynucleotide
atcatctcaccttgcctcctgacgaaggctgctgtccacctgcaggtcctttcccttcctagatcctttcccttccttcgtcctttcccttcctgactcctttcccttcctctatcctttcccttcctacttcctttcccttccttgctcctttcccttcctgtaggcgcgccatgcttcatcagactct

SEQ ID NO: 1727 - DNA, 190 bp, Artificial Sequence; identical to SEQ ID NO: 1726
  Synthetic polynucleotide

SEQ ID NO: 1728 - DNA, 180 bp, Artificial Sequence
  Synthetic polynucleotide
atcatctcaccttgcctcctgcaacaagccaggagagtcctgcagggtacttccggtagagtacttccggttcggtacttccggtgacgtacttccggtctagtacttccggtactgtacttccggttgcgtacttccggtgtagtacttccggtggcgcgccatgcttcatcagactct

SEQ ID NO: 1729 - DNA, 180 bp, Artificial Sequence; identical to SEQ ID NO: 1728
  Synthetic polynucleotide

SEQ ID NO: 1730 - DNA, 172 bp, Artificial Sequence
  Synthetic polynucleotide
atcatctcaccttgcctcctgccgttaatccagttagccctgcaggggtcatgtggagaggtcatgtggtcgggtcatgtgggacggtcatgtggctaggtcatgtggactggtcatgtggtgcggtcatgtgggtaggtcatgtggggcgcgccatgcttcatcagactct

SEQ ID NO: 1731 - DNA, 172 bp, Artificial Sequence; identical to SEQ ID NO: 1730
  Synthetic polynucleotide

SEQ ID NO: 1732 - DNA, 180 bp, Artificial Sequence
  Synthetic polynucleotide
atcatctcaccttgcctcctgacttgacacgtgaaccccctgcaggaaaccacagacagaaaaccacagactcgaaaccacagacgacaaaccacagacctaaaaccacagacactaaaccacagactgcaaaccacagacgtaaaaccacagacggcgcgccatgcttcatcagactct

SEQ ID NO: 1733 - DNA, 180 bp, Artificial Sequence; identical to SEQ ID NO: 1732
  Synthetic polynucleotide

SEQ ID NO: 1734 - DNA, 188 bp, Artificial Sequence
  Synthetic polynucleotide
atcatctcaccttgcctcctgacactcctgcatcagggcctgcaggggttacgtaatcagaggttacgtaatctcgggttacgtaatcgacggttacgtaatcctaggttacgtaatcactggttacgtaatctgcggttacgtaatcgtaggttacgtaatcggcgcgccatgcttcatcagactct

SEQ ID NO: 1735 - DNA, 188 bp, Artificial Sequence; identical to SEQ ID NO: 1734
  Synthetic polynucleotide

SEQ ID NO: 1736 - DNA, 185 bp, Artificial Sequence
  Synthetic polynucleotide
atcatctcaccttgcctcctgggtcttaggtcgcagtacctgcaggggtaagtaaataaacaagaggtaagtaaataaacatcgggtaagtaaataaacagacggtaagtaaataaacactaggtaagtaaataaacaactggtaagtaaataaacatgcggcgcgccatgcttcatcagactct

SEQ ID NO: 1737 - DNA, 185 bp, Artificial Sequence; identical to SEQ ID NO: 1736
  Synthetic polynucleotide

SEQ ID NO: 1738 - DNA, 197 bp, Artificial Sequence
  Synthetic polynucleotide
atcatctcaccttgcctcctgttaccactacaagggctcctgcaggtgccctggggccatgagatgccctggggccatgtcgtgccctggggccatggactgccctggggccatgctatgccctggggccatgacttgccctggggccatgtgctgccctggggccatggtaggcgcgccatgcttcatcagactct

SEQ ID NO: 1739 - DNA, 197 bp, Artificial Sequence; identical to SEQ ID NO: 1738
  Synthetic polynucleotide

SEQ ID NO: 1740 - DNA, 191 bp, Artificial Sequence
  Synthetic polynucleotide
atcatctcaccttgcctcctgatactaatcgcgccagccctgcaggcaggagcagctgctgagagacaggagcagctgctgagtcgcaggagcagctgctgaggaccaggagcagctgctgagctacaggagcagctgctgagactcaggagcagctgctgagtgcggcgcgccatgcttcatcagactct

SEQ ID NO: 1741 - DNA, 191 bp, Artificial Sequence; identical to SEQ ID NO: 1740
  Synthetic polynucleotide

SEQ ID NO: 1742 - DNA, 186 bp, Artificial Sequence
  Synthetic polynucleotide
atcatctcaccttgcctcctgtccatacgaatccgggccctgcaggctccggcgccccctggtggcagactccggcgccccctggtggctcgctccggcgccccctggtggcgacctccggcgccccctggtggcctactccggcgccccctggtggcactggcgcgccatgcttcatcagactct

SEQ ID NO: 1743 - DNA, 186 bp, Artificial Sequence; identical to SEQ ID NO: 1742
  Synthetic polynucleotide

SEQ ID NO: 1744 - DNA, 172 bp, Artificial Sequence
  Synthetic polynucleotide
atcatctcaccttgcctcctgctggtagagttgccaatcctgcaggaatgtaaacaagaaatgtaaacatcgaatgtaaacagacaatgtaaacactaaatgtaaacaactaatgtaaacatgcaatgtaaacagtaaatgtaaacaggcgcgccatgcttcatcagactct

SEQ ID NO: 1745 - DNA, 172 bp, Artificial Sequence; identical to SEQ ID NO: 1744
  Synthetic polynucleotide

SEQ ID NO: 1746 - DNA, 197 bp, Artificial Sequence
  Synthetic polynucleotide
atcatctcaccttgcctcctgtggaggtagtccgataccctgcagggggaacattatgtcctaaagagggaacattatgtcctaatcggggaacattatgtcctaagacgggaacattatgtcctaactagggaacattatgtcctaaactgggaacattatgtcctaatgcggcgcgccatgcttcatcagactct

SEQ ID NO: 1747 - DNA, 197 bp, Artificial Sequence; identical to SEQ ID NO: 1746
  Synthetic polynucleotide

SEQ ID NO: 1748 - DNA, 188 bp, Artificial Sequence
  Synthetic polynucleotide
atcatctcaccttgcctcctgctttccgtcttgcacgacctgcaggccacctgagcccagaccacctgagccctcgccacctgagcccgacccacctgagcccctaccacctgagcccactccacctgagccctgcccacctgagcccgtaccacctgagcccggcgcgccatgcttcatcagactct

SEQ ID NO: 1749 - DNA, 188 bp, Artificial Sequence; identical to SEQ ID NO: 1748
  Synthetic polynucleotide

SEQ ID NO: 1750 - DNA, 172 bp, Artificial Sequence
  Synthetic polynucleotide
atcatctcaccttgcctcctgctttgttccaagcggctcctgcaggcctaattatcagacctaattatctcgcctaattatcgaccctaattatcctacctaattatcactcctaattatctgccctaattatcgtacctaattatcggcgcgccatgcttcatcagactct

SEQ ID NO: 1751 - DNA, 172 bp, Artificial Sequence; identical to SEQ ID NO: 1750
  Synthetic polynucleotide

SEQ ID NO: 1752 - DNA, 188 bp, Artificial Sequence
  Synthetic polynucleotide
atcatctcaccttgcctcctgagcaagtattcttcgcacctgcaggggggactttccaagaggggactttccatcgggggactttccagacggggactttccactaggggactttccaactggggactttccatgcggggactttccagtaggggactttccaggcgcgccatgcttcatcagactct

SEQ ID NO: 1753 - DNA, 188 bp, Artificial Sequence; identical to SEQ ID NO: 1752
  Synthetic polynucleotide

SEQ ID NO: 1754 - DNA, 188 bp, Artificial Sequence
  Synthetic polynucleotide
atcatctcaccttgcctcctgcagaagattgttggcagcctgcaggatatacttatttagaatatacttattttcgatatacttatttgacatatacttatttctaatatacttatttactatatacttattttgcatatacttatttgtaatatacttatttggcgcgccatgcttcatcagactct

SEQ ID NO: 1755 - DNA, 188 bp, Artificial Sequence; identical to SEQ ID NO: 1754
  Synthetic polynucleotide

SEQ ID NO: 1756 - DNA, 188 bp, Artificial Sequence
  Synthetic polynucleotide
atcatctcaccttgcctcctgtcaacggtgctcatatacctgcaggacaataacattgagaacaataacattgtcgacaataacattggacacaataacattgctaacaataacattgactacaataacattgtgcacaataacattggtaacaataacattgggcgcgccatgcttcatcagactct

SEQ ID NO: 1757 - DNA, 188 bp, Artificial Sequence; identical to SEQ ID NO: 1756
  Synthetic polynucleotide

SEQ ID NO: 1758 - DNA, 197 bp, Artificial Sequence
  Synthetic polynucleotide
atcatctcaccttgcctcctgggcctagcaagagaacacctgcaggtgatgacgtcaccttagatgatgacgtcacctttcgtgatgacgtcaccttgactgatgacgtcaccttctatgatgacgtcaccttacttgatgacgtcacctttgctgatgacgtcaccttgtaggcgcgccatgcttcatcagactct

SEQ ID NO: 1759 - DNA, 197 bp, Artificial Sequence; identical to SEQ ID NO: 1758
  Synthetic polynucleotide

SEQ ID NO: 1760 - DNA, 197 bp, Artificial Sequence
  Synthetic polynucleotide
atcatctcaccttgcctcctgcgatcgataagctcttacctgcaggggttaataattaaccagaggttaataattaacctcgggttaataattaaccgacggttaataattaaccctaggttaataattaaccactggttaataattaacctgcggttaataattaaccgtaggcgcgccatgcttcatcagactct

SEQ ID NO: 1761 - DNA, 197 bp, Artificial Sequence; identical to SEQ ID NO: 1760
  Synthetic polynucleotide

SEQ ID NO: 1762 - DNA, 191 bp, Artificial Sequence
  Synthetic polynucleotide
atcatctcaccttgcctcctgcaataaggcacgccatacctgcaggtgaactaattagcccacagatgaactaattagcccactcgtgaactaattagcccacgactgaactaattagcccacctatgaactaattagcccacacttgaactaattagcccactgcggcgcgccatgcttcatcagactct

SEQ ID NO: 1763 - DNA, 191 bp, Artificial Sequence; identical to SEQ ID NO: 1762
  Synthetic polynucleotide

SEQ ID NO: 1764 - DNA, 164 bp, Artificial Sequence
  Synthetic polynucleotide
atcatctcaccttgcctcctggaacggcgcagcaaactcctgcaggcctaattggagacctaattggtcgcctaattgggaccctaattggctacctaattggactcctaattggtgccctaattgggtacctaattggggcgcgccatgcttcatcagactct

SEQ ID NO: 1765 - DNA, 164 bp, Artificial Sequence; identical to SEQ ID NO: 1764
  Synthetic polynucleotide

SEQ ID NO: 1766 - DNA, 185 bp, Artificial Sequence
  Synthetic polynucleotide
atcatctcaccttgcctcctggagctacgccgtaagctcctgcaggaacggtaataaaatttagaaacggtaataaaattttcgaacggtaataaaatttgacaacggtaataaaatttctaaacggtaataaaatttactaacggtaataaaattttgcggcgcgccatgcttcatcagactct

SEQ ID NO: 1767 - DNA, 185 bp, Artificial Sequence; identical to SEQ ID NO: 1766
  Synthetic polynucleotide

SEQ ID NO: 1768 - DNA, 156 bp, Artificial Sequence
  Synthetic polynucleotide
atcatctcaccttgcctcctgtttacgcgttcacgctacctgcaggctaatcaaagactaatcaatcgctaatcaagacctaatcaactactaatcaaactctaatcaatgcctaatcaagtactaatcaaggcgcgccatgcttcatcagactct

SEQ ID NO: 1769 - DNA, 156 bp, Artificial Sequence; identical to SEQ ID NO: 1768
  Synthetic polynucleotide

SEQ ID NO: 1770 - DNA, 180 bp, Artificial Sequence
  Synthetic polynucleotide
atcatctcaccttgcctcctgataggctgcatgtgcctcctgcaggagagtgggtgtagaagagtgggtgttcgagagtgggtgtgacagagtgggtgtctaagagtgggtgtactagagtgggtgttgcagagtgggtgtgtaagagtgggtgtggcgcgccatgcttcatcagactct

SEQ ID NO: 1771 - DNA, 180 bp, Artificial Sequence; identical to SEQ ID NO: 1770
  Synthetic polynucleotide

SEQ ID NO: 1772 - DNA, 156 bp, Artificial Sequence
  Synthetic polynucleotide
atcatctcaccttgcctcctgtgtttcgctgcactttacctgcagggctgtcaaagagctgtcaatcggctgtcaagacgctgtcaactagctgtcaaactgctgtcaatgcgctgtcaagtagctgtcaaggcgcgccatgcttcatcagactct

SEQ ID NO: 1773 - DNA, 156 bp, Artificial Sequence; identical to SEQ ID NO: 1772
  Synthetic polynucleotide

SEQ ID NO: 1774 - DNA, 197 bp, Artificial Sequence
  Synthetic polynucleotide
atcatctcaccttgcctcctgggtgacgagcgactatacctgcagggttaagggattaaagagagttaagggattaaagtcggttaagggattaaaggacgttaagggattaaagctagttaagggattaaagactgttaagggattaaagtgcgttaagggattaaaggtaggcgcgccatgcttcatcagactct

SEQ ID NO: 1775 - DNA, 197 bp, Artificial Sequence; identical to SEQ ID NO: 1774
  Synthetic polynucleotide

SEQ ID NO: 1776 - DNA, 196 bp, Artificial Sequence
  Synthetic polynucleotide
atcatctcaccttgcctcctgggagaaagcagtcgtgtcctgcaggttcagcaccatggacagcgcccagattcagcaccatggacagcgccctcgttcagcaccatggacagcgcccgacttcagcaccatggacagcgcccctattcagcaccatggacagcgcccactggcgcgccatgcttcatcagactct

SEQ ID NO: 1777 - DNA, 196 bp, Artificial Sequence; identical to SEQ ID NO: 1776
  Synthetic polynucleotide

SEQ ID NO: 1778 - DNA, 156 bp, Artificial Sequence
  Synthetic polynucleotide
atcatctcaccttgcctcctgcttagttcctacttcctcctgcagggcgtgactagagcgtgacttcggcgtgactgacgcgtgactctagcgtgactactgcgtgacttgcgcgtgactgtagcgtgactggcgcgccatgcttcatcagactct

SEQ ID NO: 1779 - DNA, 156 bp, Artificial Sequence; identical to SEQ ID NO: 1778
  Synthetic polynucleotide

SEQ ID NO: 1780 - DNA, 164 bp, Artificial Sequence
  Synthetic polynucleotide
atcatctcaccttgcctcctgtgaggaggagactgattcctgcaggtgatgacgtagatgatgacgttcgtgatgacgtgactgatgacgtctatgatgacgtacttgatgacgttgctgatgacgtgtatgatgacgtggcgcgccatgcttcatcagactct

SEQ ID NO: 1781 - DNA, 164 bp, Artificial Sequence; identical to SEQ ID NO: 1780
  Synthetic polynucleotide

SEQ ID NO: 1782 - DNA, 164 bp, Artificial Sequence
  Synthetic polynucleotide
atcatctcaccttgcctcctgtggctatgtactgattccctgcaggctcattaggagactcattaggtcgctcattagggacctcattaggctactcattaggactctcattaggtgcctcattagggtactcattaggggcgcgccatgcttcatcagactct

SEQ ID NO: 1783 - DNA, 164 bp, Artificial Sequence; identical to SEQ ID NO: 1782
  Synthetic polynucleotide

SEQ ID NO: 1784 - DNA, 190 bp, Artificial Sequence
  Synthetic polynucleotide
atcatctcaccttgcctcctggtgctgtgacaacacgccctgcaggtgaccacgtggtcgagatgaccacgtggtcgtcgtgaccacgtggtcggactgaccacgtggtcgctatgaccacgtggtcgacttgaccacgtggtcgtgctgaccacgtggtcggtaggcgcgccatgcttcatcagactct

SEQ ID NO: 1785 - DNA, 190 bp, Artificial Sequence; identical to SEQ ID NO: 1784
  Synthetic polynucleotide

SEQ ID NO: 1786 - DNA, 183 bp, Artificial Sequence
  Synthetic polynucleotide
atcatctcaccttgcctcctgcatctggtcacccactccctgcagggtcgcttctcacacctctgatggcaagagtcgcttctcacacctctgatggcatcggtcgcttctcacacctctgatggcagacgtcgcttctcacacctctgatggcactaggcgcgccatgcttcatcagactct

SEQ ID NO: 1787 - DNA, 183 bp, Artificial Sequence; identical to SEQ ID NO: 1786
  Synthetic polynucleotide

SEQ ID NO: 1788 - DNA, 196 bp, Artificial Sequence
  Synthetic polynucleotide
atcatctcaccttgcctcctgacacgtgcatagtacctcctgcaggacctcattacgagagaacctcattacgagtcgacctcattacgaggacacctcattacgagctaacctcattacgagactacctcattacgagtgcacctcattacgaggtaacctcattacgagggcgcgccatgcttcatcagactct

SEQ ID NO: 1789 - DNA, 196 bp, Artificial Sequence; identical to SEQ ID NO: 1788
  Synthetic polynucleotide

SEQ ID NO: 1790 - DNA, 185 bp, Artificial Sequence
  Synthetic polynucleotide
atcatctcaccttgcctcctgcctggttaaatggcccacctgcaggggggaatttccccgccagaggggaatttccccgcctcgggggaatttccccgccgacggggaatttccccgccctaggggaatttccccgccactggggaatttccccgcctgcggcgcgccatgcttcatcagactct

SEQ ID NO: 1791 - DNA, 185 bp, Artificial Sequence; identical to SEQ ID NO: 1790
  Synthetic polynucleotide

SEQ ID NO: 1792 - DNA, 172 bp, Artificial Sequence
  Synthetic polynucleotide
atcatctcaccttgcctcctggcgtctgtttaaccctccctgcaggtacgcgcgtaagatacgcgcgtatcgtacgcgcgtagactacgcgcgtactatacgcgcgtaacttacgcgcgtatgctacgcgcgtagtatacgcgcgtaggcgcgccatgcttcatcagactct

SEQ ID NO: 1793 - DNA, 172 bp, Artificial Sequence; identical to SEQ ID NO: 1792
  Synthetic polynucleotide

SEQ ID NO: 1794 - DNA, 148 bp, Artificial Sequence
  Synthetic polynucleotide
atcatctcaccttgcctcctggattgtaaggaggtgtgcctgcaggatatattagaatatatttcgatatattgacatatattctaatatattactatatatttgcatatattgtaatatattggcgcgccatgcttcatcagactct

SEQ ID NO: 1795 - DNA, 148 bp, Artificial Sequence; identical to SEQ ID NO: 1794
  Synthetic polynucleotide

SEQ ID NO: 1796 - DNA, 132 bp, Artificial Sequence
  Synthetic polynucleotide
atcatctcaccttgcctcctgattagatgggttatctccctgcaggtgtcaagatgtcatcgtgtcagactgtcactatgtcaacttgtcatgctgtcagtatgtcaggcgcgccatgcttcatcagactct

SEQ ID NO: 1797 - DNA, 132 bp, Artificial Sequence; identical to SEQ ID NO: 1796
  Synthetic polynucleotide

SEQ ID NO: 1798 - DNA, 164 bp, Artificial Sequence
  Synthetic polynucleotide
atcatctcaccttgcctcctgcccttgaagtcctgattcctgcaggtgtacgtcaagatgtacgtcatcgtgtacgtcagactgtacgtcactatgtacgtcaacttgtacgtcatgctgtacgtcagtatgtacgtcaggcgcgccatgcttcatcagactct

SEQ ID NO: 1799 - DNA, 164 bp, Artificial Sequence; identical to SEQ ID NO: 1798
  Synthetic polynucleotide

SEQ ID NO: 1800 - DNA, 190 bp, Artificial Sequence
  Synthetic polynucleotide
atcatctcaccttgcctcctggcgctgactgcatcatccctgcaggtgtatgtttatattagatgtatgtttatatttcgtgtatgtttatattgactgtatgtttatattctatgtatgtttatattacttgtatgtttatatttgctgtatgtttatattgtaggcgcgccatgcttcatcagactct

SEQ ID NO: 1801 - DNA, 190 bp, Artificial Sequence; identical to SEQ ID NO: 1800
  Synthetic polynucleotide

SEQ ID NO: 1802 - DNA, 190 bp, Artificial Sequence
  Synthetic polynucleotide
atcatctcaccttgcctcctgcgacactgcacctatgccctgcaggggggtcaaaggtcaagaggggtcaaaggtcatcgggggtcaaaggtcagacggggtcaaaggtcactaggggtcaaaggtcaactggggtcaaaggtcatgcggggtcaaaggtcagtaggcgcgccatgcttcatcagactct

SEQ ID NO: 1803 - DNA, 190 bp, Artificial Sequence; identical to SEQ ID NO: 1802
  Synthetic polynucleotide

SEQ ID NO: 1804 - DNA, 191 bp, Artificial Sequence
  Synthetic polynucleotide
atcatctcaccttgcctcctgtccacccttcgtcatcgcctgcagggccaattaattaatgcgagagccaattaattaatgcgtcggccaattaattaatgcggacgccaattaattaatgcgctagccaattaattaatgcgactgccaattaattaatgcgtgcggcgcgccatgcttcatcagactct

SEQ ID NO: 1805 - DNA, 191 bp, Artificial Sequence; identical to SEQ ID NO: 1804
  Synthetic polynucleotide

SEQ ID NO: 1806 - DNA, 197 bp, Artificial Sequence
  Synthetic polynucleotide
atcatctcaccttgcctcctgagactctactccactcgcctgcaggcattgttatgcaaatagacattgttatgcaaattcgcattgttatgcaaatgaccattgttatgcaaatctacattgttatgcaaatactcattgttatgcaaattgccattgttatgcaaatgtaggcgcgccatgcttcatcagactct

SEQ ID NO: 1807 - DNA, 197 bp, Artificial Sequence; identical to SEQ ID NO: 1806
  Synthetic polynucleotide

SEQ ID NO: 1808 - DNA, 156 bp, Artificial Sequence
  Synthetic polynucleotide
atcatctcaccttgcctcctggattggttagtgcccgtcctgcaggctaattatagactaattattcgctaattatgacctaattatctactaattatactctaattattgcctaattatgtactaattatggcgcgccatgcttcatcagactct

SEQ ID NO: 1809 - DNA, 156 bp, Artificial Sequence; identical to SEQ ID NO: 1808
  Synthetic polynucleotide

SEQ ID NO: 1810 - DNA, 156 bp, Artificial Sequence
  Synthetic polynucleotide
atcatctcaccttgcctcctgcctgaacgatgaccatccctgcagggggaatccagagggaatcctcggggaatccgacgggaatccctagggaatccactgggaatcctgcgggaatccgtagggaatccggcgcgccatgcttcatcagactct

SEQ ID NO: 1811 - DNA, 156 bp, Artificial Sequence; identical to SEQ ID NO: 1810
  Synthetic polynucleotide

SEQ ID NO: 1812 - DNA, 197 bp, Artificial Sequence
  Synthetic polynucleotide
atcatctcaccttgcctcctgtggcattggttactcttcctgcagggccggatgtacttccggtagagccggatgtacttccggttcggccggatgtacttccggtgacgccggatgtacttccggtctagccggatgtacttccggtactgccggatgtacttccggttgcggcgcgccatgcttcatcagactct

SEQ ID NO: 1813 - DNA, 197 bp, Artificial Sequence; identical to SEQ ID NO: 1812
  Synthetic polynucleotide

SEQ ID NO: 1814 - DNA, 196 bp, Artificial Sequence
  Synthetic polynucleotide
atcatctcaccttgcctcctggctggttgtatatcgctcctgcaggtgtggttctaaaaatagaacaaagatgtggttctaaaaatagaacaatcgtgtggttctaaaaatagaacaagactgtggttctaaaaatagaacaactatgtggttctaaaaatagaacaaactggcgcgccatgcttcatcagactct

SEQ ID NO: 1815 - DNA, 196 bp, Artificial Sequence; identical to SEQ ID NO: 1814
  Synthetic polynucleotide

SEQ ID NO: 1816 - DNA, 180 bp, Artificial Sequence
  Synthetic polynucleotide
atcatctcaccttgcctcctgcatagtattgctcggatcctgcaggttctgacagctagattctgacagcttcgttctgacagctgacttctgacagctctattctgacagctactttctgacagcttgcttctgacagctgtattctgacagctggcgcgccatgcttcatcagactct

SEQ ID NO: 1817 - DNA, 180 bp, Artificial Sequence; identical to SEQ ID NO: 1816
  Synthetic polynucleotide

SEQ ID NO: 1818 - DNA, 180 bp, Artificial Sequence
  Synthetic polynucleotide
atcatctcaccttgcctcctggagtcgcacacagaagccctgcagggggataatcccagagggataatccctcggggataatcccgacgggataatcccctagggataatcccactgggataatccctgcgggataatcccgtagggataatcccggcgcgccatgcttcatcagactct

SEQ ID NO: 1819 - DNA, 180 bp, Artificial Sequence; identical to SEQ ID NO: 1818
  Synthetic polynucleotide

SEQ ID NO: 1820 - DNA, 164 bp, Artificial Sequence
  Synthetic polynucleotide
atcatctcaccttgcctcctgacaagatatgtgatcctcctgcaggtgtaactgtagatgtaactgttcgtgtaactgtgactgtaactgtctatgtaactgtacttgtaactgttgctgtaactgtgtatgtaactgtggcgcgccatgcttcatcagactct

SEQ ID NO: 1821 - DNA, 164 bp, Artificial Sequence; identical to SEQ ID NO: 1820
  Synthetic polynucleotide

SEQ ID NO: 1822 - DNA, 190 bp, Artificial Sequence
  Synthetic polynucleotide
atcatctcaccttgcctcctggatctacaaggcggaaacctgcagggctataaatagaacagagctataaatagaactcggctataaatagaacgacgctataaatagaacctagctataaatagaacactgctataaatagaactgcgctataaatagaacgtaggcgcgccatgcttcatcagactct

SEQ ID NO: 1823 - DNA, 190 bp, Artificial Sequence; identical to SEQ ID NO: 1822
  Synthetic polynucleotide

SEQ ID NO: 1824 - DNA, 172 bp, Artificial Sequence
  Synthetic polynucleotide
atcatctcaccttgcctcctgccatatgctcgtacgaccctgcaggtgacccaattagatgacccaatttcgtgacccaattgactgacccaattctatgacccaattacttgacccaatttgctgacccaattgtatgacccaattggcgcgccatgcttcatcagactct

SEQ ID NO: 1825 - DNA, 172 bp, Artificial Sequence; identical to SEQ ID NO: 1824
  Synthetic polynucleotide

SEQ ID NO: 1826 - DNA, 196 bp, Artificial Sequence
  Synthetic polynucleotide
atcatctcaccttgcctcctggggacaccacttaatttcctgcaggcattgtttatatgagacattgtttatatgtcgcattgtttatatggaccattgtttatatgctacattgtttatatgactcattgtttatatgtgccattgtttatatggtacattgtttatatgggcgcgccatgcttcatcagactct

SEQ ID NO: 1827 - DNA, 196 bp, Artificial Sequence; identical to SEQ ID NO: 1826
  Synthetic polynucleotide

SEQ ID NO: 1828 - DNA, 156 bp, Artificial Sequence
  Synthetic polynucleotide
atcatctcaccttgcctcctgcctttaaacgctacagtcctgcaggtatttataagatatttatatcgtatttatagactatttatactatatttataacttatttatatgctatttatagtatatttataggcgcgccatgcttcatcagactct

SEQ ID NO: 1829 - DNA, 156 bp, Artificial Sequence; identical to SEQ ID NO: 1828
  Synthetic polynucleotide

SEQ ID NO: 1830 - DNA, 197 bp, Artificial Sequence
  Synthetic polynucleotide
atcatctcaccttgcctcctgccgatgcgagtccaaatcctgcaggtggtaatcattaaccagatggtaatcattaacctcgtggtaatcattaaccgactggtaatcattaaccctatggtaatcattaaccacttggtaatcattaacctgctggtaatcattaaccgtaggcgcgccatgcttcatcagactct

SEQ ID NO: 1831 - DNA, 197 bp, Artificial Sequence; identical to SEQ ID NO: 1830
  Synthetic polynucleotide

SEQ ID NO: 1832 - DNA, 172 bp, Artificial Sequence
  Synthetic polynucleotide
atcatctcaccttgcctcctggtgtgtgtgtattgcctcctgcagggaggggatttagagaggggattttcggaggggatttgacgaggggatttctagaggggatttactgaggggattttgcgaggggatttgtagaggggatttggcgcgccatgcttcatcagactct

SEQ ID NO: 1833 - DNA, 172 bp, Artificial Sequence; identical to SEQ ID NO: 1832
  Synthetic polynucleotide

SEQ ID NO: 1834 - DNA, 197 bp, Artificial Sequence
  Synthetic polynucleotide
atcatctcaccttgcctcctggtgcttaggcttgtaaacctgcaggttgcggtttttgcggttaagattgcggtttttgcggttatcgttgcggtttttgcggttagacttgcggtttttgcggttactattgcggtttttgcggttaactttgcggtttttgcggttatgcggcgcgccatgcttcatcagactct

SEQ ID NO: 1835 - DNA, 197 bp, Artificial Sequence; identical to SEQ ID NO: 1834
  Synthetic polynucleotide

SEQ ID NO: 1836 - DNA, 172 bp, Artificial Sequence
  Synthetic polynucleotide
atcatctcaccttgcctcctgcggagcgtattgatgcgcctgcaggaaccacttaaagaaaccacttaatcgaaccacttaagacaaccacttaactaaaccacttaaactaaccacttaatgcaaccacttaagtaaaccacttaaggcgcgccatgcttcatcagactct

SEQ ID NO: 1837 - DNA, 172 bp, Artificial Sequence; identical to SEQ ID NO: 1836
  Synthetic polynucleotide

SEQ ID NO: 1838 - DNA, 188 bp, Artificial Sequence
  Synthetic polynucleotide
atcatctcaccttgcctcctgtaccgatgatctcttagcctgcagggaaagtgaaagtagagaaagtgaaagttcggaaagtgaaagtgacgaaagtgaaagtctagaaagtgaaagtactgaaagtgaaagttgcgaaagtgaaagtgtagaaagtgaaagtggcgcgccatgcttcatcagactct

SEQ ID NO: 1839 - DNA, 188 bp, Artificial Sequence; identical to SEQ ID NO: 1838
  Synthetic polynucleotide

SEQ ID NO: 1840 - DNA, 197 bp, Artificial Sequence
  Synthetic polynucleotide
atcatctcaccttgcctcctgtaactctcgcaatcctccctgcaggcctagcaacaggtgaagacctagcaacaggtgatcgcctagcaacaggtgagaccctagcaacaggtgactacctagcaacaggtgaactcctagcaacaggtgatgccctagcaacaggtgagtaggcgcgccatgcttcatcagactct

SEQ ID NO: 1841 - DNA, 197 bp, Artificial Sequence; identical to SEQ ID NO: 1840
  Synthetic polynucleotide

SEQ ID NO: 1842 - DNA, 191 bp, Artificial Sequence
  Synthetic polynucleotide
atcatctcaccttgcctcctggcacacaattctgcacacctgcaggcaaagctaattagtttaagacaaagctaattagtttatcgcaaagctaattagtttagaccaaagctaattagtttactacaaagctaattagtttaactcaaagctaattagtttatgcggcgcgccatgcttcatcagactct

SEQ ID NO: 1843 - DNA, 191 bp, Artificial Sequence; identical to SEQ ID NO: 1842
  Synthetic polynucleotide

SEQ ID NO: 1844 - DNA, 172 bp, Artificial Sequence
  Synthetic polynucleotide
atcatctcaccttgcctcctgatgtgggccgaaggacacctgcaggattaacataaagaattaacataatcgattaacataagacattaacataactaattaacataaactattaacataatgcattaacataagtaattaacataaggcgcgccatgcttcatcagactct

SEQ ID NO: 1845 - DNA, 172 bp, Artificial Sequence; identical to SEQ ID NO: 1844
  Synthetic polynucleotide

SEQ ID NO: 1846 - DNA, 156 bp, Artificial Sequence
  Synthetic polynucleotide
atcatctcaccttgcctcctgcttccttacggttcccgcctgcaggccataaatagaccataaattcgccataaatgacccataaatctaccataaatactccataaattgcccataaatgtaccataaatggcgcgccatgcttcatcagactct

SEQ ID NO: 1847 - DNA, 156 bp, Artificial Sequence; identical to SEQ ID NO: 1846
  Synthetic polynucleotide

SEQ ID NO: 1848 - DNA, 156 bp, Artificial Sequence
  Synthetic polynucleotide
atcatctcaccttgcctcctgtagttgaggaaccgactcctgcaggctaatcccagactaatccctcgctaatcccgacctaatcccctactaatcccactctaatccctgcctaatcccgtactaatcccggcgcgccatgcttcatcagactct

SEQ ID NO: 1849 - DNA, 156 bp, Artificial Sequence; identical to SEQ ID NO: 1848
  Synthetic polynucleotide

SEQ ID NO: 1850 - DNA, 196 bp, Artificial Sequence
  Synthetic polynucleotide
atcatctcaccttgcctcctggcggtctagttcgaatccctgcaggtccggtgctaaaaatagcacctagatccggtgctaaaaatagcaccttcgtccggtgctaaaaatagcacctgactccggtgctaaaaatagcacctctatccggtgctaaaaatagcacctactggcgcgccatgcttcatcagactct

SEQ ID NO: 1851 - DNA, 196 bp, Artificial Sequence; identical to SEQ ID NO: 1850
  Synthetic polynucleotide

SEQ ID NO: 1852 - DNA, 164 bp, Artificial Sequence
  Synthetic polynucleotide
atcatctcaccttgcctcctgtgcaccactacggtattcctgcaggccgtaattgagaccgtaattgtcgccgtaattggacccgtaattgctaccgtaattgactccgtaattgtgcccgtaattggtaccgtaattgggcgcgccatgcttcatcagactct

SEQ ID NO: 1853 - DNA, 164 bp, Artificial Sequence; identical to SEQ ID NO: 1852
  Synthetic polynucleotide

SEQ ID NO: 1854 - DNA, 156 bp, Artificial Sequence
  Synthetic polynucleotide
atcatctcaccttgcctcctgtagttgacttgactaaccctgcagggcaattaaagagcaattaatcggcaattaagacgcaattaactagcaattaaactgcaattaatgcgcaattaagtagcaattaaggcgcgccatgcttcatcagactct

SEQ ID NO: 1855 - DNA, 156 bp, Artificial Sequence; identical to SEQ ID NO: 1854
  Synthetic polynucleotide

SEQ ID NO: 1856 - DNA, 164 bp, Artificial Sequence
  Synthetic polynucleotide
atcatctcaccttgcctcctgggtgttcctcatggtctcctgcaggaggcaggaaagaaggcaggaatcgaggcaggaagacaggcaggaactaaggcaggaaactaggcaggaatgcaggcaggaagtaaggcaggaaggcgcgccatgcttcatcagactct

SEQ ID NO: 1857 - DNA, 164 bp, Artificial Sequence; identical to SEQ ID NO: 1856
  Synthetic polynucleotide

SEQ ID NO: 1858 - DNA, 148 bp, Artificial Sequence
  Synthetic polynucleotide
atcatctcaccttgcctcctgagcactgttcccagtgacctgcaggtttatacagatttatactcgtttatacgactttatacctatttatacacttttatactgctttatacgtatttatacggcgcgccatgcttcatcagactct

SEQ ID NO: 1859 - DNA, 148 bp, Artificial Sequence; identical to SEQ ID NO: 1858
  Synthetic polynucleotide

SEQ ID NO: 1860 - DNA, 172 bp, Artificial Sequence
  Synthetic polynucleotide
atcatctcaccttgcctcctgtgcgactcgtaggcttacctgcagggaccccccggagagaccccccggtcggaccccccgggacgaccccccggctagaccccccggactgaccccccggtgcgaccccccgggtagaccccccggggcgcgccatgcttcatcagactct

SEQ ID NO: 1861 - DNA, 172 bp, Artificial Sequence; identical to SEQ ID NO: 1860
  Synthetic polynucleotide

SEQ ID NO: 1862 - DNA, 156 bp, Artificial Sequence
  Synthetic polynucleotide
atcatctcaccttgcctcctgctaagttgaggcctgggcctgcaggccggaaatagaccggaaattcgccggaaatgacccggaaatctaccggaaatactccggaaattgcccggaaatgtaccggaaatggcgcgccatgcttcatcagactct

SEQ ID NO: 1863 - DNA, 156 bp, Artificial Sequence; identical to SEQ ID NO: 1862
  Synthetic polynucleotide

SEQ ID NO: 1864 - DNA, 164 bp, Artificial Sequence
  Synthetic polynucleotide
atcatctcaccttgcctcctggcgtgatctggataccacctgcaggattgcgaaaagaattgcgaaatcgattgcgaaagacattgcgaaactaattgcgaaaactattgcgaaatgcattgcgaaagtaattgcgaaaggcgcgccatgcttcatcagactct

SEQ ID NO: 1865 - DNA, 164 bp, Artificial Sequence; identical to SEQ ID NO: 1864
  Synthetic polynucleotide

SEQ ID NO: 1866 - DNA, 196 bp, Artificial Sequence
  Synthetic polynucleotide
atcatctcaccttgcctcctgctgagagtcgagtaaaccctgcaggtgatgacgtggcaagatgatgacgtggcatcgtgatgacgtggcagactgatgacgtggcactatgatgacgtggcaacttgatgacgtggcatgctgatgacgtggcagtatgatgacgtggcaggcgcgccatgcttcatcagactct

SEQ ID NO: 1867 - DNA, 196 bp, Artificial Sequence; identical to SEQ ID NO: 1866
  Synthetic polynucleotide

SEQ ID NO: 1868 - DNA, 156 bp, Artificial Sequence
  Synthetic polynucleotide
atcatctcaccttgcctcctgtgacccagagggtagtgcctgcaggctaatcctagactaatccttcgctaatcctgacctaatcctctactaatcctactctaatccttgcctaatcctgtactaatcctggcgcgccatgcttcatcagactct

SEQ ID NO: 1869 - DNA, 156 bp, Artificial Sequence; identical to SEQ ID NO: 1868
  Synthetic polynucleotide

SEQ ID NO: 1870 - DNA, 172 bp, Artificial Sequence
  Synthetic polynucleotide
atcatctcaccttgcctcctgatgggtagctgctggtccctgcaggcgcagctgtgagacgcagctgtgtcgcgcagctgtggaccgcagctgtgctacgcagctgtgactcgcagctgtgtgccgcagctgtggtacgcagctgtgggcgcgccatgcttcatcagactct

SEQ ID NO: 1871 - DNA, 172 bp, Artificial Sequence; identical to SEQ ID NO: 1870
  Synthetic polynucleotide

SEQ ID NO: 1872 - DNA, 164 bp, Artificial Sequence
  Synthetic polynucleotide
atcatctcaccttgcctcctgctaggactccagctagccctgcaggaacagctgaagaaacagctgatcgaacagctgagacaacagctgactaaacagctgaactaacagctgatgcaacagctgagtaaacagctgaggcgcgccatgcttcatcagactct

SEQ ID NO: 1873 - DNA, 164 bp, Artificial Sequence; identical to SEQ ID NO: 1872
  Synthetic polynucleotide

SEQ ID NO: 1874 - DNA, 190 bp, Artificial Sequence
  Synthetic polynucleotide
atcatctcaccttgcctcctggcctgggattcaaataccctgcagggcaccagggacagcagagcaccagggacagctcggcaccagggacagcgacgcaccagggacagcctagcaccagggacagcactgcaccagggacagctgcgcaccagggacagcgtaggcgcgccatgcttcatcagactct

SEQ ID NO: 1875 - DNA, 190 bp, Artificial Sequence; identical to SEQ ID NO: 1874
  Synthetic polynucleotide

SEQ ID NO: 1876 - DNA, 196 bp, Artificial Sequence
  Synthetic polynucleotide
atcatctcaccttgcctcctgactgcggtattatgtcccctgcaggtgttacgtaaataagatgttacgtaaatatcgtgttacgtaaatagactgttacgtaaatactatgttacgtaaataacttgttacgtaaatatgctgttacgtaaatagtatgttacgtaaataggcgcgccatgcttcatcagactct

SEQ ID NO: 1877 - DNA, 196 bp, Artificial Sequence; identical to SEQ ID NO: 1876
  Synthetic polynucleotide

SEQ ID NO: 1878 - DNA, 172 bp, Artificial Sequence
  Synthetic polynucleotide
atcatctcaccttgcctcctggtctaagtctgtcaccacctgcagggcgggcggggagagcgggcggggtcggcgggcgggggacgcgggcggggctagcgggcggggactgcgggcggggtgcgcgggcgggggtagcgggcggggggcgcgccatgcttcatcagactct

SEQ ID NO: 1879 - DNA, 172 bp, Artificial Sequence; identical to SEQ ID NO: 1878
  Synthetic polynucleotide

SEQ ID NO: 1880 - DNA, 148 bp, Artificial Sequence
  Synthetic polynucleotide
atcatctcaccttgcctcctgatcgatgattagcgcagcctgcaggaatgataagaaatgatatcgaatgatagacaatgatactaaatgataactaatgatatgcaatgatagtaaatgataggcgcgccatgcttcatcagactct

SEQ ID NO: 1881 - DNA, 148 bp, Artificial Sequence; identical to SEQ ID NO: 1880
  Synthetic polynucleotide

SEQ ID NO: 1882 - DNA, 185 bp, Artificial Sequence
  Synthetic polynucleotide
atcatctcaccttgcctcctggaggatggactgcaggtcctgcagggaattaattggttgttagagaattaattggttgtttcggaattaattggttgttgacgaattaattggttgttctagaattaattggttgttactgaattaattggttgtttgcggcgcgccatgcttcatcagactct

SEQ ID NO: 1883 - DNA, 185 bp, Artificial Sequence; identical to SEQ ID NO: 1882
  Synthetic polynucleotide

SEQ ID NO: 1884 - DNA, 148 bp, Artificial Sequence
  Synthetic polynucleotide
atcatctcaccttgcctcctgttagagcctagttgatgcctgcaggtttatatagatttatattcgtttatatgactttatatctatttatatacttttatattgctttatatgtatttatatggcgcgccatgcttcatcagactct

SEQ ID NO: 1885 - DNA, 148 bp, Artificial Sequence; identical to SEQ ID NO: 1884
  Synthetic polynucleotide

SEQ ID NO: 1886 - DNA, 185 bp, Artificial Sequence
  Synthetic polynucleotide
atcatctcaccttgcctcctgggagtagtcattccagccctgcaggagataagataagataaagaagataagataagataatcgagataagataagataagacagataagataagataactaagataagataagataaactagataagataagataatgcggcgcgccatgcttcatcagactct

SEQ ID NO: 1887 - DNA, 185 bp, Artificial Sequence; identical to SEQ ID NO: 1886
  Synthetic polynucleotide

SEQ ID NO: 1888 - DNA, 188 bp, Artificial Sequence
  Synthetic polynucleotide
atcatctcaccttgcctcctgacgtgtcttgacgaatccctgcaggtgggcgggaaggagatgggcgggaaggtcgtgggcgggaagggactgggcgggaaggctatgggcgggaaggacttgggcgggaaggtgctgggcgggaagggtatgggcgggaaggggcgcgccatgcttcatcagactct

SEQ ID NO: 1889 - DNA, 188 bp, Artificial Sequence; identical to SEQ ID NO: 1888
  Synthetic polynucleotide

SEQ ID NO: 1890 - DNA, 190 bp, Artificial Sequence
  Synthetic polynucleotide
atcatctcaccttgcctcctgaattctttggacctccccctgcaggccacttccgggttcagaccacttccgggttctcgccacttccgggttcgacccacttccgggttcctaccacttccgggttcactccacttccgggttctgcccacttccgggttcgtaggcgcgccatgcttcatcagactct

SEQ ID NO: 1891 - DNA, 190 bp, Artificial Sequence; identical to SEQ ID NO: 1890
  Synthetic polynucleotide

SEQ ID NO: 1892 - DNA, 190 bp, Artificial Sequence
  Synthetic polynucleotide
atcatctcaccttgcctcctgggtcactgttatctttccctgcaggggcgggggcgggggagaggcgggggcgggggtcgggcgggggcggggggacggcgggggcgggggctaggcgggggcgggggactggcgggggcgggggtgcggcgggggcggggggtaggcgcgccatgcttcatcagactct

SEQ ID NO: 1893 - DNA, 190 bp, Artificial Sequence; identical to SEQ ID NO: 1892
  Synthetic polynucleotide

SEQ ID NO: 1894 - DNA, 191 bp, Artificial Sequence
  Synthetic polynucleotide
atcatctcaccttgcctcctggcctaagccgctaccatcctgcaggttaattacggtaattacagattaattacggtaattactcgttaattacggtaattacgacttaattacggtaattacctattaattacggtaattacactttaattacggtaattactgcggcgcgccatgcttcatcagactct

SEQ ID NO: 1895 - DNA, 191 bp, Artificial Sequence; identical to SEQ ID NO: 1894
  Synthetic polynucleotide

SEQ ID NO: 1896 - DNA, 197 bp, Artificial Sequence
  Synthetic polynucleotide
atcatctcaccttgcctcctgagatagcacggactgatcctgcaggaatttgatacattttagaaatttgatacatttttcgaatttgatacattttgacaatttgatacattttctaaatttgatacattttactaatttgatacatttttgcaatttgatacattttgtaggcgcgccatgcttcatcagactct

SEQ ID NO: 1897 - DNA, 197 bp, Artificial Sequence; identical to SEQ ID NO: 1896
  Synthetic polynucleotide

SEQ ID NO: 1898 - DNA, 191 bp, Artificial Sequence
  Synthetic polynucleotide
atcatctcaccttgcctcctgaagcatatggatcaggacctgcaggagcagtgggtcccccagagaagcagtgggtcccccagtcgagcagtgggtcccccaggacagcagtgggtcccccagctaagcagtgggtcccccagactagcagtgggtcccccagtgcggcgcgccatgcttcatcagactct

SEQ ID NO: 1899 - DNA, 191 bp, Artificial Sequence; identical to SEQ ID NO: 1898
  Synthetic polynucleotide

SEQ ID NO: 1900 - DNA, 191 bp, Artificial Sequence
  Synthetic polynucleotide
atcatctcaccttgcctcctgatcccggattctctcatcctgcagggactagatatatatattcgatagagactagatatatatattcgattcggactagatatatatattcgatgacgactagatatatatattcgatctagactagatatatatattcgatactggcgcgccatgcttcatcagactct

SEQ ID NO: 1901 - DNA, 191 bp, Artificial Sequence; identical to SEQ ID NO: 1900
  Synthetic polynucleotide

SEQ ID NO: 1902 - DNA, 197 bp, Artificial Sequence
  Synthetic polynucleotide
atcatctcaccttgcctcctgcctacagggaatacgtccctgcaggacgatgagtcatgctagaacgatgagtcatgcttcgacgatgagtcatgctgacacgatgagtcatgctctaacgatgagtcatgctactacgatgagtcatgcttgcacgatgagtcatgctgtaggcgcgccatgcttcatcagactct

SEQ ID NO: 1903 - DNA, 197 bp, Artificial Sequence; identical to SEQ ID NO: 1902
  Synthetic polynucleotide

SEQ ID NO: 1904 - DNA, 164 bp, Artificial Sequence
  Synthetic polynucleotide
atcatctcaccttgcctcctggaatgctgcgcgcttctcctgcaggccacgcccaagaccacgcccatcgccacgcccagacccacgcccactaccacgcccaactccacgcccatgcccacgcccagtaccacgcccaggcgcgccatgcttcatcagactct

SEQ ID NO: 1905 - DNA, 164 bp, Artificial Sequence; identical to SEQ ID NO: 1904
  Synthetic polynucleotide

SEQ ID NO: 1906 - DNA, 197 bp, Artificial Sequence
  Synthetic polynucleotide
atcatctcaccttgcctcctggttcgttgtcactgaaccctgcaggaataagggcgtggtcagaaataagggcgtggtctcgaataagggcgtggtcgacaataagggcgtggtcctaaataagggcgtggtcactaataagggcgtggtctgcaataagggcgtggtcgtaggcgcgccatgcttcatcagactct

SEQ ID NO: 1907 - DNA, 197 bp, Artificial Sequence; identical to SEQ ID NO: 1906
  Synthetic polynucleotide

SEQ ID NO: 1908 - DNA, 180 bp, Artificial Sequence
  Synthetic polynucleotide
atcatctcaccttgcctcctggagaactgcaactacatcctgcaggttcacacctagagattcacacctagtcgttcacacctaggacttcacacctagctattcacacctagactttcacacctagtgcttcacacctaggtattcacacctagggcgcgccatgcttcatcagactct

SEQ ID NO: 1909 - DNA, 180 bp, Artificial Sequence; identical to SEQ ID NO: 1908
  Synthetic polynucleotide

SEQ ID NO: 1910 - DNA, 185 bp, Artificial Sequence
  Synthetic polynucleotide
atcatctcaccttgcctcctgagttgtggcgctacactcctgcaggattaggtaattaccttagaattaggtaattacctttcgattaggtaattaccttgacattaggtaattaccttctaattaggtaattaccttactattaggtaattacctttgcggcgcgccatgcttcatcagactct

SEQ ID NO: 1911 - DNA, 185 bp, Artificial Sequence; identical to SEQ ID NO: 1910
  Synthetic polynucleotide

SEQ ID NO: 1912 - DNA, 197 bp, Artificial Sequence
  Synthetic polynucleotide
atcatctcaccttgcctcctggtttaggaaagaaccctcctgcagggtggtcccggattatagagtggtcccggattattcggtggtcccggattatgacgtggtcccggattatctagtggtcccggattatactgtggtcccggattattgcgtggtcccggattatgtaggcgcgccatgcttcatcagactct

SEQ ID NO: 1913 - DNA, 197 bp, Artificial Sequence; identical to SEQ ID NO: 1912
  Synthetic polynucleotide

SEQ ID NO: 1914 - DNA, 172 bp, Artificial Sequence
  Synthetic polynucleotide
atcatctcaccttgcctcctgtaccgcgctattgccttcctgcaggttttattaccagattttattacctcgttttattaccgacttttattaccctattttattaccactttttattacctgcttttattaccgtattttattaccggcgcgccatgcttcatcagactct

SEQ ID NO: 1915 - DNA, 172 bp, Artificial Sequence; identical to SEQ ID NO: 1914
  Synthetic polynucleotide

SEQ ID NO: 1916 - DNA, 172 bp, Artificial Sequence
  Synthetic polynucleotide
atcatctcaccttgcctcctggagataacaccggcccacctgcaggaaatcacagcagaaaatcacagctcgaaatcacagcgacaaatcacagcctaaaatcacagcactaaatcacagctgcaaatcacagcgtaaaatcacagcggcgcgccatgcttcatcagactct

SEQ ID NO: 1917 - DNA, 172 bp, Artificial Sequence; identical to SEQ ID NO: 1916
  Synthetic polynucleotide

SEQ ID NO: 1918 - DNA, 164 bp, Artificial Sequence
  Synthetic polynucleotide
atcatctcaccttgcctcctgacatacctgttcttcagcctgcaggatgatacccagaatgataccctcgatgatacccgacatgatacccctaatgatacccactatgataccctgcatgatacccgtaatgatacccggcgcgccatgcttcatcagactct

SEQ ID NO: 1919 - DNA, 164 bp, Artificial Sequence; identical to SEQ ID NO: 1918
  Synthetic polynucleotide

SEQ ID NO: 1920 - DNA, 197 bp, Artificial Sequence
  Synthetic polynucleotide
atcatctcaccttgcctcctgacctctttgagttccttcctgcaggaggtcacggtgacctgggagaaggtcacggtgacctgggtcgaggtcacggtgacctggggacaggtcacggtgacctgggctaaggtcacggtgacctgggactaggtcacggtgacctgggtgcggcgcgccatgcttcatcagactct

SEQ ID NO: 1921 - DNA, 197 bp, Artificial Sequence; identical to SEQ ID NO: 1920
  Synthetic polynucleotide

SEQ ID NO: 1922 - DNA, 196 bp, Artificial Sequence
  Synthetic polynucleotide
atcatctcaccttgcctcctggagggatggctaatacccctgcaggaattaatcgaaatcaaattaaaagaaattaatcgaaatcaaattaaatcgaattaatcgaaatcaaattaaagacaattaatcgaaatcaaattaaactaaattaatcgaaatcaaattaaaactggcgcgccatgcttcatcagactct

SEQ ID NO: 1923 - DNA, 196 bp, Artificial Sequence; identical to SEQ ID NO: 1922
  Synthetic polynucleotide

SEQ ID NO: 1924 - DNA, 156 bp, Artificial Sequence
  Synthetic polynucleotide
atcatctcaccttgcctcctgggaatgcgaaggatgctcctgcagggcaattatagagcaattattcggcaattatgacgcaattatctagcaattatactgcaattattgcgcaattatgtagcaattatggcgcgccatgcttcatcagactct

SEQ ID NO: 1925 - DNA, 156 bp, Artificial Sequence; identical to SEQ ID NO: 1924
  Synthetic polynucleotide

SEQ ID NO: 1926 - DNA, 197 bp, Artificial Sequence
  Synthetic polynucleotide
atcatctcaccttgcctcctgtgccgactacttagcgacctgcaggtgatgactcattcttagatgatgactcattctttcgtgatgactcattcttgactgatgactcattcttctatgatgactcattcttacttgatgactcattctttgctgatgactcattcttgtaggcgcgccatgcttcatcagactct

SEQ ID NO: 1927 - DNA, 197 bp, Artificial Sequence; identical to SEQ ID NO: 1926
  Synthetic polynucleotide

SEQ ID NO: 1928 - DNA, 198 bp, Artificial Sequence
  Synthetic polynucleotide
atcatctcaccttgcctcctgtcgtcgcatagctagagcctgcaggtttcacacctcagaggtgtgagaagatttcacacctcagaggtgtgagatcgtttcacacctcagaggtgtgagagactttcacacctcagaggtgtgagactatttcacacctcagaggtgtgagaggcgcgccatgcttcatcagactct

SEQ ID NO: 1929 - DNA, 198 bp, Artificial Sequence; identical to SEQ ID NO: 1928
  Synthetic polynucleotide

SEQ ID NO: 1930 - DNA, 156 bp, Artificial Sequence
  Synthetic polynucleotide
atcatctcaccttgcctcctgggataccaccattatgtcctgcagggcaattagagagcaattagtcggcaattaggacgcaattagctagcaattagactgcaattagtgcgcaattaggtagcaattagggcgcgccatgcttcatcagactct

SEQ ID NO: 1931 - DNA, 156 bp, Artificial Sequence; identical to SEQ ID NO: 1930
  Synthetic polynucleotide

SEQ ID NO: 1932 - DNA, 197 bp, Artificial Sequence
  Synthetic polynucleotide
atcatctcaccttgcctcctggggaattacacccactacctgcaggtatatgcatattcatagatatatgcatattcattcgtatatgcatattcatgactatatgcatattcatctatatatgcatattcatacttatatgcatattcattgctatatgcatattcatgtaggcgcgccatgcttcatcagactct

SEQ ID NO: 1933 - DNA, 197 bp, Artificial Sequence; identical to SEQ ID NO: 1932
  Synthetic polynucleotide

SEQ ID NO: 1934 - DNA, 172 bp, Artificial Sequence
  Synthetic polynucleotide
atcatctcaccttgcctcctgattccgtggataacggacctgcaggcgcgagagttagacgcgagagtttcgcgcgagagttgaccgcgagagttctacgcgagagttactcgcgagagtttgccgcgagagttgtacgcgagagttggcgcgccatgcttcatcagactct

SEQ ID NO: 1935 - DNA, 172 bp, Artificial Sequence; identical to SEQ ID NO: 1934
  Synthetic polynucleotide

SEQ ID NO: 1936 - DNA, 196 bp, Artificial Sequence
  Synthetic polynucleotide
atcatctcaccttgcctcctgtagccgaggtacctaggcctgcaggaggccaaaggtcaagaaggccaaaggtcatcgaggccaaaggtcagacaggccaaaggtcactaaggccaaaggtcaactaggccaaaggtcatgcaggccaaaggtcagtaaggccaaaggtcaggcgcgccatgcttcatcagactct

SEQ ID NO: 1937 - DNA, 196 bp, Artificial Sequence; identical to SEQ ID NO: 1936
  Synthetic polynucleotide

SEQ ID NO: 1938 - DNA, 185 bp, Artificial Sequence
  Synthetic polynucleotide
atcatctcaccttgcctcctgctgagttccagccgtaccctgcaggtgattaattaattgacagatgattaattaattgactcgtgattaattaattgacgactgattaattaattgacctatgattaattaattgacacttgattaattaattgactgcggcgcgccatgcttcatcagactct

SEQ ID NO: 1939 - DNA, 185 bp, Artificial Sequence; identical to SEQ ID NO: 1938
  Synthetic polynucleotide

SEQ ID NO: 1940 - DNA, 197 bp, Artificial Sequence
  Synthetic polynucleotide
atcatctcaccttgcctcctgggctttactctagaatccctgcagggctgagtcagcaattagagctgagtcagcaatttcggctgagtcagcaattgacgctgagtcagcaattctagctgagtcagcaattactgctgagtcagcaatttgcgctgagtcagcaattgtaggcgcgccatgcttcatcagactct

SEQ ID NO: 1941 - DNA, 197 bp, Artificial Sequence; identical to SEQ ID NO: 1940
  Synthetic polynucleotide

SEQ ID NO: 1942 - DNA, 172 bp, Artificial Sequence
  Synthetic polynucleotide
atcatctcaccttgcctcctgccctcgagtggacaattcctgcaggggcacgcgccagaggcacgcgcctcgggcacgcgccgacggcacgcgccctaggcacgcgccactggcacgcgcctgcggcacgcgccgtaggcacgcgccggcgcgccatgcttcatcagactct

SEQ ID NO: 1943 - DNA, 172 bp, Artificial Sequence; identical to SEQ ID NO: 1942
  Synthetic polynucleotide

SEQ ID NO: 1944 - DNA, 186 bp, Artificial Sequence
  Synthetic polynucleotide
atcatctcaccttgcctcctgggcacatagtggcgaagcctgcagggggcatgtctgggcatgtctagagggcatgtctgggcatgtcttcggggcatgtctgggcatgtctgacgggcatgtctgggcatgtctctagggcatgtctgggcatgtctactggcgcgccatgcttcatcagactct

SEQ ID NO: 1945 - DNA, 186 bp, Artificial Sequence; identical to SEQ ID NO: 1944
  Synthetic polynucleotide

SEQ ID NO: 1946 - DNA, 164 bp, Artificial Sequence
  Synthetic polynucleotide
atcatctcaccttgcctcctgggtagttctaagcaggccctgcagggccgttagaagagccgttagatcggccgttagagacgccgttagactagccgttagaactgccgttagatgcgccgttagagtagccgttagaggcgcgccatgcttcatcagactct

SEQ ID NO: 1947 - DNA, 164 bp, Artificial Sequence; identical to SEQ ID NO: 1946
  Synthetic polynucleotide

SEQ ID NO: 1948 - DNA, 164 bp, Artificial Sequence
  Synthetic polynucleotide
atcatctcaccttgcctcctgctgaagctgggaggttgcctgcaggttaagtggtagattaagtggttcgttaagtggtgacttaagtggtctattaagtggtactttaagtggttgcttaagtggtgtattaagtggtggcgcgccatgcttcatcagactct

SEQ ID NO: 1949 - DNA, 164 bp, Artificial Sequence; identical to SEQ ID NO: 1948
  Synthetic polynucleotide

SEQ ID NO: 1950 - DNA, 185 bp, Artificial Sequence
  Synthetic polynucleotide
atcatctcaccttgcctcctgttagactaggatagtggcctgcagggctcattacgaatgacagagctcattacgaatgactcggctcattacgaatgacgacgctcattacgaatgacctagctcattacgaatgacactgctcattacgaatgactgcggcgcgccatgcttcatcagactct

SEQ ID NO: 1951 - DNA, 185 bp, Artificial Sequence; identical to SEQ ID NO: 1950
  Synthetic polynucleotide

SEQ ID NO: 1952 - DNA, 186 bp, Artificial Sequence
  Synthetic polynucleotide
atcatctcaccttgcctcctgactaaactcgcattatgcctgcaggcaggtgatttccgggaaatgagacaggtgatttccgggaaatgtcgcaggtgatttccgggaaatggaccaggtgatttccgggaaatgctacaggtgatttccgggaaatgactggcgcgccatgcttcatcagactct

SEQ ID NO: 1953 - DNA, 186 bp, Artificial Sequence; identical to SEQ ID NO: 1952
  Synthetic polynucleotide

SEQ ID NO: 1954 - DNA, 180 bp, Artificial Sequence
  Synthetic polynucleotide
atcatctcaccttgcctcctgtggtgtctgtcgacaaccctgcaggtagccagacagagatagccagacagtcgtagccagacaggactagccagacagctatagccagacagacttagccagacagtgctagccagacaggtatagccagacagggcgcgccatgcttcatcagactct

SEQ ID NO: 1955 - DNA, 180 bp, Artificial Sequence; identical to SEQ ID NO: 1954
  Synthetic polynucleotide

SEQ ID NO: 1956 - DNA, 172 bp, Artificial Sequence
  Synthetic polynucleotide
atcatctcaccttgcctcctggatccaataggtctcaccctgcaggttgtttacgaagattgtttacgatcgttgtttacgagacttgtttacgactattgtttacgaactttgtttacgatgcttgtttacgagtattgtttacgaggcgcgccatgcttcatcagactct

SEQ ID NO: 1957 - DNA, 172 bp, Artificial Sequence; identical to SEQ ID NO: 1956
  Synthetic polynucleotide

SEQ ID NO: 1958 - DNA, 196 bp, Artificial Sequence
  Synthetic polynucleotide
atcatctcaccttgcctcctgacctgactaaataagaccctgcaggtctatttatagaaagatctatttatagaatcgtctatttatagaagactctatttatagaactatctatttatagaaacttctatttatagaatgctctatttatagaagtatctatttatagaaggcgcgccatgcttcatcagactct

SEQ ID NO: 1959 - DNA, 196 bp, Artificial Sequence; identical to SEQ ID NO: 1958
  Synthetic polynucleotide

SEQ ID NO: 1960 - DNA, 190 bp, Artificial Sequence
  Synthetic polynucleotide
atcatctcaccttgcctcctgcatgcacctcgtttatgcctgcaggtaattaagcaattaagataattaagcaattatcgtaattaagcaattagactaattaagcaattactataattaagcaattaacttaattaagcaattatgctaattaagcaattagtaggcgcgccatgcttcatcagactct

SEQ ID NO: 1961 - DNA, 190 bp, Artificial Sequence; identical to SEQ ID NO: 1960
  Synthetic polynucleotide

SEQ ID NO: 1962 - DNA, 156 bp, Artificial Sequence
  Synthetic polynucleotide
atcatctcaccttgcctcctgaccgagaaaggtatatccctgcaggctaattgcagactaattgctcgctaattgcgacctaattgcctactaattgcactctaattgctgcctaattgcgtactaattgcggcgcgccatgcttcatcagactct

SEQ ID NO: 1963 - DNA, 156 bp, Artificial Sequence; identical to SEQ ID NO: 1962
  Synthetic polynucleotide

SEQ ID NO: 1964 - DNA, 190 bp, Artificial Sequence
  Synthetic polynucleotide
atcatctcaccttgcctcctggctctcgtacaaagctacctgcaggatgttgtttacgttagaatgttgtttacgtttcgatgttgtttacgttgacatgttgtttacgttctaatgttgtttacgttactatgttgtttacgtttgcatgttgtttacgttgtaggcgcgccatgcttcatcagactct

SEQ ID NO: 1965 - DNA, 190 bp, Artificial Sequence; identical to SEQ ID NO: 1964
  Synthetic polynucleotide

SEQ ID NO: 1966 - DNA, 197 bp, Artificial Sequence
  Synthetic polynucleotide
atcatctcaccttgcctcctgtttctatcctcggataccctgcaggtgattaattgtttatagatgattaattgtttattcgtgattaattgtttatgactgattaattgtttatctatgattaattgtttatacttgattaattgtttattgctgattaattgtttatgtaggcgcgccatgcttcatcagactct

SEQ ID NO: 1967 - DNA, 197 bp, Artificial Sequence; identical to SEQ ID NO: 1966
  Synthetic polynucleotide

SEQ ID NO: 1968 - DNA, 148 bp, Artificial Sequence
  Synthetic polynucleotide
atcatctcaccttgcctcctgcttcgaattagcccgtacctgcaggagtcattagaagtcatttcgagtcattgacagtcattctaagtcattactagtcatttgcagtcattgtaagtcattggcgcgccatgcttcatcagactct

SEQ ID NO: 1969 - DNA, 148 bp, Artificial Sequence; identical to SEQ ID NO: 1968
  Synthetic polynucleotide

SEQ ID NO: 1970 - DNA, 185 bp, Artificial Sequence
  Synthetic polynucleotide
atcatctcaccttgcctcctgagtccctccacttcacccctgcagggagtccaaagtccatcagagagtccaaagtccatctcggagtccaaagtccatcgacgagtccaaagtccatcctagagtccaaagtccatcactgagtccaaagtccatctgcggcgcgccatgcttcatcagactct

SEQ ID NO: 1971 - DNA, 185 bp, Artificial Sequence; identical to SEQ ID NO: 1970
  Synthetic polynucleotide

SEQ ID NO: 1972 - DNA, 156 bp, Artificial Sequence
  Synthetic polynucleotide
atcatctcaccttgcctcctgactaccgagtccagtatcctgcaggctaattggagactaattggtcgctaattgggacctaattggctactaattggactctaattggtgcctaattgggtactaattggggcgcgccatgcttcatcagactct

SEQ ID NO: 1973 - DNA, 156 bp, Artificial Sequence; identical to SEQ ID NO: 1972
  Synthetic polynucleotide

SEQ ID NO: 1974 - DNA, 164 bp, Artificial Sequence
  Synthetic polynucleotide
atcatctcaccttgcctcctgacacgccgtcataatcgcctgcaggatgccaaccagaatgccaacctcgatgccaaccgacatgccaaccctaatgccaaccactatgccaacctgcatgccaaccgtaatgccaaccggcgcgccatgcttcatcagactct

SEQ ID NO: 1975 - DNA, 164 bp, Artificial Sequence; identical to SEQ ID NO: 1974
  Synthetic polynucleotide

SEQ ID NO: 1976 - DNA, 188 bp, Artificial Sequence
  Synthetic polynucleotide
atcatctcaccttgcctcctggtaagtttgtggtctggcctgcaggaaaaccggttttagaaaaaccggtttttcgaaaaccggttttgacaaaaccggttttctaaaaaccggttttactaaaaccggtttttgcaaaaccggttttgtaaaaaccggttttggcgcgccatgcttcatcagactct

SEQ ID NO: 1977 - DNA, 188 bp, Artificial Sequence; identical to SEQ ID NO: 1976
  Synthetic polynucleotide

SEQ ID NO: 1978 - DNA, 191 bp, Artificial Sequence
  Synthetic polynucleotide
atcatctcaccttgcctcctggagtgtttacgctatcacctgcaggtgacctctccgtgacctagatgacctctccgtgaccttcgtgacctctccgtgacctgactgacctctccgtgacctctatgacctctccgtgacctacttgacctctccgtgaccttgcggcgcgccatgcttcatcagactct

SEQ ID NO: 1979 - DNA, 191 bp, Artificial Sequence; identical to SEQ ID NO: 1978
  Synthetic polynucleotide

SEQ ID NO: 1980 - DNA, 164 bp, Artificial Sequence
  Synthetic polynucleotide
atcatctcaccttgcctcctggtgccgttaaactggcgcctgcaggttgtgcaatagattgtgcaattcgttgtgcaatgacttgtgcaatctattgtgcaatactttgtgcaattgcttgtgcaatgtattgtgcaatggcgcgccatgcttcatcagactct

SEQ ID NO: 1981 - DNA, 164 bp, Artificial Sequence; identical to SEQ ID NO: 1980
  Synthetic polynucleotide

SEQ ID NO: 1982 - DNA, 180 bp, Artificial Sequence
  Synthetic polynucleotide
atcatctcaccttgcctcctgattggccctctcatgctcctgcaggataaattatgcagaataaattatgctcgataaattatgcgacataaattatgcctaataaattatgcactataaattatgctgcataaattatgcgtaataaattatgcggcgcgccatgcttcatcagactct

SEQ ID NO: 1983 - DNA, 180 bp, Artificial Sequence; identical to SEQ ID NO: 1982
  Synthetic polynucleotide

SEQ ID NO: 1984 - DNA, 197 bp, Artificial Sequence
  Synthetic polynucleotide
atcatctcaccttgcctcctgagaacgtatcagctttgcctgcaggaggtcagggtgacctagaaggtcagggtgaccttcgaggtcagggtgacctgacaggtcagggtgacctctaaggtcagggtgacctactaggtcagggtgaccttgcaggtcagggtgacctgtaggcgcgccatgcttcatcagactct

SEQ ID NO: 1985 - DNA, 197 bp, Artificial Sequence; identical to SEQ ID NO: 1984
  Synthetic polynucleotide

SEQ ID NO: 1986 - DNA, 191 bp, Artificial Sequence
  Synthetic polynucleotide
atcatctcaccttgcctcctgtgtcctgctaatgttctcctgcagggtcggtaattatagcgaagagtcggtaattatagcgatcggtcggtaattatagcgagacgtcggtaattatagcgactagtcggtaattatagcgaactgtcggtaattatagcgatgcggcgcgccatgcttcatcagactct

SEQ ID NO: 1987 - DNA, 191 bp, Artificial Sequence; identical to SEQ ID NO: 1986
  Synthetic polynucleotide

SEQ ID NO: 1988 - DNA, 185 bp, Artificial Sequence
  Synthetic polynucleotide
atcatctcaccttgcctcctggtaccttgctataaggtcctgcaggtaggtaataaaattcaagataggtaataaaattcatcgtaggtaataaaattcagactaggtaataaaattcactataggtaataaaattcaacttaggtaataaaattcatgcggcgcgccatgcttcatcagactct

SEQ ID NO: 1989 - DNA, 185 bp, Artificial Sequence; identical to SEQ ID NO: 1988
  Synthetic polynucleotide

SEQ ID NO: 1990 - DNA, 191 bp, Artificial Sequence
  Synthetic polynucleotide
atcatctcaccttgcctcctgcccagaatccttcttaccctgcagggtagttaatccccttaaagagtagttaatccccttaatcggtagttaatccccttaagacgtagttaatccccttaactagtagttaatccccttaaactgtagttaatccccttaatgcggcgcgccatgcttcatcagactct

SEQ ID NO: 1991 - DNA, 191 bp, Artificial Sequence; identical to SEQ ID NO: 1990
  Synthetic polynucleotide

SEQ ID NO: 1992 - DNA, 180 bp, Artificial Sequence
  Synthetic polynucleotide
atcatctcaccttgcctcctgtgacccacctgtgatcacctgcaggattaataattaagaattaataattatcgattaataattagacattaataattactaattaataattaactattaataattatgcattaataattagtaattaataattaggcgcgccatgcttcatcagactct

SEQ ID NO: 1993 - DNA, 180 bp, Artificial Sequence; identical to SEQ ID NO: 1992
  Synthetic polynucleotide

SEQ ID NO: 1994 - DNA, 156 bp, Artificial Sequence
  Synthetic polynucleotide
atcatctcaccttgcctcctgttcacaatcacaagatccctgcaggtcaattaaagatcaattaatcgtcaattaagactcaattaactatcaattaaacttcaattaatgctcaattaagtatcaattaaggcgcgccatgcttcatcagactct

SEQ ID NO: 1995 - DNA, 156 bp, Artificial Sequence; identical to SEQ ID NO: 1994
  Synthetic polynucleotide

SEQ ID NO: 1996 - DNA, 191 bp, Artificial Sequence
  Synthetic polynucleotide
atcatctcaccttgcctcctggtgtattatgagagccgcctgcaggaaaagtgataccccattagaaaaagtgataccccatttcgaaaagtgataccccattgacaaaagtgataccccattctaaaaagtgataccccattactaaaagtgataccccatttgcggcgcgccatgcttcatcagactct

SEQ ID NO: 1997 - DNA, 191 bp, Artificial Sequence; identical to SEQ ID NO: 1996
  Synthetic polynucleotide

SEQ ID NO: 1998 - DNA, 190 bp, Artificial Sequence
  Synthetic polynucleotide
atcatctcaccttgcctcctggtgattgtttgctgcgacctgcaggccgccccctgctggagaccgccccctgctggtcgccgccccctgctgggacccgccccctgctggctaccgccccctgctggactccgccccctgctggtgcccgccccctgctgggtaggcgcgccatgcttcatcagactct

SEQ ID NO: 1999 - DNA, 190 bp, Artificial Sequence; identical to SEQ ID NO: 1998
  Synthetic polynucleotide

SEQ ID NO: 2000 - DNA, 180 bp, Artificial Sequence
  Synthetic polynucleotide
atcatctcaccttgcctcctgcgagaaacagacccagtcctgcaggttagctaattaagattagctaattatcgttagctaattagacttagctaattactattagctaattaactttagctaattatgcttagctaattagtattagctaattaggcgcgccatgcttcatcagactct

SEQ ID NO: 2001 - DNA, 180 bp, Artificial Sequence; identical to SEQ ID NO: 2000
  Synthetic polynucleotide

SEQ ID NO: 2002 - DNA, 172 bp, Artificial Sequence
  Synthetic polynucleotide
atcatctcaccttgcctcctggttacccgtacggacgtcctgcaggagccaaaattagaagccaaaatttcgagccaaaattgacagccaaaattctaagccaaaattactagccaaaatttgcagccaaaattgtaagccaaaattggcgcgccatgcttcatcagactct

SEQ ID NO: 2003 - DNA, 172 bp, Artificial Sequence; identical to SEQ ID NO: 2002
  Synthetic polynucleotide

SEQ ID NO: 2004 - DNA, 197 bp, Artificial Sequence
  Synthetic polynucleotide
atcatctcaccttgcctcctgtagtcgcgtatctaactcctgcaggctctgtttactttgcagactctgtttactttgctcgctctgtttactttgcgacctctgtttactttgcctactctgtttactttgcactctctgtttactttgctgcctctgtttactttgcgtaggcgcgccatgcttcatcagactct

SEQ ID NO: 2005 - DNA, 197 bp, Artificial Sequence; identical to SEQ ID NO: 2004
  Synthetic polynucleotide

SEQ ID NO: 2006 - DNA, 185 bp, Artificial Sequence
  Synthetic polynucleotide
atcatctcaccttgcctcctgccacgtccaccgatactcctgcaggctctaaaaataactctagactctaaaaataactcttcgctctaaaaataactctgacctctaaaaataactctctactctaaaaataactctactctctaaaaataactcttgcggcgcgccatgcttcatcagactct

SEQ ID NO: 2007 - DNA, 185 bp, Artificial Sequence; identical to SEQ ID NO: 2006
  Synthetic polynucleotide

SEQ ID NO: 2008 - DNA, 156 bp, Artificial Sequence
  Synthetic polynucleotide
atcatctcaccttgcctcctgattaaacgtcctcaatgcctgcaggttgatctcagattgatctctcgttgatctcgacttgatctcctattgatctcactttgatctctgcttgatctcgtattgatctcggcgcgccatgcttcatcagactct

SEQ ID NO: 2009 - DNA, 156 bp, Artificial Sequence; identical to SEQ ID NO: 2008
  Synthetic polynucleotide

SEQ ID NO: 2010 - DNA, 180 bp, Artificial Sequence
  Synthetic polynucleotide
atcatctcaccttgcctcctgggagttgctctgtcacccctgcaggaacatcaaaggagaaacatcaaaggtcgaacatcaaagggacaacatcaaaggctaaacatcaaaggactaacatcaaaggtgcaacatcaaagggtaaacatcaaaggggcgcgccatgcttcatcagactct

SEQ ID NO: 2011 - DNA, 180 bp, Artificial Sequence; identical to SEQ ID NO: 2010
  Synthetic polynucleotide

SEQ ID NO: 2012 - DNA, 188 bp, Artificial Sequence
  Synthetic polynucleotide
atcatctcaccttgcctcctgctattgtgcctctctgccctgcaggttatgttaaatcagattatgttaaatctcgttatgttaaatcgacttatgttaaatcctattatgttaaatcactttatgttaaatctgcttatgttaaatcgtattatgttaaatcggcgcgccatgcttcatcagactct

SEQ ID NO: 2013 - DNA, 188 bp, Artificial Sequence; identical to SEQ ID NO: 2012
  Synthetic polynucleotide

SEQ ID NO: 2014 - DNA, 191 bp, Artificial Sequence
  Synthetic polynucleotide
atcatctcaccttgcctcctgaccacaattcgttcagacctgcagggggtttaattaaaattcagagggtttaattaaaattctcggggtttaattaaaattcgacgggtttaattaaaattcctagggtttaattaaaattcactgggtttaattaaaattctgcggcgcgccatgcttcatcagactct

SEQ ID NO: 2015 - DNA, 191 bp, Artificial Sequence; identical to SEQ ID NO: 2014
  Synthetic polynucleotide

SEQ ID NO: 2016 - DNA, 197 bp, Artificial Sequence
  Synthetic polynucleotide
atcatctcaccttgcctcctgagccgatgaaggtcttgcctgcaggggccgccattttggtagaggccgccattttggttcgggccgccattttggtgacggccgccattttggtctaggccgccattttggtactggccgccattttggttgcggccgccattttggtgtaggcgcgccatgcttcatcagactct

SEQ ID NO: 2017 - DNA, 197 bp, Artificial Sequence; identical to SEQ ID NO: 2016
  Synthetic polynucleotide

SEQ ID NO: 2018 - DNA, 191 bp, Artificial Sequence
  Synthetic polynucleotide
atcatctcaccttgcctcctgaggtaagcttcacagctcctgcaggaagaacaggttgttgtaagaaagaacaggttgttgtatcgaagaacaggttgttgtagacaagaacaggttgttgtactaaagaacaggttgttgtaactaagaacaggttgttgtatgcggcgcgccatgcttcatcagactct

SEQ ID NO: 2019 - DNA, 191 bp, Artificial Sequence; identical to SEQ ID NO: 2018
  Synthetic polynucleotide

SEQ ID NO: 2020 - DNA, 197 bp, Artificial Sequence
  Synthetic polynucleotide
atcatctcaccttgcctcctgtattcagcgaacccaaacctgcagggtggtcccggatcatagagtggtcccggatcattcggtggtcccggatcatgacgtggtcccggatcatctagtggtcccggatcatactgtggtcccggatcattgcgtggtcccggatcatgtaggcgcgccatgcttcatcagactct

SEQ ID NO: 2021 - DNA, 197 bp, Artificial Sequence; identical to SEQ ID NO: 2020
  Synthetic polynucleotide

SEQ ID NO: 2022 - DNA, 191 bp, Artificial Sequence
  Synthetic polynucleotide
atcatctcaccttgcctcctgaagtttggccacggttgcctgcaggaccactaattagtggacagaaccactaattagtggactcgaccactaattagtggacgacaccactaattagtggacctaaccactaattagtggacactaccactaattagtggactgcggcgcgccatgcttcatcagactct

SEQ ID NO: 2023 - DNA, 191 bp, Artificial Sequence; identical to SEQ ID NO: 2022
  Synthetic polynucleotide

SEQ ID NO: 2024 - DNA, 172 bp, Artificial Sequence
  Synthetic polynucleotide
atcatctcaccttgcctcctggtactcgatgctaaatacctgcaggggggtatcatagaggggtatcattcgggggtatcatgacggggtatcatctaggggtatcatactggggtatcattgcggggtatcatgtaggggtatcatggcgcgccatgcttcatcagactct

SEQ ID NO: 2025 - DNA, 172 bp, Artificial Sequence; identical to SEQ ID NO: 2024
  Synthetic polynucleotide

SEQ ID NO: 2026 - DNA, 185 bp, Artificial Sequence
  Synthetic polynucleotide
atcatctcaccttgcctcctggcgtgctgatcactacgcctgcaggtgtcaggtgtcacctgagatgtcaggtgtcacctgtcgtgtcaggtgtcacctggactgtcaggtgtcacctgctatgtcaggtgtcacctgacttgtcaggtgtcacctgtgcggcgcgccatgcttcatcagactct

SEQ ID NO: 2027 - DNA, 185 bp, Artificial Sequence; identical to SEQ ID NO: 2026
  Synthetic polynucleotide

SEQ ID NO: 2028 - DNA, 196 bp, Artificial Sequence
  Synthetic polynucleotide
atcatctcaccttgcctcctggccgacacagaggattgcctgcagggactgcaattcatagagactgcaattcattcggactgcaattcatgacgactgcaattcatctagactgcaattcatactgactgcaattcattgcgactgcaattcatgtagactgcaattcatggcgcgccatgcttcatcagactct

SEQ ID NO: 2029 - DNA, 196 bp, Artificial Sequence; identical to SEQ ID NO: 2028
  Synthetic polynucleotide

SEQ ID NO: 2030 - DNA, 172 bp, Artificial Sequence
  Synthetic polynucleotide
atcatctcaccttgcctcctggcgattattagcgttcgcctgcaggcagccaatcaagacagccaatcatcgcagccaatcagaccagccaatcactacagccaatcaactcagccaatcatgccagccaatcagtacagccaatcaggcgcgccatgcttcatcagactct

SEQ ID NO: 2031 - DNA, 172 bp, Artificial Sequence; identical to SEQ ID NO: 2030
  Synthetic polynucleotide

SEQ ID NO: 2032 - DNA, 148 bp, Artificial Sequence
  Synthetic polynucleotide
atcatctcaccttgcctcctgcgcctctttatcgatagcctgcaggggattaaagaggattaatcgggattaagacggattaactaggattaaactggattaatgcggattaagtaggattaaggcgcgccatgcttcatcagactct

SEQ ID NO: 2033 - DNA, 148 bp, Artificial Sequence; identical to SEQ ID NO: 2032
  Synthetic polynucleotide

SEQ ID NO: 2034 - DNA, 188 bp, Artificial Sequence
  Synthetic polynucleotide
atcatctcaccttgcctcctggccatcctgggtttgtacctgcaggtttgttgtgttcagatttgttgtgttctcgtttgttgtgttcgactttgttgtgttcctatttgttgtgttcacttttgttgtgttctgctttgttgtgttcgtatttgttgtgttcggcgcgccatgcttcatcagactct

SEQ ID NO: 2035 - DNA, 188 bp, Artificial Sequence; identical to SEQ ID NO: 2034
  Synthetic polynucleotide

SEQ ID NO: 2036 - DNA, 140 bp, Artificial Sequence
  Synthetic polynucleotide
atcatctcaccttgcctcctggtgacagttagttcggacctgcaggcacgtgagacacgtgtcgcacgtggaccacgtgctacacgtgactcacgtgtgccacgtggtacacgtgggcgcgccatgcttcatcagactct

SEQ ID NO: 2037 - DNA, 140 bp, Artificial Sequence; identical to SEQ ID NO: 2036
  Synthetic polynucleotide

SEQ ID NO: 2038 - DNA, 200 bp, Artificial Sequence
  Synthetic polynucleotide
atcatctcaccttgcctcctggacaatcgacagcacctcctgcaggtcgtgacctttgaccctgtagatcgtgacctttgaccctgttcgtcgtgacctttgaccctgtgactcgtgacctttgaccctgtctatcgtgacctttgaccctgtacttcgtgacctttgaccctgtggcgcgccatgcttcatcagactct

SEQ ID NO: 2039 - DNA, 200 bp, Artificial Sequence; identical to SEQ ID NO: 2038
  Synthetic polynucleotide

SEQ ID NO: 2040 - DNA, 180 bp, Artificial Sequence
  Synthetic polynucleotide
atcatctcaccttgcctcctgtgtaaagttcggacaaacctgcaggaccagggggcgagaaccagggggcgtcgaccagggggcggacaccagggggcgctaaccagggggcgactaccagggggcgtgcaccagggggcggtaaccagggggcgggcgcgccatgcttcatcagactct

SEQ ID NO: 2041 - DNA, 180 bp, Artificial Sequence; identical to SEQ ID NO: 2040
  Synthetic polynucleotide

SEQ ID NO: 2042 - DNA, 188 bp, Artificial Sequence
  Synthetic polynucleotide
atcatctcaccttgcctcctgtttggtgcggcgcctttcctgcaggtccagatgtttcagatccagatgtttctcgtccagatgtttcgactccagatgtttcctatccagatgtttcacttccagatgtttctgctccagatgtttcgtatccagatgtttcggcgcgccatgcttcatcagactct

SEQ ID NO: 2043 - DNA, 188 bp, Artificial Sequence; identical to SEQ ID NO: 2042
  Synthetic polynucleotide

SEQ ID NO: 2044 - DNA, 191 bp, Artificial Sequence
  Synthetic polynucleotide
atcatctcaccttgcctcctggcgaagaaacggacgaacctgcaggctcagcagctgctcctgagactcagcagctgctcctgtcgctcagcagctgctcctggacctcagcagctgctcctgctactcagcagctgctcctgactctcagcagctgctcctgtgcggcgcgccatgcttcatcagactct

SEQ ID NO: 2045 - DNA, 191 bp, Artificial Sequence; identical to SEQ ID NO: 2044
  Synthetic polynucleotide

SEQ ID NO: 2046 - DNA, 148 bp, Artificial Sequence
  Synthetic polynucleotide
atcatctcaccttgcctcctgccactgtccaatacagccctgcagggtcatgcagagtcatgctcggtcatgcgacgtcatgcctagtcatgcactgtcatgctgcgtcatgcgtagtcatgcggcgcgccatgcttcatcagactct

SEQ ID NO: 2047 - DNA, 148 bp, Artificial Sequence; identical to SEQ ID NO: 2046
  Synthetic polynucleotide

SEQ ID NO: 2048 - DNA, 172 bp, Artificial Sequence
  Synthetic polynucleotide
atcatctcaccttgcctcctggcttctcattcgacccacctgcagggggaatccccagagggaatcccctcggggaatccccgacgggaatccccctagggaatccccactgggaatcccctgcgggaatccccgtagggaatccccggcgcgccatgcttcatcagactct

SEQ ID NO: 2049 - DNA, 172 bp, Artificial Sequence; identical to SEQ ID NO: 2048
  Synthetic polynucleotide

SEQ ID NO: 2050 - DNA, 196 bp, Artificial Sequence
  Synthetic polynucleotide
atcatctcaccttgcctcctgacaggcaaactttgttacctgcaggctaatttaatcaaagactaatttaatcaatcgctaatttaatcaagacctaatttaatcaactactaatttaatcaaactctaatttaatcaatgcctaatttaatcaagtactaatttaatcaaggcgcgccatgcttcatcagactct

SEQ ID NO: 2051 - DNA, 196 bp, Artificial Sequence; identical to SEQ ID NO: 2050
  Synthetic polynucleotide

SEQ ID NO: 2052 - DNA, 172 bp, Artificial Sequence
  Synthetic polynucleotide
atcatctcaccttgcctcctgcctgcagaaggtgcgaacctgcaggatggggtgatagaatggggtgattcgatggggtgatgacatggggtgatctaatggggtgatactatggggtgattgcatggggtgatgtaatggggtgatggcgcgccatgcttcatcagactct

SEQ ID NO: 2053 - DNA, 172 bp, Artificial Sequence; identical to SEQ ID NO: 2052
  Synthetic polynucleotide

SEQ ID NO: 2054 - DNA, 172 bp, Artificial Sequence
  Synthetic polynucleotide
atcatctcaccttgcctcctgcttgccgcctggacatacctgcaggttaagtggctagattaagtggcttcgttaagtggctgacttaagtggctctattaagtggctactttaagtggcttgcttaagtggctgtattaagtggctggcgcgccatgcttcatcagactct

SEQ ID NO: 2055 - DNA, 172 bp, Artificial Sequence; identical to SEQ ID NO: 2054
  Synthetic polynucleotide

SEQ ID NO: 2056 - DNA, 196 bp, Artificial Sequence
  Synthetic polynucleotide
atcatctcaccttgcctcctgtatcgctctagctccgccctgcagggcgggggcgggggagagcgggggcgggggtcggcgggggcggggggacgcgggggcgggggctagcgggggcgggggactgcgggggcgggggtgcgcgggggcggggggtagcgggggcgggggggcgcgccatgcttcatcagactct

SEQ ID NO: 2057 - DNA, 196 bp, Artificial Sequence; identical to SEQ ID NO: 2056
  Synthetic polynucleotide

SEQ ID NO: 2058 - DNA, 156 bp, Artificial Sequence
  Synthetic polynucleotide
atcatctcaccttgcctcctggcattcacataccagggcctgcaggcatgcagcagacatgcagctcgcatgcagcgaccatgcagcctacatgcagcactcatgcagctgccatgcagcgtacatgcagcggcgcgccatgcttcatcagactct

SEQ ID NO: 2059 - DNA, 156 bp, Artificial Sequence; identical to SEQ ID NO: 2058
  Synthetic polynucleotide

SEQ ID NO: 2060 - DNA, 191 bp, Artificial Sequence
  Synthetic polynucleotide
atcatctcaccttgcctcctgcccaaagcgacttggagcctgcaggttttcgcacctgtggatagattttcgcacctgtggattcgttttcgcacctgtggatgacttttcgcacctgtggatctattttcgcacctgtggatactttttcgcacctgtggattgcggcgcgccatgcttcatcagactct

SEQ ID NO: 2061 - DNA, 191 bp, Artificial Sequence; identical to SEQ ID NO: 2060
  Synthetic polynucleotide

SEQ ID NO: 2062 - DNA, 172 bp, Artificial Sequence
  Synthetic polynucleotide
atcatctcaccttgcctcctgcacatctcaggatcgtgcctgcagggaacacctgcagagaacacctgctcggaacacctgcgacgaacacctgcctagaacacctgcactgaacacctgctgcgaacacctgcgtagaacacctgcggcgcgccatgcttcatcagactct

SEQ ID NO: 2063 - DNA, 172 bp, Artificial Sequence; identical to SEQ ID NO: 2062
  Synthetic polynucleotide

SEQ ID NO: 2064 - DNA, 164 bp, Artificial Sequence
  Synthetic polynucleotide
atcatctcaccttgcctcctgaagatcgtactcaagaacctgcaggcacgtgaccagacacgtgacctcgcacgtgaccgaccacgtgaccctacacgtgaccactcacgtgacctgccacgtgaccgtacacgtgaccggcgcgccatgcttcatcagactct

SEQ ID NO: 2065 - DNA, 164 bp, Artificial Sequence; identical to SEQ ID NO: 2064
  Synthetic polynucleotide

SEQ ID NO: 2066 - DNA, 180 bp, Artificial Sequence
  Synthetic polynucleotide
atcatctcaccttgcctcctgtagccactcccaatgttcctgcaggggtcacgtggcagaggtcacgtggctcgggtcacgtggcgacggtcacgtggcctaggtcacgtggcactggtcacgtggctgcggtcacgtggcgtaggtcacgtggcggcgcgccatgcttcatcagactct

SEQ ID NO: 2067 - DNA, 180 bp, Artificial Sequence; identical to SEQ ID NO: 2066
  Synthetic polynucleotide

SEQ ID NO: 2068 - DNA, 156 bp, Artificial Sequence
  Synthetic polynucleotide
atcatctcaccttgcctcctgctgttctgctcgttaaacctgcaggatttgcatagaatttgcattcgatttgcatgacatttgcatctaatttgcatactatttgcattgcatttgcatgtaatttgcatggcgcgccatgcttcatcagactct

SEQ ID NO: 2069 - DNA, 156 bp, Artificial Sequence; identical to SEQ ID NO: 2068
  Synthetic polynucleotide

SEQ ID NO: 2070 - DNA, 188 bp, Artificial Sequence
  Synthetic polynucleotide
atcatctcaccttgcctcctgctgcgcgtaaagaggagcctgcaggttatgcaaattaagattatgcaaattatcgttatgcaaattagacttatgcaaattactattatgcaaattaactttatgcaaattatgcttatgcaaattagtattatgcaaattaggcgcgccatgcttcatcagactct

SEQ ID NO: 2071 - DNA, 188 bp, Artificial Sequence; identical to SEQ ID NO: 2070
  Synthetic polynucleotide

SEQ ID NO: 2072 - DNA, 186 bp, Artificial Sequence
  Synthetic polynucleotide
atcatctcaccttgcctcctgaaaggttgcagactgggcctgcagggccaccagggggcgccggagagagccaccagggggcgccggagtcggccaccagggggcgccggaggacgccaccagggggcgccggagctagccaccagggggcgccggagactggcgcgccatgcttcatcagactct

SEQ ID NO: 2073 - DNA, 186 bp, Artificial Sequence; identical to SEQ ID NO: 2072
  Synthetic polynucleotide

SEQ ID NO: 2074 - DNA, 164 bp, Artificial Sequence
  Synthetic polynucleotide
atcatctcaccttgcctcctgcgaggattgagccgattcctgcagggggagctgtagagggagctgttcggggagctgtgacgggagctgtctagggagctgtactgggagctgttgcgggagctgtgtagggagctgtggcgcgccatgcttcatcagactct

SEQ ID NO: 2075 - DNA, 164 bp, Artificial Sequence; identical to SEQ ID NO: 2074
  Synthetic polynucleotide

SEQ ID NO: 2076 - DNA, 148 bp, Artificial Sequence
  Synthetic polynucleotide
atcatctcaccttgcctcctgaaagagctgccgtcgtccctgcagggcagctgagagcagctgtcggcagctggacgcagctgctagcagctgactgcagctgtgcgcagctggtagcagctgggcgcgccatgcttcatcagactct

SEQ ID NO: 2077 - DNA, 148 bp, Artificial Sequence; identical to SEQ ID NO: 2076
  Synthetic polynucleotide

SEQ ID NO: 2078 - DNA, 164 bp, Artificial Sequence
  Synthetic polynucleotide
atcatctcaccttgcctcctggggcgctgtgtttattccctgcaggcccataaaaagacccataaaatcgcccataaaagaccccataaaactacccataaaaactcccataaaatgccccataaaagtacccataaaaggcgcgccatgcttcatcagactct

SEQ ID NO: 2079 - DNA, 164 bp, Artificial Sequence; identical to SEQ ID NO: 2078
  Synthetic polynucleotide

SEQ ID NO: 2080 - DNA, 186 bp, Artificial Sequence
  Synthetic polynucleotide
atcatctcaccttgcctcctgtaacttcgcatcgcgtacctgcagggcaaggcatgatgggaaatcagagcaaggcatgatgggaaatctcggcaaggcatgatgggaaatcgacgcaaggcatgatgggaaatcctagcaaggcatgatgggaaatcactggcgcgccatgcttcatcagactct

SEQ ID NO: 2081 - DNA, 186 bp, Artificial Sequence; identical to SEQ ID NO: 2080
  Synthetic polynucleotide

SEQ ID NO: 2082 - DNA, 188 bp, Artificial Sequence
  Synthetic polynucleotide
atcatctcaccttgcctcctgttcgaccgtataatactcctgcagggccatatatggtagagccatatatggttcggccatatatggtgacgccatatatggtctagccatatatggtactgccatatatggttgcgccatatatggtgtagccatatatggtggcgcgccatgcttcatcagactct

SEQ ID NO: 2083 - DNA, 188 bp, Artificial Sequence; identical to SEQ ID NO: 2082
  Synthetic polynucleotide

SEQ ID NO: 2084 - DNA, 191 bp, Artificial Sequence
  Synthetic polynucleotide
atcatctcaccttgcctcctgagtgcggaccgtgaattcctgcaggcggaattaattaataggagacggaattaattaataggtcgcggaattaattaatagggaccggaattaattaataggctacggaattaattaataggactcggaattaattaataggtgcggcgcgccatgcttcatcagactct

SEQ ID NO: 2085 - DNA, 191 bp, Artificial Sequence; identical to SEQ ID NO: 2084
  Synthetic polynucleotide

SEQ ID NO: 2086 - DNA, 196 bp, Artificial Sequence
  Synthetic polynucleotide
atcatctcaccttgcctcctgtcgttcagagtacttatcctgcaggattttgcaatctgagaattttgcaatctgtcgattttgcaatctggacattttgcaatctgctaattttgcaatctgactattttgcaatctgtgcattttgcaatctggtaattttgcaatctgggcgcgccatgcttcatcagactct

SEQ ID NO: 2087 - DNA, 196 bp, Artificial Sequence; identical to SEQ ID NO: 2086
  Synthetic polynucleotide

SEQ ID NO: 2088 - DNA, 172 bp, Artificial Sequence
  Synthetic polynucleotide
atcatctcaccttgcctcctgtagcctcgttgagaactcctgcagggcagaacaatagagcagaacaattcggcagaacaatgacgcagaacaatctagcagaacaatactgcagaacaattgcgcagaacaatgtagcagaacaatggcgcgccatgcttcatcagactct

SEQ ID NO: 2089 - DNA, 172 bp, Artificial Sequence; identical to SEQ ID NO: 2088
  Synthetic polynucleotide

SEQ ID NO: 2090 - DNA, 188 bp, Artificial Sequence
  Synthetic polynucleotide
atcatctcaccttgcctcctggccgtgtcctcatataccctgcaggtttccccacacgagatttccccacacgtcgtttccccacacggactttccccacacgctatttccccacacgacttttccccacacgtgctttccccacacggtatttccccacacgggcgcgccatgcttcatcagactct

SEQ ID NO: 2091 - DNA, 188 bp, Artificial Sequence; identical to SEQ ID NO: 2090
  Synthetic polynucleotide

SEQ ID NO: 2092 - DNA, 172 bp, Artificial Sequence
  Synthetic polynucleotide
atcatctcaccttgcctcctgacacacgcgtattagatcctgcaggtaattagcatagataattagcattcgtaattagcatgactaattagcatctataattagcatacttaattagcattgctaattagcatgtataattagcatggcgcgccatgcttcatcagactct

SEQ ID NO: 2093 - DNA, 172 bp, Artificial Sequence; identical to SEQ ID NO: 2092
  Synthetic polynucleotide

SEQ ID NO: 2094 - DNA, 148 bp, Artificial Sequence
  Synthetic polynucleotide
atcatctcaccttgcctcctgttacggtttaatgggcccctgcaggagtcatgagaagtcatgtcgagtcatggacagtcatgctaagtcatgactagtcatgtgcagtcatggtaagtcatgggcgcgccatgcttcatcagactct

SEQ ID NO: 2095 - DNA, 148 bp, Artificial Sequence; identical to SEQ ID NO: 2094
  Synthetic polynucleotide

SEQ ID NO: 2096 - DNA, 156 bp, Artificial Sequence
  Synthetic polynucleotide
atcatctcaccttgcctcctgtccgaactcaacggcgacctgcaggtcattcacagatcattcactcgtcattcacgactcattcacctatcattcacacttcattcactgctcattcacgtatcattcacggcgcgccatgcttcatcagactct

SEQ ID NO: 2097 - DNA, 156 bp, Artificial Sequence; identical to SEQ ID NO: 2096
  Synthetic polynucleotide

SEQ ID NO: 2098 - DNA, 196 bp, Artificial Sequence
  Synthetic polynucleotide
atcatctcaccttgcctcctgagcaacaccaagtggagcctgcaggctttatttcttatctctaaaaaagactttatttcttatctctaaaaatcgctttatttcttatctctaaaaagacctttatttcttatctctaaaaactactttatttcttatctctaaaaaactggcgcgccatgcttcatcagactct

SEQ ID NO: 2099 - DNA, 196 bp, Artificial Sequence; identical to SEQ ID NO: 2098
  Synthetic polynucleotide

SEQ ID NO: 2100 - DNA, 190 bp, Artificial Sequence
  Synthetic polynucleotide
atcatctcaccttgcctcctgttcccaagtaacaagaccctgcaggacgaaaccgaaactagaacgaaaccgaaacttcgacgaaaccgaaactgacacgaaaccgaaactctaacgaaaccgaaactactacgaaaccgaaacttgcacgaaaccgaaactgtaggcgcgccatgcttcatcagactct

SEQ ID NO: 2101 - DNA, 190 bp, Artificial Sequence; identical to SEQ ID NO: 2100
  Synthetic polynucleotide

SEQ ID NO: 2102 - DNA, 197 bp, Artificial Sequence
  Synthetic polynucleotide
atcatctcaccttgcctcctgcctcttctagtggatatcctgcaggatgcccatatatggtaatagaatgcccatatatggtaattcgatgcccatatatggtaatgacatgcccatatatggtaatctaatgcccatatatggtaatactatgcccatatatggtaattgcggcgcgccatgcttcatcagactct

SEQ ID NO: 2103 - DNA, 197 bp, Artificial Sequence; identical to SEQ ID NO: 2102
  Synthetic polynucleotide

SEQ ID NO: 2104 - DNA, 197 bp, Artificial Sequence
  Synthetic polynucleotide
atcatctcaccttgcctcctgctggcagcaacttgggtcctgcaggatgaattccattcatagaatgaattccattcattcgatgaattccattcatgacatgaattccattcatctaatgaattccattcatactatgaattccattcattgcatgaattccattcatgtaggcgcgccatgcttcatcagactct

SEQ ID NO: 2105 - DNA, 197 bp, Artificial Sequence; identical to SEQ ID NO: 2104
  Synthetic polynucleotide

SEQ ID NO: 2106 - DNA, 197 bp, Artificial Sequence
  Synthetic polynucleotide
atcatctcaccttgcctcctggggctaaggttgtatgtcctgcagggagtctaatgacccaagagagtctaatgacccatcggagtctaatgacccagacgagtctaatgacccactagagtctaatgacccaactgagtctaatgacccatgcgagtctaatgacccagtaggcgcgccatgcttcatcagactct

SEQ ID NO: 2107 - DNA, 197 bp, Artificial Sequence; identical to SEQ ID NO: 2106
  Synthetic polynucleotide

SEQ ID NO: 2108 - DNA, 156 bp, Artificial Sequence
  Synthetic polynucleotide
atcatctcaccttgcctcctgtagagatttcgactccgcctgcaggattagtacagaattagtactcgattagtacgacattagtacctaattagtacactattagtactgcattagtacgtaattagtacggcgcgccatgcttcatcagactct

SEQ ID NO: 2109 - DNA, 156 bp, Artificial Sequence; identical to SEQ ID NO: 2108
  Synthetic polynucleotide

SEQ ID NO: 2110 - DNA, 186 bp, Artificial Sequence
  Synthetic polynucleotide
atcatctcaccttgcctcctgaatgcataagcaaggatcctgcaggagacatgcccagacatgcccagaagacatgcccagacatgccctcgagacatgcccagacatgcccgacagacatgcccagacatgcccctaagacatgcccagacatgcccactggcgcgccatgcttcatcagactct

SEQ ID NO: 2111 - DNA, 186 bp, Artificial Sequence; identical to SEQ ID NO: 2110
  Synthetic polynucleotide

SEQ ID NO: 2112 - DNA, 191 bp, Artificial Sequence
  Synthetic polynucleotide
atcatctcaccttgcctcctggtaagcccgaagtgcagcctgcaggagggaacagaatgttctgggcagaagggaacagaatgttctgggctcgagggaacagaatgttctgggcgacagggaacagaatgttctgggcctaagggaacagaatgttctgggcactggcgcgccatgcttcatcagactct

SEQ ID NO: 2113 - DNA, 191 bp, Artificial Sequence; identical to SEQ ID NO: 2112
  Synthetic polynucleotide

SEQ ID NO: 2114 - DNA, 164 bp, Artificial Sequence
  Synthetic polynucleotide
atcatctcaccttgcctcctggcgctcatcagcttactcctgcaggttaagtggaagattaagtggatcgttaagtggagacttaagtggactattaagtggaactttaagtggatgcttaagtggagtattaagtggaggcgcgccatgcttcatcagactct

SEQ ID NO: 2115 - DNA, 164 bp, Artificial Sequence; identical to SEQ ID NO: 2114
  Synthetic polynucleotide

SEQ ID NO: 2116 - DNA, 180 bp, Artificial Sequence
  Synthetic polynucleotide
atcatctcaccttgcctcctggtgtaatcattctcgatcctgcaggtctcacgcaagagatctcacgcaagtcgtctcacgcaaggactctcacgcaagctatctcacgcaagacttctcacgcaagtgctctcacgcaaggtatctcacgcaagggcgcgccatgcttcatcagactct

SEQ ID NO: 2117 - DNA, 180 bp, Artificial Sequence; identical to SEQ ID NO: 2116
  Synthetic polynucleotide

SEQ ID NO: 2118 - DNA, 196 bp, Artificial Sequence
  Synthetic polynucleotide
atcatctcaccttgcctcctgagagggcgtgctagtatcctgcaggttacttccttgtaagattacttccttgtatcgttacttccttgtagacttacttccttgtactattacttccttgtaactttacttccttgtatgcttacttccttgtagtattacttccttgtaggcgcgccatgcttcatcagactct

SEQ ID NO: 2119 - DNA, 196 bp, Artificial Sequence; identical to SEQ ID NO: 2118
  Synthetic polynucleotide

SEQ ID NO: 2120 - DNA, 185 bp, Artificial Sequence
  Synthetic polynucleotide
atcatctcaccttgcctcctgtgtgcggactatagcgccctgcaggttcttaattggtttttagattcttaattggttttttcgttcttaattggtttttgacttcttaattggtttttctattcttaattggtttttactttcttaattggttttttgcggcgcgccatgcttcatcagactct

SEQ ID NO: 2121 - DNA, 185 bp, Artificial Sequence; identical to SEQ ID NO: 2120
  Synthetic polynucleotide

SEQ ID NO: 2122 - DNA, 197 bp, Artificial Sequence
  Synthetic polynucleotide
atcatctcaccttgcctcctgagtcctcccatcgtctacctgcaggatgcccatatatggaagaatgcccatatatggatcgatgcccatatatggagacatgcccatatatggactaatgcccatatatggaactatgcccatatatggatgcatgcccatatatggagtaggcgcgccatgcttcatcagactct

SEQ ID NO: 2123 - DNA, 197 bp, Artificial Sequence; identical to SEQ ID NO: 2122
  Synthetic polynucleotide

SEQ ID NO: 2124 - DNA, 185 bp, Artificial Sequence
  Synthetic polynucleotide
atcatctcaccttgcctcctgtaggctgctgaatgtaccctgcaggctctaaaaataaccctagactctaaaaataacccttcgctctaaaaataaccctgacctctaaaaataaccctctactctaaaaataaccctactctctaaaaataacccttgcggcgcgccatgcttcatcagactct

SEQ ID NO: 2125 - DNA, 185 bp, Artificial Sequence; identical to SEQ ID NO: 2124
  Synthetic polynucleotide

SEQ ID NO: 2126 - DNA, 172 bp, Artificial Sequence
  Synthetic polynucleotide
atcatctcaccttgcctcctgagagtatctccagatcgcctgcaggcggaagtcgcagacggaagtcgctcgcggaagtcgcgaccggaagtcgcctacggaagtcgcactcggaagtcgctgccggaagtcgcgtacggaagtcgcggcgcgccatgcttcatcagactct

SEQ ID NO: 2127 - DNA, 172 bp, Artificial Sequence; identical to SEQ ID NO: 2126
  Synthetic polynucleotide

SEQ ID NO: 2128 - DNA, 180 bp, Artificial Sequence
  Synthetic polynucleotide
atcatctcaccttgcctcctgcggtgtcgttcattccgcctgcagggtcacgtgaccagagtcacgtgacctcggtcacgtgaccgacgtcacgtgaccctagtcacgtgaccactgtcacgtgacctgcgtcacgtgaccgtagtcacgtgaccggcgcgccatgcttcatcagactct

SEQ ID NO: 2129 - DNA, 180 bp, Artificial Sequence; identical to SEQ ID NO: 2128
  Synthetic polynucleotide

SEQ ID NO: 2130 - DNA, 156 bp, Artificial Sequence
  Synthetic polynucleotide
atcatctcaccttgcctcctgttacgtgccgaagtaaccctgcaggtaattgccagataattgcctcgtaattgccgactaattgccctataattgccacttaattgcctgctaattgccgtataattgccggcgcgccatgcttcatcagactct

SEQ ID NO: 2131 - DNA, 156 bp, Artificial Sequence; identical to SEQ ID NO: 2130
  Synthetic polynucleotide

SEQ ID NO: 2132 - DNA, 180 bp, Artificial Sequence
  Synthetic polynucleotide
atcatctcaccttgcctcctgtcggaagggcagttaagcctgcaggtatttccggttagatatttccggtttcgtatttccggttgactatttccggttctatatttccggttacttatttccggtttgctatttccggttgtatatttccggttggcgcgccatgcttcatcagactct

SEQ ID NO: 2133 - DNA, 180 bp, Artificial Sequence; identical to SEQ ID NO: 2132
  Synthetic polynucleotide

SEQ ID NO: 2134 - DNA, 140 bp, Artificial Sequence
  Synthetic polynucleotide
atcatctcaccttgcctcctgtaactttcgcgcgggcacctgcaggctaattagactaatttcgctaattgacctaattctactaattactctaatttgcctaattgtactaattggcgcgccatgcttcatcagactct

SEQ ID NO: 2135 - DNA, 140 bp, Artificial Sequence; identical to SEQ ID NO: 2134
  Synthetic polynucleotide

SEQ ID NO: 2136 - DNA, 185 bp, Artificial Sequence
  Synthetic polynucleotide
atcatctcaccttgcctcctgtgctactgtcgacttaccctgcagggggccgtgtgcaaaaaagagggccgtgtgcaaaaatcggggccgtgtgcaaaaagacgggccgtgtgcaaaaactagggccgtgtgcaaaaaactgggccgtgtgcaaaaatgcggcgcgccatgcttcatcagactct

SEQ ID NO: 2137 - DNA, 185 bp, Artificial Sequence; identical to SEQ ID NO: 2136
  Synthetic polynucleotide

SEQ ID NO: 2138 - DNA, 191 bp, Artificial Sequence
  Synthetic polynucleotide
atcatctcaccttgcctcctgcgcccatagccgattgacctgcaggtgtgctgagtcagcattagatgtgctgagtcagcatttcgtgtgctgagtcagcattgactgtgctgagtcagcattctatgtgctgagtcagcattacttgtgctgagtcagcatttgcggcgcgccatgcttcatcagactct

SEQ ID NO: 2139 - DNA, 191 bp, Artificial Sequence; identical to SEQ ID NO: 2138
  Synthetic polynucleotide

SEQ ID NO: 2140 - DNA, 188 bp, Artificial Sequence
  Synthetic polynucleotide
atcatctcaccttgcctcctgagtagaggtaggccattcctgcaggagggttaataaaagaagggttaataaatcgagggttaataaagacagggttaataaactaagggttaataaaactagggttaataaatgcagggttaataaagtaagggttaataaaggcgcgccatgcttcatcagactct

SEQ ID NO: 2141 - DNA, 188 bp, Artificial Sequence; identical to SEQ ID NO: 2140
  Synthetic polynucleotide

SEQ ID NO: 2142 - DNA, 196 bp, Artificial Sequence
  Synthetic polynucleotide
atcatctcaccttgcctcctggcgatttctgtcgctctcctgcaggttgtttatttacaagattgtttatttacatcgttgtttatttacagacttgtttatttacactattgtttatttacaactttgtttatttacatgcttgtttatttacagtattgtttatttacaggcgcgccatgcttcatcagactct

SEQ ID NO: 2143 - DNA, 196 bp, Artificial Sequence; identical to SEQ ID NO: 2142
  Synthetic polynucleotide

SEQ ID NO: 2144 - DNA, 191 bp, Artificial Sequence
  Synthetic polynucleotide
atcatctcaccttgcctcctgtcttctcggtgaaccaccctgcaggttcagcaccacggacagcgccagattcagcaccacggacagcgcctcgttcagcaccacggacagcgccgacttcagcaccacggacagcgccctattcagcaccacggacagcgccactggcgcgccatgcttcatcagactct

SEQ ID NO: 2145 - DNA, 191 bp, Artificial Sequence; identical to SEQ ID NO: 2144
  Synthetic polynucleotide

SEQ ID NO: 2146 - DNA, 172 bp, Artificial Sequence
  Synthetic polynucleotide
atcatctcaccttgcctcctggacttcgcccgctttagcctgcaggaccacctgttagaaccacctgtttcgaccacctgttgacaccacctgttctaaccacctgttactaccacctgtttgcaccacctgttgtaaccacctgttggcgcgccatgcttcatcagactct

SEQ ID NO: 2147 - DNA, 172 bp, Artificial Sequence; identical to SEQ ID NO: 2146
  Synthetic polynucleotide

SEQ ID NO: 2148 - DNA, 156 bp, Artificial Sequence
  Synthetic polynucleotide
atcatctcaccttgcctcctggtttatagggtgtcaggcctgcaggcttgtcaaagacttgtcaatcgcttgtcaagaccttgtcaactacttgtcaaactcttgtcaatgccttgtcaagtacttgtcaaggcgcgccatgcttcatcagactct

SEQ ID NO: 2149 - DNA, 156 bp, Artificial Sequence; identical to SEQ ID NO: 2148
  Synthetic polynucleotide

SEQ ID NO: 2150 - DNA, 188 bp, Artificial Sequence
  Synthetic polynucleotide
atcatctcaccttgcctcctgggtgcttcgctcgcaaacctgcagggggtctggcattagagggtctggcatttcggggtctggcattgacgggtctggcattctagggtctggcattactgggtctggcatttgcgggtctggcattgtagggtctggcattggcgcgccatgcttcatcagactct

SEQ ID NO: 2151 - DNA, 188 bp, Artificial Sequence; identical to SEQ ID NO: 2150
  Synthetic polynucleotide

SEQ ID NO: 2152 - DNA, 172 bp, Artificial Sequence
  Synthetic polynucleotide
atcatctcaccttgcctcctgctggctggtatatgtggcctgcaggccccgctgtgagaccccgctgtgtcgccccgctgtggacccccgctgtgctaccccgctgtgactccccgctgtgtgcccccgctgtggtaccccgctgtgggcgcgccatgcttcatcagactct

SEQ ID NO: 2153 - DNA, 172 bp, Artificial Sequence; identical to SEQ ID NO: 2152
  Synthetic polynucleotide

SEQ ID NO: 2154 - DNA, 172 bp, Artificial Sequence
  Synthetic polynucleotide
atcatctcaccttgcctcctgtttgcagataggtgtttcctgcaggggcgcgaaacagaggcgcgaaactcgggcgcgaaacgacggcgcgaaacctaggcgcgaaacactggcgcgaaactgcggcgcgaaacgtaggcgcgaaacggcgcgccatgcttcatcagactct

SEQ ID NO: 2155 - DNA, 172 bp, Artificial Sequence; identical to SEQ ID NO: 2154
  Synthetic polynucleotide

SEQ ID NO: 2156 - DNA, 188 bp, Artificial Sequence
  Synthetic polynucleotide
atcatctcaccttgcctcctgctggagtggtcacgtttcctgcaggacgcagctgcgcagaacgcagctgcgctcgacgcagctgcgcgacacgcagctgcgcctaacgcagctgcgcactacgcagctgcgctgcacgcagctgcgcgtaacgcagctgcgcggcgcgccatgcttcatcagactct

SEQ ID NO: 2157 - DNA, 188 bp, Artificial Sequence; identical to SEQ ID NO: 2156
  Synthetic polynucleotide

SEQ ID NO: 2158 - DNA, 185 bp, Artificial Sequence
  Synthetic polynucleotide
atcatctcaccttgcctcctgcccggacaggacattaacctgcaggctgggttaattaacgtagactgggttaattaacgttcgctgggttaattaacgtgacctgggttaattaacgtctactgggttaattaacgtactctgggttaattaacgttgcggcgcgccatgcttcatcagactct

SEQ ID NO: 2159 - DNA, 185 bp, Artificial Sequence; identical to SEQ ID NO: 2158
  Synthetic polynucleotide

SEQ ID NO: 2160 - DNA, 196 bp, Artificial Sequence
  Synthetic polynucleotide
atcatctcaccttgcctcctgtatccagcctccaaggacctgcaggtattacataaattagatattacataaatttcgtattacataaattgactattacataaattctatattacataaattacttattacataaatttgctattacataaattgtatattacataaattggcgcgccatgcttcatcagactct

SEQ ID NO: 2161 - DNA, 196 bp, Artificial Sequence; identical to SEQ ID NO: 2160
  Synthetic polynucleotide

SEQ ID NO: 2162 - DNA, 188 bp, Artificial Sequence
  Synthetic polynucleotide
atcatctcaccttgcctcctgcgactgttcgtacaatgcctgcaggggttacgtaatgagaggttacgtaatgtcgggttacgtaatggacggttacgtaatgctaggttacgtaatgactggttacgtaatgtgcggttacgtaatggtaggttacgtaatgggcgcgccatgcttcatcagactct

SEQ ID NO: 2163 - DNA, 188 bp, Artificial Sequence; identical to SEQ ID NO: 2162
  Synthetic polynucleotide

SEQ ID NO: 2164 - DNA, 180 bp, Artificial Sequence
  Synthetic polynucleotide
atcatctcaccttgcctcctggtcatccagcacgaaagcctgcagggtgactcagcaagagtgactcagcatcggtgactcagcagacgtgactcagcactagtgactcagcaactgtgactcagcatgcgtgactcagcagtagtgactcagcaggcgcgccatgcttcatcagactct

SEQ ID NO: 2165 - DNA, 180 bp, Artificial Sequence; identical to SEQ ID NO: 2164
  Synthetic polynucleotide

SEQ ID NO: 2166 - DNA, 188 bp, Artificial Sequence
  Synthetic polynucleotide
atcatctcaccttgcctcctggacccaacctaggcttccctgcaggaccggaagtgcaagaaccggaagtgcatcgaccggaagtgcagacaccggaagtgcactaaccggaagtgcaactaccggaagtgcatgcaccggaagtgcagtaaccggaagtgcaggcgcgccatgcttcatcagactct

SEQ ID NO: 2167 - DNA, 188 bp, Artificial Sequence; identical to SEQ ID NO: 2166
  Synthetic polynucleotide

SEQ ID NO: 2168 - DNA, 172 bp, Artificial Sequence
  Synthetic polynucleotide
atcatctcaccttgcctcctgcatgttctcgcatatgtcctgcaggaccacctgtcagaaccacctgtctcgaccacctgtcgacaccacctgtcctaaccacctgtcactaccacctgtctgcaccacctgtcgtaaccacctgtcggcgcgccatgcttcatcagactct

SEQ ID NO: 2169 - DNA, 172 bp, Artificial Sequence; identical to SEQ ID NO: 2168
  Synthetic polynucleotide

SEQ ID NO: 2170 - DNA, 164 bp, Artificial Sequence
  Synthetic polynucleotide
atcatctcaccttgcctcctgtcacacgtacgaccacgcctgcaggggccattaaagaggccattaatcgggccattaagacggccattaactaggccattaaactggccattaatgcggccattaagtaggccattaaggcgcgccatgcttcatcagactct

SEQ ID NO: 2171 - DNA, 164 bp, Artificial Sequence; identical to SEQ ID NO: 2170
  Synthetic polynucleotide

SEQ ID NO: 2172 - DNA, 180 bp, Artificial Sequence
  Synthetic polynucleotide
atcatctcaccttgcctcctgtggttacacagtatagtcctgcaggctaggtgtgaaagactaggtgtgaatcgctaggtgtgaagacctaggtgtgaactactaggtgtgaaactctaggtgtgaatgcctaggtgtgaagtactaggtgtgaaggcgcgccatgcttcatcagactct

SEQ ID NO: 2173 - DNA, 180 bp, Artificial Sequence; identical to SEQ ID NO: 2172
  Synthetic polynucleotide

SEQ ID NO: 2174 - DNA, 188 bp, Artificial Sequence
  Synthetic polynucleotide
atcatctcaccttgcctcctggggatccaaggtgcgatcctgcaggcgccccctgacaagacgccccctgacatcgcgccccctgacagaccgccccctgacactacgccccctgacaactcgccccctgacatgccgccccctgacagtacgccccctgacaggcgcgccatgcttcatcagactct

SEQ ID NO: 2175 - DNA, 188 bp, Artificial Sequence; identical to SEQ ID NO: 2174
  Synthetic polynucleotide

SEQ ID NO: 2176 - DNA, 148 bp, Artificial Sequence
  Synthetic polynucleotide
atcatctcaccttgcctcctgcacgtttctccaacagacctgcaggggttcatagaggttcattcgggttcatgacggttcatctaggttcatactggttcattgcggttcatgtaggttcatggcgcgccatgcttcatcagactct

SEQ ID NO: 2177 - DNA, 148 bp, Artificial Sequence; identical to SEQ ID NO: 2176
  Synthetic polynucleotide

SEQ ID NO: 2178 - DNA, 197 bp, Artificial Sequence
  Synthetic polynucleotide
atcatctcaccttgcctcctgttcgattgggatctttgcctgcagggtgccagcctatgccaacagagtgccagcctatgccaactcggtgccagcctatgccaacgacgtgccagcctatgccaacctagtgccagcctatgccaacactgtgccagcctatgccaactgcggcgcgccatgcttcatcagactct

SEQ ID NO: 2179 - DNA, 197 bp, Artificial Sequence; identical to SEQ ID NO: 2178
  Synthetic polynucleotide

SEQ ID NO: 2180 - DNA, 172 bp, Artificial Sequence
  Synthetic polynucleotide
atcatctcaccttgcctcctgacggccgtcgatctttacctgcaggttgtttacatagattgtttacattcgttgtttacatgacttgtttacatctattgtttacatactttgtttacattgcttgtttacatgtattgtttacatggcgcgccatgcttcatcagactct

SEQ ID NO: 2181 - DNA, 172 bp, Artificial Sequence; identical to SEQ ID NO: 2180
  Synthetic polynucleotide

SEQ ID NO: 2182 - DNA, 185 bp, Artificial Sequence
  Synthetic polynucleotide
atcatctcaccttgcctcctgcctgccgtacacatattcctgcaggctcagccaatcagcgcagactcagccaatcagcgctcgctcagccaatcagcgcgacctcagccaatcagcgcctactcagccaatcagcgcactctcagccaatcagcgctgcggcgcgccatgcttcatcagactct

SEQ ID NO: 2183 - DNA, 185 bp, Artificial Sequence; identical to SEQ ID NO: 2182
  Synthetic polynucleotide

SEQ ID NO: 2184 - DNA, 186 bp, Artificial Sequence
  Synthetic polynucleotide
atcatctcaccttgcctcctgcccttcgtgattgactgcctgcagggtgaccttacataaggtcacagagtgaccttacataaggtcactcggtgaccttacataaggtcacgacgtgaccttacataaggtcacctagtgaccttacataaggtcacactggcgcgccatgcttcatcagactct

SEQ ID NO: 2185 - DNA, 186 bp, Artificial Sequence; identical to SEQ ID NO: 2184
  Synthetic polynucleotide

SEQ ID NO: 2186 - DNA, 191 bp, Artificial Sequence
  Synthetic polynucleotide
atcatctcaccttgcctcctgagttcacgactcgtgagcctgcaggaggtcacggagaggtcaagaaggtcacggagaggtcatcgaggtcacggagaggtcagacaggtcacggagaggtcactaaggtcacggagaggtcaactaggtcacggagaggtcatgcggcgcgccatgcttcatcagactct

SEQ ID NO: 2187 - DNA, 191 bp, Artificial Sequence; identical to SEQ ID NO: 2186
  Synthetic polynucleotide

SEQ ID NO: 2188 - DNA, 156 bp, Artificial Sequence
  Synthetic polynucleotide
atcatctcaccttgcctcctgtaggagcacacttatcacctgcaggctgtttacagactgtttactcgctgtttacgacctgtttacctactgtttacactctgtttactgcctgtttacgtactgtttacggcgcgccatgcttcatcagactct

SEQ ID NO: 2189 - DNA, 156 bp, Artificial Sequence; identical to SEQ ID NO: 2188
  Synthetic polynucleotide

SEQ ID NO: 2190 - DNA, 197 bp, Artificial Sequence
  Synthetic polynucleotide
atcatctcaccttgcctcctggggtggtcgaactagttcctgcagggcgccctctggtggcagagcgccctctggtggctcggcgccctctggtggcgacgcgccctctggtggcctagcgccctctggtggcactgcgccctctggtggctgcgcgccctctggtggcgtaggcgcgccatgcttcatcagactct

SEQ ID NO: 2191 - DNA, 197 bp, Artificial Sequence; identical to SEQ ID NO: 2190
  Synthetic polynucleotide

SEQ ID NO: 2192 - DNA, 172 bp, Artificial Sequence
  Synthetic polynucleotide
atcatctcaccttgcctcctggtactcacaggctttctcctgcaggtgagtgacagagatgagtgacagtcgtgagtgacaggactgagtgacagctatgagtgacagacttgagtgacagtgctgagtgacaggtatgagtgacagggcgcgccatgcttcatcagactct

SEQ ID NO: 2193 - DNA, 172 bp, Artificial Sequence; identical to SEQ ID NO: 2192
  Synthetic polynucleotide

SEQ ID NO: 2194 - DNA, 164 bp, Artificial Sequence
  Synthetic polynucleotide
atcatctcaccttgcctcctgatggcctggctcaattccctgcagggggtatcatagagggtatcattcggggtatcatgacgggtatcatctagggtatcatactgggtatcattgcgggtatcatgtagggtatcatggcgcgccatgcttcatcagactct

SEQ ID NO: 2195 - DNA, 164 bp, Artificial Sequence; identical to SEQ ID NO: 2194
  Synthetic polynucleotide

SEQ ID NO: 2196 - DNA, 191 bp, Artificial Sequence
  Synthetic polynucleotide
atcatctcaccttgcctcctgctttagagttgtggtgtcctgcaggagcagttaataattaaccataagaagcagttaataattaaccatatcgagcagttaataattaaccatagacagcagttaataattaaccatactaagcagttaataattaaccataactggcgcgccatgcttcatcagactct

SEQ ID NO: 2197 - DNA, 191 bp, Artificial Sequence; identical to SEQ ID NO: 2196
  Synthetic polynucleotide

SEQ ID NO: 2198 - DNA, 200 bp, Artificial Sequence
  Synthetic polynucleotide
atcatctcaccttgcctcctgttacactatgttcagcgcctgcagggatgactcatatcgaaactagagatgactcatatcgaaacttcggatgactcatatcgaaactgacgatgactcatatcgaaactctagatgactcatatcgaaactactgatgactcatatcgaaactggcgcgccatgcttcatcagactct

SEQ ID NO: 2199 - DNA, 200 bp, Artificial Sequence; identical to SEQ ID NO: 2198
  Synthetic polynucleotide

SEQ ID NO: 2200 - DNA, 172 bp, Artificial Sequence
  Synthetic polynucleotide
atcatctcaccttgcctcctgaagaagtaaacaggcagcctgcaggataattaataagaataattaatatcgataattaatagacataattaatactaataattaataactataattaatatgcataattaatagtaataattaataggcgcgccatgcttcatcagactct

SEQ ID NO: 2201 - DNA, 172 bp, Artificial Sequence; identical to SEQ ID NO: 2200
  Synthetic polynucleotide

SEQ ID NO: 2202 - DNA, 172 bp, Artificial Sequence
  Synthetic polynucleotide
atcatctcaccttgcctcctggtatactttatcgctgccctgcaggtctcgcgagaagatctcgcgagatcgtctcgcgagagactctcgcgagactatctcgcgagaacttctcgcgagatgctctcgcgagagtatctcgcgagaggcgcgccatgcttcatcagactct

SEQ ID NO: 2203 - DNA, 172 bp, Artificial Sequence; identical to SEQ ID NO: 2202
  Synthetic polynucleotide

SEQ ID NO: 2204 - DNA, 197 bp, Artificial Sequence
  Synthetic polynucleotide
atcatctcaccttgcctcctgcattcagactgccggtgcctgcaggtatcttatcttatctagatatcttatcttatcttcgtatcttatcttatctgactatcttatcttatctctatatcttatcttatctacttatcttatcttatcttgctatcttatcttatctgtaggcgcgccatgcttcatcagactct

SEQ ID NO: 2205 - DNA, 197 bp, Artificial Sequence; identical to SEQ ID NO: 2204
  Synthetic polynucleotide

SEQ ID NO: 2206 - DNA, 164 bp, Artificial Sequence
  Synthetic polynucleotide
atcatctcaccttgcctcctgcatgcggagtatccgaccctgcaggctcaagtggagactcaagtggtcgctcaagtgggacctcaagtggctactcaagtggactctcaagtggtgcctcaagtgggtactcaagtggggcgcgccatgcttcatcagactct

SEQ ID NO: 2207 - DNA, 164 bp, Artificial Sequence; identical to SEQ ID NO: 2206
  Synthetic polynucleotide

SEQ ID NO: 2208 - DNA, 188 bp, Artificial Sequence
  Synthetic polynucleotide
atcatctcaccttgcctcctgaatctccggctagggtccctgcaggcaagacgccttaagacaagacgccttatcgcaagacgccttagaccaagacgccttactacaagacgccttaactcaagacgccttatgccaagacgccttagtacaagacgccttaggcgcgccatgcttcatcagactct

SEQ ID NO: 2209 - DNA, 188 bp, Artificial Sequence; identical to SEQ ID NO: 2208
  Synthetic polynucleotide

SEQ ID NO: 2210 - DNA, 196 bp, Artificial Sequence
  Synthetic polynucleotide
atcatctcaccttgcctcctgtgcgacacgtattgaggcctgcaggctaatttaattaaagactaatttaattaatcgctaatttaattaagacctaatttaattaactactaatttaattaaactctaatttaattaatgcctaatttaattaagtactaatttaattaaggcgcgccatgcttcatcagactct

SEQ ID NO: 2211 - DNA, 196 bp, Artificial Sequence; identical to SEQ ID NO: 2210
  Synthetic polynucleotide

SEQ ID NO: 2212 - DNA, 164 bp, Artificial Sequence
  Synthetic polynucleotide
atcatctcaccttgcctcctgaccatgtcgggtttaaccctgcaggcgctgttaaagacgctgttaatcgcgctgttaagaccgctgttaactacgctgttaaactcgctgttaatgccgctgttaagtacgctgttaaggcgcgccatgcttcatcagactct

SEQ ID NO: 2213 - DNA, 164 bp, Artificial Sequence; identical to SEQ ID NO: 2212
  Synthetic polynucleotide

SEQ ID NO: 2214 - DNA, 156 bp, Artificial Sequence
  Synthetic polynucleotide
atcatctcaccttgcctcctgtccgactagctccggaacctgcaggagaggaagagaagaggaagtcgagaggaaggacagaggaagctaagaggaagactagaggaagtgcagaggaaggtaagaggaagggcgcgccatgcttcatcagactct

SEQ ID NO: 2215 - DNA, 156 bp, Artificial Sequence; identical to SEQ ID NO: 2214
  Synthetic polynucleotide

SEQ ID NO: 2216 - DNA, 172 bp, Artificial Sequence
  Synthetic polynucleotide
atcatctcaccttgcctcctgtttcgctcaggcgatgacctgcagggctcaagtgcagagctcaagtgctcggctcaagtgcgacgctcaagtgcctagctcaagtgcactgctcaagtgctgcgctcaagtgcgtagctcaagtgcggcgcgccatgcttcatcagactct

SEQ ID NO: 2217 - DNA, 172 bp, Artificial Sequence; identical to SEQ ID NO: 2216
  Synthetic polynucleotide

SEQ ID NO: 2218 - DNA, 172 bp, Artificial Sequence
  Synthetic polynucleotide
atcatctcaccttgcctcctgtagtcttcccaagctaccctgcaggggtgccaagtagaggtgccaagttcgggtgccaagtgacggtgccaagtctaggtgccaagtactggtgccaagttgcggtgccaagtgtaggtgccaagtggcgcgccatgcttcatcagactct

SEQ ID NO: 2219 - DNA, 172 bp, Artificial Sequence; identical to SEQ ID NO: 2218
  Synthetic polynucleotide

SEQ ID NO: 2220 - DNA, 164 bp, Artificial Sequence
  Synthetic polynucleotide
atcatctcaccttgcctcctgctatccattcctcttgccctgcaggtcatcagttagatcatcagtttcgtcatcagttgactcatcagttctatcatcagttacttcatcagtttgctcatcagttgtatcatcagttggcgcgccatgcttcatcagactct

SEQ ID NO: 2221 - DNA, 164 bp, Artificial Sequence; identical to SEQ ID NO: 2220
  Synthetic polynucleotide

SEQ ID NO: 2222 - DNA, 172 bp, Artificial Sequence
  Synthetic polynucleotide
atcatctcaccttgcctcctggggaatgagtggcaatacctgcaggattcaaatctagaattcaaatcttcgattcaaatctgacattcaaatctctaattcaaatctactattcaaatcttgcattcaaatctgtaattcaaatctggcgcgccatgcttcatcagactct

SEQ ID NO: 2223 - DNA, 172 bp, Artificial Sequence; identical to SEQ ID NO: 2222
  Synthetic polynucleotide

SEQ ID NO: 2224 - DNA, 197 bp, Artificial Sequence
  Synthetic polynucleotide
atcatctcaccttgcctcctggcgagttggaggaaacccctgcaggtcacccccttgacccagatcacccccttgaccctcgtcacccccttgacccgactcacccccttgacccctatcacccccttgacccacttcacccccttgaccctgctcacccccttgacccgtaggcgcgccatgcttcatcagactct

SEQ ID NO: 2225 - DNA, 197 bp, Artificial Sequence; identical to SEQ ID NO: 2224
  Synthetic polynucleotide

SEQ ID NO: 2226 - DNA, 196 bp, Artificial Sequence
  Synthetic polynucleotide
atcatctcaccttgcctcctgagccttgatcgaacccgcctgcaggctaatttaattagagactaatttaattagtcgctaatttaattaggacctaatttaattagctactaatttaattagactctaatttaattagtgcctaatttaattaggtactaatttaattagggcgcgccatgcttcatcagactct

SEQ ID NO: 2227 - DNA, 196 bp, Artificial Sequence; identical to SEQ ID NO: 2226
  Synthetic polynucleotide

SEQ ID NO: 2228 - DNA, 197 bp, Artificial Sequence
  Synthetic polynucleotide
atcatctcaccttgcctcctgaacgccagatctagtcgcctgcagggggtcaacgagttcaagagggtcaacgagttcatcggggtcaacgagttcagacgggtcaacgagttcactagggtcaacgagttcaactgggtcaacgagttcatgcgggtcaacgagttcagtaggcgcgccatgcttcatcagactct

SEQ ID NO: 2229 - DNA, 197 bp, Artificial Sequence; identical to SEQ ID NO: 2228
  Synthetic polynucleotide

SEQ ID NO: 2230 - DNA, 164 bp, Artificial Sequence
  Synthetic polynucleotide
atcatctcaccttgcctcctgccctaaacttggtcgaacctgcaggaagtttcacagaaagtttcactcgaagtttcacgacaagtttcacctaaagtttcacactaagtttcactgcaagtttcacgtaaagtttcacggcgcgccatgcttcatcagactct

SEQ ID NO: 2231 - DNA, 164 bp, Artificial Sequence; identical to SEQ ID NO: 2230
  Synthetic polynucleotide

SEQ ID NO: 2232 - DNA, 197 bp, Artificial Sequence
  Synthetic polynucleotide
atcatctcaccttgcctcctgtcgtacttacggttgggcctgcaggggttaattattaaccagaggttaattattaacctcgggttaattattaaccgacggttaattattaaccctaggttaattattaaccactggttaattattaacctgcggttaattattaaccgtaggcgcgccatgcttcatcagactct

SEQ ID NO: 2233 - DNA, 197 bp, Artificial Sequence; identical to SEQ ID NO: 2232
  Synthetic polynucleotide

SEQ ID NO: 2234 - DNA, 196 bp, Artificial Sequence
  Synthetic polynucleotide
atcatctcaccttgcctcctgataattccgcacgtgcacctgcaggcgccctctggtggagacgccctctggtggtcgcgccctctggtgggaccgccctctggtggctacgccctctggtggactcgccctctggtggtgccgccctctggtgggtacgccctctggtggggcgcgccatgcttcatcagactct

SEQ ID NO: 2235 - DNA, 196 bp, Artificial Sequence; identical to SEQ ID NO: 2234
  Synthetic polynucleotide

SEQ ID NO: 2236 - DNA, 180 bp, Artificial Sequence
  Synthetic polynucleotide
atcatctcaccttgcctcctgaggtccactaagcgtaccctgcagggtccgccattaagagtccgccattatcggtccgccattagacgtccgccattactagtccgccattaactgtccgccattatgcgtccgccattagtagtccgccattaggcgcgccatgcttcatcagactct

SEQ ID NO: 2237 - DNA, 180 bp, Artificial Sequence; identical to SEQ ID NO: 2236
  Synthetic polynucleotide

SEQ ID NO: 2238 - DNA, 172 bp, Artificial Sequence
  Synthetic polynucleotide
atcatctcaccttgcctcctgatacccaccttacgacccctgcagggttgtgcaatagagttgtgcaattcggttgtgcaatgacgttgtgcaatctagttgtgcaatactgttgtgcaattgcgttgtgcaatgtagttgtgcaatggcgcgccatgcttcatcagactct

SEQ ID NO: 2239 - DNA, 172 bp, Artificial Sequence; identical to SEQ ID NO: 2238
  Synthetic polynucleotide

SEQ ID NO: 2240 - DNA, 180 bp, Artificial Sequence
  Synthetic polynucleotide
atcatctcaccttgcctcctgacgatttcacatcccttcctgcagggggagataagaagagggagataagatcggggagataagagacgggagataagactagggagataagaactgggagataagatgcgggagataagagtagggagataagaggcgcgccatgcttcatcagactct

SEQ ID NO: 2241 - DNA, 180 bp, Artificial Sequence; identical to SEQ ID NO: 2240
  Synthetic polynucleotide

SEQ ID NO: 2242 - DNA, 191 bp, Artificial Sequence
  Synthetic polynucleotide
atcatctcaccttgcctcctgccaatcctgtttcccaccctgcaggtttcgcctggcacgtcaagatttcgcctggcacgtcatcgtttcgcctggcacgtcagactttcgcctggcacgtcactatttcgcctggcacgtcaacttttcgcctggcacgtcatgcggcgcgccatgcttcatcagactct

SEQ ID NO: 2243 - DNA, 191 bp, Artificial Sequence; identical to SEQ ID NO: 2242
  Synthetic polynucleotide

SEQ ID NO: 2244 - DNA, 172 bp, Artificial Sequence
  Synthetic polynucleotide
atcatctcaccttgcctcctgatgacgtctggtatagacctgcaggcgcacgtggcagacgcacgtggctcgcgcacgtggcgaccgcacgtggcctacgcacgtggcactcgcacgtggctgccgcacgtggcgtacgcacgtggcggcgcgccatgcttcatcagactct

SEQ ID NO: 2245 - DNA, 172 bp, Artificial Sequence; identical to SEQ ID NO: 2244
  Synthetic polynucleotide

SEQ ID NO: 2246 - DNA, 164 bp, Artificial Sequence
  Synthetic polynucleotide
atcatctcaccttgcctcctggggacggagaatctgagcctgcaggcatagcaacagacatagcaactcgcatagcaacgaccatagcaacctacatagcaacactcatagcaactgccatagcaacgtacatagcaacggcgcgccatgcttcatcagactct

SEQ ID NO: 2247 - DNA, 164 bp, Artificial Sequence; identical to SEQ ID NO: 2246
  Synthetic polynucleotide

SEQ ID NO: 2248 - DNA, 197 bp, Artificial Sequence
  Synthetic polynucleotide
atcatctcaccttgcctcctggagcagttccatccaatcctgcaggaaccaagatggcggcagaaaccaagatggcggctcgaaccaagatggcggcgacaaccaagatggcggcctaaaccaagatggcggcactaaccaagatggcggctgcaaccaagatggcggcgtaggcgcgccatgcttcatcagactct

SEQ ID NO: 2249 - DNA, 197 bp, Artificial Sequence; identical to SEQ ID NO: 2248
  Synthetic polynucleotide

SEQ ID NO: 2250 - DNA, 197 bp, Artificial Sequence
  Synthetic polynucleotide
atcatctcaccttgcctcctgtattctgcctgagtcggcctgcagggacactgtaacaaaaagagacactgtaacaaaatcggacactgtaacaaaagacgacactgtaacaaaactagacactgtaacaaaaactgacactgtaacaaaatgcgacactgtaacaaaagtaggcgcgccatgcttcatcagactct

SEQ ID NO: 2251 - DNA, 197 bp, Artificial Sequence; identical to SEQ ID NO: 2250
  Synthetic polynucleotide

SEQ ID NO: 2252 - DNA, 190 bp, Artificial Sequence
  Synthetic polynucleotide
atcatctcaccttgcctcctgtatgacgacattgatagcctgcaggttgacctacttataagattgacctacttatatcgttgacctacttatagacttgacctacttatactattgacctacttataactttgacctacttatatgcttgacctacttatagtaggcgcgccatgcttcatcagactct

SEQ ID NO: 2253 - DNA, 190 bp, Artificial Sequence; identical to SEQ ID NO: 2252
  Synthetic polynucleotide

SEQ ID NO: 2254 - DNA, 172 bp, Artificial Sequence
  Synthetic polynucleotide
atcatctcaccttgcctcctgccaagtgtgtccaggtgcctgcagggcgtgggcggagagcgtgggcggtcggcgtgggcgggacgcgtgggcggctagcgtgggcggactgcgtgggcggtgcgcgtgggcgggtagcgtgggcggggcgcgccatgcttcatcagactct

SEQ ID NO: 2255 - DNA, 172 bp, Artificial Sequence; identical to SEQ ID NO: 2254
  Synthetic polynucleotide

SEQ ID NO: 2256 - DNA, 190 bp, Artificial Sequence
  Synthetic polynucleotide
atcatctcaccttgcctcctgctgattcctcgtagtatcctgcagggcacccaagggtgcagagcacccaagggtgctcggcacccaagggtgcgacgcacccaagggtgcctagcacccaagggtgcactgcacccaagggtgctgcgcacccaagggtgcgtaggcgcgccatgcttcatcagactct

SEQ ID NO: 2257 - DNA, 190 bp, Artificial Sequence; identical to SEQ ID NO: 2256
  Synthetic polynucleotide

SEQ ID NO: 2258 - DNA, 172 bp, Artificial Sequence
  Synthetic polynucleotide
atcatctcaccttgcctcctgtgccttattgcgtaagccctgcaggtcgtaaacaaagatcgtaaacaatcgtcgtaaacaagactcgtaaacaactatcgtaaacaaacttcgtaaacaatgctcgtaaacaagtatcgtaaacaaggcgcgccatgcttcatcagactct

SEQ ID NO: 2259 - DNA, 172 bp, Artificial Sequence; identical to SEQ ID NO: 2258
  Synthetic polynucleotide

SEQ ID NO: 2260 - DNA, 180 bp, Artificial Sequence
  Synthetic polynucleotide
atcatctcaccttgcctcctgcgacacgtagagacctccctgcaggggatttccggtagaggatttccggttcgggatttccggtgacggatttccggtctaggatttccggtactggatttccggttgcggatttccggtgtaggatttccggtggcgcgccatgcttcatcagactct

SEQ ID NO: 2261 - DNA, 180 bp, Artificial Sequence; identical to SEQ ID NO: 2260
  Synthetic polynucleotide

SEQ ID NO: 2262 - DNA, 197 bp, Artificial Sequence
  Synthetic polynucleotide
atcatctcaccttgcctcctgcgatagtaccactttagcctgcaggcaaaagtaaacaaagagacaaaagtaaacaaagtcgcaaaagtaaacaaaggaccaaaagtaaacaaagctacaaaagtaaacaaagactcaaaagtaaacaaagtgccaaaagtaaacaaaggtaggcgcgccatgcttcatcagactct

SEQ ID NO: 2263 - DNA, 197 bp, Artificial Sequence; identical to SEQ ID NO: 2262
  Synthetic polynucleotide

SEQ ID NO: 2264 - DNA, 190 bp, Artificial Sequence
  Synthetic polynucleotide
atcatctcaccttgcctcctgcgaattggttcgctagtcctgcaggatgccacgtcatcaagaatgccacgtcatcatcgatgccacgtcatcagacatgccacgtcatcactaatgccacgtcatcaactatgccacgtcatcatgcatgccacgtcatcagtaggcgcgccatgcttcatcagactct

SEQ ID NO: 2265 - DNA, 190 bp, Artificial Sequence; identical to SEQ ID NO: 2264
  Synthetic polynucleotide

SEQ ID NO: 2266 - DNA, 156 bp, Artificial Sequence
  Synthetic polynucleotide
atcatctcaccttgcctcctgcgatacgcattcctgaacctgcaggaataaaaaagaaataaaaatcgaataaaaagacaataaaaactaaataaaaaactaataaaaatgcaataaaaagtaaataaaaaggcgcgccatgcttcatcagactct

SEQ ID NO: 2267 - DNA, 156 bp, Artificial Sequence; identical to SEQ ID NO: 2266
  Synthetic polynucleotide

SEQ ID NO: 2268 - DNA, 188 bp, Artificial Sequence
  Synthetic polynucleotide
atcatctcaccttgcctcctgatgagcgtcaacagtcgcctgcaggatttcctcttatagaatttcctcttattcgatttcctcttatgacatttcctcttatctaatttcctcttatactatttcctcttattgcatttcctcttatgtaatttcctcttatggcgcgccatgcttcatcagactct

SEQ ID NO: 2269 - DNA, 188 bp, Artificial Sequence; identical to SEQ ID NO: 2268
  Synthetic polynucleotide

SEQ ID NO: 2270 - DNA, 180 bp, Artificial Sequence
  Synthetic polynucleotide
atcatctcaccttgcctcctgcacctctgctgactatgcctgcagggtcagcaaattagagtcagcaaatttcggtcagcaaattgacgtcagcaaattctagtcagcaaattactgtcagcaaatttgcgtcagcaaattgtagtcagcaaattggcgcgccatgcttcatcagactct

SEQ ID NO: 2271 - DNA, 180 bp, Artificial Sequence; identical to SEQ ID NO: 2270
  Synthetic polynucleotide

SEQ ID NO: 2272 - DNA, 180 bp, Artificial Sequence
  Synthetic polynucleotide
atcatctcaccttgcctcctggtacagtcctaattccccctgcagggatgagtcaccagagatgagtcacctcggatgagtcaccgacgatgagtcaccctagatgagtcaccactgatgagtcacctgcgatgagtcaccgtagatgagtcaccggcgcgccatgcttcatcagactct

SEQ ID NO: 2273 - DNA, 180 bp, Artificial Sequence; identical to SEQ ID NO: 2272
  Synthetic polynucleotide

SEQ ID NO: 2274 - DNA, 172 bp, Artificial Sequence
  Synthetic polynucleotide
atcatctcaccttgcctcctgctccatccactgtttctcctgcaggtgtccatggtagatgtccatggttcgtgtccatggtgactgtccatggtctatgtccatggtacttgtccatggttgctgtccatggtgtatgtccatggtggcgcgccatgcttcatcagactct

SEQ ID NO: 2275 - DNA, 172 bp, Artificial Sequence; identical to SEQ ID NO: 2274
  Synthetic polynucleotide

SEQ ID NO: 2276 - DNA, 185 bp, Artificial Sequence
  Synthetic polynucleotide
atcatctcaccttgcctcctgtaagacgttctgtgaggcctgcaggaccaagtaattcctagagaaccaagtaattcctagtcgaccaagtaattcctaggacaccaagtaattcctagctaaccaagtaattcctagactaccaagtaattcctagtgcggcgcgccatgcttcatcagactct

SEQ ID NO: 2277 - DNA, 185 bp, Artificial Sequence; identical to SEQ ID NO: 2276
  Synthetic polynucleotide

SEQ ID NO: 2278 - DNA, 191 bp, Artificial Sequence
  Synthetic polynucleotide
atcatctcaccttgcctcctgatgcgttgccatggcaacctgcaggcaaattaattaataaaaagacaaattaattaataaaatcgcaaattaattaataaaagaccaaattaattaataaaactacaaattaattaataaaaactcaaattaattaataaaatgcggcgcgccatgcttcatcagactct

SEQ ID NO: 2279 - DNA, 191 bp, Artificial Sequence; identical to SEQ ID NO: 2278
  Synthetic polynucleotide

SEQ ID NO: 2280 - DNA, 190 bp, Artificial Sequence
  Synthetic polynucleotide
atcatctcaccttgcctcctgcacatagctgcgaatcgcctgcaggatgcattacataacagaatgcattacataactcgatgcattacataacgacatgcattacataacctaatgcattacataacactatgcattacataactgcatgcattacataacgtaggcgcgccatgcttcatcagactct

SEQ ID NO: 2281 - DNA, 190 bp, Artificial Sequence; identical to SEQ ID NO: 2280
  Synthetic polynucleotide

SEQ ID NO: 2282 - DNA, 148 bp, Artificial Sequence
  Synthetic polynucleotide
atcatctcaccttgcctcctgatttccgccttgagccccctgcaggagcaaacagaagcaaactcgagcaaacgacagcaaacctaagcaaacactagcaaactgcagcaaacgtaagcaaacggcgcgccatgcttcatcagactct

SEQ ID NO: 2283 - DNA, 148 bp, Artificial Sequence; identical to SEQ ID NO: 2282
  Synthetic polynucleotide

SEQ ID NO: 2284 - DNA, 190 bp, Artificial Sequence
  Synthetic polynucleotide
atcatctcaccttgcctcctggatggcaactcttactccctgcaggtggggtttgtggttagatggggtttgtggtttcgtggggtttgtggttgactggggtttgtggttctatggggtttgtggttacttggggtttgtggtttgctggggtttgtggttgtaggcgcgccatgcttcatcagactct

SEQ ID NO: 2285 - DNA, 190 bp, Artificial Sequence; identical to SEQ ID NO: 2284
  Synthetic polynucleotide

SEQ ID NO: 2286 - DNA, 197 bp, Artificial Sequence
  Synthetic polynucleotide
atcatctcaccttgcctcctgcttgcaacttcgacgcgcctgcaggctggccatatatggcagactggccatatatggctcgctggccatatatggcgacctggccatatatggcctactggccatatatggcactctggccatatatggctgcctggccatatatggcgtaggcgcgccatgcttcatcagactct

SEQ ID NO: 2287 - DNA, 197 bp, Artificial Sequence; identical to SEQ ID NO: 2286
  Synthetic polynucleotide

SEQ ID NO: 2288 - DNA, 180 bp, Artificial Sequence
  Synthetic polynucleotide
atcatctcaccttgcctcctggggtcaaagtgatgcgacctgcaggctgagtaaacaagactgagtaaacatcgctgagtaaacagacctgagtaaacactactgagtaaacaactctgagtaaacatgcctgagtaaacagtactgagtaaacaggcgcgccatgcttcatcagactct

SEQ ID NO: 2289 - DNA, 180 bp, Artificial Sequence; identical to SEQ ID NO: 2288
  Synthetic polynucleotide

SEQ ID NO: 2290 - DNA, 188 bp, Artificial Sequence
  Synthetic polynucleotide
atcatctcaccttgcctcctgcccttctcagagcacaacctgcaggcggaggaatgtgagacggaggaatgtgtcgcggaggaatgtggaccggaggaatgtgctacggaggaatgtgactcggaggaatgtgtgccggaggaatgtggtacggaggaatgtgggcgcgccatgcttcatcagactct

SEQ ID NO: 2291 - DNA, 188 bp, Artificial Sequence; identical to SEQ ID NO: 2290
  Synthetic polynucleotide

SEQ ID NO: 2292 - DNA, 180 bp, Artificial Sequence
  Synthetic polynucleotide
atcatctcaccttgcctcctgctcaggcacaagagtgtcctgcaggttatgtaacatagattatgtaacattcgttatgtaacatgacttatgtaacatctattatgtaacatactttatgtaacattgcttatgtaacatgtattatgtaacatggcgcgccatgcttcatcagactct

SEQ ID NO: 2293 - DNA, 180 bp, Artificial Sequence; identical to SEQ ID NO: 2292
  Synthetic polynucleotide

SEQ ID NO: 2294 - DNA, 191 bp, Artificial Sequence
  Synthetic polynucleotide
atcatctcaccttgcctcctgcaatggtcagttatcgtcctgcaggtttggccactagggggcactaagatttggccactagggggcactatcgtttggccactagggggcactagactttggccactagggggcactactatttggccactagggggcactaactggcgcgccatgcttcatcagactct

SEQ ID NO: 2295 - DNA, 191 bp, Artificial Sequence; identical to SEQ ID NO: 2294
  Synthetic polynucleotide

SEQ ID NO: 2296 - DNA, 197 bp, Artificial Sequence
  Synthetic polynucleotide
atcatctcaccttgcctcctgaatcattgggtgtctttcctgcaggcattttggcgccatttttagacattttggcgccattttttcgcattttggcgccatttttgaccattttggcgccatttttctacattttggcgccatttttactcattttggcgccattttttgcggcgcgccatgcttcatcagactct

SEQ ID NO: 2297 - DNA, 197 bp, Artificial Sequence; identical to SEQ ID NO: 2296
  Synthetic polynucleotide

SEQ ID NO: 2298 - DNA, 172 bp, Artificial Sequence
  Synthetic polynucleotide
atcatctcaccttgcctcctgtcttcgtcctattcgcgcctgcaggtttccgggaaagatttccgggaatcgtttccgggaagactttccgggaactatttccgggaaacttttccgggaatgctttccgggaagtatttccgggaaggcgcgccatgcttcatcagactct

SEQ ID NO: 2299 - DNA, 172 bp, Artificial Sequence; identical to SEQ ID NO: 2298
  Synthetic polynucleotide

SEQ ID NO: 2300 - DNA, 164 bp, Artificial Sequence
  Synthetic polynucleotide
atcatctcaccttgcctcctgaggagtcgggtagactgcctgcaggaccagcaggagaaccagcaggtcgaccagcagggacaccagcaggctaaccagcaggactaccagcaggtgcaccagcagggtaaccagcaggggcgcgccatgcttcatcagactct

SEQ ID NO: 2301 - DNA, 164 bp, Artificial Sequence; identical to SEQ ID NO: 2300
  Synthetic polynucleotide

SEQ ID NO: 2302 - DNA, 188 bp, Artificial Sequence
  Synthetic polynucleotide
atcatctcaccttgcctcctggagtgcatgggtcattgcctgcagggaccccccgctgagagaccccccgctgtcggaccccccgctggacgaccccccgctgctagaccccccgctgactgaccccccgctgtgcgaccccccgctggtagaccccccgctgggcgcgccatgcttcatcagactct

SEQ ID NO: 2303 - DNA, 188 bp, Artificial Sequence; identical to SEQ ID NO: 2302
  Synthetic polynucleotide

SEQ ID NO: 2304 - DNA, 156 bp, Artificial Sequence
  Synthetic polynucleotide
atcatctcaccttgcctcctgctttgagcccttcacttcctgcaggtaattggtagataattggttcgtaattggtgactaattggtctataattggtacttaattggttgctaattggtgtataattggtggcgcgccatgcttcatcagactct

SEQ ID NO: 2305 - DNA, 156 bp, Artificial Sequence; identical to SEQ ID NO: 2304
  Synthetic polynucleotide

SEQ ID NO: 2306 - DNA, 172 bp, Artificial Sequence
  Synthetic polynucleotide
atcatctcaccttgcctcctgtttggatttgtacttcgcctgcaggcccgccccttagacccgcccctttcgcccgccccttgaccccgccccttctacccgccccttactcccgcccctttgccccgccccttgtacccgccccttggcgcgccatgcttcatcagactct

SEQ ID NO: 2307 - DNA, 172 bp, Artificial Sequence; identical to SEQ ID NO: 2306
  Synthetic polynucleotide

SEQ ID NO: 2308 - DNA, 186 bp, Artificial Sequence
  Synthetic polynucleotide
atcatctcaccttgcctcctgagagaccaatagactgacctgcaggcatttccgaattgggaaacaagacatttccgaattgggaaacatcgcatttccgaattgggaaacagaccatttccgaattgggaaacactacatttccgaattgggaaacaactggcgcgccatgcttcatcagactct

SEQ ID NO: 2309 - DNA, 186 bp, Artificial Sequence; identical to SEQ ID NO: 2308
  Synthetic polynucleotide

SEQ ID NO: 2310 - DNA, 197 bp, Artificial Sequence
  Synthetic polynucleotide
atcatctcaccttgcctcctgtttgcgtttacttcaaccctgcaggaaaggtcatgtgaggtcaagaaaaggtcatgtgaggtcatcgaaaggtcatgtgaggtcagacaaaggtcatgtgaggtcactaaaaggtcatgtgaggtcaactaaaggtcatgtgaggtcatgcggcgcgccatgcttcatcagactct

SEQ ID NO: 2311 - DNA, 197 bp, Artificial Sequence; identical to SEQ ID NO: 2310
  Synthetic polynucleotide

SEQ ID NO: 2312 - DNA, 190 bp, Artificial Sequence
  Synthetic polynucleotide
atcatctcaccttgcctcctgtacgtctttaccctcagcctgcaggggcagcgggtgcagagaggcagcgggtgcagtcgggcagcgggtgcaggacggcagcgggtgcagctaggcagcgggtgcagactggcagcgggtgcagtgcggcagcgggtgcaggtaggcgcgccatgcttcatcagactct

SEQ ID NO: 2313 - DNA, 190 bp, Artificial Sequence; identical to SEQ ID NO: 2312
  Synthetic polynucleotide

SEQ ID NO: 2314 - DNA, 172 bp, Artificial Sequence
  Synthetic polynucleotide
atcatctcaccttgcctcctgtattcgcactcatccgtcctgcagggcccataaaaagagcccataaaatcggcccataaaagacgcccataaaactagcccataaaaactgcccataaaatgcgcccataaaagtagcccataaaaggcgcgccatgcttcatcagactct

SEQ ID NO: 2315 - DNA, 172 bp, Artificial Sequence; identical to SEQ ID NO: 2314
  Synthetic polynucleotide

SEQ ID NO: 2316 - DNA, 164 bp, Artificial Sequence
  Synthetic polynucleotide
atcatctcaccttgcctcctgagagttcttgtgtagaacctgcaggtaaccctagagataaccctagtcgtaaccctaggactaaccctagctataaccctagacttaaccctagtgctaaccctaggtataaccctagggcgcgccatgcttcatcagactct

SEQ ID NO: 2317 - DNA, 164 bp, Artificial Sequence; identical to SEQ ID NO: 2316
  Synthetic polynucleotide

SEQ ID NO: 2318 - DNA, 191 bp, Artificial Sequence
  Synthetic polynucleotide
atcatctcaccttgcctcctggtcggtaagaagctggacctgcaggcgaacagtgctcactatagacgaacagtgctcactattcgcgaacagtgctcactatgaccgaacagtgctcactatctacgaacagtgctcactatactcgaacagtgctcactattgcggcgcgccatgcttcatcagactct

SEQ ID NO: 2319 - DNA, 191 bp, Artificial Sequence; identical to SEQ ID NO: 2318
  Synthetic polynucleotide

SEQ ID NO: 2320 - DNA, 185 bp, Artificial Sequence
  Synthetic polynucleotide
atcatctcaccttgcctcctgagttgaatttgcgtcgccctgcaggcgccactaattagtacagacgccactaattagtactcgcgccactaattagtacgaccgccactaattagtacctacgccactaattagtacactcgccactaattagtactgcggcgcgccatgcttcatcagactct

SEQ ID NO: 2321 - DNA, 185 bp, Artificial Sequence; identical to SEQ ID NO: 2320
  Synthetic polynucleotide

SEQ ID NO: 2322 - DNA, 185 bp, Artificial Sequence
  Synthetic polynucleotide
atcatctcaccttgcctcctgatctatgagttcgtatgcctgcaggcatttagcagcaattaagacatttagcagcaattatcgcatttagcagcaattagaccatttagcagcaattactacatttagcagcaattaactcatttagcagcaattatgcggcgcgccatgcttcatcagactct

SEQ ID NO: 2323 - DNA, 185 bp, Artificial Sequence; identical to SEQ ID NO: 2322
  Synthetic polynucleotide

SEQ ID NO: 2324 - DNA, 197 bp, Artificial Sequence
  Synthetic polynucleotide
atcatctcaccttgcctcctggtagccaacagagctggcctgcaggccactagatggcactagaccactagatggcacttcgccactagatggcactgacccactagatggcactctaccactagatggcactactccactagatggcacttgcccactagatggcactgtaggcgcgccatgcttcatcagactct

SEQ ID NO: 2325 - DNA, 197 bp, Artificial Sequence; identical to SEQ ID NO: 2324
  Synthetic polynucleotide

SEQ ID NO: 2326 - DNA, 190 bp, Artificial Sequence
  Synthetic polynucleotide
atcatctcaccttgcctcctgtctgggaagcatagagtcctgcaggggggtggtttggggagaggggtggtttggggtcgggggtggtttgggggacggggtggtttggggctaggggtggtttggggactggggtggtttggggtgcggggtggtttgggggtaggcgcgccatgcttcatcagactct

SEQ ID NO: 2327 - DNA, 190 bp, Artificial Sequence; identical to SEQ ID NO: 2326
  Synthetic polynucleotide

SEQ ID NO: 2328 - DNA, 172 bp, Artificial Sequence
  Synthetic polynucleotide
atcatctcaccttgcctcctggcccttcgttcaacattcctgcaggcctcctccccagacctcctcccctcgcctcctccccgaccctcctccccctacctcctccccactcctcctcccctgccctcctccccgtacctcctccccggcgcgccatgcttcatcagactct

SEQ ID NO: 2329 - DNA, 172 bp, Artificial Sequence; identical to SEQ ID NO: 2328
  Synthetic polynucleotide

SEQ ID NO: 2330 - DNA, 197 bp, Artificial Sequence
  Synthetic polynucleotide
atcatctcaccttgcctcctgttgatgactcatcgttacctgcaggccccgggcttgcgtgagaagaccccgggcttgcgtgagatcgccccgggcttgcgtgagagacccccgggcttgcgtgagactaccccgggcttgcgtgagaactccccgggcttgcgtgagatgcggcgcgccatgcttcatcagactct

SEQ ID NO: 2331 - DNA, 197 bp, Artificial Sequence; identical to SEQ ID NO: 2330
  Synthetic polynucleotide

SEQ ID NO: 2332 - DNA, 172 bp, Artificial Sequence
  Synthetic polynucleotide
atcatctcaccttgcctcctgttctttggagctacgggcctgcaggatgtgcacatagaatgtgcacattcgatgtgcacatgacatgtgcacatctaatgtgcacatactatgtgcacattgcatgtgcacatgtaatgtgcacatggcgcgccatgcttcatcagactct

SEQ ID NO: 2333 - DNA, 172 bp, Artificial Sequence; identical to SEQ ID NO: 2332
  Synthetic polynucleotide

SEQ ID NO: 2334 - DNA, 164 bp, Artificial Sequence
  Synthetic polynucleotide
atcatctcaccttgcctcctgagagacatgaatgcgaacctgcaggccaattaggagaccaattaggtcgccaattagggacccaattaggctaccaattaggactccaattaggtgcccaattagggtaccaattaggggcgcgccatgcttcatcagactct

SEQ ID NO: 2335 - DNA, 164 bp, Artificial Sequence; identical to SEQ ID NO: 2334
  Synthetic polynucleotide

SEQ ID NO: 2336 - DNA, 185 bp, Artificial Sequence
  Synthetic polynucleotide
atcatctcaccttgcctcctgctatcacggccgtactacctgcaggccgatgacgtcatcccagaccgatgacgtcatccctcgccgatgacgtcatcccgacccgatgacgtcatcccctaccgatgacgtcatcccactccgatgacgtcatccctgcggcgcgccatgcttcatcagactct

SEQ ID NO: 2337 - DNA, 185 bp, Artificial Sequence; identical to SEQ ID NO: 2336
  Synthetic polynucleotide

SEQ ID NO: 2338 - DNA, 164 bp, Artificial Sequence
  Synthetic polynucleotide
atcatctcaccttgcctcctgataatgggactcttgcgcctgcaggtaattaaaaagataattaaaatcgtaattaaaagactaattaaaactataattaaaaacttaattaaaatgctaattaaaagtataattaaaaggcgcgccatgcttcatcagactct

SEQ ID NO: 2339 - DNA, 164 bp, Artificial Sequence; identical to SEQ ID NO: 2338
  Synthetic polynucleotide

SEQ ID NO: 2340 - DNA, 197 bp, Artificial Sequence
  Synthetic polynucleotide
atcatctcaccttgcctcctgtcctatacgaattggtccctgcaggttctatttttagcatagattctatttttagcattcgttctatttttagcatgacttctatttttagcatctattctatttttagcatactttctatttttagcattgcttctatttttagcatgtaggcgcgccatgcttcatcagactct

SEQ ID NO: 2341 - DNA, 197 bp, Artificial Sequence; identical to SEQ ID NO: 2340
  Synthetic polynucleotide

SEQ ID NO: 2342 - DNA, 197 bp, Artificial Sequence
  Synthetic polynucleotide
atcatctcaccttgcctcctgacgttgatccataaccgcctgcaggcggtgactcatccttagacggtgactcatcctttcgcggtgactcatccttgaccggtgactcatccttctacggtgactcatccttactcggtgactcatcctttgccggtgactcatccttgtaggcgcgccatgcttcatcagactct

SEQ ID NO: 2343 - DNA, 197 bp, Artificial Sequence; identical to SEQ ID NO: 2342
  Synthetic polynucleotide

SEQ ID NO: 2344 - DNA, 148 bp, Artificial Sequence
  Synthetic polynucleotide
atcatctcaccttgcctcctgcaccatcacttatgtcacctgcaggcaattacagacaattactcgcaattacgaccaattacctacaattacactcaattactgccaattacgtacaattacggcgcgccatgcttcatcagactct

SEQ ID NO: 2345 - DNA, 148 bp, Artificial Sequence; identical to SEQ ID NO: 2344
  Synthetic polynucleotide

SEQ ID NO: 2346 - DNA, 164 bp, Artificial Sequence
  Synthetic polynucleotide
atcatctcaccttgcctcctgagagaagatgaagttcacctgcaggccaattagcagaccaattagctcgccaattagcgacccaattagcctaccaattagcactccaattagctgcccaattagcgtaccaattagcggcgcgccatgcttcatcagactct

SEQ ID NO: 2347 - DNA, 164 bp, Artificial Sequence; identical to SEQ ID NO: 2346
  Synthetic polynucleotide

SEQ ID NO: 2348 - DNA, 148 bp, Artificial Sequence
  Synthetic polynucleotide
atcatctcaccttgcctcctgacaaagtattacgctcgcctgcaggcaattaaagacaattaatcgcaattaagaccaattaactacaattaaactcaattaatgccaattaagtacaattaaggcgcgccatgcttcatcagactct

SEQ ID NO: 2349 - DNA, 148 bp, Artificial Sequence; identical to SEQ ID NO: 2348
  Synthetic polynucleotide

SEQ ID NO: 2350 - DNA, 172 bp, Artificial Sequence
  Synthetic polynucleotide
atcatctcaccttgcctcctgggtttatgtgtcctcgccctgcaggaccatatgttagaaccatatgtttcgaccatatgttgacaccatatgttctaaccatatgttactaccatatgtttgcaccatatgttgtaaccatatgttggcgcgccatgcttcatcagactct

SEQ ID NO: 2351 - DNA, 172 bp, Artificial Sequence; identical to SEQ ID NO: 2350
  Synthetic polynucleotide

SEQ ID NO: 2352 - DNA, 188 bp, Artificial Sequence
  Synthetic polynucleotide
atcatctcaccttgcctcctgcactctggctgattgaccctgcagggtctttctagaaagagtctttctagaatcggtctttctagaagacgtctttctagaactagtctttctagaaactgtctttctagaatgcgtctttctagaagtagtctttctagaaggcgcgccatgcttcatcagactct

SEQ ID NO: 2353 - DNA, 188 bp, Artificial Sequence; identical to SEQ ID NO: 2352
  Synthetic polynucleotide

SEQ ID NO: 2354 - DNA, 188 bp, Artificial Sequence
  Synthetic polynucleotide
atcatctcaccttgcctcctgatacgcgtccacacctccctgcaggaatattcaacagagaaatattcaacagtcgaatattcaacaggacaatattcaacagctaaatattcaacagactaatattcaacagtgcaatattcaacaggtaaatattcaacagggcgcgccatgcttcatcagactct

SEQ ID NO: 2355 - DNA, 188 bp, Artificial Sequence; identical to SEQ ID NO: 2354
  Synthetic polynucleotide

SEQ ID NO: 2356 - DNA, 197 bp, Artificial Sequence
  Synthetic polynucleotide
atcatctcaccttgcctcctgtgagtcaacattgggcccctgcagggtgacctttgcccccagagtgacctttgccccctcggtgacctttgcccccgacgtgacctttgcccccctagtgacctttgcccccactgtgacctttgccccctgcgtgacctttgcccccgtaggcgcgccatgcttcatcagactct

SEQ ID NO: 2357 - DNA, 197 bp, Artificial Sequence; identical to SEQ ID NO: 2356
  Synthetic polynucleotide

SEQ ID NO: 2358 - DNA, 197 bp, Artificial Sequence
  Synthetic polynucleotide
atcatctcaccttgcctcctgtcacctaatcgcgagatcctgcaggcccacttcctgtctcagacccacttcctgtctctcgcccacttcctgtctcgaccccacttcctgtctcctacccacttcctgtctcactcccacttcctgtctctgccccacttcctgtctcgtaggcgcgccatgcttcatcagactct

SEQ ID NO: 2359 - DNA, 197 bp, Artificial Sequence; identical to SEQ ID NO: 2358
  Synthetic polynucleotide

SEQ ID NO: 2360 - DNA, 185 bp, Artificial Sequence
  Synthetic polynucleotide
atcatctcaccttgcctcctggcactgattcggacctccctgcaggcgctgtccatggtgctagacgctgtccatggtgcttcgcgctgtccatggtgctgaccgctgtccatggtgctctacgctgtccatggtgctactcgctgtccatggtgcttgcggcgcgccatgcttcatcagactct

SEQ ID NO: 2361 - DNA, 185 bp, Artificial Sequence; identical to SEQ ID NO: 2360
  Synthetic polynucleotide

SEQ ID NO: 2362 - DNA, 191 bp, Artificial Sequence
  Synthetic polynucleotide
atcatctcaccttgcctcctgtccgttgtgtaagcactcctgcaggagcgctaattagcgattagaagcgctaattagcgatttcgagcgctaattagcgattgacagcgctaattagcgattctaagcgctaattagcgattactagcgctaattagcgatttgcggcgcgccatgcttcatcagactct

SEQ ID NO: 2363 - DNA, 191 bp, Artificial Sequence; identical to SEQ ID NO: 2362
  Synthetic polynucleotide

SEQ ID NO: 2364 - DNA, 185 bp, Artificial Sequence
  Synthetic polynucleotide
atcatctcaccttgcctcctggtaccctgactgtgaggcctgcaggaagaacatcctgttccagaaagaacatcctgttcctcgaagaacatcctgttccgacaagaacatcctgttccctaaagaacatcctgttccactaagaacatcctgttcctgcggcgcgccatgcttcatcagactct

SEQ ID NO: 2365 - DNA, 185 bp, Artificial Sequence; identical to SEQ ID NO: 2364
  Synthetic polynucleotide

SEQ ID NO: 2366 - DNA, 148 bp, Artificial Sequence
  Synthetic polynucleotide
atcatctcaccttgcctcctggccagtctgctttggaacctgcaggcaattagagacaattagtcgcaattaggaccaattagctacaattagactcaattagtgccaattaggtacaattagggcgcgccatgcttcatcagactct

SEQ ID NO: 2367 - DNA, 148 bp, Artificial Sequence; identical to SEQ ID NO: 2366
  Synthetic polynucleotide

SEQ ID NO: 2368 - DNA, 190 bp, Artificial Sequence
  Synthetic polynucleotide
atcatctcaccttgcctcctgcaagcatggctttcccgcctgcaggcacattcctgcgccagacacattcctgcgcctcgcacattcctgcgccgaccacattcctgcgccctacacattcctgcgccactcacattcctgcgcctgccacattcctgcgccgtaggcgcgccatgcttcatcagactct

SEQ ID NO: 2369 - DNA, 190 bp, Artificial Sequence; identical to SEQ ID NO: 2368
  Synthetic polynucleotide

SEQ ID NO: 2370 - DNA, 156 bp, Artificial Sequence
  Synthetic polynucleotide
atcatctcaccttgcctcctgaaagtacctatcagccacctgcaggtgaaacttagatgaaactttcgtgaaacttgactgaaacttctatgaaacttacttgaaactttgctgaaacttgtatgaaacttggcgcgccatgcttcatcagactct

SEQ ID NO: 2371 - DNA, 156 bp, Artificial Sequence; identical to SEQ ID NO: 2370
  Synthetic polynucleotide

SEQ ID NO: 2372 - DNA, 164 bp, Artificial Sequence
  Synthetic polynucleotide
atcatctcaccttgcctcctgccctaatagttagcggacctgcaggactcaccacagaactcaccactcgactcaccacgacactcaccacctaactcaccacactactcaccactgcactcaccacgtaactcaccacggcgcgccatgcttcatcagactct

SEQ ID NO: 2373 - DNA, 164 bp, Artificial Sequence; identical to SEQ ID NO: 2372
  Synthetic polynucleotide

SEQ ID NO: 2374 - DNA, 164 bp, Artificial Sequence
  Synthetic polynucleotide
atcatctcaccttgcctcctggtgatctccgggtgtatcctgcaggtttgtttacagatttgtttactcgtttgtttacgactttgtttacctatttgtttacacttttgtttactgctttgtttacgtatttgtttacggcgcgccatgcttcatcagactct

SEQ ID NO: 2375 - DNA, 164 bp, Artificial Sequence; identical to SEQ ID NO: 2374
  Synthetic polynucleotide

SEQ ID NO: 2376 - DNA, 164 bp, Artificial Sequence
  Synthetic polynucleotide
atcatctcaccttgcctcctgagcgggctaaggtgatgcctgcaggacttccggtagaacttccggttcgacttccggtgacacttccggtctaacttccggtactacttccggttgcacttccggtgtaacttccggtggcgcgccatgcttcatcagactct

SEQ ID NO: 2377 - DNA, 164 bp, Artificial Sequence; identical to SEQ ID NO: 2376
  Synthetic polynucleotide

SEQ ID NO: 2378 - DNA, 196 bp, Artificial Sequence
  Synthetic polynucleotide
atcatctcaccttgcctcctggtctacctcactaagagcctgcaggataattaaattaaagaataattaaattaatcgataattaaattaagacataattaaattaactaataattaaattaaactataattaaattaatgcataattaaattaagtaataattaaattaaggcgcgccatgcttcatcagactct

SEQ ID NO: 2379 - DNA, 196 bp, Artificial Sequence; identical to SEQ ID NO: 2378
  Synthetic polynucleotide

SEQ ID NO: 2380 - DNA, 180 bp, Artificial Sequence
  Synthetic polynucleotide
atcatctcaccttgcctcctggttgtagctgcgtctggcctgcaggaccgtgacctgagaaccgtgacctgtcgaccgtgacctggacaccgtgacctgctaaccgtgacctgactaccgtgacctgtgcaccgtgacctggtaaccgtgacctgggcgcgccatgcttcatcagactct

SEQ ID NO: 2381 - DNA, 180 bp, Artificial Sequence; identical to SEQ ID NO: 2380
  Synthetic polynucleotide

SEQ ID NO: 2382 - DNA, 188 bp, Artificial Sequence
  Synthetic polynucleotide
atcatctcaccttgcctcctggtacgatgggcagtaagcctgcagggaaaatgaaactagagaaaatgaaacttcggaaaatgaaactgacgaaaatgaaactctagaaaatgaaactactgaaaatgaaacttgcgaaaatgaaactgtagaaaatgaaactggcgcgccatgcttcatcagactct

SEQ ID NO: 2383 - DNA, 188 bp, Artificial Sequence; identical to SEQ ID NO: 2382
  Synthetic polynucleotide

SEQ ID NO: 2384 - DNA, 196 bp, Artificial Sequence
  Synthetic polynucleotide
atcatctcaccttgcctcctgcacgagataaggatcttcctgcaggaatttatgtaataagaaatttatgtaatatcgaatttatgtaatagacaatttatgtaatactaaatttatgtaataactaatttatgtaatatgcaatttatgtaatagtaaatttatgtaataggcgcgccatgcttcatcagactct

SEQ ID NO: 2385 - DNA, 196 bp, Artificial Sequence; identical to SEQ ID NO: 2384
  Synthetic polynucleotide

SEQ ID NO: 2386 - DNA, 172 bp, Artificial Sequence
  Synthetic polynucleotide
atcatctcaccttgcctcctgcgtacacggatgcgcaacctgcagggcgcgtgcgcagagcgcgtgcgctcggcgcgtgcgcgacgcgcgtgcgcctagcgcgtgcgcactgcgcgtgcgctgcgcgcgtgcgcgtagcgcgtgcgcggcgcgccatgcttcatcagactct

SEQ ID NO: 2387 - DNA, 172 bp, Artificial Sequence; identical to SEQ ID NO: 2386
  Synthetic polynucleotide

SEQ ID NO: 2388 - DNA, 197 bp, Artificial Sequence
  Synthetic polynucleotide
atcatctcaccttgcctcctggactagccaccaggtagcctgcagggccgccatcttgggtagagccgccatcttgggttcggccgccatcttgggtgacgccgccatcttgggtctagccgccatcttgggtactgccgccatcttgggttgcgccgccatcttgggtgtaggcgcgccatgcttcatcagactct

SEQ ID NO: 2389 - DNA, 197 bp, Artificial Sequence; identical to SEQ ID NO: 2388
  Synthetic polynucleotide

SEQ ID NO: 2390 - DNA, 191 bp, Artificial Sequence
  Synthetic polynucleotide
atcatctcaccttgcctcctgtcaatctgacgggtagacctgcaggcatcaataacattgatcagacatcaataacattgatctcgcatcaataacattgatcgaccatcaataacattgatcctacatcaataacattgatcactcatcaataacattgatctgcggcgcgccatgcttcatcagactct

SEQ ID NO: 2391 - DNA, 191 bp, Artificial Sequence; identical to SEQ ID NO: 2390
  Synthetic polynucleotide

SEQ ID NO: 2392 - DNA, 197 bp, Artificial Sequence
  Synthetic polynucleotide
atcatctcaccttgcctcctgcgcaccttaatccgatacctgcaggtacgcgcgaaaactgagatacgcgcgaaaactgtcgtacgcgcgaaaactggactacgcgcgaaaactgctatacgcgcgaaaactgacttacgcgcgaaaactgtgctacgcgcgaaaactggtaggcgcgccatgcttcatcagactct

SEQ ID NO: 2393 - DNA, 197 bp, Artificial Sequence; identical to SEQ ID NO: 2392
  Synthetic polynucleotide

SEQ ID NO: 2394 - DNA, 191 bp, Artificial Sequence
  Synthetic polynucleotide
atcatctcaccttgcctcctgagatatacagctgacgacctgcaggcatttaagtacttagtaagacatttaagtacttagtatcgcatttaagtacttagtagaccatttaagtacttagtactacatttaagtacttagtaactcatttaagtacttagtatgcggcgcgccatgcttcatcagactct

SEQ ID NO: 2395 - DNA, 191 bp, Artificial Sequence; identical to SEQ ID NO: 2394
  Synthetic polynucleotide

SEQ ID NO: 2396 - DNA, 132 bp, Artificial Sequence
  Synthetic polynucleotide
atcatctcaccttgcctcctgttgtgtataacgctgggcctgcaggtgtttagatgttttcgtgtttgactgtttctatgtttacttgttttgctgtttgtatgtttggcgcgccatgcttcatcagactct

SEQ ID NO: 2397 - DNA, 132 bp, Artificial Sequence; identical to SEQ ID NO: 2396
  Synthetic polynucleotide

SEQ ID NO: 2398 - DNA, 172 bp, Artificial Sequence
  Synthetic polynucleotide
atcatctcaccttgcctcctgctgacgtagaagattaccctgcaggcaaaggtcagagacaaaggtcagtcgcaaaggtcaggaccaaaggtcagctacaaaggtcagactcaaaggtcagtgccaaaggtcaggtacaaaggtcagggcgcgccatgcttcatcagactct

SEQ ID NO: 2399 - DNA, 172 bp, Artificial Sequence; identical to SEQ ID NO: 2398
  Synthetic polynucleotide

SEQ ID NO: 2400 - DNA, 197 bp, Artificial Sequence
  Synthetic polynucleotide
atcatctcaccttgcctcctgtcgttactctaacgaaacctgcaggtggccccagggcatgagatggccccagggcatgtcgtggccccagggcatggactggccccagggcatgctatggccccagggcatgacttggccccagggcatgtgctggccccagggcatggtaggcgcgccatgcttcatcagactct

SEQ ID NO: 2401 - DNA, 197 bp, Artificial Sequence; identical to SEQ ID NO: 2400
  Synthetic polynucleotide

SEQ ID NO: 2402 - DNA, 185 bp, Artificial Sequence
  Synthetic polynucleotide
atcatctcaccttgcctcctgtactatctggagacgtgcctgcagggagttcattgagttcaagagagttcattgagttcatcggagttcattgagttcagacgagttcattgagttcactagagttcattgagttcaactgagttcattgagttcatgcggcgcgccatgcttcatcagactct

SEQ ID NO: 2403 - DNA, 185 bp, Artificial Sequence; identical to SEQ ID NO: 2402
  Synthetic polynucleotide

SEQ ID NO: 2404 - DNA, 188 bp, Artificial Sequence
  Synthetic polynucleotide
atcatctcaccttgcctcctgtatctcaaacgtaacgtcctgcaggtttgattgatgtagatttgattgatgttcgtttgattgatgtgactttgattgatgtctatttgattgatgtacttttgattgatgttgctttgattgatgtgtatttgattgatgtggcgcgccatgcttcatcagactct

SEQ ID NO: 2405 - DNA, 188 bp, Artificial Sequence; identical to SEQ ID NO: 2404
  Synthetic polynucleotide

SEQ ID NO: 2406 - DNA, 197 bp, Artificial Sequence
  Synthetic polynucleotide
atcatctcaccttgcctcctgtcacgttgatatgacgacctgcaggaccggaagtacatccggtagaaccggaagtacatccggttcgaccggaagtacatccggtgacaccggaagtacatccggtctaaccggaagtacatccggtactaccggaagtacatccggttgcggcgcgccatgcttcatcagactct

SEQ ID NO: 2407 - DNA, 197 bp, Artificial Sequence; identical to SEQ ID NO: 2406
  Synthetic polynucleotide

SEQ ID NO: 2408 - DNA, 185 bp, Artificial Sequence
  Synthetic polynucleotide
atcatctcaccttgcctcctgatatcgacggctaaaggcctgcaggaactagctgtcaatacagaaactagctgtcaatactcgaactagctgtcaatacgacaactagctgtcaatacctaaactagctgtcaatacactaactagctgtcaatactgcggcgcgccatgcttcatcagactct

SEQ ID NO: 2409 - DNA, 185 bp, Artificial Sequence; identical to SEQ ID NO: 2408
  Synthetic polynucleotide

SEQ ID NO: 2410 - DNA, 190 bp, Artificial Sequence
  Synthetic polynucleotide
atcatctcaccttgcctcctgaagcggaattcgagaaccctgcaggaaccacaacacataagaaaccacaacacatatcgaaccacaacacatagacaaccacaacacatactaaaccacaacacataactaaccacaacacatatgcaaccacaacacatagtaggcgcgccatgcttcatcagactct

SEQ ID NO: 2411 - DNA, 190 bp, Artificial Sequence; identical to SEQ ID NO: 2410
  Synthetic polynucleotide

SEQ ID NO: 2412 - DNA, 180 bp, Artificial Sequence
  Synthetic polynucleotide
atcatctcaccttgcctcctgggactctagtgatttcgcctgcaggattttatggccagaattttatggcctcgattttatggccgacattttatggccctaattttatggccactattttatggcctgcattttatggccgtaattttatggccggcgcgccatgcttcatcagactct

SEQ ID NO: 2413 - DNA, 180 bp, Artificial Sequence; identical to SEQ ID NO: 2412
  Synthetic polynucleotide

SEQ ID NO: 2414 - DNA, 140 bp, Artificial Sequence
  Synthetic polynucleotide
atcatctcaccttgcctcctgctctaggacgcgaagagcctgcaggagatagagaagatagtcgagataggacagatagctaagatagactagatagtgcagataggtaagatagggcgcgccatgcttcatcagactct

SEQ ID NO: 2415 - DNA, 140 bp, Artificial Sequence; identical to SEQ ID NO: 2414
  Synthetic polynucleotide

SEQ ID NO: 2416 - DNA, 148 bp, Artificial Sequence
  Synthetic polynucleotide
atcatctcaccttgcctcctgcccagtgtgtgtttcgccctgcaggctgttctagactgttcttcgctgttctgacctgttctctactgttctactctgttcttgcctgttctgtactgttctggcgcgccatgcttcatcagactct

SEQ ID NO: 2417 - DNA, 148 bp, Artificial Sequence; identical to SEQ ID NO: 2416
  Synthetic polynucleotide

SEQ ID NO: 2418 - DNA, 156 bp, Artificial Sequence
  Synthetic polynucleotide
atcatctcaccttgcctcctgggacgctgctagctatacctgcaggttgacaggagattgacaggtcgttgacagggacttgacaggctattgacaggactttgacaggtgcttgacagggtattgacaggggcgcgccatgcttcatcagactct

SEQ ID NO: 2419 - DNA, 156 bp, Artificial Sequence; identical to SEQ ID NO: 2418
  Synthetic polynucleotide

SEQ ID NO: 2420 - DNA, 180 bp, Artificial Sequence
  Synthetic polynucleotide
atcatctcaccttgcctcctgagcatctttccggcttgcctgcagggaatttataccagagaatttatacctcggaatttataccgacgaatttataccctagaatttataccactgaatttatacctgcgaatttataccgtagaatttataccggcgcgccatgcttcatcagactct

SEQ ID NO: 2421 - DNA, 180 bp, Artificial Sequence; identical to SEQ ID NO: 2420
  Synthetic polynucleotide

SEQ ID NO: 2422 - DNA, 196 bp, Artificial Sequence
  Synthetic polynucleotide
atcatctcaccttgcctcctgcaacagacgagcttcaccctgcaggttaattaaattaaagattaattaaattaatcgttaattaaattaagacttaattaaattaactattaattaaattaaactttaattaaattaatgcttaattaaattaagtattaattaaattaaggcgcgccatgcttcatcagactct

SEQ ID NO: 2423 - DNA, 196 bp, Artificial Sequence; identical to SEQ ID NO: 2422
  Synthetic polynucleotide

SEQ ID NO: 2424 - DNA, 180 bp, Artificial Sequence
  Synthetic polynucleotide
atcatctcaccttgcctcctgatagacagtagtacgtacctgcaggtatcgatagttagatatcgatagtttcgtatcgatagttgactatcgatagttctatatcgatagttacttatcgatagtttgctatcgatagttgtatatcgatagttggcgcgccatgcttcatcagactct

SEQ ID NO: 2425 - DNA, 180 bp, Artificial Sequence; identical to SEQ ID NO: 2424
  Synthetic polynucleotide

SEQ ID NO: 2426 - DNA, 188 bp, Artificial Sequence
  Synthetic polynucleotide
atcatctcaccttgcctcctgaaagccatgtgcgttcgcctgcaggttcctaattgggagattcctaattgggtcgttcctaattggggacttcctaattgggctattcctaattgggactttcctaattgggtgcttcctaattggggtattcctaattgggggcgcgccatgcttcatcagactct

SEQ ID NO: 2427 - DNA, 188 bp, Artificial Sequence; identical to SEQ ID NO: 2426
  Synthetic polynucleotide

SEQ ID NO: 2428 - DNA, 188 bp, Artificial Sequence
  Synthetic polynucleotide
atcatctcaccttgcctcctgttctgatcccgaccaaacctgcaggtttgattgatggagatttgattgatggtcgtttgattgatgggactttgattgatggctatttgattgatggacttttgattgatggtgctttgattgatgggtatttgattgatggggcgcgccatgcttcatcagactct

SEQ ID NO: 2429 - DNA, 188 bp, Artificial Sequence; identical to SEQ ID NO: 2428
  Synthetic polynucleotide

SEQ ID NO: 2430 - DNA, 186 bp, Artificial Sequence
  Synthetic polynucleotide
atcatctcaccttgcctcctgcccggttgtgttgcgatcctgcagggtgcgggggcggggggggggagagtgcgggggcggggggggggtcggtgcgggggcgggggggggggacgtgcgggggcggggggggggctagtgcgggggcggggggggggactggcgcgccatgcttcatcagactct

SEQ ID NO: 2431 - DNA, 186 bp, Artificial Sequence; identical to SEQ ID NO: 2430
  Synthetic polynucleotide

SEQ ID NO: 2432 - DNA, 190 bp, Artificial Sequence
  Synthetic polynucleotide
atcatctcaccttgcctcctgctgtaagggtctgtcatcctgcaggggcccaaggtcacaagaggcccaaggtcacatcgggcccaaggtcacagacggcccaaggtcacactaggcccaaggtcacaactggcccaaggtcacatgcggcccaaggtcacagtaggcgcgccatgcttcatcagactct

SEQ ID NO: 2433 - DNA, 190 bp, Artificial Sequence; identical to SEQ ID NO: 2432
  Synthetic polynucleotide

SEQ ID NO: 2434 - DNA, 191 bp, Artificial Sequence
  Synthetic polynucleotide
atcatctcaccttgcctcctgcgctgctatctgtcccacctgcaggaaatttgctgacttagcagaaaatttgctgacttagctcgaaatttgctgacttagcgacaaatttgctgacttagcctaaaatttgctgacttagcactaaatttgctgacttagctgcggcgcgccatgcttcatcagactct

SEQ ID NO: 2435 - DNA, 191 bp, Artificial Sequence; identical to SEQ ID NO: 2434
  Synthetic polynucleotide

SEQ ID NO: 2436 - DNA, 197 bp, Artificial Sequence
  Synthetic polynucleotide
atcatctcaccttgcctcctgccctgacgtccaaacttcctgcaggggcgccccctggcggagaggcgccccctggcggtcgggcgccccctggcgggacggcgccccctggcggctaggcgccccctggcggactggcgccccctggcggtgcggcgccccctggcgggtaggcgcgccatgcttcatcagactct

SEQ ID NO: 2437 - DNA, 197 bp, Artificial Sequence; identical to SEQ ID NO: 2436
  Synthetic polynucleotide

SEQ ID NO: 2438 - DNA, 197 bp, Artificial Sequence
  Synthetic polynucleotide
atcatctcaccttgcctcctgaactaatccggtcgtggcctgcaggcccgccacgtgacccagacccgccacgtgaccctcgcccgccacgtgacccgaccccgccacgtgacccctacccgccacgtgacccactcccgccacgtgaccctgccccgccacgtgacccgtaggcgcgccatgcttcatcagactct

SEQ ID NO: 2439 - DNA, 197 bp, Artificial Sequence; identical to SEQ ID NO: 2438
  Synthetic polynucleotide

SEQ ID NO: 2440 - DNA, 196 bp, Artificial Sequence
  Synthetic polynucleotide
atcatctcaccttgcctcctgggactggatccatacgtcctgcaggttaattaaattagagattaattaaattagtcgttaattaaattaggacttaattaaattagctattaattaaattagactttaattaaattagtgcttaattaaattaggtattaattaaattagggcgcgccatgcttcatcagactct

SEQ ID NO: 2441 - DNA, 196 bp, Artificial Sequence; identical to SEQ ID NO: 2440
  Synthetic polynucleotide

SEQ ID NO: 2442 - DNA, 156 bp, Artificial Sequence
  Synthetic polynucleotide
atcatctcaccttgcctcctgcatgagactatccaaagcctgcaggtgtcataaagatgtcataatcgtgtcataagactgtcataactatgtcataaacttgtcataatgctgtcataagtatgtcataaggcgcgccatgcttcatcagactct

SEQ ID NO: 2443 - DNA, 156 bp, Artificial Sequence; identical to SEQ ID NO: 2442
  Synthetic polynucleotide

SEQ ID NO: 2444 - DNA, 164 bp, Artificial Sequence
  Synthetic polynucleotide
atcatctcaccttgcctcctgaaattcccaactactggcctgcagggaccaattaagagaccaattatcggaccaattagacgaccaattactagaccaattaactgaccaattatgcgaccaattagtagaccaattaggcgcgccatgcttcatcagactct

SEQ ID NO: 2445 - DNA, 164 bp, Artificial Sequence; identical to SEQ ID NO: 2444
  Synthetic polynucleotide

SEQ ID NO: 2446 - DNA, 197 bp, Artificial Sequence
  Synthetic polynucleotide
atcatctcaccttgcctcctgccttagatacacagatgcctgcaggaacactaccattgttagaaacactaccattgtttcgaacactaccattgttgacaacactaccattgttctaaacactaccattgttactaacactaccattgtttgcaacactaccattgttgtaggcgcgccatgcttcatcagactct

SEQ ID NO: 2447 - DNA, 197 bp, Artificial Sequence; identical to SEQ ID NO: 2446
  Synthetic polynucleotide

SEQ ID NO: 2448 - DNA, 191 bp, Artificial Sequence
  Synthetic polynucleotide
atcatctcaccttgcctcctgttccatgcgaccacaagcctgcaggcatgactcagcaattttagacatgactcagcaatttttcgcatgactcagcaattttgaccatgactcagcaattttctacatgactcagcaattttactcatgactcagcaatttttgcggcgcgccatgcttcatcagactct

SEQ ID NO: 2449 - DNA, 191 bp, Artificial Sequence; identical to SEQ ID NO: 2448
  Synthetic polynucleotide

SEQ ID NO: 2450 - DNA, 197 bp, Artificial Sequence
  Synthetic polynucleotide
atcatctcaccttgcctcctgtgacgaaacaggactagcctgcaggaccggaagtacatccggcagaaccggaagtacatccggctcgaccggaagtacatccggcgacaccggaagtacatccggcctaaccggaagtacatccggcactaccggaagtacatccggctgcggcgcgccatgcttcatcagactct

SEQ ID NO: 2451 - DNA, 197 bp, Artificial Sequence; identical to SEQ ID NO: 2450
  Synthetic polynucleotide

SEQ ID NO: 2452 - DNA, 197 bp, Artificial Sequence
  Synthetic polynucleotide
atcatctcaccttgcctcctgtgggtcctcattctgaccctgcaggggtttccgggaaatgagaggtttccgggaaatgtcgggtttccgggaaatggacggtttccgggaaatgctaggtttccgggaaatgactggtttccgggaaatgtgcggtttccgggaaatggtaggcgcgccatgcttcatcagactct

SEQ ID NO: 2453 - DNA, 197 bp, Artificial Sequence; identical to SEQ ID NO: 2452
  Synthetic polynucleotide

SEQ ID NO: 2454 - DNA, 172 bp, Artificial Sequence
  Synthetic polynucleotide
atcatctcaccttgcctcctgcttagcgctatatcgagcctgcaggatcagctgttagaatcagctgtttcgatcagctgttgacatcagctgttctaatcagctgttactatcagctgtttgcatcagctgttgtaatcagctgttggcgcgccatgcttcatcagactct

SEQ ID NO: 2455 - DNA, 172 bp, Artificial Sequence; identical to SEQ ID NO: 2454
  Synthetic polynucleotide

SEQ ID NO: 2456 - DNA, 156 bp, Artificial Sequence
  Synthetic polynucleotide
atcatctcaccttgcctcctgtctagttggcgcatttacctgcaggttgacagcagattgacagctcgttgacagcgacttgacagcctattgacagcactttgacagctgcttgacagcgtattgacagcggcgcgccatgcttcatcagactct

SEQ ID NO: 2457 - DNA, 156 bp, Artificial Sequence; identical to SEQ ID NO: 2456
  Synthetic polynucleotide

SEQ ID NO: 2458 - DNA, 180 bp, Artificial Sequence
  Synthetic polynucleotide
atcatctcaccttgcctcctgggcacagtatggctctgcctgcagggaaagtgaaagagagaaagtgaaagtcggaaagtgaaaggacgaaagtgaaagctagaaagtgaaagactgaaagtgaaagtgcgaaagtgaaaggtagaaagtgaaagggcgcgccatgcttcatcagactct

SEQ ID NO: 2459 - DNA, 180 bp, Artificial Sequence; identical to SEQ ID NO: 2458
  Synthetic polynucleotide

SEQ ID NO: 2460 - DNA, 156 bp, Artificial Sequence
  Synthetic polynucleotide
atcatctcaccttgcctcctgcactcctcaattcttcgcctgcagggctgacgcagagctgacgctcggctgacgcgacgctgacgcctagctgacgcactgctgacgctgcgctgacgcgtagctgacgcggcgcgccatgcttcatcagactct

SEQ ID NO: 2461 - DNA, 156 bp, Artificial Sequence; identical to SEQ ID NO: 2460
  Synthetic polynucleotide

SEQ ID NO: 2462 - DNA, 185 bp, Artificial Sequence
  Synthetic polynucleotide
atcatctcaccttgcctcctggcacttatccgtcgacgcctgcaggtgaccatatatggtcaagatgaccatatatggtcatcgtgaccatatatggtcagactgaccatatatggtcactatgaccatatatggtcaacttgaccatatatggtcatgcggcgcgccatgcttcatcagactct

SEQ ID NO: 2463 - DNA, 185 bp, Artificial Sequence; identical to SEQ ID NO: 2462
  Synthetic polynucleotide

SEQ ID NO: 2464 - DNA, 172 bp, Artificial Sequence
  Synthetic polynucleotide
atcatctcaccttgcctcctggttggcggctaactcatcctgcaggcaaaggtcaaagacaaaggtcaatcgcaaaggtcaagaccaaaggtcaactacaaaggtcaaactcaaaggtcaatgccaaaggtcaagtacaaaggtcaaggcgcgccatgcttcatcagactct

SEQ ID NO: 2465 - DNA, 172 bp, Artificial Sequence; identical to SEQ ID NO: 2464
  Synthetic polynucleotide

SEQ ID NO: 2466 - DNA, 190 bp, Artificial Sequence
  Synthetic polynucleotide
atcatctcaccttgcctcctgagcattgaaccgcgaggcctgcaggccagttcaaaccagagaccagttcaaaccagtcgccagttcaaaccaggacccagttcaaaccagctaccagttcaaaccagactccagttcaaaccagtgcccagttcaaaccaggtaggcgcgccatgcttcatcagactct

SEQ ID NO: 2467 - DNA, 190 bp, Artificial Sequence; identical to SEQ ID NO: 2466
  Synthetic polynucleotide

SEQ ID NO: 2468 - DNA, 180 bp, Artificial Sequence
  Synthetic polynucleotide
atcatctcaccttgcctcctgcgttaatttgtccatcgcctgcaggacccggaagtaagaacccggaagtatcgacccggaagtagacacccggaagtactaacccggaagtaactacccggaagtatgcacccggaagtagtaacccggaagtaggcgcgccatgcttcatcagactct

SEQ ID NO: 2469 - DNA, 180 bp, Artificial Sequence; identical to SEQ ID NO: 2468
  Synthetic polynucleotide

SEQ ID NO: 2470 - DNA, 191 bp, Artificial Sequence
  Synthetic polynucleotide
atcatctcaccttgcctcctgtacgagggacatacctgcctgcaggaggggaggtacacggtgttcttttgggagaaggggaggtacacggtgttcttttgggtcgaggggaggtacacggtgttcttttggggacaggggaggtacacggtgttcttttgggctaggcgcgccatgcttcatcagactct

SEQ ID NO: 2471 - DNA, 191 bp, Artificial Sequence; identical to SEQ ID NO: 2470
  Synthetic polynucleotide

SEQ ID NO: 2472 - DNA, 172 bp, Artificial Sequence
  Synthetic polynucleotide
atcatctcaccttgcctcctgatgctaccttaccagcacctgcaggaaatgactggagaaaatgactggtcgaaatgactgggacaaatgactggctaaaatgactggactaaatgactggtgcaaatgactgggtaaaatgactggggcgcgccatgcttcatcagactct

SEQ ID NO: 2473 - DNA, 172 bp, Artificial Sequence; identical to SEQ ID NO: 2472
  Synthetic polynucleotide

SEQ ID NO: 2474 - DNA, 197 bp, Artificial Sequence
  Synthetic polynucleotide
atcatctcaccttgcctcctgaatataccgggcgcagtcctgcaggatgaatatgcatataagaatgaatatgcatatatcgatgaatatgcatatagacatgaatatgcatatactaatgaatatgcatataactatgaatatgcatatatgcatgaatatgcatatagtaggcgcgccatgcttcatcagactct

SEQ ID NO: 2475 - DNA, 197 bp, Artificial Sequence; identical to SEQ ID NO: 2474
  Synthetic polynucleotide

SEQ ID NO: 2476 - DNA, 190 bp, Artificial Sequence
  Synthetic polynucleotide
atcatctcaccttgcctcctgtacgtgctactagtacccctgcaggtgttatcttatcttagatgttatcttatctttcgtgttatcttatcttgactgttatcttatcttctatgttatcttatcttacttgttatcttatctttgctgttatcttatcttgtaggcgcgccatgcttcatcagactct

SEQ ID NO: 2477 - DNA, 190 bp, Artificial Sequence; identical to SEQ ID NO: 2476
  Synthetic polynucleotide

SEQ ID NO: 2478 - DNA, 197 bp, Artificial Sequence
  Synthetic polynucleotide
atcatctcaccttgcctcctgagtcagctgacaatagccctgcaggagaaagtgaaagtgaagaagaaagtgaaagtgatcgagaaagtgaaagtgagacagaaagtgaaagtgactaagaaagtgaaagtgaactagaaagtgaaagtgatgcagaaagtgaaagtgagtaggcgcgccatgcttcatcagactct

SEQ ID NO: 2479 - DNA, 197 bp, Artificial Sequence; identical to SEQ ID NO: 2478
  Synthetic polynucleotide

SEQ ID NO: 2480 - DNA, 164 bp, Artificial Sequence
  Synthetic polynucleotide
atcatctcaccttgcctcctgtgcaacggaaacagtcacctgcaggtaattaaatagataattaaattcgtaattaaatgactaattaaatctataattaaatacttaattaaattgctaattaaatgtataattaaatggcgcgccatgcttcatcagactct

SEQ ID NO: 2481 - DNA, 164 bp, Artificial Sequence; identical to SEQ ID NO: 2480
  Synthetic polynucleotide

SEQ ID NO: 2482 - DNA, 148 bp, Artificial Sequence
  Synthetic polynucleotide
atcatctcaccttgcctcctgtagtctaatgaacacctcctgcaggctgtcaaagactgtcaatcgctgtcaagacctgtcaactactgtcaaactctgtcaatgcctgtcaagtactgtcaaggcgcgccatgcttcatcagactct

SEQ ID NO: 2483 - DNA, 148 bp, Artificial Sequence; identical to SEQ ID NO: 2482
  Synthetic polynucleotide

SEQ ID NO: 2484 - DNA, 180 bp, Artificial Sequence
  Synthetic polynucleotide
atcatctcaccttgcctcctgtaatcaagcgtctaccccctgcaggacccggaagtgagaacccggaagtgtcgacccggaagtggacacccggaagtgctaacccggaagtgactacccggaagtgtgcacccggaagtggtaacccggaagtgggcgcgccatgcttcatcagactct

SEQ ID NO: 2485 - DNA, 180 bp, Artificial Sequence; identical to SEQ ID NO: 2484
  Synthetic polynucleotide

SEQ ID NO: 2486 - DNA, 148 bp, Artificial Sequence
  Synthetic polynucleotide
atcatctcaccttgcctcctgtacgtggctactagatgcctgcaggctgtcacagactgtcactcgctgtcacgacctgtcacctactgtcacactctgtcactgcctgtcacgtactgtcacggcgcgccatgcttcatcagactct

SEQ ID NO: 2487 - DNA, 148 bp, Artificial Sequence; identical to SEQ ID NO: 2486
  Synthetic polynucleotide

SEQ ID NO: 2488 - DNA, 197 bp, Artificial Sequence
  Synthetic polynucleotide
atcatctcaccttgcctcctgcttcgggttgttatgctcctgcaggtttccattatggaaaagatttccattatggaaatcgtttccattatggaaagactttccattatggaaactatttccattatggaaaacttttccattatggaaatgctttccattatggaaagtaggcgcgccatgcttcatcagactct

SEQ ID NO: 2489 - DNA, 197 bp, Artificial Sequence; identical to SEQ ID NO: 2488
  Synthetic polynucleotide

SEQ ID NO: 2490 - DNA, 172 bp, Artificial Sequence
  Synthetic polynucleotide
atcatctcaccttgcctcctgaaccaccgaaggttgaacctgcagggcgacttccgagagcgacttccgtcggcgacttccggacgcgacttccgctagcgacttccgactgcgacttccgtgcgcgacttccggtagcgacttccgggcgcgccatgcttcatcagactct

SEQ ID NO: 2491 - DNA, 172 bp, Artificial Sequence; identical to SEQ ID NO: 2490
  Synthetic polynucleotide

SEQ ID NO: 2492 - DNA, 180 bp, Artificial Sequence
  Synthetic polynucleotide
atcatctcaccttgcctcctgataatcctctgcgttaacctgcaggcttcccgccccagacttcccgcccctcgcttcccgccccgaccttcccgccccctacttcccgccccactcttcccgcccctgccttcccgccccgtacttcccgccccggcgcgccatgcttcatcagactct

SEQ ID NO: 2493 - DNA, 180 bp, Artificial Sequence; identical to SEQ ID NO: 2492
  Synthetic polynucleotide

SEQ ID NO: 2494 - DNA, 197 bp, Artificial Sequence
  Synthetic polynucleotide
atcatctcaccttgcctcctggattgatgtcatagatgcctgcaggccgcgcgccctccccagaccgcgcgccctcccctcgccgcgcgccctccccgacccgcgcgccctccccctaccgcgcgccctccccactccgcgcgccctcccctgcccgcgcgccctccccgtaggcgcgccatgcttcatcagactct

SEQ ID NO: 2495 - DNA, 197 bp, Artificial Sequence; identical to SEQ ID NO: 2494
  Synthetic polynucleotide

SEQ ID NO: 2496 - DNA, 185 bp, Artificial Sequence
  Synthetic polynucleotide
atcatctcaccttgcctcctggggtcatcttcaatttgcctgcaggaaggtaattaccaataagaaaggtaattaccaatatcgaaggtaattaccaatagacaaggtaattaccaatactaaaggtaattaccaataactaaggtaattaccaatatgcggcgcgccatgcttcatcagactct

SEQ ID NO: 2497 - DNA, 185 bp, Artificial Sequence; identical to SEQ ID NO: 2496
  Synthetic polynucleotide

SEQ ID NO: 2498 - DNA, 185 bp, Artificial Sequence
  Synthetic polynucleotide
atcatctcaccttgcctcctggtaaattcgatgcactgcctgcagggtgccctctagtgggcagagtgccctctagtgggctcggtgccctctagtgggcgacgtgccctctagtgggcctagtgccctctagtgggcactgtgccctctagtgggctgcggcgcgccatgcttcatcagactct

SEQ ID NO: 2499 - DNA, 185 bp, Artificial Sequence; identical to SEQ ID NO: 2498
  Synthetic polynucleotide

SEQ ID NO: 2500 - DNA, 197 bp, Artificial Sequence
  Synthetic polynucleotide
atcatctcaccttgcctcctggggttcgttctcatccccctgcaggggggggtgactcatcagaggggggtgactcatctcgggggggtgactcatcgacggggggtgactcatcctaggggggtgactcatcactggggggtgactcatctgcggggggtgactcatcgtaggcgcgccatgcttcatcagactct

SEQ ID NO: 2501 - DNA, 197 bp, Artificial Sequence; identical to SEQ ID NO: 2500
  Synthetic polynucleotide

SEQ ID NO: 2502 - DNA, 190 bp, Artificial Sequence
  Synthetic polynucleotide
atcatctcaccttgcctcctggacgaatgatcacagaacctgcagggcgctgattggctgagagcgctgattggctgtcggcgctgattggctggacgcgctgattggctgctagcgctgattggctgactgcgctgattggctgtgcgcgctgattggctggtaggcgcgccatgcttcatcagactct

SEQ ID NO: 2503 - DNA, 190 bp, Artificial Sequence; identical to SEQ ID NO: 2502
  Synthetic polynucleotide

SEQ ID NO: 2504 - DNA, 172 bp, Artificial Sequence
  Synthetic polynucleotide
atcatctcaccttgcctcctgggtgttctgcggatgaacctgcaggcagctgttacagacagctgttactcgcagctgttacgaccagctgttacctacagctgttacactcagctgttactgccagctgttacgtacagctgttacggcgcgccatgcttcatcagactct

SEQ ID NO: 2505 - DNA, 172 bp, Artificial Sequence; identical to SEQ ID NO: 2504
  Synthetic polynucleotide

SEQ ID NO: 2506 - DNA, 196 bp, Artificial Sequence
  Synthetic polynucleotide
atcatctcaccttgcctcctgaaagcggcatggttgtgcctgcagggtgcgtacgtgggagagtgcgtacgtgggtcggtgcgtacgtggggacgtgcgtacgtgggctagtgcgtacgtgggactgtgcgtacgtgggtgcgtgcgtacgtggggtagtgcgtacgtgggggcgcgccatgcttcatcagactct

SEQ ID NO: 2507 - DNA, 196 bp, Artificial Sequence; identical to SEQ ID NO: 2506
  Synthetic polynucleotide

SEQ ID NO: 2508 - DNA, 197 bp, Artificial Sequence
  Synthetic polynucleotide
atcatctcaccttgcctcctggaacatggctcacggtgcctgcaggccacttcctctttttagaccacttcctcttttttcgccacttcctctttttgacccacttcctctttttctaccacttcctctttttactccacttcctcttttttgcccacttcctctttttgtaggcgcgccatgcttcatcagactct

SEQ ID NO: 2509 - DNA, 197 bp, Artificial Sequence; identical to SEQ ID NO: 2508
  Synthetic polynucleotide

SEQ ID NO: 2510 - DNA, 180 bp, Artificial Sequence
  Synthetic polynucleotide
atcatctcaccttgcctcctgaactatccacgaaccctcctgcaggcatgagtcaccagacatgagtcacctcgcatgagtcaccgaccatgagtcaccctacatgagtcaccactcatgagtcacctgccatgagtcaccgtacatgagtcaccggcgcgccatgcttcatcagactct

SEQ ID NO: 2511 - DNA, 180 bp, Artificial Sequence; identical to SEQ ID NO: 2510
  Synthetic polynucleotide

SEQ ID NO: 2512 - DNA, 191 bp, Artificial Sequence
  Synthetic polynucleotide
atcatctcaccttgcctcctggcggaacaacgcatttccctgcaggatttcctttgatctataagaatttcctttgatctatatcgatttcctttgatctatagacatttcctttgatctatactaatttcctttgatctataactatttcctttgatctatatgcggcgcgccatgcttcatcagactct

SEQ ID NO: 2513 - DNA, 191 bp, Artificial Sequence; identical to SEQ ID NO: 2512
  Synthetic polynucleotide

SEQ ID NO: 2514 - DNA, 180 bp, Artificial Sequence
  Synthetic polynucleotide
atcatctcaccttgcctcctgtttgcgtggtatagaggcctgcaggtgactcatttcagatgactcatttctcgtgactcatttcgactgactcatttcctatgactcatttcacttgactcatttctgctgactcatttcgtatgactcatttcggcgcgccatgcttcatcagactct

SEQ ID NO: 2515 - DNA, 180 bp, Artificial Sequence; identical to SEQ ID NO: 2514
  Synthetic polynucleotide

SEQ ID NO: 2516 - DNA, 188 bp, Artificial Sequence
  Synthetic polynucleotide
atcatctcaccttgcctcctgttgcactagaccaattacctgcaggaatcacgtgcttagaaatcacgtgctttcgaatcacgtgcttgacaatcacgtgcttctaaatcacgtgcttactaatcacgtgctttgcaatcacgtgcttgtaaatcacgtgcttggcgcgccatgcttcatcagactct

SEQ ID NO: 2517 - DNA, 188 bp, Artificial Sequence; identical to SEQ ID NO: 2516
  Synthetic polynucleotide

SEQ ID NO: 2518 - DNA, 191 bp, Artificial Sequence
  Synthetic polynucleotide
atcatctcaccttgcctcctgccgcattaactacgacgcctgcaggatcttcttatcagtttaagaatcttcttatcagtttatcgatcttcttatcagtttagacatcttcttatcagtttactaatcttcttatcagtttaactatcttcttatcagtttatgcggcgcgccatgcttcatcagactct

SEQ ID NO: 2519 - DNA, 191 bp, Artificial Sequence; identical to SEQ ID NO: 2518
  Synthetic polynucleotide

SEQ ID NO: 2520 - DNA, 156 bp, Artificial Sequence
  Synthetic polynucleotide
atcatctcaccttgcctcctggggattgagttggcgagcctgcaggccttatctagaccttatcttcgccttatctgacccttatctctaccttatctactccttatcttgcccttatctgtaccttatctggcgcgccatgcttcatcagactct

SEQ ID NO: 2521 - DNA, 156 bp, Artificial Sequence; identical to SEQ ID NO: 2520
  Synthetic polynucleotide

SEQ ID NO: 2522 - DNA, 180 bp, Artificial Sequence
  Synthetic polynucleotide
atcatctcaccttgcctcctgtgtattggcatgtagtacctgcaggggtcacgtgacagaggtcacgtgactcgggtcacgtgacgacggtcacgtgacctaggtcacgtgacactggtcacgtgactgcggtcacgtgacgtaggtcacgtgacggcgcgccatgcttcatcagactct

SEQ ID NO: 2523 - DNA, 180 bp, Artificial Sequence; identical to SEQ ID NO: 2522
  Synthetic polynucleotide

SEQ ID NO: 2524 - DNA, 191 bp, Artificial Sequence
  Synthetic polynucleotide
atcatctcaccttgcctcctgacacgtatagggtcatgcctgcaggggcgcgcggcggtgacgtgacagaggcgcgcggcggtgacgtgactcgggcgcgcggcggtgacgtgacgacggcgcgcggcggtgacgtgacctaggcgcgcggcggtgacgtgacactggcgcgccatgcttcatcagactct

SEQ ID NO: 2525 - DNA, 191 bp, Artificial Sequence; identical to SEQ ID NO: 2524
  Synthetic polynucleotide

SEQ ID NO: 2526 - DNA, 188 bp, Artificial Sequence
  Synthetic polynucleotide
atcatctcaccttgcctcctgcaacggaagccgtgaatcctgcaggtcataaatcatcagatcataaatcatctcgtcataaatcatcgactcataaatcatcctatcataaatcatcacttcataaatcatctgctcataaatcatcgtatcataaatcatcggcgcgccatgcttcatcagactct

SEQ ID NO: 2527 - DNA, 188 bp, Artificial Sequence; identical to SEQ ID NO: 2526
  Synthetic polynucleotide

SEQ ID NO: 2528 - DNA, 197 bp, Artificial Sequence
  Synthetic polynucleotide
atcatctcaccttgcctcctgattgagtcctgccctcccctgcaggccgggccacgtgaccagaccgggccacgtgacctcgccgggccacgtgaccgacccgggccacgtgaccctaccgggccacgtgaccactccgggccacgtgacctgcccgggccacgtgaccgtaggcgcgccatgcttcatcagactct

SEQ ID NO: 2529 - DNA, 197 bp, Artificial Sequence; identical to SEQ ID NO: 2528
  Synthetic polynucleotide

SEQ ID NO: 2530 - DNA, 172 bp, Artificial Sequence
  Synthetic polynucleotide
atcatctcaccttgcctcctgtctcagaaattagtcggcctgcaggtcaaggtcatagatcaaggtcattcgtcaaggtcatgactcaaggtcatctatcaaggtcatacttcaaggtcattgctcaaggtcatgtatcaaggtcatggcgcgccatgcttcatcagactct

SEQ ID NO: 2531 - DNA, 172 bp, Artificial Sequence; identical to SEQ ID NO: 2530
  Synthetic polynucleotide

SEQ ID NO: 2532 - DNA, 190 bp, Artificial Sequence
  Synthetic polynucleotide
atcatctcaccttgcctcctgggctcattagtagccaacctgcaggccccaaaccaccccagaccccaaaccacccctcgccccaaaccaccccgacccccaaaccaccccctaccccaaaccaccccactccccaaaccacccctgcccccaaaccaccccgtaggcgcgccatgcttcatcagactct

SEQ ID NO: 2533 - DNA, 190 bp, Artificial Sequence; identical to SEQ ID NO: 2532
  Synthetic polynucleotide

SEQ ID NO: 2534 - DNA, 172 bp, Artificial Sequence
  Synthetic polynucleotide
atcatctcaccttgcctcctgtttaggttctgtgccctcctgcaggccagctgacgagaccagctgacgtcgccagctgacggacccagctgacgctaccagctgacgactccagctgacgtgcccagctgacggtaccagctgacgggcgcgccatgcttcatcagactct

SEQ ID NO: 2535 - DNA, 172 bp, Artificial Sequence; identical to SEQ ID NO: 2534
  Synthetic polynucleotide

SEQ ID NO: 2536 - DNA, 197 bp, Artificial Sequence
  Synthetic polynucleotide
atcatctcaccttgcctcctgcgtataactcgtagagacctgcaggccataattaattacaagaccataattaattacatcgccataattaattacagacccataattaattacactaccataattaattacaactccataattaattacatgcccataattaattacagtaggcgcgccatgcttcatcagactct

SEQ ID NO: 2537 - DNA, 197 bp, Artificial Sequence; identical to SEQ ID NO: 2536
  Synthetic polynucleotide

SEQ ID NO: 2538 - DNA, 191 bp, Artificial Sequence
  Synthetic polynucleotide
atcatctcaccttgcctcctgtcttcgtaatgtcttgacctgcaggtgtagggattaattgtcagatgtagggattaattgtctcgtgtagggattaattgtcgactgtagggattaattgtcctatgtagggattaattgtcacttgtagggattaattgtctgcggcgcgccatgcttcatcagactct

SEQ ID NO: 2539 - DNA, 191 bp, Artificial Sequence; identical to SEQ ID NO: 2538
  Synthetic polynucleotide

SEQ ID NO: 2540 - DNA, 188 bp, Artificial Sequence
  Synthetic polynucleotide
atcatctcaccttgcctcctgatattgcactgcacctgcctgcaggtgtgggaaaagcagatgtgggaaaagctcgtgtgggaaaagcgactgtgggaaaagcctatgtgggaaaagcacttgtgggaaaagctgctgtgggaaaagcgtatgtgggaaaagcggcgcgccatgcttcatcagactct

SEQ ID NO: 2541 - DNA, 188 bp, Artificial Sequence; identical to SEQ ID NO: 2540
  Synthetic polynucleotide

SEQ ID NO: 2542 - DNA, 190 bp, Artificial Sequence
  Synthetic polynucleotide
atcatctcaccttgcctcctgcattagtgaagctttagcctgcaggagaatgttctagaaagaagaatgttctagaatcgagaatgttctagaagacagaatgttctagaactaagaatgttctagaaactagaatgttctagaatgcagaatgttctagaagtaggcgcgccatgcttcatcagactct

SEQ ID NO: 2543 - DNA, 190 bp, Artificial Sequence; identical to SEQ ID NO: 2542
  Synthetic polynucleotide

SEQ ID NO: 2544 - DNA, 156 bp, Artificial Sequence
  Synthetic polynucleotide
atcatctcaccttgcctcctgcaattccacccactctccctgcaggtctgttctagatctgttcttcgtctgttctgactctgttctctatctgttctacttctgttcttgctctgttctgtatctgttctggcgcgccatgcttcatcagactct

SEQ ID NO: 2545 - DNA, 156 bp, Artificial Sequence; identical to SEQ ID NO: 2544
  Synthetic polynucleotide

SEQ ID NO: 2546 - DNA, 200 bp, Artificial Sequence
  Synthetic polynucleotide
atcatctcaccttgcctcctgcgttgatcccacacggtcctgcagggtcacgcttcactgccctcagagtcacgcttcactgccctctcggtcacgcttcactgccctcgacgtcacgcttcactgccctcctagtcacgcttcactgccctcactgtcacgcttcactgccctcggcgcgccatgcttcatcagactct

SEQ ID NO: 2547 - DNA, 200 bp, Artificial Sequence; identical to SEQ ID NO: 2546
  Synthetic polynucleotide

SEQ ID NO: 2548 - DNA, 197 bp, Artificial Sequence
  Synthetic polynucleotide
atcatctcaccttgcctcctgatatacgctcgatcagacctgcagggccagcagctggcgcagagccagcagctggcgctcggccagcagctggcgcgacgccagcagctggcgcctagccagcagctggcgcactgccagcagctggcgctgcgccagcagctggcgcgtaggcgcgccatgcttcatcagactct

SEQ ID NO: 2549 - DNA, 197 bp, Artificial Sequence; identical to SEQ ID NO: 2548
  Synthetic polynucleotide

SEQ ID NO: 2550 - DNA, 164 bp, Artificial Sequence
  Synthetic polynucleotide
atcatctcaccttgcctcctgctgtggatgctgcgacacctgcaggaacacctggagaaacacctggtcgaacacctgggacaacacctggctaaacacctggactaacacctggtgcaacacctgggtaaacacctggggcgcgccatgcttcatcagactct

SEQ ID NO: 2551 - DNA, 164 bp, Artificial Sequence; identical to SEQ ID NO: 2550
  Synthetic polynucleotide

SEQ ID NO: 2552 - DNA, 197 bp, Artificial Sequence
  Synthetic polynucleotide
atcatctcaccttgcctcctggcagttgatgctcgtgccctgcaggctggcaaattgccaaagactggcaaattgccaatcgctggcaaattgccaagacctggcaaattgccaactactggcaaattgccaaactctggcaaattgccaatgcctggcaaattgccaagtaggcgcgccatgcttcatcagactct

SEQ ID NO: 2553 - DNA, 197 bp, Artificial Sequence; identical to SEQ ID NO: 2552
  Synthetic polynucleotide

SEQ ID NO: 2554 - DNA, 196 bp, Artificial Sequence
  Synthetic polynucleotide
atcatctcaccttgcctcctgcataattaatgcgcctacctgcaggggatgatgcaataagaggatgatgcaatatcgggatgatgcaatagacggatgatgcaatactaggatgatgcaataactggatgatgcaatatgcggatgatgcaatagtaggatgatgcaataggcgcgccatgcttcatcagactct

SEQ ID NO: 2555 - DNA, 196 bp, Artificial Sequence; identical to SEQ ID NO: 2554
  Synthetic polynucleotide

SEQ ID NO: 2556 - DNA, 172 bp, Artificial Sequence
  Synthetic polynucleotide
atcatctcaccttgcctcctgctcgtccaatttcgaggcctgcaggaaagatcttaagaaaagatcttatcgaaagatcttagacaaagatcttactaaaagatcttaactaaagatcttatgcaaagatcttagtaaaagatcttaggcgcgccatgcttcatcagactct

SEQ ID NO: 2557 - DNA, 172 bp, Artificial Sequence; identical to SEQ ID NO: 2556
  Synthetic polynucleotide

SEQ ID NO: 2558 - DNA, 172 bp, Artificial Sequence
  Synthetic polynucleotide
atcatctcaccttgcctcctgtatactcatcgttaggacctgcaggaaacatggcgagaaaacatggcgtcgaaacatggcggacaaacatggcgctaaaacatggcgactaaacatggcgtgcaaacatggcggtaaaacatggcgggcgcgccatgcttcatcagactct

SEQ ID NO: 2559 - DNA, 172 bp, Artificial Sequence; identical to SEQ ID NO: 2558
  Synthetic polynucleotide

SEQ ID NO: 2560 - DNA, 196 bp, Artificial Sequence
  Synthetic polynucleotide
atcatctcaccttgcctcctgtcatggtttcctcatgacctgcaggtacttacctgtgtagatacttacctgtgttcgtacttacctgtgtgactacttacctgtgtctatacttacctgtgtacttacttacctgtgttgctacttacctgtgtgtatacttacctgtgtggcgcgccatgcttcatcagactct

SEQ ID NO: 2561 - DNA, 196 bp, Artificial Sequence; identical to SEQ ID NO: 2560
  Synthetic polynucleotide

SEQ ID NO: 2562 - DNA, 200 bp, Artificial Sequence
  Synthetic polynucleotide
atcatctcaccttgcctcctgcggcaacgataattattcctgcaggtggccaccagggggcgctaagatggccaccagggggcgctatcgtggccaccagggggcgctagactggccaccagggggcgctactatggccaccagggggcgctaacttggccaccagggggcgctaggcgcgccatgcttcatcagactct

SEQ ID NO: 2563 - DNA, 200 bp, Artificial Sequence; identical to SEQ ID NO: 2562
  Synthetic polynucleotide

SEQ ID NO: 2564 - DNA, 172 bp, Artificial Sequence
  Synthetic polynucleotide
atcatctcaccttgcctcctgccggcctcaatgaaacacctgcaggatcacgtgacagaatcacgtgactcgatcacgtgacgacatcacgtgacctaatcacgtgacactatcacgtgactgcatcacgtgacgtaatcacgtgacggcgcgccatgcttcatcagactct

SEQ ID NO: 2565 - DNA, 172 bp, Artificial Sequence; identical to SEQ ID NO: 2564
  Synthetic polynucleotide

SEQ ID NO: 2566 - DNA, 156 bp, Artificial Sequence
  Synthetic polynucleotide
atcatctcaccttgcctcctgcagtaagctagtagacgcctgcaggttgattacagattgattactcgttgattacgacttgattacctattgattacactttgattactgcttgattacgtattgattacggcgcgccatgcttcatcagactct

SEQ ID NO: 2567 - DNA, 156 bp, Artificial Sequence; identical to SEQ ID NO: 2566
  Synthetic polynucleotide

SEQ ID NO: 2568 - DNA, 185 bp, Artificial Sequence
  Synthetic polynucleotide
atcatctcaccttgcctcctgcgacctcggatgtttgacctgcaggatttgcataacaaaggagaatttgcataacaaaggtcgatttgcataacaaagggacatttgcataacaaaggctaatttgcataacaaaggactatttgcataacaaaggtgcggcgcgccatgcttcatcagactct

SEQ ID NO: 2569 - DNA, 185 bp, Artificial Sequence; identical to SEQ ID NO: 2568
  Synthetic polynucleotide

SEQ ID NO: 2570 - DNA, 132 bp, Artificial Sequence
  Synthetic polynucleotide
atcatctcaccttgcctcctgcgaagtaggtcaacagacctgcaggtgttaagatgttatcgtgttagactgttactatgttaacttgttatgctgttagtatgttaggcgcgccatgcttcatcagactct

SEQ ID NO: 2571 - DNA, 132 bp, Artificial Sequence; identical to SEQ ID NO: 2570
  Synthetic polynucleotide

SEQ ID NO: 2572 - DNA, 156 bp, Artificial Sequence
  Synthetic polynucleotide
atcatctcaccttgcctcctgttcagattcgccacctccctgcaggttgtttttagattgttttttcgttgtttttgacttgtttttctattgtttttactttgttttttgcttgtttttgtattgtttttggcgcgccatgcttcatcagactct

SEQ ID NO: 2573 - DNA, 156 bp, Artificial Sequence; identical to SEQ ID NO: 2572
  Synthetic polynucleotide

SEQ ID NO: 2574 - DNA, 197 bp, Artificial Sequence
  Synthetic polynucleotide
atcatctcaccttgcctcctgggtacctcatctagggccctgcaggtcagtttcgttttccagatcagtttcgttttcctcgtcagtttcgttttccgactcagtttcgttttccctatcagtttcgttttccacttcagtttcgttttcctgctcagtttcgttttccgtaggcgcgccatgcttcatcagactct

SEQ ID NO: 2575 - DNA, 197 bp, Artificial Sequence; identical to SEQ ID NO: 2574
  Synthetic polynucleotide

SEQ ID NO: 2576 - DNA, 186 bp, Artificial Sequence
  Synthetic polynucleotide
atcatctcaccttgcctcctgactatagtggcgacggtcctgcaggagacatgcccgggcatgtccagaagacatgcccgggcatgtcctcgagacatgcccgggcatgtccgacagacatgcccgggcatgtccctaagacatgcccgggcatgtccactggcgcgccatgcttcatcagactct

SEQ ID NO: 2577 - DNA, 186 bp, Artificial Sequence; identical to SEQ ID NO: 2576
  Synthetic polynucleotide

SEQ ID NO: 2578 - DNA, 172 bp, Artificial Sequence
  Synthetic polynucleotide
atcatctcaccttgcctcctgacggagggcaaccataacctgcagggctaatccccagagctaatcccctcggctaatccccgacgctaatccccctagctaatccccactgctaatcccctgcgctaatccccgtagctaatccccggcgcgccatgcttcatcagactct

SEQ ID NO: 2579 - DNA, 172 bp, Artificial Sequence; identical to SEQ ID NO: 2578
  Synthetic polynucleotide

SEQ ID NO: 2580 - DNA, 179 bp, Artificial Sequence
  Synthetic polynucleotide
atcatctcaccttgcctcctgattccgaccggacagatcctgcaggggggccagggggggggcggggccgagaggggccagggggggggcggggccgtcgggggccagggggggggcggggccggacggggccagggggggggcggggccgctaggcgcgccatgcttcatcagactct

SEQ ID NO: 2581 - DNA, 179 bp, Artificial Sequence; identical to SEQ ID NO: 2580
  Synthetic polynucleotide

SEQ ID NO: 2582 - DNA, 172 bp, Artificial Sequence
  Synthetic polynucleotide
atcatctcaccttgcctcctgctggcatctccactactcctgcaggatcacgtgatagaatcacgtgattcgatcacgtgatgacatcacgtgatctaatcacgtgatactatcacgtgattgcatcacgtgatgtaatcacgtgatggcgcgccatgcttcatcagactct

SEQ ID NO: 2583 - DNA, 172 bp, Artificial Sequence; identical to SEQ ID NO: 2582
  Synthetic polynucleotide

SEQ ID NO: 2584 - DNA, 197 bp, Artificial Sequence
  Synthetic polynucleotide
atcatctcaccttgcctcctgcagttactgcagagattcctgcaggccccgggcacccgggagaccccgggcacccgggtcgccccgggcacccggggacccccgggcacccgggctaccccgggcacccgggactccccgggcacccgggtgcccccgggcacccggggtaggcgcgccatgcttcatcagactct

SEQ ID NO: 2585 - DNA, 197 bp, Artificial Sequence; identical to SEQ ID NO: 2584
  Synthetic polynucleotide

SEQ ID NO: 2586 - DNA, 185 bp, Artificial Sequence
  Synthetic polynucleotide
atcatctcaccttgcctcctgtatgctactcctttcgccctgcaggattggactttgaccccagaattggactttgacccctcgattggactttgaccccgacattggactttgaccccctaattggactttgaccccactattggactttgacccctgcggcgcgccatgcttcatcagactct

SEQ ID NO: 2587 - DNA, 185 bp, Artificial Sequence; identical to SEQ ID NO: 2586
  Synthetic polynucleotide

SEQ ID NO: 2588 - DNA, 180 bp, Artificial Sequence
  Synthetic polynucleotide
atcatctcaccttgcctcctggagcagtgtagagaaaccctgcagggaatgatatccagagaatgatatcctcggaatgatatccgacgaatgatatccctagaatgatatccactgaatgatatcctgcgaatgatatccgtagaatgatatccggcgcgccatgcttcatcagactct

SEQ ID NO: 2589 - DNA, 180 bp, Artificial Sequence; identical to SEQ ID NO: 2588
  Synthetic polynucleotide

SEQ ID NO: 2590 - DNA, 197 bp, Artificial Sequence
  Synthetic polynucleotide
atcatctcaccttgcctcctgattctggacgatcgctacctgcaggtgacctctgacccctagatgacctctgaccccttcgtgacctctgacccctgactgacctctgacccctctatgacctctgacccctacttgacctctgaccccttgctgacctctgacccctgtaggcgcgccatgcttcatcagactct

SEQ ID NO: 2591 - DNA, 197 bp, Artificial Sequence; identical to SEQ ID NO: 2590
  Synthetic polynucleotide

SEQ ID NO: 2592 - DNA, 156 bp, Artificial Sequence
  Synthetic polynucleotide
atcatctcaccttgcctcctgcctaatgaagcttgattcctgcaggaggtcacgagaaggtcacgtcgaggtcacggacaggtcacgctaaggtcacgactaggtcacgtgcaggtcacggtaaggtcacgggcgcgccatgcttcatcagactct

SEQ ID NO: 2593 - DNA, 156 bp, Artificial Sequence; identical to SEQ ID NO: 2592
  Synthetic polynucleotide

SEQ ID NO: 2594 - DNA, 172 bp, Artificial Sequence
  Synthetic polynucleotide
atcatctcaccttgcctcctgcgacctaacgttcatgccctgcaggaccccgccccagaaccccgcccctcgaccccgccccgacaccccgccccctaaccccgccccactaccccgcccctgcaccccgccccgtaaccccgccccggcgcgccatgcttcatcagactct

SEQ ID NO: 2595 - DNA, 172 bp, Artificial Sequence; identical to SEQ ID NO: 2594
  Synthetic polynucleotide

SEQ ID NO: 2596 - DNA, 196 bp, Artificial Sequence
  Synthetic polynucleotide
atcatctcaccttgcctcctgggatgtgtgccgttgtccctgcagggttacttcctgtcagagttacttcctgtctcggttacttcctgtcgacgttacttcctgtcctagttacttcctgtcactgttacttcctgtctgcgttacttcctgtcgtagttacttcctgtcggcgcgccatgcttcatcagactct

SEQ ID NO: 2597 - DNA, 196 bp, Artificial Sequence; identical to SEQ ID NO: 2596
  Synthetic polynucleotide

SEQ ID NO: 2598 - DNA, 197 bp, Artificial Sequence
  Synthetic polynucleotide
atcatctcaccttgcctcctgggcaattactgggctctcctgcaggaacaattgcagtgttagaaacaattgcagtgtttcgaacaattgcagtgttgacaacaattgcagtgttctaaacaattgcagtgttactaacaattgcagtgtttgcaacaattgcagtgttgtaggcgcgccatgcttcatcagactct

SEQ ID NO: 2599 - DNA, 197 bp, Artificial Sequence; identical to SEQ ID NO: 2598
  Synthetic polynucleotide

SEQ ID NO: 2600 - DNA, 200 bp, Artificial Sequence
  Synthetic polynucleotide
atcatctcaccttgcctcctgggccgaaactgaatattcctgcaggggggatcgcgtgacaacccagaggggatcgcgtgacaaccctcgggggatcgcgtgacaacccgacggggatcgcgtgacaacccctaggggatcgcgtgacaacccactggggatcgcgtgacaacccggcgcgccatgcttcatcagactct

SEQ ID NO: 2601 - DNA, 200 bp, Artificial Sequence; identical to SEQ ID NO: 2600
  Synthetic polynucleotide

SEQ ID NO: 2602 - DNA, 156 bp, Artificial Sequence
  Synthetic polynucleotide
atcatctcaccttgcctcctgacaactactgattccaccctgcaggtatcacttagatatcactttcgtatcacttgactatcacttctatatcacttacttatcactttgctatcacttgtatatcacttggcgcgccatgcttcatcagactct

SEQ ID NO: 2603 - DNA, 156 bp, Artificial Sequence; identical to SEQ ID NO: 2602
  Synthetic polynucleotide

SEQ ID NO: 2604 - DNA, 164 bp, Artificial Sequence
  Synthetic polynucleotide
atcatctcaccttgcctcctgtgaagcgctgcaatgatcctgcaggtaattaagaagataattaagatcgtaattaagagactaattaagactataattaagaacttaattaagatgctaattaagagtataattaagaggcgcgccatgcttcatcagactct

SEQ ID NO: 2605 - DNA, 164 bp, Artificial Sequence; identical to SEQ ID NO: 2604
  Synthetic polynucleotide

SEQ ID NO: 2606 - DNA, 197 bp, Artificial Sequence
  Synthetic polynucleotide
atcatctcaccttgcctcctgtctatatgaagaagaggcctgcaggcaataatccgtttttagacaataatccgttttttcgcaataatccgtttttgaccaataatccgtttttctacaataatccgtttttactcaataatccgttttttgccaataatccgtttttgtaggcgcgccatgcttcatcagactct

SEQ ID NO: 2607 - DNA, 197 bp, Artificial Sequence; identical to SEQ ID NO: 2606
  Synthetic polynucleotide

SEQ ID NO: 2608 - DNA, 200 bp, Artificial Sequence
  Synthetic polynucleotide
atcatctcaccttgcctcctggagactagtttcccgaccctgcaggtgggtacactgtgttctagagatgggtacactgtgttctagtcgtgggtacactgtgttctaggactgggtacactgtgttctagctatgggtacactgtgttctagacttgggtacactgtgttctagggcgcgccatgcttcatcagactct

SEQ ID NO: 2609 - DNA, 200 bp, Artificial Sequence; identical to SEQ ID NO: 2608
  Synthetic polynucleotide

SEQ ID NO: 2610 - DNA, 156 bp, Artificial Sequence
  Synthetic polynucleotide
atcatctcaccttgcctcctggcaggacagaacatcggcctgcagggagatcaaagagagatcaatcggagatcaagacgagatcaactagagatcaaactgagatcaatgcgagatcaagtagagatcaaggcgcgccatgcttcatcagactct

SEQ ID NO: 2611 - DNA, 156 bp, Artificial Sequence; identical to SEQ ID NO: 2610
  Synthetic polynucleotide

SEQ ID NO: 2612 - DNA, 188 bp, Artificial Sequence
  Synthetic polynucleotide
atcatctcaccttgcctcctgttgatcctgtgattcgccctgcaggatgttaacataaagaatgttaacataatcgatgttaacataagacatgttaacataactaatgttaacataaactatgttaacataatgcatgttaacataagtaatgttaacataaggcgcgccatgcttcatcagactct

SEQ ID NO: 2613 - DNA, 188 bp, Artificial Sequence; identical to SEQ ID NO: 2612
  Synthetic polynucleotide

SEQ ID NO: 2614 - DNA, 180 bp, Artificial Sequence
  Synthetic polynucleotide
atcatctcaccttgcctcctgccctttgtttacagctacctgcaggggcgtgggcggagaggcgtgggcggtcgggcgtgggcgggacggcgtgggcggctaggcgtgggcggactggcgtgggcggtgcggcgtgggcgggtaggcgtgggcggggcgcgccatgcttcatcagactct

SEQ ID NO: 2615 - DNA, 180 bp, Artificial Sequence; identical to SEQ ID NO: 2614
  Synthetic polynucleotide

SEQ ID NO: 2616 - DNA, 148 bp, Artificial Sequence
  Synthetic polynucleotide
atcatctcaccttgcctcctggttgaatccatcttccgcctgcaggaggaagtagaaggaagttcgaggaagtgacaggaagtctaaggaagtactaggaagttgcaggaagtgtaaggaagtggcgcgccatgcttcatcagactct

SEQ ID NO: 2617 - DNA, 148 bp, Artificial Sequence; identical to SEQ ID NO: 2616
  Synthetic polynucleotide

SEQ ID NO: 2618 - DNA, 186 bp, Artificial Sequence
  Synthetic polynucleotide
atcatctcaccttgcctcctgcggcgttgtatgtacagcctgcaggggccaccagatggcactataagaggccaccagatggcactatatcgggccaccagatggcactatagacggccaccagatggcactatactaggccaccagatggcactataactggcgcgccatgcttcatcagactct

SEQ ID NO: 2619 - DNA, 186 bp, Artificial Sequence; identical to SEQ ID NO: 2618
  Synthetic polynucleotide

SEQ ID NO: 2620 - DNA, 191 bp, Artificial Sequence
  Synthetic polynucleotide
atcatctcaccttgcctcctgtatcagcccatcactcacctgcaggaaaacatcgtttttaagagaaaaacatcgtttttaagtcgaaaacatcgtttttaaggacaaaacatcgtttttaagctaaaaacatcgtttttaagactaaaacatcgtttttaagtgcggcgcgccatgcttcatcagactct

SEQ ID NO: 2621 - DNA, 191 bp, Artificial Sequence; identical to SEQ ID NO: 2620
  Synthetic polynucleotide

SEQ ID NO: 2622 - DNA, 185 bp, Artificial Sequence
  Synthetic polynucleotide
atcatctcaccttgcctcctgacagacgcttaggataacctgcaggagggggattagctgccagaagggggattagctgcctcgagggggattagctgccgacagggggattagctgccctaagggggattagctgccactagggggattagctgcctgcggcgcgccatgcttcatcagactct

SEQ ID NO: 2623 - DNA, 185 bp, Artificial Sequence; identical to SEQ ID NO: 2622
  Synthetic polynucleotide

SEQ ID NO: 2624 - DNA, 197 bp, Artificial Sequence
  Synthetic polynucleotide
atcatctcaccttgcctcctgcggattagtgctctatccctgcaggcccctcccccaccccagacccctcccccacccctcgcccctcccccaccccgaccccctcccccaccccctacccctcccccaccccactcccctcccccacccctgccccctcccccaccccgtaggcgcgccatgcttcatcagactct

SEQ ID NO: 2625 - DNA, 197 bp, Artificial Sequence; identical to SEQ ID NO: 2624
  Synthetic polynucleotide

SEQ ID NO: 2626 - DNA, 156 bp, Artificial Sequence
  Synthetic polynucleotide
atcatctcaccttgcctcctgcgtccaatatgaccaatcctgcaggtagggtacagatagggtactcgtagggtacgactagggtacctatagggtacacttagggtactgctagggtacgtatagggtacggcgcgccatgcttcatcagactct

SEQ ID NO: 2627 - DNA, 156 bp, Artificial Sequence; identical to SEQ ID NO: 2626
  Synthetic polynucleotide

SEQ ID NO: 2628 - DNA, 190 bp, Artificial Sequence
  Synthetic polynucleotide
atcatctcaccttgcctcctgccctgtcgcagggtaatcctgcaggtgacctttgtcctaagatgacctttgtcctatcgtgacctttgtcctagactgacctttgtcctactatgacctttgtcctaacttgacctttgtcctatgctgacctttgtcctagtaggcgcgccatgcttcatcagactct

SEQ ID NO: 2629 - DNA, 190 bp, Artificial Sequence; identical to SEQ ID NO: 2628
  Synthetic polynucleotide

SEQ ID NO: 2630 - DNA, 156 bp, Artificial Sequence
  Synthetic polynucleotide
atcatctcaccttgcctcctgatcgaaaggacctgcaccctgcaggaacaaaggagaaacaaaggtcgaacaaagggacaacaaaggctaaacaaaggactaacaaaggtgcaacaaagggtaaacaaaggggcgcgccatgcttcatcagactct

SEQ ID NO: 2631 - DNA, 156 bp, Artificial Sequence; identical to SEQ ID NO: 2630
  Synthetic polynucleotide

SEQ ID NO: 2632 - DNA, 156 bp, Artificial Sequence
  Synthetic polynucleotide
atcatctcaccttgcctcctgatgggtctaattagtcccctgcaggcacttgagagacacttgagtcgcacttgaggaccacttgagctacacttgagactcacttgagtgccacttgaggtacacttgagggcgcgccatgcttcatcagactct

SEQ ID NO: 2633 - DNA, 156 bp, Artificial Sequence; identical to SEQ ID NO: 2632
  Synthetic polynucleotide

SEQ ID NO: 2634 - DNA, 196 bp, Artificial Sequence
  Synthetic polynucleotide
atcatctcaccttgcctcctgatatggaatctctccgccctgcaggtggactttgacctagatggactttgaccttcgtggactttgacctgactggactttgacctctatggactttgacctacttggactttgaccttgctggactttgacctgtatggactttgacctggcgcgccatgcttcatcagactct

SEQ ID NO: 2635 - DNA, 196 bp, Artificial Sequence; identical to SEQ ID NO: 2634
  Synthetic polynucleotide

SEQ ID NO: 2636 - DNA, 172 bp, Artificial Sequence
  Synthetic polynucleotide
atcatctcaccttgcctcctgcgatcttacattatccgcctgcagggccacgcccaagagccacgcccatcggccacgcccagacgccacgcccactagccacgcccaactgccacgcccatgcgccacgcccagtagccacgcccaggcgcgccatgcttcatcagactct

SEQ ID NO: 2637 - DNA, 172 bp, Artificial Sequence; identical to SEQ ID NO: 2636
  Synthetic polynucleotide

SEQ ID NO: 2638 - DNA, 196 bp, Artificial Sequence
  Synthetic polynucleotide
atcatctcaccttgcctcctgcagatcctaccaaacctcctgcagggggttaatgacctagagggttaatgaccttcggggttaatgacctgacgggttaatgacctctagggttaatgacctactgggttaatgaccttgcgggttaatgacctgtagggttaatgacctggcgcgccatgcttcatcagactct

SEQ ID NO: 2639 - DNA, 196 bp, Artificial Sequence; identical to SEQ ID NO: 2638
  Synthetic polynucleotide

SEQ ID NO: 2640 - DNA, 164 bp, Artificial Sequence
  Synthetic polynucleotide
atcatctcaccttgcctcctgatttagagtctccatcgcctgcagggcctggggcagagcctggggctcggcctggggcgacgcctggggcctagcctggggcactgcctggggctgcgcctggggcgtagcctggggcggcgcgccatgcttcatcagactct

SEQ ID NO: 2641 - DNA, 164 bp, Artificial Sequence; identical to SEQ ID NO: 2640
  Synthetic polynucleotide

SEQ ID NO: 2642 - DNA, 148 bp, Artificial Sequence
  Synthetic polynucleotide
atcatctcaccttgcctcctgatcgtctagacagcccacctgcaggaatgactagaaatgacttcgaatgactgacaatgactctaaatgactactaatgacttgcaatgactgtaaatgactggcgcgccatgcttcatcagactct

SEQ ID NO: 2643 - DNA, 148 bp, Artificial Sequence; identical to SEQ ID NO: 2642
  Synthetic polynucleotide

SEQ ID NO: 2644 - DNA, 164 bp, Artificial Sequence
  Synthetic polynucleotide
atcatctcaccttgcctcctgttaaccaggctacgtagcctgcaggccaattaaaagaccaattaaatcgccaattaaagacccaattaaactaccaattaaaactccaattaaatgcccaattaaagtaccaattaaaggcgcgccatgcttcatcagactct

SEQ ID NO: 2645 - DNA, 164 bp, Artificial Sequence; identical to SEQ ID NO: 2644
  Synthetic polynucleotide

SEQ ID NO: 2646 - DNA, 197 bp, Artificial Sequence
  Synthetic polynucleotide
atcatctcaccttgcctcctgtggcaagccgccatttacctgcaggaggtcaccgtgacccagaaggtcaccgtgaccctcgaggtcaccgtgacccgacaggtcaccgtgacccctaaggtcaccgtgacccactaggtcaccgtgaccctgcaggtcaccgtgacccgtaggcgcgccatgcttcatcagactct

SEQ ID NO: 2647 - DNA, 197 bp, Artificial Sequence; identical to SEQ ID NO: 2646
  Synthetic polynucleotide

SEQ ID NO: 2648 - DNA, 197 bp, Artificial Sequence
  Synthetic polynucleotide
atcatctcaccttgcctcctggcggtggaagatatcctcctgcaggaacaatttcagtgttagaaacaatttcagtgtttcgaacaatttcagtgttgacaacaatttcagtgttctaaacaatttcagtgttactaacaatttcagtgtttgcaacaatttcagtgttgtaggcgcgccatgcttcatcagactct

SEQ ID NO: 2649 - DNA, 197 bp, Artificial Sequence; identical to SEQ ID NO: 2648
  Synthetic polynucleotide

SEQ ID NO: 2650 - DNA, 188 bp, Artificial Sequence
  Synthetic polynucleotide
atcatctcaccttgcctcctggacaacatgattcgcaccctgcagggcgtcagctgttagagcgtcagctgtttcggcgtcagctgttgacgcgtcagctgttctagcgtcagctgttactgcgtcagctgtttgcgcgtcagctgttgtagcgtcagctgttggcgcgccatgcttcatcagactct

SEQ ID NO: 2651 - DNA, 188 bp, Artificial Sequence; identical to SEQ ID NO: 2650
  Synthetic polynucleotide

SEQ ID NO: 2652 - DNA, 172 bp, Artificial Sequence
  Synthetic polynucleotide
atcatctcaccttgcctcctggttgcttaagtctttgtcctgcaggttttgcgccaagattttgcgccatcgttttgcgccagacttttgcgccactattttgcgccaactttttgcgccatgcttttgcgccagtattttgcgccaggcgcgccatgcttcatcagactct

SEQ ID NO: 2653 - DNA, 172 bp, Artificial Sequence; identical to SEQ ID NO: 2652
  Synthetic polynucleotide

SEQ ID NO: 2654 - DNA, 188 bp, Artificial Sequence
  Synthetic polynucleotide
atcatctcaccttgcctcctgtgcgtcactctttgcagcctgcaggtgtatgctaattagatgtatgctaatttcgtgtatgctaattgactgtatgctaattctatgtatgctaattacttgtatgctaatttgctgtatgctaattgtatgtatgctaattggcgcgccatgcttcatcagactct

SEQ ID NO: 2655 - DNA, 188 bp, Artificial Sequence; identical to SEQ ID NO: 2654
  Synthetic polynucleotide

SEQ ID NO: 2656 - DNA, 156 bp, Artificial Sequence
  Synthetic polynucleotide
atcatctcaccttgcctcctggtaggcagtgctgttgccctgcaggacttccggagaacttccggtcgacttccgggacacttccggctaacttccggactacttccggtgcacttccgggtaacttccggggcgcgccatgcttcatcagactct

SEQ ID NO: 2657 - DNA, 156 bp, Artificial Sequence; identical to SEQ ID NO: 2656
  Synthetic polynucleotide

SEQ ID NO: 2658 - DNA, 140 bp, Artificial Sequence
  Synthetic polynucleotide
atcatctcaccttgcctcctgggtagaactgaccgtcacctgcaggctgtcaagactgtcatcgctgtcagacctgtcactactgtcaactctgtcatgcctgtcagtactgtcaggcgcgccatgcttcatcagactct

SEQ ID NO: 2659 - DNA, 140 bp, Artificial Sequence; identical to SEQ ID NO: 2658
  Synthetic polynucleotide

SEQ ID NO: 2660 - DNA, 186 bp, Artificial Sequence
  Synthetic polynucleotide
atcatctcaccttgcctcctggattctagagtccactgcctgcagggcaaggcattatgggaaatcagagcaaggcattatgggaaatctcggcaaggcattatgggaaatcgacgcaaggcattatgggaaatcctagcaaggcattatgggaaatcactggcgcgccatgcttcatcagactct

SEQ ID NO: 2661 - DNA, 186 bp, Artificial Sequence; identical to SEQ ID NO: 2660
  Synthetic polynucleotide

SEQ ID NO: 2662 - DNA, 156 bp, Artificial Sequence
  Synthetic polynucleotide
atcatctcaccttgcctcctgttatactgtggtacacccctgcaggcgcccacgagacgcccacgtcgcgcccacggaccgcccacgctacgcccacgactcgcccacgtgccgcccacggtacgcccacgggcgcgccatgcttcatcagactct

SEQ ID NO: 2663 - DNA, 156 bp, Artificial Sequence; identical to SEQ ID NO: 2662
  Synthetic polynucleotide

SEQ ID NO: 2664 - DNA, 188 bp, Artificial Sequence
  Synthetic polynucleotide
atcatctcaccttgcctcctgcctacctacaccaggaacctgcaggtaagtaaacaaaagataagtaaacaaatcgtaagtaaacaaagactaagtaaacaaactataagtaaacaaaacttaagtaaacaaatgctaagtaaacaaagtataagtaaacaaaggcgcgccatgcttcatcagactct

SEQ ID NO: 2665 - DNA, 188 bp, Artificial Sequence; identical to SEQ ID NO: 2664
  Synthetic polynucleotide

SEQ ID NO: 2666 - DNA, 172 bp, Artificial Sequence
  Synthetic polynucleotide
atcatctcaccttgcctcctgcagagaacggttgcgtccctgcaggggcacgcgtcagaggcacgcgtctcgggcacgcgtcgacggcacgcgtcctaggcacgcgtcactggcacgcgtctgcggcacgcgtcgtaggcacgcgtcggcgcgccatgcttcatcagactct

SEQ ID NO: 2667 - DNA, 172 bp, Artificial Sequence; identical to SEQ ID NO: 2666
  Synthetic polynucleotide

SEQ ID NO: 2668 - DNA, 188 bp, Artificial Sequence
  Synthetic polynucleotide
atcatctcaccttgcctcctgaaccgcgatcctaagtccctgcaggcacattcctccgagacacattcctccgtcgcacattcctccggaccacattcctccgctacacattcctccgactcacattcctccgtgccacattcctccggtacacattcctccgggcgcgccatgcttcatcagactct

SEQ ID NO: 2669 - DNA, 188 bp, Artificial Sequence; identical to SEQ ID NO: 2668
  Synthetic polynucleotide

SEQ ID NO: 2670 - DNA, 180 bp, Artificial Sequence
  Synthetic polynucleotide
atcatctcaccttgcctcctgtgatccctctatgtgtgcctgcaggacagataagaaagaacagataagaatcgacagataagaagacacagataagaactaacagataagaaactacagataagaatgcacagataagaagtaacagataagaaggcgcgccatgcttcatcagactct

SEQ ID NO: 2671 - DNA, 180 bp, Artificial Sequence; identical to SEQ ID NO: 2670
  Synthetic polynucleotide

SEQ ID NO: 2672 - DNA, 156 bp, Artificial Sequence
  Synthetic polynucleotide
atcatctcaccttgcctcctgttgtgcgcaggcctttacctgcagggtgaacttagagtgaactttcggtgaacttgacgtgaacttctagtgaacttactgtgaactttgcgtgaacttgtagtgaacttggcgcgccatgcttcatcagactct

SEQ ID NO: 2673 - DNA, 156 bp, Artificial Sequence; identical to SEQ ID NO: 2672
  Synthetic polynucleotide

SEQ ID NO: 2674 - DNA, 156 bp, Artificial Sequence
  Synthetic polynucleotide
atcatctcaccttgcctcctgaggatatattaacgcgccctgcaggttatgacaagattatgacatcgttatgacagacttatgacactattatgacaactttatgacatgcttatgacagtattatgacaggcgcgccatgcttcatcagactct

SEQ ID NO: 2675 - DNA, 156 bp, Artificial Sequence; identical to SEQ ID NO: 2674
  Synthetic polynucleotide

SEQ ID NO: 2676 - DNA, 198 bp, Artificial Sequence
  Synthetic polynucleotide
atcatctcaccttgcctcctgactacgtcctgacattccctgcaggtctcacacctctgaggtgtgaaaagatctcacacctctgaggtgtgaaatcgtctcacacctctgaggtgtgaaagactctcacacctctgaggtgtgaaactatctcacacctctgaggtgtgaaaggcgcgccatgcttcatcagactct

SEQ ID NO: 2677 - DNA, 198 bp, Artificial Sequence; identical to SEQ ID NO: 2676
  Synthetic polynucleotide

SEQ ID NO: 2678 - DNA, 191 bp, Artificial Sequence
  Synthetic polynucleotide
atcatctcaccttgcctcctgctcgacgcgtcacgatacctgcaggttcagcaccacggagagcgccagattcagcaccacggagagcgcctcgttcagcaccacggagagcgccgacttcagcaccacggagagcgccctattcagcaccacggagagcgccactggcgcgccatgcttcatcagactct

SEQ ID NO: 2679 - DNA, 191 bp, Artificial Sequence; identical to SEQ ID NO: 2678
  Synthetic polynucleotide

SEQ ID NO: 2680 - DNA, 197 bp, Artificial Sequence
  Synthetic polynucleotide
atcatctcaccttgcctcctgtaccgctacgatgaacccctgcaggttcgaaccgttcgaaagattcgaaccgttcgaatcgttcgaaccgttcgaagacttcgaaccgttcgaactattcgaaccgttcgaaactttcgaaccgttcgaatgcttcgaaccgttcgaagtaggcgcgccatgcttcatcagactct

SEQ ID NO: 2681 - DNA, 197 bp, Artificial Sequence; identical to SEQ ID NO: 2680
  Synthetic polynucleotide

SEQ ID NO: 2682 - DNA, 156 bp, Artificial Sequence
  Synthetic polynucleotide
atcatctcaccttgcctcctggatacaaagtaccagctcctgcaggccttatcaagaccttatcatcgccttatcagacccttatcactaccttatcaactccttatcatgcccttatcagtaccttatcaggcgcgccatgcttcatcagactct

SEQ ID NO: 2683 - DNA, 156 bp, Artificial Sequence; identical to SEQ ID NO: 2682
  Synthetic polynucleotide

SEQ ID NO: 2684 - DNA, 172 bp, Artificial Sequence
  Synthetic polynucleotide
atcatctcaccttgcctcctggtgccttacctaaagttcctgcaggtgcgggggcgagatgcgggggcgtcgtgcgggggcggactgcgggggcgctatgcgggggcgacttgcgggggcgtgctgcgggggcggtatgcgggggcgggcgcgccatgcttcatcagactct

SEQ ID NO: 2685 - DNA, 172 bp, Artificial Sequence; identical to SEQ ID NO: 2684
  Synthetic polynucleotide

SEQ ID NO: 2686 - DNA, 191 bp, Artificial Sequence
  Synthetic polynucleotide
atcatctcaccttgcctcctggtctcctgtattgcggtcctgcaggatagttaatccccctcaagaatagttaatccccctcatcgatagttaatccccctcagacatagttaatccccctcactaatagttaatccccctcaactatagttaatccccctcatgcggcgcgccatgcttcatcagactct

SEQ ID NO: 2687 - DNA, 191 bp, Artificial Sequence; identical to SEQ ID NO: 2686
  Synthetic polynucleotide

SEQ ID NO: 2688 - DNA, 188 bp, Artificial Sequence
  Synthetic polynucleotide
atcatctcaccttgcctcctgacactatccgtctttgtcctgcaggccgcggacgttgagaccgcggacgttgtcgccgcggacgttggacccgcggacgttgctaccgcggacgttgactccgcggacgttgtgcccgcggacgttggtaccgcggacgttgggcgcgccatgcttcatcagactct

SEQ ID NO: 2689 - DNA, 188 bp, Artificial Sequence; identical to SEQ ID NO: 2688
  Synthetic polynucleotide

SEQ ID NO: 2690 - DNA, 197 bp, Artificial Sequence
  Synthetic polynucleotide
atcatctcaccttgcctcctggatcctgagatcccggacctgcaggaggtcaccgtgacctagaaggtcaccgtgaccttcgaggtcaccgtgacctgacaggtcaccgtgacctctaaggtcaccgtgacctactaggtcaccgtgaccttgcaggtcaccgtgacctgtaggcgcgccatgcttcatcagactct

SEQ ID NO: 2691 - DNA, 197 bp, Artificial Sequence; identical to SEQ ID NO: 2690
  Synthetic polynucleotide

SEQ ID NO: 2692 - DNA, 172 bp, Artificial Sequence
  Synthetic polynucleotide
atcatctcaccttgcctcctgtctcggtatcgttaagtcctgcaggggagggggaaagaggagggggaatcgggagggggaagacggagggggaactaggagggggaaactggagggggaatgcggagggggaagtaggagggggaaggcgcgccatgcttcatcagactct

SEQ ID NO: 2693 - DNA, 172 bp, Artificial Sequence; identical to SEQ ID NO: 2692
  Synthetic polynucleotide

SEQ ID NO: 2694 - DNA, 191 bp, Artificial Sequence
  Synthetic polynucleotide
atcatctcaccttgcctcctggaaggcctgcacagttccctgcaggcacttccggcggaagtgagacacttccggcggaagtgtcgcacttccggcggaagtggaccacttccggcggaagtgctacacttccggcggaagtgactcacttccggcggaagtgtgcggcgcgccatgcttcatcagactct

SEQ ID NO: 2695 - DNA, 191 bp, Artificial Sequence; identical to SEQ ID NO: 2694
  Synthetic polynucleotide

SEQ ID NO: 2696 - DNA, 188 bp, Artificial Sequence
  Synthetic polynucleotide
atcatctcaccttgcctcctgttagcggcatctggttacctgcaggcagtgtggtcgcagacagtgtggtcgctcgcagtgtggtcgcgaccagtgtggtcgcctacagtgtggtcgcactcagtgtggtcgctgccagtgtggtcgcgtacagtgtggtcgcggcgcgccatgcttcatcagactct

SEQ ID NO: 2697 - DNA, 188 bp, Artificial Sequence; identical to SEQ ID NO: 2696
  Synthetic polynucleotide

SEQ ID NO: 2698 - DNA, 180 bp, Artificial Sequence
  Synthetic polynucleotide
atcatctcaccttgcctcctgcgaatatgttgcatgcacctgcaggaatttgctgacagaaatttgctgactcgaatttgctgacgacaatttgctgacctaaatttgctgacactaatttgctgactgcaatttgctgacgtaaatttgctgacggcgcgccatgcttcatcagactct

SEQ ID NO: 2699 - DNA, 180 bp, Artificial Sequence; identical to SEQ ID NO: 2698
  Synthetic polynucleotide

SEQ ID NO: 2700 - DNA, 197 bp, Artificial Sequence
  Synthetic polynucleotide
atcatctcaccttgcctcctgctagggtaccttctcggcctgcaggaaggatgagtcaccgagaaaggatgagtcaccgtcgaaggatgagtcaccggacaaggatgagtcaccgctaaaggatgagtcaccgactaaggatgagtcaccgtgcaaggatgagtcaccggtaggcgcgccatgcttcatcagactct

SEQ ID NO: 2701 - DNA, 197 bp, Artificial Sequence; identical to SEQ ID NO: 2700
  Synthetic polynucleotide

SEQ ID NO: 2702 - DNA, 191 bp, Artificial Sequence
  Synthetic polynucleotide
atcatctcaccttgcctcctgatctgtcctagctgatgcctgcaggcttcaggggtcaattgaagacttcaggggtcaattgatcgcttcaggggtcaattgagaccttcaggggtcaattgactacttcaggggtcaattgaactcttcaggggtcaattgatgcggcgcgccatgcttcatcagactct

SEQ ID NO: 2703 - DNA, 191 bp, Artificial Sequence; identical to SEQ ID NO: 2702
  Synthetic polynucleotide

SEQ ID NO: 2704 - DNA, 188 bp, Artificial Sequence
  Synthetic polynucleotide
atcatctcaccttgcctcctgtttagagaagcgaaggtcctgcaggtataatcgttttagatataatcgtttttcgtataatcgttttgactataatcgttttctatataatcgttttacttataatcgtttttgctataatcgttttgtatataatcgttttggcgcgccatgcttcatcagactct

SEQ ID NO: 2705 - DNA, 188 bp, Artificial Sequence; identical to SEQ ID NO: 2704
  Synthetic polynucleotide

SEQ ID NO: 2706 - DNA, 200 bp, Artificial Sequence
  Synthetic polynucleotide
atcatctcaccttgcctcctgtcacttgatagcggtagcctgcagggggggccccaggcctcggcagagggggccccaggcctcggctcggggggccccaggcctcggcgacgggggccccaggcctcggcctagggggccccaggcctcggcactgggggccccaggcctcggcggcgcgccatgcttcatcagactct

SEQ ID NO: 2707 - DNA, 200 bp, Artificial Sequence; identical to SEQ ID NO: 2706
  Synthetic polynucleotide

SEQ ID NO: 2708 - DNA, 190 bp, Artificial Sequence
  Synthetic polynucleotide
atcatctcaccttgcctcctgtgtactctgcgcctggtcctgcaggacgaccccccacagagaacgaccccccacagtcgacgaccccccacaggacacgaccccccacagctaacgaccccccacagactacgaccccccacagtgcacgaccccccacaggtaggcgcgccatgcttcatcagactct

SEQ ID NO: 2709 - DNA, 190 bp, Artificial Sequence; identical to SEQ ID NO: 2708
  Synthetic polynucleotide

SEQ ID NO: 2710 - DNA, 164 bp, Artificial Sequence
  Synthetic polynucleotide
atcatctcaccttgcctcctggttagcattcaattccgcctgcagggtaattaatagagtaattaattcggtaattaatgacgtaattaatctagtaattaatactgtaattaattgcgtaattaatgtagtaattaatggcgcgccatgcttcatcagactct

SEQ ID NO: 2711 - DNA, 164 bp, Artificial Sequence; identical to SEQ ID NO: 2710
  Synthetic polynucleotide

SEQ ID NO: 2712 - DNA, 188 bp, Artificial Sequence
  Synthetic polynucleotide
atcatctcaccttgcctcctggatttaaagccgctattcctgcaggcgggtggggattagacgggtggggatttcgcgggtggggattgaccgggtggggattctacgggtggggattactcgggtggggatttgccgggtggggattgtacgggtggggattggcgcgccatgcttcatcagactct

SEQ ID NO: 2713 - DNA, 188 bp, Artificial Sequence; identical to SEQ ID NO: 2712
  Synthetic polynucleotide

SEQ ID NO: 2714 - DNA, 197 bp, Artificial Sequence
  Synthetic polynucleotide
atcatctcaccttgcctcctggtgacctctatattcctcctgcagggcaaagtaaacagagagagcaaagtaaacagagtcggcaaagtaaacagaggacgcaaagtaaacagagctagcaaagtaaacagagactgcaaagtaaacagagtgcgcaaagtaaacagaggtaggcgcgccatgcttcatcagactct

SEQ ID NO: 2715 - DNA, 197 bp, Artificial Sequence; identical to SEQ ID NO: 2714
  Synthetic polynucleotide

SEQ ID NO: 2716 - DNA, 180 bp, Artificial Sequence
  Synthetic polynucleotide
atcatctcaccttgcctcctgccatgctatgagaaagacctgcaggccggaagtggcagaccggaagtggctcgccggaagtggcgacccggaagtggcctaccggaagtggcactccggaagtggctgcccggaagtggcgtaccggaagtggcggcgcgccatgcttcatcagactct

SEQ ID NO: 2717 - DNA, 180 bp, Artificial Sequence; identical to SEQ ID NO: 2716
  Synthetic polynucleotide

SEQ ID NO: 2718 - DNA, 197 bp, Artificial Sequence
  Synthetic polynucleotide
atcatctcaccttgcctcctgcaattccataaagaggccctgcaggaaggtgacgtcatcaagaaaggtgacgtcatcatcgaaggtgacgtcatcagacaaggtgacgtcatcactaaaggtgacgtcatcaactaaggtgacgtcatcatgcaaggtgacgtcatcagtaggcgcgccatgcttcatcagactct

SEQ ID NO: 2719 - DNA, 197 bp, Artificial Sequence; identical to SEQ ID NO: 2718
  Synthetic polynucleotide

SEQ ID NO: 2720 - DNA, 197 bp, Artificial Sequence
  Synthetic polynucleotide
atcatctcaccttgcctcctgatgttaataccagggagcctgcaggtttttttcttttcttagatttttttcttttctttcgtttttttcttttcttgactttttttcttttcttctatttttttcttttcttacttttttttcttttctttgctttttttcttttcttgtaggcgcgccatgcttcatcagactct

SEQ ID NO: 2721 - DNA, 197 bp, Artificial Sequence; identical to SEQ ID NO: 2720
  Synthetic polynucleotide

SEQ ID NO: 2722 - DNA, 172 bp, Artificial Sequence
  Synthetic polynucleotide
atcatctcaccttgcctcctgtcatcggatcgtaccaacctgcaggactgacctcgagaactgacctcgtcgactgacctcggacactgacctcgctaactgacctcgactactgacctcgtgcactgacctcggtaactgacctcgggcgcgccatgcttcatcagactct

SEQ ID NO: 2723 - DNA, 172 bp, Artificial Sequence; identical to SEQ ID NO: 2722
  Synthetic polynucleotide

SEQ ID NO: 2724 - DNA, 197 bp, Artificial Sequence
  Synthetic polynucleotide
atcatctcaccttgcctcctgtcagtagatttgcacgacctgcaggaacaaaatggcggccagaaacaaaatggcggcctcgaacaaaatggcggccgacaacaaaatggcggccctaaacaaaatggcggccactaacaaaatggcggcctgcaacaaaatggcggccgtaggcgcgccatgcttcatcagactct

SEQ ID NO: 2725 - DNA, 197 bp, Artificial Sequence; identical to SEQ ID NO: 2724
  Synthetic polynucleotide

SEQ ID NO: 2726 - DNA, 190 bp, Artificial Sequence
  Synthetic polynucleotide
atcatctcaccttgcctcctgattccataatcttcgaccctgcaggcactcactccctgtagacactcactccctgttcgcactcactccctgtgaccactcactccctgtctacactcactccctgtactcactcactccctgttgccactcactccctgtgtaggcgcgccatgcttcatcagactct

SEQ ID NO: 2727 - DNA, 190 bp, Artificial Sequence; identical to SEQ ID NO: 2726
  Synthetic polynucleotide

SEQ ID NO: 2728 - DNA, 172 bp, Artificial Sequence
  Synthetic polynucleotide
atcatctcaccttgcctcctgcgtagattgttcacgatcctgcaggtttcaagtggagatttcaagtggtcgtttcaagtgggactttcaagtggctatttcaagtggacttttcaagtggtgctttcaagtgggtatttcaagtggggcgcgccatgcttcatcagactct

SEQ ID NO: 2729 - DNA, 172 bp, Artificial Sequence; identical to SEQ ID NO: 2728
  Synthetic polynucleotide

SEQ ID NO: 2730 - DNA, 191 bp, Artificial Sequence
  Synthetic polynucleotide
atcatctcaccttgcctcctggacgatcaagattccgtcctgcaggtattgttaattaattcgagatattgttaattaattcgtcgtattgttaattaattcggactattgttaattaattcgctatattgttaattaattcgacttattgttaattaattcgtgcggcgcgccatgcttcatcagactct

SEQ ID NO: 2731 - DNA, 191 bp, Artificial Sequence; identical to SEQ ID NO: 2730
  Synthetic polynucleotide

SEQ ID NO: 2732 - DNA, 196 bp, Artificial Sequence
  Synthetic polynucleotide
atcatctcaccttgcctcctgctgatattcgacaccaacctgcaggctcgacctaattaagactcgacctaattatcgctcgacctaattagacctcgacctaattactactcgacctaattaactctcgacctaattatgcctcgacctaattagtactcgacctaattaggcgcgccatgcttcatcagactct

SEQ ID NO: 2733 - DNA, 196 bp, Artificial Sequence; identical to SEQ ID NO: 2732
  Synthetic polynucleotide

SEQ ID NO: 2734 - DNA, 164 bp, Artificial Sequence
  Synthetic polynucleotide
atcatctcaccttgcctcctgaaacgctggcgcgcattcctgcaggtccacttaaagatccacttaatcgtccacttaagactccacttaactatccacttaaacttccacttaatgctccacttaagtatccacttaaggcgcgccatgcttcatcagactct

SEQ ID NO: 2735 - DNA, 164 bp, Artificial Sequence; identical to SEQ ID NO: 2734
  Synthetic polynucleotide

SEQ ID NO: 2736 - DNA, 156 bp, Artificial Sequence
  Synthetic polynucleotide
atcatctcaccttgcctcctgccataccgcatgactcgcctgcaggccggaagtagaccggaagttcgccggaagtgacccggaagtctaccggaagtactccggaagttgcccggaagtgtaccggaagtggcgcgccatgcttcatcagactct

SEQ ID NO: 2737 - DNA, 156 bp, Artificial Sequence; identical to SEQ ID NO: 2736
  Synthetic polynucleotide

SEQ ID NO: 2738 - DNA, 180 bp, Artificial Sequence
  Synthetic polynucleotide
atcatctcaccttgcctcctgtctcgacatatggtcgccctgcaggtgggtggggccagatgggtggggcctcgtgggtggggccgactgggtggggccctatgggtggggccacttgggtggggcctgctgggtggggccgtatgggtggggccggcgcgccatgcttcatcagactct

SEQ ID NO: 2739 - DNA, 180 bp, Artificial Sequence; identical to SEQ ID NO: 2738
  Synthetic polynucleotide

SEQ ID NO: 2740 - DNA, 190 bp, Artificial Sequence
  Synthetic polynucleotide
atcatctcaccttgcctcctgtctccaggatcctcctacctgcaggttaatgatgattagagattaatgatgattagtcgttaatgatgattaggacttaatgatgattagctattaatgatgattagactttaatgatgattagtgcttaatgatgattaggtaggcgcgccatgcttcatcagactct

SEQ ID NO: 2741 - DNA, 190 bp, Artificial Sequence; identical to SEQ ID NO: 2740
  Synthetic polynucleotide

SEQ ID NO: 2742 - DNA, 196 bp, Artificial Sequence
  Synthetic polynucleotide
atcatctcaccttgcctcctggagaggacgcggttatgcctgcaggaaaaaataaacaaagaaaaaaataaacaatcgaaaaaataaacaagacaaaaaataaacaactaaaaaaataaacaaactaaaaaataaacaatgcaaaaaataaacaagtaaaaaaataaacaaggcgcgccatgcttcatcagactct

SEQ ID NO: 2743 - DNA, 196 bp, Artificial Sequence; identical to SEQ ID NO: 2742
  Synthetic polynucleotide

SEQ ID NO: 2744 - DNA, 191 bp, Artificial Sequence
  Synthetic polynucleotide
atcatctcaccttgcctcctggcgcggagctattacaacctgcagggttttgcacacggcactagagttttgcacacggcacttcggttttgcacacggcactgacgttttgcacacggcactctagttttgcacacggcactactgttttgcacacggcacttgcggcgcgccatgcttcatcagactct

SEQ ID NO: 2745 - DNA, 191 bp, Artificial Sequence; identical to SEQ ID NO: 2744
  Synthetic polynucleotide

SEQ ID NO: 2746 - DNA, 172 bp, Artificial Sequence
  Synthetic polynucleotide
atcatctcaccttgcctcctggagggatttagagaattcctgcaggactgacctctagaactgacctcttcgactgacctctgacactgacctctctaactgacctctactactgacctcttgcactgacctctgtaactgacctctggcgcgccatgcttcatcagactct

SEQ ID NO: 2747 - DNA, 172 bp, Artificial Sequence; identical to SEQ ID NO: 2746
  Synthetic polynucleotide

SEQ ID NO: 2748 - DNA, 156 bp, Artificial Sequence
  Synthetic polynucleotide
atcatctcaccttgcctcctgctaaagaccaggctaggcctgcaggtttttattagatttttatttcgtttttattgactttttattctatttttattacttttttatttgctttttattgtatttttattggcgcgccatgcttcatcagactct

SEQ ID NO: 2749 - DNA, 156 bp, Artificial Sequence; identical to SEQ ID NO: 2748
  Synthetic polynucleotide

SEQ ID NO: 2750 - DNA, 186 bp, Artificial Sequence
  Synthetic polynucleotide
atcatctcaccttgcctcctggggcaacgtataaggcacctgcaggccggacatgcccgggcatgtagaccggacatgcccgggcatgttcgccggacatgcccgggcatgtgacccggacatgcccgggcatgtctaccggacatgcccgggcatgtactggcgcgccatgcttcatcagactct

SEQ ID NO: 2751 - DNA, 186 bp, Artificial Sequence; identical to SEQ ID NO: 2750
  Synthetic polynucleotide

SEQ ID NO: 2752 - DNA, 185 bp, Artificial Sequence
  Synthetic polynucleotide
atcatctcaccttgcctcctgttcccgccttatgtaaccctgcaggatgttttacgactttaagaatgttttacgactttatcgatgttttacgactttagacatgttttacgactttactaatgttttacgactttaactatgttttacgactttatgcggcgcgccatgcttcatcagactct

SEQ ID NO: 2753 - DNA, 185 bp, Artificial Sequence; identical to SEQ ID NO: 2752
  Synthetic polynucleotide

SEQ ID NO: 2754 - DNA, 197 bp, Artificial Sequence
  Synthetic polynucleotide
atcatctcaccttgcctcctggatgctcggttgacgaccctgcaggcgtatcgaaaccaaaagacgtatcgaaaccaaatcgcgtatcgaaaccaaagaccgtatcgaaaccaaactacgtatcgaaaccaaaactcgtatcgaaaccaaatgccgtatcgaaaccaaagtaggcgcgccatgcttcatcagactct

SEQ ID NO: 2755 - DNA, 197 bp, Artificial Sequence; identical to SEQ ID NO: 2754
  Synthetic polynucleotide

SEQ ID NO: 2756 - DNA, 190 bp, Artificial Sequence
  Synthetic polynucleotide
atcatctcaccttgcctcctgaggattgaaagtggatacctgcaggtgacctttgacctcagatgacctttgacctctcgtgacctttgacctcgactgacctttgacctcctatgacctttgacctcacttgacctttgacctctgctgacctttgacctcgtaggcgcgccatgcttcatcagactct

SEQ ID NO: 2757 - DNA, 190 bp, Artificial Sequence; identical to SEQ ID NO: 2756
  Synthetic polynucleotide

SEQ ID NO: 2758 - DNA, 197 bp, Artificial Sequence
  Synthetic polynucleotide
atcatctcaccttgcctcctgccatatgcgcaggaaaccctgcaggggcgccccctggtggccaagaggcgccccctggtggccatcgggcgccccctggtggccagacggcgccccctggtggccactaggcgccccctggtggccaactggcgccccctggtggccatgcggcgcgccatgcttcatcagactct

SEQ ID NO: 2759 - DNA, 197 bp, Artificial Sequence; identical to SEQ ID NO: 2758
  Synthetic polynucleotide

SEQ ID NO: 2760 - DNA, 140 bp, Artificial Sequence
  Synthetic polynucleotide
atcatctcaccttgcctcctgcgccgaataccagtagacctgcaggcacgcaagacacgcatcgcacgcagaccacgcactacacgcaactcacgcatgccacgcagtacacgcaggcgcgccatgcttcatcagactct

SEQ ID NO: 2761 - DNA, 140 bp, Artificial Sequence; identical to SEQ ID NO: 2760
  Synthetic polynucleotide

SEQ ID NO: 2762 - DNA, 190 bp, Artificial Sequence
  Synthetic polynucleotide
atcatctcaccttgcctcctgatcccttctcaactatgcctgcaggtcactttcactttcagatcactttcactttctcgtcactttcactttcgactcactttcactttcctatcactttcactttcacttcactttcactttctgctcactttcactttcgtaggcgcgccatgcttcatcagactct

SEQ ID NO: 2763 - DNA, 190 bp, Artificial Sequence; identical to SEQ ID NO: 2762
  Synthetic polynucleotide

SEQ ID NO: 2764 - DNA, 172 bp, Artificial Sequence
  Synthetic polynucleotide
atcatctcaccttgcctcctgtactggaacaacggtaccctgcaggggtaattagcagaggtaattagctcgggtaattagcgacggtaattagcctaggtaattagcactggtaattagctgcggtaattagcgtaggtaattagcggcgcgccatgcttcatcagactct

SEQ ID NO: 2765 - DNA, 172 bp, Artificial Sequence; identical to SEQ ID NO: 2764
  Synthetic polynucleotide

SEQ ID NO: 2766 - DNA, 180 bp, Artificial Sequence
  Synthetic polynucleotide
atcatctcaccttgcctcctgaaactgaccacgcgcgacctgcaggtctgtggtttgagatctgtggtttgtcgtctgtggtttggactctgtggtttgctatctgtggtttgacttctgtggtttgtgctctgtggtttggtatctgtggtttgggcgcgccatgcttcatcagactct

SEQ ID NO: 2767 - DNA, 180 bp, Artificial Sequence; identical to SEQ ID NO: 2766
  Synthetic polynucleotide

SEQ ID NO: 2768 - DNA, 190 bp, Artificial Sequence
  Synthetic polynucleotide
atcatctcaccttgcctcctgtcattagcaactaccgccctgcaggggtattgcacaatcagaggtattgcacaatctcgggtattgcacaatcgacggtattgcacaatcctaggtattgcacaatcactggtattgcacaatctgcggtattgcacaatcgtaggcgcgccatgcttcatcagactct

SEQ ID NO: 2769 - DNA, 190 bp, Artificial Sequence; identical to SEQ ID NO: 2768
  Synthetic polynucleotide

SEQ ID NO: 2770 - DNA, 190 bp, Artificial Sequence
  Synthetic polynucleotide
atcatctcaccttgcctcctggatcaagcttgtgtgtccctgcaggctccctgtcccctcagactccctgtcccctctcgctccctgtcccctcgacctccctgtcccctcctactccctgtcccctcactctccctgtcccctctgcctccctgtcccctcgtaggcgcgccatgcttcatcagactct

SEQ ID NO: 2771 - DNA, 190 bp, Artificial Sequence; identical to SEQ ID NO: 2770
  Synthetic polynucleotide

SEQ ID NO: 2772 - DNA, 188 bp, Artificial Sequence
  Synthetic polynucleotide
atcatctcaccttgcctcctgggataatgccattcctgcctgcaggaattttccattgagaaattttccattgtcgaattttccattggacaattttccattgctaaattttccattgactaattttccattgtgcaattttccattggtaaattttccattgggcgcgccatgcttcatcagactct

SEQ ID NO: 2773 - DNA, 188 bp, Artificial Sequence; identical to SEQ ID NO: 2772
  Synthetic polynucleotide

SEQ ID NO: 2774 - DNA, 172 bp, Artificial Sequence
  Synthetic polynucleotide
atcatctcaccttgcctcctgtctacatcacaatcttgcctgcaggcacagcggggagacacagcggggtcgcacagcgggggaccacagcggggctacacagcggggactcacagcggggtgccacagcgggggtacacagcggggggcgcgccatgcttcatcagactct

SEQ ID NO: 2775 - DNA, 172 bp, Artificial Sequence; identical to SEQ ID NO: 2774
  Synthetic polynucleotide

SEQ ID NO: 2776 - DNA, 197 bp, Artificial Sequence
  Synthetic polynucleotide
atcatctcaccttgcctcctgtcgtctactttcgccgacctgcaggaggtcaaggtcacccagaaggtcaaggtcaccctcgaggtcaaggtcacccgacaggtcaaggtcacccctaaggtcaaggtcacccactaggtcaaggtcaccctgcaggtcaaggtcacccgtaggcgcgccatgcttcatcagactct

SEQ ID NO: 2777 - DNA, 197 bp, Artificial Sequence; identical to SEQ ID NO: 2776
  Synthetic polynucleotide

SEQ ID NO: 2778 - DNA, 172 bp, Artificial Sequence
  Synthetic polynucleotide
atcatctcaccttgcctcctgctttggtgaacgaataccctgcaggggtaattaggagaggtaattaggtcgggtaattagggacggtaattaggctaggtaattaggactggtaattaggtgcggtaattagggtaggtaattaggggcgcgccatgcttcatcagactct

SEQ ID NO: 2779 - DNA, 172 bp, Artificial Sequence; identical to SEQ ID NO: 2778
  Synthetic polynucleotide

SEQ ID NO: 2780 - DNA, 191 bp, Artificial Sequence
  Synthetic polynucleotide
atcatctcaccttgcctcctgattcgacgcgcaattcacctgcaggccttagttaactaaaatagaccttagttaactaaaattcgccttagttaactaaaatgacccttagttaactaaaatctaccttagttaactaaaatactccttagttaactaaaattgcggcgcgccatgcttcatcagactct

SEQ ID NO: 2781 - DNA, 191 bp, Artificial Sequence; identical to SEQ ID NO: 2780
  Synthetic polynucleotide

SEQ ID NO: 2782 - DNA, 197 bp, Artificial Sequence
  Synthetic polynucleotide
atcatctcaccttgcctcctggcggttatattaagagccctgcaggtaggaaatcgaaagttggagataggaaatcgaaagttggtcgtaggaaatcgaaagttgggactaggaaatcgaaagttggctataggaaatcgaaagttggacttaggaaatcgaaagttggtgcggcgcgccatgcttcatcagactct

SEQ ID NO: 2783 - DNA, 197 bp, Artificial Sequence; identical to SEQ ID NO: 2782
  Synthetic polynucleotide

SEQ ID NO: 2784 - DNA, 148 bp, Artificial Sequence
  Synthetic polynucleotide
atcatctcaccttgcctcctgccagggactccctcatacctgcagggtgacctagagtgaccttcggtgacctgacgtgacctctagtgacctactgtgaccttgcgtgacctgtagtgacctggcgcgccatgcttcatcagactct

SEQ ID NO: 2785 - DNA, 148 bp, Artificial Sequence; identical to SEQ ID NO: 2784
  Synthetic polynucleotide

SEQ ID NO: 2786 - DNA, 172 bp, Artificial Sequence
  Synthetic polynucleotide
atcatctcaccttgcctcctgtgtcaatgatcaggctccctgcaggggtaattagtagaggtaattagttcgggtaattagtgacggtaattagtctaggtaattagtactggtaattagttgcggtaattagtgtaggtaattagtggcgcgccatgcttcatcagactct

SEQ ID NO: 2787 - DNA, 172 bp, Artificial Sequence; identical to SEQ ID NO: 2786
  Synthetic polynucleotide

SEQ ID NO: 2788 - DNA, 188 bp, Artificial Sequence
  Synthetic polynucleotide
atcatctcaccttgcctcctgtagagcgtctagaacgccctgcagggcacttcctgggagagcacttcctgggtcggcacttcctggggacgcacttcctgggctagcacttcctgggactgcacttcctgggtgcgcacttcctggggtagcacttcctgggggcgcgccatgcttcatcagactct

SEQ ID NO: 2789 - DNA, 188 bp, Artificial Sequence; identical to SEQ ID NO: 2788
  Synthetic polynucleotide

SEQ ID NO: 2790 - DNA, 185 bp, Artificial Sequence
  Synthetic polynucleotide
atcatctcaccttgcctcctggtcgaacgtggtttgatcctgcaggaattccattgttcaatagaaattccattgttcaattcgaattccattgttcaatgacaattccattgttcaatctaaattccattgttcaatactaattccattgttcaattgcggcgcgccatgcttcatcagactct

SEQ ID NO: 2791 - DNA, 185 bp, Artificial Sequence; identical to SEQ ID NO: 2790
  Synthetic polynucleotide

SEQ ID NO: 2792 - DNA, 185 bp, Artificial Sequence
  Synthetic polynucleotide
atcatctcaccttgcctcctgcgttcgattagtcgattcctgcaggatcagctaattaacctagaatcagctaattaaccttcgatcagctaattaacctgacatcagctaattaacctctaatcagctaattaacctactatcagctaattaaccttgcggcgcgccatgcttcatcagactct

SEQ ID NO: 2793 - DNA, 185 bp, Artificial Sequence; identical to SEQ ID NO: 2792
  Synthetic polynucleotide

SEQ ID NO: 2794 - DNA, 196 bp, Artificial Sequence
  Synthetic polynucleotide
atcatctcaccttgcctcctgctgagaattgtcatatgcctgcaggagtttctatttttagtaacagtagaagtttctatttttagtaacagttcgagtttctatttttagtaacagtgacagtttctatttttagtaacagtctaagtttctatttttagtaacagtactggcgcgccatgcttcatcagactct

SEQ ID NO: 2795 - DNA, 196 bp, Artificial Sequence; identical to SEQ ID NO: 2794
  Synthetic polynucleotide

SEQ ID NO: 2796 - DNA, 191 bp, Artificial Sequence
  Synthetic polynucleotide
atcatctcaccttgcctcctgagccgaaacctcaatcacctgcaggtttcagtttcgctttccagatttcagtttcgctttcctcgtttcagtttcgctttccgactttcagtttcgctttccctatttcagtttcgctttccacttttcagtttcgctttcctgcggcgcgccatgcttcatcagactct

SEQ ID NO: 2797 - DNA, 191 bp, Artificial Sequence; identical to SEQ ID NO: 2796
  Synthetic polynucleotide

SEQ ID NO: 2798 - DNA, 164 bp, Artificial Sequence
  Synthetic polynucleotide
atcatctcaccttgcctcctgcgtagatcagagcctagcctgcaggatgtcaattagaatgtcaatttcgatgtcaattgacatgtcaattctaatgtcaattactatgtcaatttgcatgtcaattgtaatgtcaattggcgcgccatgcttcatcagactct

SEQ ID NO: 2799 - DNA, 164 bp, Artificial Sequence; identical to SEQ ID NO: 2798
  Synthetic polynucleotide

SEQ ID NO: 2800 - DNA, 185 bp, Artificial Sequence
  Synthetic polynucleotide
atcatctcaccttgcctcctgcacggtgtccgttaggtcctgcaggctgtccatggtgctgaagactgtccatggtgctgatcgctgtccatggtgctgagacctgtccatggtgctgactactgtccatggtgctgaactctgtccatggtgctgatgcggcgcgccatgcttcatcagactct

SEQ ID NO: 2801 - DNA, 185 bp, Artificial Sequence; identical to SEQ ID NO: 2800
  Synthetic polynucleotide

SEQ ID NO: 2802 - DNA, 198 bp, Artificial Sequence
  Synthetic polynucleotide
atcatctcaccttgcctcctgtcccacttcacagaatacctgcaggttgcccgcacccaagatggcggcagattgcccgcacccaagatggcggctcgttgcccgcacccaagatggcggcgacttgcccgcacccaagatggcggcctattgcccgcacccaagatggcggcggcgcgccatgcttcatcagactct

SEQ ID NO: 2803 - DNA, 198 bp, Artificial Sequence; identical to SEQ ID NO: 2802
  Synthetic polynucleotide

SEQ ID NO: 2804 - DNA, 172 bp, Artificial Sequence
  Synthetic polynucleotide
atcatctcaccttgcctcctgaatgaaattcctcagtccctgcaggtttttattggagatttttattggtcgtttttattgggactttttattggctatttttattggacttttttattggtgctttttattgggtatttttattggggcgcgccatgcttcatcagactct

SEQ ID NO: 2805 - DNA, 172 bp, Artificial Sequence; identical to SEQ ID NO: 2804
  Synthetic polynucleotide

SEQ ID NO: 2806 - DNA, 196 bp, Artificial Sequence
  Synthetic polynucleotide
atcatctcaccttgcctcctgtgcctcgggtacgatctcctgcaggatggggcgcagctgcgcccctcagaatggggcgcagctgcgcccctctcgatggggcgcagctgcgcccctcgacatggggcgcagctgcgcccctcctaatggggcgcagctgcgcccctcactggcgcgccatgcttcatcagactct

SEQ ID NO: 2807 - DNA, 196 bp, Artificial Sequence; identical to SEQ ID NO: 2806
  Synthetic polynucleotide

SEQ ID NO: 2808 - DNA, 164 bp, Artificial Sequence
  Synthetic polynucleotide
atcatctcaccttgcctcctgatgtacccaagcggctgcctgcaggcccaccctcagacccaccctctcgcccaccctcgaccccaccctcctacccaccctcactcccaccctctgccccaccctcgtacccaccctcggcgcgccatgcttcatcagactct

SEQ ID NO: 2809 - DNA, 164 bp, Artificial Sequence; identical to SEQ ID NO: 2808
  Synthetic polynucleotide

SEQ ID NO: 2810 - DNA, 196 bp, Artificial Sequence
  Synthetic polynucleotide
atcatctcaccttgcctcctggagatataacacctgcccctgcaggctcgtaatgaggtagactcgtaatgaggttcgctcgtaatgaggtgacctcgtaatgaggtctactcgtaatgaggtactctcgtaatgaggttgcctcgtaatgaggtgtactcgtaatgaggtggcgcgccatgcttcatcagactct

SEQ ID NO: 2811 - DNA, 196 bp, Artificial Sequence; identical to SEQ ID NO: 2810
  Synthetic polynucleotide

SEQ ID NO: 2812 - DNA, 172 bp, Artificial Sequence
  Synthetic polynucleotide
atcatctcaccttgcctcctggcggagtctagttatcacctgcaggtttttattgcagatttttattgctcgtttttattgcgactttttattgcctatttttattgcacttttttattgctgctttttattgcgtatttttattgcggcgcgccatgcttcatcagactct

SEQ ID NO: 2813 - DNA, 172 bp, Artificial Sequence; identical to SEQ ID NO: 2812
  Synthetic polynucleotide

SEQ ID NO: 2814 - DNA, 197 bp, Artificial Sequence
  Synthetic polynucleotide
atcatctcaccttgcctcctggcagtcgtactcggcaacctgcaggaggtcaccctgacctagaaggtcaccctgaccttcgaggtcaccctgacctgacaggtcaccctgacctctaaggtcaccctgacctactaggtcaccctgaccttgcaggtcaccctgacctgtaggcgcgccatgcttcatcagactct

SEQ ID NO: 2815 - DNA, 197 bp, Artificial Sequence; identical to SEQ ID NO: 2814
  Synthetic polynucleotide

SEQ ID NO: 2816 - DNA, 148 bp, Artificial Sequence
  Synthetic polynucleotide
atcatctcaccttgcctcctgtgtgccctatggcgtgacctgcaggattacaaagaattacaatcgattacaagacattacaactaattacaaactattacaatgcattacaagtaattacaaggcgcgccatgcttcatcagactct

SEQ ID NO: 2817 - DNA, 148 bp, Artificial Sequence; identical to SEQ ID NO: 2816
  Synthetic polynucleotide

SEQ ID NO: 2818 - DNA, 196 bp, Artificial Sequence
  Synthetic polynucleotide
atcatctcaccttgcctcctggtctagtaaaggttgtgcctgcaggagggggcggggccagaagggggcggggcctcgagggggcggggccgacagggggcggggccctaagggggcggggccactagggggcggggcctgcagggggcggggccgtaagggggcggggccggcgcgccatgcttcatcagactct

SEQ ID NO: 2819 - DNA, 196 bp, Artificial Sequence; identical to SEQ ID NO: 2818
  Synthetic polynucleotide

SEQ ID NO: 2820 - DNA, 197 bp, Artificial Sequence
  Synthetic polynucleotide
atcatctcaccttgcctcctgaagcgagcaggcttctccctgcaggccatacatattggtgagaccatacatattggtgtcgccatacatattggtggacccatacatattggtgctaccatacatattggtgactccatacatattggtgtgcccatacatattggtggtaggcgcgccatgcttcatcagactct

SEQ ID NO: 2821 - DNA, 197 bp, Artificial Sequence; identical to SEQ ID NO: 2820
  Synthetic polynucleotide

SEQ ID NO: 2822 - DNA, 172 bp, Artificial Sequence
  Synthetic polynucleotide
atcatctcaccttgcctcctgtgggataaagttgggcgcctgcaggttacgcccccagattacgccccctcgttacgcccccgacttacgcccccctattacgcccccactttacgccccctgcttacgcccccgtattacgcccccggcgcgccatgcttcatcagactct

SEQ ID NO: 2823 - DNA, 172 bp, Artificial Sequence; identical to SEQ ID NO: 2822
  Synthetic polynucleotide

SEQ ID NO: 2824 - DNA, 164 bp, Artificial Sequence
  Synthetic polynucleotide
atcatctcaccttgcctcctggtggctgtctggtgtaacctgcagggtatcaaatagagtatcaaattcggtatcaaatgacgtatcaaatctagtatcaaatactgtatcaaattgcgtatcaaatgtagtatcaaatggcgcgccatgcttcatcagactct

SEQ ID NO: 2825 - DNA, 164 bp, Artificial Sequence; identical to SEQ ID NO: 2824
  Synthetic polynucleotide

SEQ ID NO: 2826 - DNA, 197 bp, Artificial Sequence
  Synthetic polynucleotide
atcatctcaccttgcctcctggcctaggcaaaggcagtcctgcaggggtgggtgtggctggagaggtgggtgtggctggtcgggtgggtgtggctgggacggtgggtgtggctggctaggtgggtgtggctggactggtgggtgtggctggtgcggtgggtgtggctgggtaggcgcgccatgcttcatcagactct

SEQ ID NO: 2827 - DNA, 197 bp, Artificial Sequence; identical to SEQ ID NO: 2826
  Synthetic polynucleotide

SEQ ID NO: 2828 - DNA, 191 bp, Artificial Sequence
  Synthetic polynucleotide
atcatctcaccttgcctcctgagtgcttagttcgtgctcctgcaggcgagttaattaataagcagacgagttaattaataagctcgcgagttaattaataagcgaccgagttaattaataagcctacgagttaattaataagcactcgagttaattaataagctgcggcgcgccatgcttcatcagactct

SEQ ID NO: 2829 - DNA, 191 bp, Artificial Sequence; identical to SEQ ID NO: 2828
  Synthetic polynucleotide

SEQ ID NO: 2830 - DNA, 156 bp, Artificial Sequence
  Synthetic polynucleotide
atcatctcaccttgcctcctgtacgcagaatattctgtcctgcagggggattagagagggattagtcggggattaggacgggattagctagggattagactgggattagtgcgggattaggtagggattagggcgcgccatgcttcatcagactct

SEQ ID NO: 2831 - DNA, 156 bp, Artificial Sequence; identical to SEQ ID NO: 2830
  Synthetic polynucleotide

SEQ ID NO: 2832 - DNA, 191 bp, Artificial Sequence
  Synthetic polynucleotide
atcatctcaccttgcctcctgtccaggtatactaggcccctgcaggtatggttaattattaactgctagatatggttaattattaactgcttcgtatggttaattattaactgctgactatggttaattattaactgctctatatggttaattattaactgctactggcgcgccatgcttcatcagactct

SEQ ID NO: 2833 - DNA, 191 bp, Artificial Sequence; identical to SEQ ID NO: 2832
  Synthetic polynucleotide

SEQ ID NO: 2834 - DNA, 156 bp, Artificial Sequence
  Synthetic polynucleotide
atcatctcaccttgcctcctgagtcgaggaatttcagacctgcaggttgattagagattgattagtcgttgattaggacttgattagctattgattagactttgattagtgcttgattaggtattgattagggcgcgccatgcttcatcagactct

SEQ ID NO: 2835 - DNA, 156 bp, Artificial Sequence; identical to SEQ ID NO: 2834
  Synthetic polynucleotide

SEQ ID NO: 2836 - DNA, 188 bp, Artificial Sequence
  Synthetic polynucleotide
atcatctcaccttgcctcctgcgccggttacaacagaccctgcaggggtccttttataagaggtccttttatatcgggtccttttatagacggtccttttatactaggtccttttataactggtccttttatatgcggtccttttatagtaggtccttttataggcgcgccatgcttcatcagactct

SEQ ID NO: 2837 - DNA, 188 bp, Artificial Sequence; identical to SEQ ID NO: 2836
  Synthetic polynucleotide

SEQ ID NO: 2838 - DNA, 191 bp, Artificial Sequence
  Synthetic polynucleotide
atcatctcaccttgcctcctgaccaattatcgcagtggcctgcaggtaccactaggtggcgctagataccactaggtggcgcttcgtaccactaggtggcgctgactaccactaggtggcgctctataccactaggtggcgctacttaccactaggtggcgcttgcggcgcgccatgcttcatcagactct

SEQ ID NO: 2839 - DNA, 191 bp, Artificial Sequence; identical to SEQ ID NO: 2838
  Synthetic polynucleotide

SEQ ID NO: 2840 - DNA, 164 bp, Artificial Sequence
  Synthetic polynucleotide
atcatctcaccttgcctcctggctccacaggcggtaatcctgcagggataattagagagataattagtcggataattaggacgataattagctagataattagactgataattagtgcgataattaggtagataattagggcgcgccatgcttcatcagactct

SEQ ID NO: 2841 - DNA, 164 bp, Artificial Sequence; identical to SEQ ID NO: 2840
  Synthetic polynucleotide

SEQ ID NO: 2842 - DNA, 164 bp, Artificial Sequence
  Synthetic polynucleotide
atcatctcaccttgcctcctgttcttggtttgagtaagcctgcaggcacgtgatcagacacgtgatctcgcacgtgatcgaccacgtgatcctacacgtgatcactcacgtgatctgccacgtgatcgtacacgtgatcggcgcgccatgcttcatcagactct

SEQ ID NO: 2843 - DNA, 164 bp, Artificial Sequence; identical to SEQ ID NO: 2842
  Synthetic polynucleotide

SEQ ID NO: 2844 - DNA, 164 bp, Artificial Sequence
  Synthetic polynucleotide
atcatctcaccttgcctcctgccactaatgggactgctcctgcaggcgttaatgaagacgttaatgatcgcgttaatgagaccgttaatgactacgttaatgaactcgttaatgatgccgttaatgagtacgttaatgaggcgcgccatgcttcatcagactct

SEQ ID NO: 2845 - DNA, 164 bp, Artificial Sequence; identical to SEQ ID NO: 2844
  Synthetic polynucleotide

SEQ ID NO: 2846 - DNA, 156 bp, Artificial Sequence
  Synthetic polynucleotide
atcatctcaccttgcctcctgccggatgcaagttcttgcctgcagggggattatagagggattattcggggattatgacgggattatctagggattatactgggattattgcgggattatgtagggattatggcgcgccatgcttcatcagactct

SEQ ID NO: 2847 - DNA, 156 bp, Artificial Sequence; identical to SEQ ID NO: 2846
  Synthetic polynucleotide

SEQ ID NO: 2848 - DNA, 180 bp, Artificial Sequence
  Synthetic polynucleotide
atcatctcaccttgcctcctggcgtgtttcatccatcgcctgcaggccatatgtcacagaccatatgtcactcgccatatgtcacgacccatatgtcacctaccatatgtcacactccatatgtcactgcccatatgtcacgtaccatatgtcacggcgcgccatgcttcatcagactct

SEQ ID NO: 2849 - DNA, 180 bp, Artificial Sequence; identical to SEQ ID NO: 2848
  Synthetic polynucleotide

SEQ ID NO: 2850 - DNA, 172 bp, Artificial Sequence
  Synthetic polynucleotide
atcatctcaccttgcctcctgtttatcatgaacgaccgcctgcaggcattaatcaaagacattaatcaatcgcattaatcaagaccattaatcaactacattaatcaaactcattaatcaatgccattaatcaagtacattaatcaaggcgcgccatgcttcatcagactct

SEQ ID NO: 2851 - DNA, 172 bp, Artificial Sequence; identical to SEQ ID NO: 2850
  Synthetic polynucleotide

SEQ ID NO: 2852 - DNA, 185 bp, Artificial Sequence
  Synthetic polynucleotide
atcatctcaccttgcctcctgtgtcaaacatatggtctcctgcaggcttaagtaaacaatggagacttaagtaaacaatggtcgcttaagtaaacaatgggaccttaagtaaacaatggctacttaagtaaacaatggactcttaagtaaacaatggtgcggcgcgccatgcttcatcagactct

SEQ ID NO: 2853 - DNA, 185 bp, Artificial Sequence; identical to SEQ ID NO: 2852
  Synthetic polynucleotide

SEQ ID NO: 2854 - DNA, 185 bp, Artificial Sequence
  Synthetic polynucleotide
atcatctcaccttgcctcctgtctaacggcttgcattccctgcaggatgaatgtgcagtcatagaatgaatgtgcagtcattcgatgaatgtgcagtcatgacatgaatgtgcagtcatctaatgaatgtgcagtcatactatgaatgtgcagtcattgcggcgcgccatgcttcatcagactct

SEQ ID NO: 2855 - DNA, 185 bp, Artificial Sequence; identical to SEQ ID NO: 2854
  Synthetic polynucleotide

SEQ ID NO: 2856 - DNA, 190 bp, Artificial Sequence
  Synthetic polynucleotide
atcatctcaccttgcctcctgtaaatcctattatgccgcctgcaggtgatgacgtcaccgagatgatgacgtcaccgtcgtgatgacgtcaccggactgatgacgtcaccgctatgatgacgtcaccgacttgatgacgtcaccgtgctgatgacgtcaccggtaggcgcgccatgcttcatcagactct

SEQ ID NO: 2857 - DNA, 190 bp, Artificial Sequence; identical to SEQ ID NO: 2856
  Synthetic polynucleotide

SEQ ID NO: 2858 - DNA, 197 bp, Artificial Sequence
  Synthetic polynucleotide
atcatctcaccttgcctcctgcctagaaatgccatagacctgcaggaagaatgagtcatcaagaaagaatgagtcatcatcgaagaatgagtcatcagacaagaatgagtcatcactaaagaatgagtcatcaactaagaatgagtcatcatgcaagaatgagtcatcagtaggcgcgccatgcttcatcagactct

SEQ ID NO: 2859 - DNA, 197 bp, Artificial Sequence; identical to SEQ ID NO: 2858
  Synthetic polynucleotide

SEQ ID NO: 2860 - DNA, 156 bp, Artificial Sequence
  Synthetic polynucleotide
atcatctcaccttgcctcctgctcttatcggtaagactcctgcagggggattaaagagggattaatcggggattaagacgggattaactagggattaaactgggattaatgcgggattaagtagggattaaggcgcgccatgcttcatcagactct

SEQ ID NO: 2861 - DNA, 156 bp, Artificial Sequence; identical to SEQ ID NO: 2860
  Synthetic polynucleotide

SEQ ID NO: 2862 - DNA, 191 bp, Artificial Sequence
  Synthetic polynucleotide
atcatctcaccttgcctcctggggtatgtatacctttacctgcagggaaaactagttaacatcagagaaaactagttaacatctcggaaaactagttaacatcgacgaaaactagttaacatcctagaaaactagttaacatcactgaaaactagttaacatctgcggcgcgccatgcttcatcagactct

SEQ ID NO: 2863 - DNA, 191 bp, Artificial Sequence; identical to SEQ ID NO: 2862
  Synthetic polynucleotide

SEQ ID NO: 2864 - DNA, 196 bp, Artificial Sequence
  Synthetic polynucleotide
atcatctcaccttgcctcctgtgccactacggtttggccctgcagggcggaggccggggagagcggaggccggggtcggcggaggccgggggacgcggaggccggggctagcggaggccggggactgcggaggccggggtgcgcggaggccgggggtagcggaggccggggggcgcgccatgcttcatcagactct

SEQ ID NO: 2865 - DNA, 196 bp, Artificial Sequence; identical to SEQ ID NO: 2864
  Synthetic polynucleotide

SEQ ID NO: 2866 - DNA, 156 bp, Artificial Sequence
  Synthetic polynucleotide
atcatctcaccttgcctcctggagagcactgtcttatacctgcaggacttcctgagaacttcctgtcgacttcctggacacttcctgctaacttcctgactacttcctgtgcacttcctggtaacttcctgggcgcgccatgcttcatcagactct

SEQ ID NO: 2867 - DNA, 156 bp, Artificial Sequence; identical to SEQ ID NO: 2866
  Synthetic polynucleotide

SEQ ID NO: 2868 - DNA, 164 bp, Artificial Sequence
  Synthetic polynucleotide
atcatctcaccttgcctcctgacctttccagctccgtgcctgcaggaattttgggagaaattttgggtcgaattttggggacaattttgggctaaattttgggactaattttgggtgcaattttggggtaaattttgggggcgcgccatgcttcatcagactct

SEQ ID NO: 2869 - DNA, 164 bp, Artificial Sequence; identical to SEQ ID NO: 2868
  Synthetic polynucleotide

SEQ ID NO: 2870 - DNA, 185 bp, Artificial Sequence
  Synthetic polynucleotide
atcatctcaccttgcctcctgcactcacggaaatggtgcctgcaggtaaccgcaaaccgcaaagataaccgcaaaccgcaatcgtaaccgcaaaccgcaagactaaccgcaaaccgcaactataaccgcaaaccgcaaacttaaccgcaaaccgcaatgcggcgcgccatgcttcatcagactct

SEQ ID NO: 2871 - DNA, 185 bp, Artificial Sequence; identical to SEQ ID NO: 2870
  Synthetic polynucleotide

SEQ ID NO: 2872 - DNA, 156 bp, Artificial Sequence
  Synthetic polynucleotide
atcatctcaccttgcctcctgtgccggccctgaattagcctgcaggacttcctcagaacttcctctcgacttcctcgacacttcctcctaacttcctcactacttcctctgcacttcctcgtaacttcctcggcgcgccatgcttcatcagactct

SEQ ID NO: 2873 - DNA, 156 bp, Artificial Sequence; identical to SEQ ID NO: 2872
  Synthetic polynucleotide

SEQ ID NO: 2874 - DNA, 191 bp, Artificial Sequence
  Synthetic polynucleotide
atcatctcaccttgcctcctggcgggtcaatttagtagcctgcaggccccatttcccggaaatcaccagaccccatttcccggaaatcacctcgccccatttcccggaaatcaccgacccccatttcccggaaatcaccctaccccatttcccggaaatcaccactggcgcgccatgcttcatcagactct

SEQ ID NO: 2875 - DNA, 191 bp, Artificial Sequence; identical to SEQ ID NO: 2874
  Synthetic polynucleotide

SEQ ID NO: 2876 - DNA, 172 bp, Artificial Sequence
  Synthetic polynucleotide
atcatctcaccttgcctcctgctttggtcgccgtcagacctgcagggggaaagcccagagggaaagccctcggggaaagcccgacgggaaagcccctagggaaagcccactgggaaagccctgcgggaaagcccgtagggaaagcccggcgcgccatgcttcatcagactct

SEQ ID NO: 2877 - DNA, 172 bp, Artificial Sequence; identical to SEQ ID NO: 2876
  Synthetic polynucleotide

SEQ ID NO: 2878 - DNA, 180 bp, Artificial Sequence
  Synthetic polynucleotide
atcatctcaccttgcctcctggaacgtagctaaacgagcctgcaggggatgagtcatagaggatgagtcattcgggatgagtcatgacggatgagtcatctaggatgagtcatactggatgagtcattgcggatgagtcatgtaggatgagtcatggcgcgccatgcttcatcagactct

SEQ ID NO: 2879 - DNA, 180 bp, Artificial Sequence; identical to SEQ ID NO: 2878
  Synthetic polynucleotide

SEQ ID NO: 2880 - DNA, 196 bp, Artificial Sequence
  Synthetic polynucleotide
atcatctcaccttgcctcctgagaatctgcaaatccttcctgcaggcggtgggggggatagacggtgggggggattcgcggtgggggggatgaccggtgggggggatctacggtgggggggatactcggtgggggggattgccggtgggggggatgtacggtgggggggatggcgcgccatgcttcatcagactct

SEQ ID NO: 2881 - DNA, 196 bp, Artificial Sequence; identical to SEQ ID NO: 2880
  Synthetic polynucleotide

SEQ ID NO: 2882 - DNA, 190 bp, Artificial Sequence
  Synthetic polynucleotide
atcatctcaccttgcctcctgtaatacccaggaaacgacctgcaggaaccacaaaccccaagaaaccacaaaccccatcgaaccacaaaccccagacaaccacaaaccccactaaaccacaaaccccaactaaccacaaaccccatgcaaccacaaaccccagtaggcgcgccatgcttcatcagactct

SEQ ID NO: 2883 - DNA, 190 bp, Artificial Sequence; identical to SEQ ID NO: 2882
  Synthetic polynucleotide

SEQ ID NO: 2884 - DNA, 172 bp, Artificial Sequence
  Synthetic polynucleotide
atcatctcaccttgcctcctgaggaactgtgacctgatcctgcaggtatgacgtaaagatatgacgtaatcgtatgacgtaagactatgacgtaactatatgacgtaaacttatgacgtaatgctatgacgtaagtatatgacgtaaggcgcgccatgcttcatcagactct

SEQ ID NO: 2885 - DNA, 172 bp, Artificial Sequence; identical to SEQ ID NO: 2884
  Synthetic polynucleotide

SEQ ID NO: 2886 - DNA, 196 bp, Artificial Sequence
  Synthetic polynucleotide
atcatctcaccttgcctcctggaccaacttctatacctcctgcaggcccacgtacgcacagacccacgtacgcactcgcccacgtacgcacgaccccacgtacgcacctacccacgtacgcacactcccacgtacgcactgccccacgtacgcacgtacccacgtacgcacggcgcgccatgcttcatcagactct

SEQ ID NO: 2887 - DNA, 196 bp, Artificial Sequence; identical to SEQ ID NO: 2886
  Synthetic polynucleotide

SEQ ID NO: 2888 - DNA, 172 bp, Artificial Sequence
  Synthetic polynucleotide
atcatctcaccttgcctcctggaaacggataggtcttccctgcaggcatagcaaccagacatagcaacctcgcatagcaaccgaccatagcaaccctacatagcaaccactcatagcaacctgccatagcaaccgtacatagcaaccggcgcgccatgcttcatcagactct

SEQ ID NO: 2889 - DNA, 172 bp, Artificial Sequence; identical to SEQ ID NO: 2888
  Synthetic polynucleotide

SEQ ID NO: 2890 - DNA, 185 bp, Artificial Sequence
  Synthetic polynucleotide
atcatctcaccttgcctcctgggaaggcagtagcaggacctgcaggccgatgacgtcatcgtagaccgatgacgtcatcgttcgccgatgacgtcatcgtgacccgatgacgtcatcgtctaccgatgacgtcatcgtactccgatgacgtcatcgttgcggcgcgccatgcttcatcagactct

SEQ ID NO: 2891 - DNA, 185 bp, Artificial Sequence; identical to SEQ ID NO: 2890
  Synthetic polynucleotide

SEQ ID NO: 2892 - DNA, 156 bp, Artificial Sequence
  Synthetic polynucleotide
atcatctcaccttgcctcctgtgcacttgtgttaacgacctgcaggacccgcatagaacccgcattcgacccgcatgacacccgcatctaacccgcatactacccgcattgcacccgcatgtaacccgcatggcgcgccatgcttcatcagactct

SEQ ID NO: 2893 - DNA, 156 bp, Artificial Sequence; identical to SEQ ID NO: 2892
  Synthetic polynucleotide

SEQ ID NO: 2894 - DNA, 172 bp, Artificial Sequence
  Synthetic polynucleotide
atcatctcaccttgcctcctgcacaattggccacagcccctgcaggcacacctgcaagacacacctgcatcgcacacctgcagaccacacctgcactacacacctgcaactcacacctgcatgccacacctgcagtacacacctgcaggcgcgccatgcttcatcagactct

SEQ ID NO: 2895 - DNA, 172 bp, Artificial Sequence; identical to SEQ ID NO: 2894
  Synthetic polynucleotide

SEQ ID NO: 2896 - DNA, 164 bp, Artificial Sequence
  Synthetic polynucleotide
atcatctcaccttgcctcctggtaacgttgacgtcagacctgcaggccctatctcagaccctatctctcgccctatctcgacccctatctcctaccctatctcactccctatctctgcccctatctcgtaccctatctcggcgcgccatgcttcatcagactct

SEQ ID NO: 2897 - DNA, 164 bp, Artificial Sequence; identical to SEQ ID NO: 2896
  Synthetic polynucleotide

SEQ ID NO: 2898 - DNA, 180 bp, Artificial Sequence
  Synthetic polynucleotide
atcatctcaccttgcctcctgtagtgaccgatgcaaggcctgcagggatgagtcatgagagatgagtcatgtcggatgagtcatggacgatgagtcatgctagatgagtcatgactgatgagtcatgtgcgatgagtcatggtagatgagtcatgggcgcgccatgcttcatcagactct

SEQ ID NO: 2899 - DNA, 180 bp, Artificial Sequence; identical to SEQ ID NO: 2898
  Synthetic polynucleotide

SEQ ID NO: 2900 - DNA, 197 bp, Artificial Sequence
  Synthetic polynucleotide
atcatctcaccttgcctcctgcatcgaagaatgaagcacctgcaggggcgccccctggtggagaggcgccccctggtggtcgggcgccccctggtgggacggcgccccctggtggctaggcgccccctggtggactggcgccccctggtggtgcggcgccccctggtgggtaggcgcgccatgcttcatcagactct

SEQ ID NO: 2901 - DNA, 197 bp, Artificial Sequence; identical to SEQ ID NO: 2900
  Synthetic polynucleotide

SEQ ID NO: 2902 - DNA, 197 bp, Artificial Sequence
  Synthetic polynucleotide
atcatctcaccttgcctcctgacataatactatggccgcctgcaggagtgctgacgtaagcattagaagtgctgacgtaagcatttcgagtgctgacgtaagcattgacagtgctgacgtaagcattctaagtgctgacgtaagcattactagtgctgacgtaagcatttgcggcgcgccatgcttcatcagactct

SEQ ID NO: 2903 - DNA, 197 bp, Artificial Sequence; identical to SEQ ID NO: 2902
  Synthetic polynucleotide

SEQ ID NO: 2904 - DNA, 188 bp, Artificial Sequence
  Synthetic polynucleotide
atcatctcaccttgcctcctgccaaagcattgtggccacctgcaggccctcaagagccagaccctcaagagcctcgccctcaagagccgacccctcaagagccctaccctcaagagccactccctcaagagcctgcccctcaagagccgtaccctcaagagccggcgcgccatgcttcatcagactct

SEQ ID NO: 2905 - DNA, 188 bp, Artificial Sequence; identical to SEQ ID NO: 2904
  Synthetic polynucleotide

SEQ ID NO: 2906 - DNA, 172 bp, Artificial Sequence
  Synthetic polynucleotide
atcatctcaccttgcctcctgacaccgcgcattagtgccctgcaggtaatacattaagataatacattatcgtaatacattagactaatacattactataatacattaacttaatacattatgctaatacattagtataatacattaggcgcgccatgcttcatcagactct

SEQ ID NO: 2907 - DNA, 172 bp, Artificial Sequence; identical to SEQ ID NO: 2906
  Synthetic polynucleotide

SEQ ID NO: 2908 - DNA, 197 bp, Artificial Sequence
  Synthetic polynucleotide
atcatctcaccttgcctcctgtaaatcgcagagcgggacctgcaggctctgattggctggtagactctgattggctggttcgctctgattggctggtgacctctgattggctggtctactctgattggctggtactctctgattggctggttgcctctgattggctggtgtaggcgcgccatgcttcatcagactct

SEQ ID NO: 2909 - DNA, 197 bp, Artificial Sequence; identical to SEQ ID NO: 2908
  Synthetic polynucleotide

SEQ ID NO: 2910 - DNA, 164 bp, Artificial Sequence
  Synthetic polynucleotide
atcatctcaccttgcctcctggggccctgtgctattaacctgcagggttatctgtagagttatctgttcggttatctgtgacgttatctgtctagttatctgtactgttatctgttgcgttatctgtgtagttatctgtggcgcgccatgcttcatcagactct

SEQ ID NO: 2911 - DNA, 164 bp, Artificial Sequence; identical to SEQ ID NO: 2910
  Synthetic polynucleotide

SEQ ID NO: 2912 - DNA, 172 bp, Artificial Sequence
  Synthetic polynucleotide
atcatctcaccttgcctcctgggtaactttccttgtcacctgcaggcatagcaacgagacatagcaacgtcgcatagcaacggaccatagcaacgctacatagcaacgactcatagcaacgtgccatagcaacggtacatagcaacgggcgcgccatgcttcatcagactct

SEQ ID NO: 2913 - DNA, 172 bp, Artificial Sequence; identical to SEQ ID NO: 2912
  Synthetic polynucleotide

SEQ ID NO: 2914 - DNA, 191 bp, Artificial Sequence
  Synthetic polynucleotide
atcatctcaccttgcctcctgagctttatggtaagtaccctgcaggaaatttcgtcacggttaaggtagaaaatttcgtcacggttaaggttcgaaatttcgtcacggttaaggtgacaaatttcgtcacggttaaggtctaaaatttcgtcacggttaaggtactggcgcgccatgcttcatcagactct

SEQ ID NO: 2915 - DNA, 191 bp, Artificial Sequence; identical to SEQ ID NO: 2914
  Synthetic polynucleotide

SEQ ID NO: 2916 - DNA, 196 bp, Artificial Sequence
  Synthetic polynucleotide
atcatctcaccttgcctcctgtgtcgtcacattagacccctgcaggtttaatttgatttcgattaattagatttaatttgatttcgattaatttcgtttaatttgatttcgattaattgactttaatttgatttcgattaattctatttaatttgatttcgattaattactggcgcgccatgcttcatcagactct

SEQ ID NO: 2917 - DNA, 196 bp, Artificial Sequence; identical to SEQ ID NO: 2916
  Synthetic polynucleotide

SEQ ID NO: 2918 - DNA, 197 bp, Artificial Sequence
  Synthetic polynucleotide
atcatctcaccttgcctcctgggtaatcatgatggtgccctgcaggctcccgcccccactcagactcccgcccccactctcgctcccgcccccactcgacctcccgcccccactcctactcccgcccccactcactctcccgcccccactctgcctcccgcccccactcgtaggcgcgccatgcttcatcagactct

SEQ ID NO: 2919 - DNA, 197 bp, Artificial Sequence; identical to SEQ ID NO: 2918
  Synthetic polynucleotide

SEQ ID NO: 2920 - DNA, 172 bp, Artificial Sequence
  Synthetic polynucleotide
atcatctcaccttgcctcctggtctgtgcatgaagaaacctgcaggattatttatgagaattatttatgtcgattatttatggacattatttatgctaattatttatgactattatttatgtgcattatttatggtaattatttatgggcgcgccatgcttcatcagactct

SEQ ID NO: 2921 - DNA, 172 bp, Artificial Sequence; identical to SEQ ID NO: 2920
  Synthetic polynucleotide

SEQ ID NO: 2922 - DNA, 180 bp, Artificial Sequence
  Synthetic polynucleotide
atcatctcaccttgcctcctgacggtgcttacacggcacctgcagggggaatttcccagagggaatttccctcggggaatttcccgacgggaatttcccctagggaatttcccactgggaatttccctgcgggaatttcccgtagggaatttcccggcgcgccatgcttcatcagactct

SEQ ID NO: 2923 - DNA, 180 bp, Artificial Sequence; identical to SEQ ID NO: 2922
  Synthetic polynucleotide

SEQ ID NO: 2924 - DNA, 188 bp, Artificial Sequence
  Synthetic polynucleotide
atcatctcaccttgcctcctggatcattgcgcagcggtcctgcaggtttgtcatgtagagatttgtcatgtagtcgtttgtcatgtaggactttgtcatgtagctatttgtcatgtagacttttgtcatgtagtgctttgtcatgtaggtatttgtcatgtagggcgcgccatgcttcatcagactct

SEQ ID NO: 2925 - DNA, 188 bp, Artificial Sequence; identical to SEQ ID NO: 2924
  Synthetic polynucleotide

SEQ ID NO: 2926 - DNA, 191 bp, Artificial Sequence
  Synthetic polynucleotide
atcatctcaccttgcctcctgggaaataatcccacttgcctgcaggtgacctttgccctagttagatgacctttgccctagtttcgtgacctttgccctagttgactgacctttgccctagttctatgacctttgccctagttacttgacctttgccctagtttgcggcgcgccatgcttcatcagactct

SEQ ID NO: 2927 - DNA, 191 bp, Artificial Sequence; identical to SEQ ID NO: 2926
  Synthetic polynucleotide

SEQ ID NO: 2928 - DNA, 200 bp, Artificial Sequence
  Synthetic polynucleotide
atcatctcaccttgcctcctggacgcgtctttaccttccctgcaggccggccccgccccctccccagaccggccccgccccctcccctcgccggccccgccccctccccgacccggccccgccccctccccctaccggccccgccccctccccactccggccccgccccctccccggcgcgccatgcttcatcagactct

SEQ ID NO: 2929 - DNA, 200 bp, Artificial Sequence; identical to SEQ ID NO: 2928
  Synthetic polynucleotide

SEQ ID NO: 2930 - DNA, 190 bp, Artificial Sequence
  Synthetic polynucleotide
atcatctcaccttgcctcctggcgctacgatgggtttccctgcaggtgatgacgtcatcaagatgatgacgtcatcatcgtgatgacgtcatcagactgatgacgtcatcactatgatgacgtcatcaacttgatgacgtcatcatgctgatgacgtcatcagtaggcgcgccatgcttcatcagactct

SEQ ID NO: 2931 - DNA, 190 bp, Artificial Sequence; identical to SEQ ID NO: 2930
  Synthetic polynucleotide

SEQ ID NO: 2932 - DNA, 190 bp, Artificial Sequence
  Synthetic polynucleotide
atcatctcaccttgcctcctgcgtgactgtaacgacaccctgcaggaaatcacgtgatatagaaaatcacgtgatattcgaaatcacgtgatatgacaaatcacgtgatatctaaaatcacgtgatatactaaatcacgtgatattgcaaatcacgtgatatgtaggcgcgccatgcttcatcagactct

SEQ ID NO: 2933 - DNA, 190 bp, Artificial Sequence; identical to SEQ ID NO: 2932
  Synthetic polynucleotide

SEQ ID NO: 2934 - DNA, 172 bp, Artificial Sequence
  Synthetic polynucleotide
atcatctcaccttgcctcctggagtagcgatgctagcccctgcaggtctgattggcagatctgattggctcgtctgattggcgactctgattggcctatctgattggcacttctgattggctgctctgattggcgtatctgattggcggcgcgccatgcttcatcagactct

SEQ ID NO: 2935 - DNA, 172 bp, Artificial Sequence; identical to SEQ ID NO: 2934
  Synthetic polynucleotide

SEQ ID NO: 2936 - DNA, 197 bp, Artificial Sequence
  Synthetic polynucleotide
atcatctcaccttgcctcctgttatccaaacctataggcctgcagggccgccatcttggttagagccgccatcttggtttcggccgccatcttggttgacgccgccatcttggttctagccgccatcttggttactgccgccatcttggtttgcgccgccatcttggttgtaggcgcgccatgcttcatcagactct

SEQ ID NO: 2937 - DNA, 197 bp, Artificial Sequence; identical to SEQ ID NO: 2936
  Synthetic polynucleotide

SEQ ID NO: 2938 - DNA, 164 bp, Artificial Sequence
  Synthetic polynucleotide
atcatctcaccttgcctcctggatcgaaaccaacagcccctgcaggggggactttagaggggacttttcgggggactttgacggggactttctaggggactttactggggacttttgcggggactttgtaggggactttggcgcgccatgcttcatcagactct

SEQ ID NO: 2939 - DNA, 164 bp, Artificial Sequence; identical to SEQ ID NO: 2938
  Synthetic polynucleotide

SEQ ID NO: 2940 - DNA, 156 bp, Artificial Sequence
  Synthetic polynucleotide
atcatctcaccttgcctcctgccctacgggaccctaatcctgcaggaattaatcagaaattaatctcgaattaatcgacaattaatcctaaattaatcactaattaatctgcaattaatcgtaaattaatcggcgcgccatgcttcatcagactct

SEQ ID NO: 2941 - DNA, 156 bp, Artificial Sequence; identical to SEQ ID NO: 2940
  Synthetic polynucleotide

SEQ ID NO: 2942 - DNA, 164 bp, Artificial Sequence
  Synthetic polynucleotide
atcatctcaccttgcctcctgtcttcgggacatttgatcctgcaggccctatctgagaccctatctgtcgccctatctggacccctatctgctaccctatctgactccctatctgtgcccctatctggtaccctatctgggcgcgccatgcttcatcagactct

SEQ ID NO: 2943 - DNA, 164 bp, Artificial Sequence; identical to SEQ ID NO: 2942
  Synthetic polynucleotide

SEQ ID NO: 2944 - DNA, 180 bp, Artificial Sequence
  Synthetic polynucleotide
atcatctcaccttgcctcctgatttaaccattgcgcaacctgcagggatgagtcatcagagatgagtcatctcggatgagtcatcgacgatgagtcatcctagatgagtcatcactgatgagtcatctgcgatgagtcatcgtagatgagtcatcggcgcgccatgcttcatcagactct

SEQ ID NO: 2945 - DNA, 180 bp, Artificial Sequence; identical to SEQ ID NO: 2944
  Synthetic polynucleotide

SEQ ID NO: 2946 - DNA, 190 bp, Artificial Sequence
  Synthetic polynucleotide
atcatctcaccttgcctcctgcactaggacgtccgtgacctgcaggtgatgacgtcatcgagatgatgacgtcatcgtcgtgatgacgtcatcggactgatgacgtcatcgctatgatgacgtcatcgacttgatgacgtcatcgtgctgatgacgtcatcggtaggcgcgccatgcttcatcagactct

SEQ ID NO: 2947 - DNA, 190 bp, Artificial Sequence; identical to SEQ ID NO: 2946
  Synthetic polynucleotide

SEQ ID NO: 2948 - DNA, 190 bp, Artificial Sequence
  Synthetic polynucleotide
atcatctcaccttgcctcctgtaacatgtccttcgccacctgcaggggcgcaggaatgtgagaggcgcaggaatgtgtcgggcgcaggaatgtggacggcgcaggaatgtgctaggcgcaggaatgtgactggcgcaggaatgtgtgcggcgcaggaatgtggtaggcgcgccatgcttcatcagactct

SEQ ID NO: 2949 - DNA, 190 bp, Artificial Sequence; identical to SEQ ID NO: 2948
  Synthetic polynucleotide

SEQ ID NO: 2950 - DNA, 180 bp, Artificial Sequence
  Synthetic polynucleotide
atcatctcaccttgcctcctgcctcagtacatacatctcctgcaggaagtaattactagaaagtaattacttcgaagtaattactgacaagtaattactctaaagtaattactactaagtaattacttgcaagtaattactgtaaagtaattactggcgcgccatgcttcatcagactct

SEQ ID NO: 2951 - DNA, 180 bp, Artificial Sequence; identical to SEQ ID NO: 2950
  Synthetic polynucleotide

SEQ ID NO: 2952 - DNA, 191 bp, Artificial Sequence
  Synthetic polynucleotide
atcatctcaccttgcctcctggtttgttgacgccgatacctgcaggcgacccaatcaacggtgagacgacccaatcaacggtgtcgcgacccaatcaacggtggaccgacccaatcaacggtgctacgacccaatcaacggtgactcgacccaatcaacggtgtgcggcgcgccatgcttcatcagactct

SEQ ID NO: 2953 - DNA, 191 bp, Artificial Sequence; identical to SEQ ID NO: 2952
  Synthetic polynucleotide

SEQ ID NO: 2954 - DNA, 172 bp, Artificial Sequence
  Synthetic polynucleotide
atcatctcaccttgcctcctggggctagagttaacttacctgcagggataatatctagagataatatcttcggataatatctgacgataatatctctagataatatctactgataatatcttgcgataatatctgtagataatatctggcgcgccatgcttcatcagactct

SEQ ID NO: 2955 - DNA, 172 bp, Artificial Sequence; identical to SEQ ID NO: 2954
  Synthetic polynucleotide

SEQ ID NO: 2956 - DNA, 148 bp, Artificial Sequence
  Synthetic polynucleotide
atcatctcaccttgcctcctgttgtggagaaacgtggccctgcaggtttgtttagatttgttttcgtttgtttgactttgtttctatttgtttacttttgttttgctttgtttgtatttgtttggcgcgccatgcttcatcagactct

SEQ ID NO: 2957 - DNA, 148 bp, Artificial Sequence; identical to SEQ ID NO: 2956
  Synthetic polynucleotide

SEQ ID NO: 2958 - DNA, 180 bp, Artificial Sequence
  Synthetic polynucleotide
atcatctcaccttgcctcctggaatttcgattcagggacctgcagggccacgtgctcagagccacgtgctctcggccacgtgctcgacgccacgtgctcctagccacgtgctcactgccacgtgctctgcgccacgtgctcgtagccacgtgctcggcgcgccatgcttcatcagactct

SEQ ID NO: 2959 - DNA, 180 bp, Artificial Sequence; identical to SEQ ID NO: 2958
  Synthetic polynucleotide

SEQ ID NO: 2960 - DNA, 197 bp, Artificial Sequence
  Synthetic polynucleotide
atcatctcaccttgcctcctgggccagagaaaccgagacctgcaggcagatctcgcgagagagacagatctcgcgagagtcgcagatctcgcgagaggaccagatctcgcgagagctacagatctcgcgagagactcagatctcgcgagagtgccagatctcgcgagaggtaggcgcgccatgcttcatcagactct

SEQ ID NO: 2961 - DNA, 197 bp, Artificial Sequence; identical to SEQ ID NO: 2960
  Synthetic polynucleotide

SEQ ID NO: 2962 - DNA, 196 bp, Artificial Sequence
  Synthetic polynucleotide
atcatctcaccttgcctcctgtctgtgcacacaaagttcctgcagggatgatagagccgagagatgatagagccgtcggatgatagagccggacgatgatagagccgctagatgatagagccgactgatgatagagccgtgcgatgatagagccggtagatgatagagccgggcgcgccatgcttcatcagactct

SEQ ID NO: 2963 - DNA, 196 bp, Artificial Sequence; identical to SEQ ID NO: 2962
  Synthetic polynucleotide

SEQ ID NO: 2964 - DNA, 197 bp, Artificial Sequence
  Synthetic polynucleotide
atcatctcaccttgcctcctggtcaccaggtaactttacctgcaggaaggggatttccaaaagaaaggggatttccaaatcgaaggggatttccaaagacaaggggatttccaaactaaaggggatttccaaaactaaggggatttccaaatgcaaggggatttccaaagtaggcgcgccatgcttcatcagactct

SEQ ID NO: 2965 - DNA, 197 bp, Artificial Sequence; identical to SEQ ID NO: 2964
  Synthetic polynucleotide

SEQ ID NO: 2966 - DNA, 190 bp, Artificial Sequence
  Synthetic polynucleotide
atcatctcaccttgcctcctggggttcttgaccaaatccctgcaggtccatggtgctgaaagatccatggtgctgaatcgtccatggtgctgaagactccatggtgctgaactatccatggtgctgaaacttccatggtgctgaatgctccatggtgctgaagtaggcgcgccatgcttcatcagactct

SEQ ID NO: 2967 - DNA, 190 bp, Artificial Sequence; identical to SEQ ID NO: 2966
  Synthetic polynucleotide

SEQ ID NO: 2968 - DNA, 197 bp, Artificial Sequence
  Synthetic polynucleotide
atcatctcaccttgcctcctgtatacggccctgggttgcctgcaggactgcctcagggcatagaactgcctcagggcattcgactgcctcagggcatgacactgcctcagggcatctaactgcctcagggcatactactgcctcagggcattgcactgcctcagggcatgtaggcgcgccatgcttcatcagactct

SEQ ID NO: 2969 - DNA, 197 bp, Artificial Sequence; identical to SEQ ID NO: 2968
  Synthetic polynucleotide

SEQ ID NO: 2970 - DNA, 191 bp, Artificial Sequence
  Synthetic polynucleotide
atcatctcaccttgcctcctggcttcgggctgtgatatcctgcaggccttggcaacttgccagagaccttggcaacttgccagtcgccttggcaacttgccaggacccttggcaacttgccagctaccttggcaacttgccagactccttggcaacttgccagtgcggcgcgccatgcttcatcagactct

SEQ ID NO: 2971 - DNA, 191 bp, Artificial Sequence; identical to SEQ ID NO: 2970
  Synthetic polynucleotide

SEQ ID NO: 2972 - DNA, 172 bp, Artificial Sequence
  Synthetic polynucleotide
atcatctcaccttgcctcctgagagcacatcaagggtgcctgcaggttgtttattgagattgtttattgtcgttgtttattggacttgtttattgctattgtttattgactttgtttattgtgcttgtttattggtattgtttattgggcgcgccatgcttcatcagactct

SEQ ID NO: 2973 - DNA, 172 bp, Artificial Sequence; identical to SEQ ID NO: 2972
  Synthetic polynucleotide

SEQ ID NO: 2974 - DNA, 191 bp, Artificial Sequence
  Synthetic polynucleotide
atcatctcaccttgcctcctgctcaaagcaatttgttccctgcaggcaggaaactgaacagctgtccagacaggaaactgaacagctgtcctcgcaggaaactgaacagctgtccgaccaggaaactgaacagctgtccctacaggaaactgaacagctgtccactggcgcgccatgcttcatcagactct

SEQ ID NO: 2975 - DNA, 191 bp, Artificial Sequence; identical to SEQ ID NO: 2974
  Synthetic polynucleotide

SEQ ID NO: 2976 - DNA, 197 bp, Artificial Sequence
  Synthetic polynucleotide
atcatctcaccttgcctcctgttcaacagccgtcgattcctgcaggaaggggatttccaagagaaaggggatttccaagtcgaaggggatttccaaggacaaggggatttccaagctaaaggggatttccaagactaaggggatttccaagtgcaaggggatttccaaggtaggcgcgccatgcttcatcagactct

SEQ ID NO: 2977 - DNA, 197 bp, Artificial Sequence; identical to SEQ ID NO: 2976
  Synthetic polynucleotide

SEQ ID NO: 2978 - DNA, 172 bp, Artificial Sequence
  Synthetic polynucleotide
atcatctcaccttgcctcctggtggatattacctggtgcctgcaggccacgtggttagaccacgtggtttcgccacgtggttgacccacgtggttctaccacgtggttactccacgtggtttgcccacgtggttgtaccacgtggttggcgcgccatgcttcatcagactct

SEQ ID NO: 2979 - DNA, 172 bp, Artificial Sequence; identical to SEQ ID NO: 2978
  Synthetic polynucleotide

SEQ ID NO: 2980 - DNA, 180 bp, Artificial Sequence
  Synthetic polynucleotide
atcatctcaccttgcctcctgcgagtaattgttctctccctgcaggattgatacattagaattgatacatttcgattgatacattgacattgatacattctaattgatacattactattgatacatttgcattgatacattgtaattgatacattggcgcgccatgcttcatcagactct

SEQ ID NO: 2981 - DNA, 180 bp, Artificial Sequence; identical to SEQ ID NO: 2980
  Synthetic polynucleotide

SEQ ID NO: 2982 - DNA, 185 bp, Artificial Sequence
  Synthetic polynucleotide
atcatctcaccttgcctcctggatgtccgagcgctatccctgcaggtctggccagttcaggcagatctggccagttcaggctcgtctggccagttcaggcgactctggccagttcaggcctatctggccagttcaggcacttctggccagttcaggctgcggcgcgccatgcttcatcagactct

SEQ ID NO: 2983 - DNA, 185 bp, Artificial Sequence; identical to SEQ ID NO: 2982
  Synthetic polynucleotide

SEQ ID NO: 2984 - DNA, 180 bp, Artificial Sequence
  Synthetic polynucleotide
atcatctcaccttgcctcctggctattctccattcaaacctgcaggtgggcgtggccagatgggcgtggcctcgtgggcgtggccgactgggcgtggccctatgggcgtggccacttgggcgtggcctgctgggcgtggccgtatgggcgtggccggcgcgccatgcttcatcagactct

SEQ ID NO: 2985 - DNA, 180 bp, Artificial Sequence; identical to SEQ ID NO: 2984
  Synthetic polynucleotide

SEQ ID NO: 2986 - DNA, 180 bp, Artificial Sequence
  Synthetic polynucleotide
atcatctcaccttgcctcctgcgcttcaataatagcaccctgcaggaaatgagcaacagaaaatgagcaactcgaaatgagcaacgacaaatgagcaacctaaaatgagcaacactaaatgagcaactgcaaatgagcaacgtaaaatgagcaacggcgcgccatgcttcatcagactct

SEQ ID NO: 2987 - DNA, 180 bp, Artificial Sequence; identical to SEQ ID NO: 2986
  Synthetic polynucleotide

SEQ ID NO: 2988 - DNA, 156 bp, Artificial Sequence
  Synthetic polynucleotide
atcatctcaccttgcctcctgatacttgtgtagctcgtcctgcaggttacatttagattacattttcgttacatttgacttacatttctattacatttactttacattttgcttacatttgtattacatttggcgcgccatgcttcatcagactct

SEQ ID NO: 2989 - DNA, 156 bp, Artificial Sequence; identical to SEQ ID NO: 2988
  Synthetic polynucleotide

SEQ ID NO: 2990 - DNA, 185 bp, Artificial Sequence
  Synthetic polynucleotide
atcatctcaccttgcctcctgcgggatgccgaactagtcctgcaggggcagctaatccccctagaggcagctaatcccccttcgggcagctaatccccctgacggcagctaatccccctctaggcagctaatccccctactggcagctaatcccccttgcggcgcgccatgcttcatcagactct

SEQ ID NO: 2991 - DNA, 185 bp, Artificial Sequence; identical to SEQ ID NO: 2990
  Synthetic polynucleotide

SEQ ID NO: 2992 - DNA, 191 bp, Artificial Sequence
  Synthetic polynucleotide
atcatctcaccttgcctcctgatcctctggaaaccttgcctgcaggccatcgtacgtacactcagaccatcgtacgtacactctcgccatcgtacgtacactcgacccatcgtacgtacactcctaccatcgtacgtacactcactccatcgtacgtacactctgcggcgcgccatgcttcatcagactct

SEQ ID NO: 2993 - DNA, 191 bp, Artificial Sequence; identical to SEQ ID NO: 2992
  Synthetic polynucleotide

SEQ ID NO: 2994 - DNA, 172 bp, Artificial Sequence
  Synthetic polynucleotide
atcatctcaccttgcctcctgcgaaagcggatctgcttcctgcagggctaatccgtagagctaatccgttcggctaatccgtgacgctaatccgtctagctaatccgtactgctaatccgttgcgctaatccgtgtagctaatccgtggcgcgccatgcttcatcagactct

SEQ ID NO: 2995 - DNA, 172 bp, Artificial Sequence; identical to SEQ ID NO: 2994
  Synthetic polynucleotide

SEQ ID NO: 2996 - DNA, 172 bp, Artificial Sequence
  Synthetic polynucleotide
atcatctcaccttgcctcctgaccaggaactcgaatagcctgcaggtgaggtcacaagatgaggtcacatcgtgaggtcacagactgaggtcacactatgaggtcacaacttgaggtcacatgctgaggtcacagtatgaggtcacaggcgcgccatgcttcatcagactct

SEQ ID NO: 2997 - DNA, 172 bp, Artificial Sequence; identical to SEQ ID NO: 2996
  Synthetic polynucleotide

SEQ ID NO: 2998 - DNA, 191 bp, Artificial Sequence
  Synthetic polynucleotide
atcatctcaccttgcctcctgtacctacgggcttaattcctgcaggcccctcctgatgcccccagacccctcctgatgccccctcgcccctcctgatgcccccgaccccctcctgatgcccccctacccctcctgatgcccccactcccctcctgatgccccctgcggcgcgccatgcttcatcagactct

SEQ ID NO: 2999 - DNA, 191 bp, Artificial Sequence; identical to SEQ ID NO: 2998
  Synthetic polynucleotide

SEQ ID NO: 3000 - DNA, 197 bp, Artificial Sequence
  Synthetic polynucleotide
atcatctcaccttgcctcctgagcgtggtaatcatggacctgcaggggccgccattttgttagaggccgccattttgtttcgggccgccattttgttgacggccgccattttgttctaggccgccattttgttactggccgccattttgtttgcggccgccattttgttgtaggcgcgccatgcttcatcagactct

SEQ ID NO: 3001 - DNA, 197 bp, Artificial Sequence; identical to SEQ ID NO: 3000
  Synthetic polynucleotide

SEQ ID NO: 3002 - DNA, 172 bp, Artificial Sequence
  Synthetic polynucleotide
atcatctcaccttgcctcctggcatgtagcggaacattcctgcaggagcaggtgcgagaagcaggtgcgtcgagcaggtgcggacagcaggtgcgctaagcaggtgcgactagcaggtgcgtgcagcaggtgcggtaagcaggtgcgggcgcgccatgcttcatcagactct

SEQ ID NO: 3003 - DNA, 172 bp, Artificial Sequence; identical to SEQ ID NO: 3002
  Synthetic polynucleotide

SEQ ID NO: 3004 - DNA, 164 bp, Artificial Sequence
  Synthetic polynucleotide
atcatctcaccttgcctcctggctggtctgacgtcatgcctgcaggacagctcccagaacagctccctcgacagctcccgacacagctcccctaacagctcccactacagctccctgcacagctcccgtaacagctcccggcgcgccatgcttcatcagactct

SEQ ID NO: 3005 - DNA, 164 bp, Artificial Sequence; identical to SEQ ID NO: 3004
  Synthetic polynucleotide

SEQ ID NO: 3006 - DNA, 190 bp, Artificial Sequence
  Synthetic polynucleotide
atcatctcaccttgcctcctgcagtacgctgtttagctcctgcaggtttttgtttactcaagatttttgtttactcatcgtttttgtttactcagactttttgtttactcactatttttgtttactcaacttttttgtttactcatgctttttgtttactcagtaggcgcgccatgcttcatcagactct

SEQ ID NO: 3007 - DNA, 190 bp, Artificial Sequence; identical to SEQ ID NO: 3006
  Synthetic polynucleotide

SEQ ID NO: 3008 - DNA, 200 bp, Artificial Sequence
  Synthetic polynucleotide
atcatctcaccttgcctcctgcaggtctgaaagatattcctgcaggtcacaccttttaggtgtgaagatcacaccttttaggtgtgatcgtcacaccttttaggtgtgagactcacaccttttaggtgtgactatcacaccttttaggtgtgaacttcacaccttttaggtgtgaggcgcgccatgcttcatcagactct

SEQ ID NO: 3009 - DNA, 200 bp, Artificial Sequence; identical to SEQ ID NO: 3008
  Synthetic polynucleotide

SEQ ID NO: 3010 - DNA, 188 bp, Artificial Sequence
  Synthetic polynucleotide
atcatctcaccttgcctcctgcgaagagcggtcctatacctgcaggatgtaaacaagcagaatgtaaacaagctcgatgtaaacaagcgacatgtaaacaagcctaatgtaaacaagcactatgtaaacaagctgcatgtaaacaagcgtaatgtaaacaagcggcgcgccatgcttcatcagactct

SEQ ID NO: 3011 - DNA, 188 bp, Artificial Sequence; identical to SEQ ID NO: 3010
  Synthetic polynucleotide

SEQ ID NO: 3012 - DNA, 197 bp, Artificial Sequence
  Synthetic polynucleotide
atcatctcaccttgcctcctgtgcttggctctcagtatcctgcaggggcggccgccatcttagaggcggccgccatctttcgggcggccgccatcttgacggcggccgccatcttctaggcggccgccatcttactggcggccgccatctttgcggcggccgccatcttgtaggcgcgccatgcttcatcagactct

SEQ ID NO: 3013 - DNA, 197 bp, Artificial Sequence; identical to SEQ ID NO: 3012
  Synthetic polynucleotide

SEQ ID NO: 3014 - DNA, 172 bp, Artificial Sequence
  Synthetic polynucleotide
atcatctcaccttgcctcctgaaatgacagctaaagcacctgcaggggtctggcatagaggtctggcattcgggtctggcatgacggtctggcatctaggtctggcatactggtctggcattgcggtctggcatgtaggtctggcatggcgcgccatgcttcatcagactct

SEQ ID NO: 3015 - DNA, 172 bp, Artificial Sequence; identical to SEQ ID NO: 3014
  Synthetic polynucleotide

SEQ ID NO: 3016 - DNA, 191 bp, Artificial Sequence
  Synthetic polynucleotide
atcatctcaccttgcctcctgacgacattctctgaatccctgcaggaatcaatttcagtgattagaaatcaatttcagtgatttcgaatcaatttcagtgattgacaatcaatttcagtgattctaaatcaatttcagtgattactaatcaatttcagtgatttgcggcgcgccatgcttcatcagactct

SEQ ID NO: 3017 - DNA, 191 bp, Artificial Sequence; identical to SEQ ID NO: 3016
  Synthetic polynucleotide

SEQ ID NO: 3018 - DNA, 156 bp, Artificial Sequence
  Synthetic polynucleotide
atcatctcaccttgcctcctgtatgtatgatgcggcgtcctgcaggtattacgtagatattacgttcgtattacgtgactattacgtctatattacgtacttattacgttgctattacgtgtatattacgtggcgcgccatgcttcatcagactct

SEQ ID NO: 3019 - DNA, 156 bp, Artificial Sequence; identical to SEQ ID NO: 3018
  Synthetic polynucleotide

SEQ ID NO: 3020 - DNA, 172 bp, Artificial Sequence
  Synthetic polynucleotide
atcatctcaccttgcctcctgaatttatgtggcgtctacctgcaggaattttggcaagaaattttggcatcgaattttggcagacaattttggcactaaattttggcaactaattttggcatgcaattttggcagtaaattttggcaggcgcgccatgcttcatcagactct

SEQ ID NO: 3021 - DNA, 172 bp, Artificial Sequence; identical to SEQ ID NO: 3020
  Synthetic polynucleotide

SEQ ID NO: 3022 - DNA, 196 bp, Artificial Sequence
  Synthetic polynucleotide
atcatctcaccttgcctcctgcgccatggaatgtgtcgcctgcaggaaggtgtgaaaatagaaaggtgtgaaaattcgaaggtgtgaaaatgacaaggtgtgaaaatctaaaggtgtgaaaatactaaggtgtgaaaattgcaaggtgtgaaaatgtaaaggtgtgaaaatggcgcgccatgcttcatcagactct

SEQ ID NO: 3023 - DNA, 196 bp, Artificial Sequence; identical to SEQ ID NO: 3022
  Synthetic polynucleotide

SEQ ID NO: 3024 - DNA, 140 bp, Artificial Sequence
  Synthetic polynucleotide
atcatctcaccttgcctcctggcgtaattgaatcccatcctgcagggtatcaagagtatcatcggtatcagacgtatcactagtatcaactgtatcatgcgtatcagtagtatcaggcgcgccatgcttcatcagactct

SEQ ID NO: 3025 - DNA, 140 bp, Artificial Sequence; identical to SEQ ID NO: 3024
  Synthetic polynucleotide

SEQ ID NO: 3026 - DNA, 164 bp, Artificial Sequence
  Synthetic polynucleotide
atcatctcaccttgcctcctggttgtggacgtttaccacctgcaggacagctcctagaacagctccttcgacagctcctgacacagctcctctaacagctcctactacagctccttgcacagctcctgtaacagctcctggcgcgccatgcttcatcagactct

SEQ ID NO: 3027 - DNA, 164 bp, Artificial Sequence; identical to SEQ ID NO: 3026
  Synthetic polynucleotide

SEQ ID NO: 3028 - DNA, 197 bp, Artificial Sequence
  Synthetic polynucleotide
atcatctcaccttgcctcctgaaagaggagtaatcctccctgcaggtaaccgcaaaaaccgcaaagataaccgcaaaaaccgcaatcgtaaccgcaaaaaccgcaagactaaccgcaaaaaccgcaactataaccgcaaaaaccgcaaacttaaccgcaaaaaccgcaatgcggcgcgccatgcttcatcagactct

SEQ ID NO: 3029 - DNA, 197 bp, Artificial Sequence; identical to SEQ ID NO: 3028
  Synthetic polynucleotide

SEQ ID NO: 3030 - DNA, 196 bp, Artificial Sequence
  Synthetic polynucleotide
atcatctcaccttgcctcctgattcaccgagtccactgcctgcaggactagacgagatgagaactagacgagatgtcgactagacgagatggacactagacgagatgctaactagacgagatgactactagacgagatgtgcactagacgagatggtaactagacgagatgggcgcgccatgcttcatcagactct

SEQ ID NO: 3031 - DNA, 196 bp, Artificial Sequence; identical to SEQ ID NO: 3030
  Synthetic polynucleotide

SEQ ID NO: 3032 - DNA, 200 bp, Artificial Sequence
  Synthetic polynucleotide
atcatctcaccttgcctcctgctgccagctatggacttcctgcagggttgccatggcaaccgcggagagttgccatggcaaccgcggtcggttgccatggcaaccgcgggacgttgccatggcaaccgcggctagttgccatggcaaccgcggactgttgccatggcaaccgcggggcgcgccatgcttcatcagactct

SEQ ID NO: 3033 - DNA, 200 bp, Artificial Sequence; identical to SEQ ID NO: 3032
  Synthetic polynucleotide

SEQ ID NO: 3034 - DNA, 199 bp, Artificial Sequence
  Synthetic polynucleotide
atcatctcaccttgcctcctgcccatccataccttagacctgcaggcacctgttcaatttggcacggagccaacaagacacctgttcaatttggcacggagccaacatcgcacctgttcaatttggcacggagccaacagaccacctgttcaatttggcacggagccaacactaggcgcgccatgcttcatcagactct

SEQ ID NO: 3035 - DNA, 199 bp, Artificial Sequence; identical to SEQ ID NO: 3034
  Synthetic polynucleotide

SEQ ID NO: 3036 - DNA, 197 bp, Artificial Sequence
  Synthetic polynucleotide
atcatctcaccttgcctcctgactaagtaaaggacctgcctgcaggataaacaattaatcaagaataaacaattaatcatcgataaacaattaatcagacataaacaattaatcactaataaacaattaatcaactataaacaattaatcatgcataaacaattaatcagtaggcgcgccatgcttcatcagactct

SEQ ID NO: 3037 - DNA, 197 bp, Artificial Sequence; identical to SEQ ID NO: 3036
  Synthetic polynucleotide

SEQ ID NO: 3038 - DNA, 156 bp, Artificial Sequence
  Synthetic polynucleotide
atcatctcaccttgcctcctggcctaaactattatgtgcctgcaggggcagctgagaggcagctgtcgggcagctggacggcagctgctaggcagctgactggcagctgtgcggcagctggtaggcagctgggcgcgccatgcttcatcagactct

SEQ ID NO: 3039 - DNA, 156 bp, Artificial Sequence; identical to SEQ ID NO: 3038
  Synthetic polynucleotide

SEQ ID NO: 3040 - DNA, 197 bp, Artificial Sequence
  Synthetic polynucleotide
atcatctcaccttgcctcctgaaccggaacttgttgctcctgcaggtacgtaactgacgtaagatacgtaactgacgtatcgtacgtaactgacgtagactacgtaactgacgtactatacgtaactgacgtaacttacgtaactgacgtatgctacgtaactgacgtagtaggcgcgccatgcttcatcagactct

SEQ ID NO: 3041 - DNA, 197 bp, Artificial Sequence; identical to SEQ ID NO: 3040
  Synthetic polynucleotide

SEQ ID NO: 3042 - DNA, 190 bp, Artificial Sequence
  Synthetic polynucleotide
atcatctcaccttgcctcctggtatttagcaccctacacctgcagggtaaacaataaacaagagtaaacaataaacatcggtaaacaataaacagacgtaaacaataaacactagtaaacaataaacaactgtaaacaataaacatgcgtaaacaataaacagtaggcgcgccatgcttcatcagactct

SEQ ID NO: 3043 - DNA, 190 bp, Artificial Sequence; identical to SEQ ID NO: 3042
  Synthetic polynucleotide

SEQ ID NO: 3044 - DNA, 197 bp, Artificial Sequence
  Synthetic polynucleotide
atcatctcaccttgcctcctgattgtgcctttccggcccctgcaggtgatgactcatacttagatgatgactcatactttcgtgatgactcatacttgactgatgactcatacttctatgatgactcatacttacttgatgactcatactttgctgatgactcatacttgtaggcgcgccatgcttcatcagactct

SEQ ID NO: 3045 - DNA, 197 bp, Artificial Sequence; identical to SEQ ID NO: 3044
  Synthetic polynucleotide

SEQ ID NO: 3046 - DNA, 185 bp, Artificial Sequence
  Synthetic polynucleotide
atcatctcaccttgcctcctgttagcctcgtgcgaagacctgcaggctgaagtaattattccagactgaagtaattattcctcgctgaagtaattattccgacctgaagtaattattccctactgaagtaattattccactctgaagtaattattcctgcggcgcgccatgcttcatcagactct

SEQ ID NO: 3047 - DNA, 185 bp, Artificial Sequence; identical to SEQ ID NO: 3046
  Synthetic polynucleotide

SEQ ID NO: 3048 - DNA, 188 bp, Artificial Sequence
  Synthetic polynucleotide
atcatctcaccttgcctcctgagtcccatgacgccacacctgcagggccacgcccactagagccacgcccacttcggccacgcccactgacgccacgcccactctagccacgcccactactgccacgcccacttgcgccacgcccactgtagccacgcccactggcgcgccatgcttcatcagactct

SEQ ID NO: 3049 - DNA, 188 bp, Artificial Sequence; identical to SEQ ID NO: 3048
  Synthetic polynucleotide

SEQ ID NO: 3050 - DNA, 196 bp, Artificial Sequence
  Synthetic polynucleotide
atcatctcaccttgcctcctgtgtcaattggacatgtgcctgcagggtgaccttgggctagagtgaccttgggcttcggtgaccttgggctgacgtgaccttgggctctagtgaccttgggctactgtgaccttgggcttgcgtgaccttgggctgtagtgaccttgggctggcgcgccatgcttcatcagactct

SEQ ID NO: 3051 - DNA, 196 bp, Artificial Sequence; identical to SEQ ID NO: 3050
  Synthetic polynucleotide

SEQ ID NO: 3052 - DNA, 197 bp, Artificial Sequence
  Synthetic polynucleotide
atcatctcaccttgcctcctgaaaggcggtcaagttgtcctgcaggaatgcttacgtcagcactagaaatgcttacgtcagcacttcgaatgcttacgtcagcactgacaatgcttacgtcagcactctaaatgcttacgtcagcactactaatgcttacgtcagcacttgcggcgcgccatgcttcatcagactct

SEQ ID NO: 3053 - DNA, 197 bp, Artificial Sequence; identical to SEQ ID NO: 3052
  Synthetic polynucleotide

SEQ ID NO: 3054 - DNA, 190 bp, Artificial Sequence
  Synthetic polynucleotide
atcatctcaccttgcctcctgacatgtcgtacttgtgacctgcaggttggaaatccccttagattggaaatcccctttcgttggaaatccccttgacttggaaatccccttctattggaaatccccttactttggaaatcccctttgcttggaaatccccttgtaggcgcgccatgcttcatcagactct

SEQ ID NO: 3055 - DNA, 190 bp, Artificial Sequence; identical to SEQ ID NO: 3054
  Synthetic polynucleotide

SEQ ID NO: 3056 - DNA, 185 bp, Artificial Sequence
  Synthetic polynucleotide
atcatctcaccttgcctcctgggcgtggtctgaaacaccctgcagggggaacagatggtctcagagggaacagatggtctctcggggaacagatggtctcgacgggaacagatggtctcctagggaacagatggtctcactgggaacagatggtctctgcggcgcgccatgcttcatcagactct

SEQ ID NO: 3057 - DNA, 185 bp, Artificial Sequence; identical to SEQ ID NO: 3056
  Synthetic polynucleotide

SEQ ID NO: 3058 - DNA, 197 bp, Artificial Sequence
  Synthetic polynucleotide
atcatctcaccttgcctcctgcccttcaagttgcccatcctgcaggttcccctcagggaatagattcccctcagggaattcgttcccctcagggaatgacttcccctcagggaatctattcccctcagggaatactttcccctcagggaattgcttcccctcagggaatgtaggcgcgccatgcttcatcagactct

SEQ ID NO: 3059 - DNA, 197 bp, Artificial Sequence; identical to SEQ ID NO: 3058
  Synthetic polynucleotide

SEQ ID NO: 3060 - DNA, 172 bp, Artificial Sequence
  Synthetic polynucleotide
atcatctcaccttgcctcctgaccgaatgcacatagtccctgcaggctgacgtcacagactgacgtcactcgctgacgtcacgacctgacgtcacctactgacgtcacactctgacgtcactgcctgacgtcacgtactgacgtcacggcgcgccatgcttcatcagactct

SEQ ID NO: 3061 - DNA, 172 bp, Artificial Sequence; identical to SEQ ID NO: 3060
  Synthetic polynucleotide

SEQ ID NO: 3062 - DNA, 180 bp, Artificial Sequence
  Synthetic polynucleotide
atcatctcaccttgcctcctgggaagtccagagcctttcctgcaggtttgtttacatagatttgtttacattcgtttgtttacatgactttgtttacatctatttgtttacatacttttgtttacattgctttgtttacatgtatttgtttacatggcgcgccatgcttcatcagactct

SEQ ID NO: 3063 - DNA, 180 bp, Artificial Sequence; identical to SEQ ID NO: 3062
  Synthetic polynucleotide

SEQ ID NO: 3064 - DNA, 156 bp, Artificial Sequence
  Synthetic polynucleotide
atcatctcaccttgcctcctgtttaggcgcaaagtcagcctgcaggaacacgtgagaaacacgtgtcgaacacgtggacaacacgtgctaaacacgtgactaacacgtgtgcaacacgtggtaaacacgtgggcgcgccatgcttcatcagactct

SEQ ID NO: 3065 - DNA, 156 bp, Artificial Sequence; identical to SEQ ID NO: 3064
  Synthetic polynucleotide

SEQ ID NO: 3066 - DNA, 164 bp, Artificial Sequence
  Synthetic polynucleotide
atcatctcaccttgcctcctgcgttgtgcacctgtacacctgcaggtttgggagaagatttgggagatcgtttgggagagactttgggagactatttgggagaacttttgggagatgctttgggagagtatttgggagaggcgcgccatgcttcatcagactct

SEQ ID NO: 3067 - DNA, 164 bp, Artificial Sequence; identical to SEQ ID NO: 3066
  Synthetic polynucleotide

SEQ ID NO: 3068 - DNA, 172 bp, Artificial Sequence
  Synthetic polynucleotide
atcatctcaccttgcctcctggtgcaatgctcatttgtcctgcaggaattttggctagaaattttggcttcgaattttggctgacaattttggctctaaattttggctactaattttggcttgcaattttggctgtaaattttggctggcgcgccatgcttcatcagactct

SEQ ID NO: 3069 - DNA, 172 bp, Artificial Sequence; identical to SEQ ID NO: 3068
  Synthetic polynucleotide

SEQ ID NO: 3070 - DNA, 185 bp, Artificial Sequence
  Synthetic polynucleotide
atcatctcaccttgcctcctgtgccatctgttagagagcctgcaggccgaccatctgttcagagaccgaccatctgttcagtcgccgaccatctgttcaggacccgaccatctgttcagctaccgaccatctgttcagactccgaccatctgttcagtgcggcgcgccatgcttcatcagactct

SEQ ID NO: 3071 - DNA, 185 bp, Artificial Sequence; identical to SEQ ID NO: 3070
  Synthetic polynucleotide

SEQ ID NO: 3072 - DNA, 164 bp, Artificial Sequence
  Synthetic polynucleotide
atcatctcaccttgcctcctgaaatcttcgtcgcccaacctgcaggactggacttagaactggactttcgactggacttgacactggacttctaactggacttactactggactttgcactggacttgtaactggacttggcgcgccatgcttcatcagactct

SEQ ID NO: 3073 - DNA, 164 bp, Artificial Sequence; identical to SEQ ID NO: 3072
  Synthetic polynucleotide

SEQ ID NO: 3074 - DNA, 172 bp, Artificial Sequence
  Synthetic polynucleotide
atcatctcaccttgcctcctggctcttgatcgcctactcctgcaggaggtcattaaagaaggtcattaatcgaggtcattaagacaggtcattaactaaggtcattaaactaggtcattaatgcaggtcattaagtaaggtcattaaggcgcgccatgcttcatcagactct

SEQ ID NO: 3075 - DNA, 172 bp, Artificial Sequence; identical to SEQ ID NO: 3074
  Synthetic polynucleotide

SEQ ID NO: 3076 - DNA, 164 bp, Artificial Sequence
  Synthetic polynucleotide
atcatctcaccttgcctcctgcttagtacggccgacctcctgcaggatgacaggtagaatgacaggttcgatgacaggtgacatgacaggtctaatgacaggtactatgacaggttgcatgacaggtgtaatgacaggtggcgcgccatgcttcatcagactct

SEQ ID NO: 3077 - DNA, 164 bp, Artificial Sequence; identical to SEQ ID NO: 3076
  Synthetic polynucleotide

SEQ ID NO: 3078 - DNA, 197 bp, Artificial Sequence
  Synthetic polynucleotide
atcatctcaccttgcctcctgatcattctggcgggacccctgcaggacggcaggtgtccccagaacggcaggtgtcccctcgacggcaggtgtccccgacacggcaggtgtccccctaacggcaggtgtccccactacggcaggtgtcccctgcacggcaggtgtccccgtaggcgcgccatgcttcatcagactct

SEQ ID NO: 3079 - DNA, 197 bp, Artificial Sequence; identical to SEQ ID NO: 3078
  Synthetic polynucleotide

SEQ ID NO: 3080 - DNA, 188 bp, Artificial Sequence
  Synthetic polynucleotide
atcatctcaccttgcctcctgtgtcccacgagactgagcctgcaggaagattgcgcaaagaaagattgcgcaatcgaagattgcgcaagacaagattgcgcaactaaagattgcgcaaactaagattgcgcaatgcaagattgcgcaagtaaagattgcgcaaggcgcgccatgcttcatcagactct

SEQ ID NO: 3081 - DNA, 188 bp, Artificial Sequence; identical to SEQ ID NO: 3080
  Synthetic polynucleotide

SEQ ID NO: 3082 - DNA, 186 bp, Artificial Sequence
  Synthetic polynucleotide
atcatctcaccttgcctcctggtcacgttgagtttgcacctgcaggttcacacctctaggtgtgaaagattcacacctctaggtgtgaatcgttcacacctctaggtgtgaagacttcacacctctaggtgtgaactattcacacctctaggtgtgaaactggcgcgccatgcttcatcagactct

SEQ ID NO: 3083 - DNA, 186 bp, Artificial Sequence; identical to SEQ ID NO: 3082
  Synthetic polynucleotide

SEQ ID NO: 3084 - DNA, 180 bp, Artificial Sequence
  Synthetic polynucleotide
atcatctcaccttgcctcctgggttcttataggaggctcctgcaggttattatatatagattattatatattcgttattatatatgacttattatatatctattattatatatactttattatatattgcttattatatatgtattattatatatggcgcgccatgcttcatcagactct

SEQ ID NO: 3085 - DNA, 180 bp, Artificial Sequence; identical to SEQ ID NO: 3084
  Synthetic polynucleotide

SEQ ID NO: 3086 - DNA, 185 bp, Artificial Sequence
  Synthetic polynucleotide
atcatctcaccttgcctcctgacacgaggatcaacacgcctgcaggttaatgagctaattaaagattaatgagctaattaatcgttaatgagctaattaagacttaatgagctaattaactattaatgagctaattaaactttaatgagctaattaatgcggcgcgccatgcttcatcagactct

SEQ ID NO: 3087 - DNA, 185 bp, Artificial Sequence; identical to SEQ ID NO: 3086
  Synthetic polynucleotide

SEQ ID NO: 3088 - DNA, 180 bp, Artificial Sequence
  Synthetic polynucleotide
atcatctcaccttgcctcctgctgtgcactcataactgcctgcagggccgccatcttagagccgccatctttcggccgccatcttgacgccgccatcttctagccgccatcttactgccgccatctttgcgccgccatcttgtagccgccatcttggcgcgccatgcttcatcagactct

SEQ ID NO: 3089 - DNA, 180 bp, Artificial Sequence; identical to SEQ ID NO: 3088
  Synthetic polynucleotide

SEQ ID NO: 3090 - DNA, 191 bp, Artificial Sequence
  Synthetic polynucleotide
atcatctcaccttgcctcctgagcatatgctaggcgtccctgcaggaaacaatgacattgtttagaaaacaatgacattgttttcgaaacaatgacattgtttgacaaacaatgacattgtttctaaaacaatgacattgtttactaaacaatgacattgttttgcggcgcgccatgcttcatcagactct

SEQ ID NO: 3091 - DNA, 191 bp, Artificial Sequence; identical to SEQ ID NO: 3090
  Synthetic polynucleotide

SEQ ID NO: 3092 - DNA, 172 bp, Artificial Sequence
  Synthetic polynucleotide
atcatctcaccttgcctcctgctgagcgcaggtcatagcctgcaggagcagctgctagaagcagctgcttcgagcagctgctgacagcagctgctctaagcagctgctactagcagctgcttgcagcagctgctgtaagcagctgctggcgcgccatgcttcatcagactct

SEQ ID NO: 3093 - DNA, 172 bp, Artificial Sequence; identical to SEQ ID NO: 3092
  Synthetic polynucleotide

SEQ ID NO: 3094 - DNA, 180 bp, Artificial Sequence
  Synthetic polynucleotide
atcatctcaccttgcctcctgtgggctagcttgctgcacctgcaggaagatcaaaggagaaagatcaaaggtcgaagatcaaagggacaagatcaaaggctaaagatcaaaggactaagatcaaaggtgcaagatcaaagggtaaagatcaaaggggcgcgccatgcttcatcagactct

SEQ ID NO: 3095 - DNA, 180 bp, Artificial Sequence; identical to SEQ ID NO: 3094
  Synthetic polynucleotide

SEQ ID NO: 3096 - DNA, 191 bp, Artificial Sequence
  Synthetic polynucleotide
atcatctcaccttgcctcctgtcaactggatgtggtgccctgcagggcccagaacattctgttccctagagcccagaacattctgttcccttcggcccagaacattctgttccctgacgcccagaacattctgttccctctagcccagaacattctgttccctactggcgcgccatgcttcatcagactct

SEQ ID NO: 3097 - DNA, 191 bp, Artificial Sequence; identical to SEQ ID NO: 3096
  Synthetic polynucleotide

SEQ ID NO: 3098 - DNA, 191 bp, Artificial Sequence
  Synthetic polynucleotide
atcatctcaccttgcctcctgggttgtgcactattccccctgcaggcacttccgccggaagtgagacacttccgccggaagtgtcgcacttccgccggaagtggaccacttccgccggaagtgctacacttccgccggaagtgactcacttccgccggaagtgtgcggcgcgccatgcttcatcagactct

SEQ ID NO: 3099 - DNA, 191 bp, Artificial Sequence; identical to SEQ ID NO: 3098
  Synthetic polynucleotide

SEQ ID NO: 3100 - DNA, 172 bp, Artificial Sequence
  Synthetic polynucleotide
atcatctcaccttgcctcctgatgatcgtgagacggatcctgcagggataattacaagagataattacatcggataattacagacgataattacactagataattacaactgataattacatgcgataattacagtagataattacaggcgcgccatgcttcatcagactct

SEQ ID NO: 3101 - DNA, 172 bp, Artificial Sequence; identical to SEQ ID NO: 3100
  Synthetic polynucleotide

SEQ ID NO: 3102 - DNA, 197 bp, Artificial Sequence
  Synthetic polynucleotide
atcatctcaccttgcctcctgagcctcattgaggtcaccctgcagggcggacacctgccggagagcggacacctgccggtcggcggacacctgccgggacgcggacacctgccggctagcggacacctgccggactgcggacacctgccggtgcgcggacacctgccgggtaggcgcgccatgcttcatcagactct

SEQ ID NO: 3103 - DNA, 197 bp, Artificial Sequence; identical to SEQ ID NO: 3102
  Synthetic polynucleotide

SEQ ID NO: 3104 - DNA, 197 bp, Artificial Sequence
  Synthetic polynucleotide
atcatctcaccttgcctcctgtgtgcaactgaatgctacctgcaggatgactgcaattcatagaatgactgcaattcattcgatgactgcaattcatgacatgactgcaattcatctaatgactgcaattcatactatgactgcaattcattgcatgactgcaattcatgtaggcgcgccatgcttcatcagactct

SEQ ID NO: 3105 - DNA, 197 bp, Artificial Sequence; identical to SEQ ID NO: 3104
  Synthetic polynucleotide

SEQ ID NO: 3106 - DNA, 164 bp, Artificial Sequence
  Synthetic polynucleotide
atcatctcaccttgcctcctgtagaccctcgttctagccctgcaggccctcccccagaccctccccctcgccctcccccgacccctcccccctaccctcccccactccctccccctgcccctcccccgtaccctcccccggcgcgccatgcttcatcagactct

SEQ ID NO: 3107 - DNA, 164 bp, Artificial Sequence; identical to SEQ ID NO: 3106
  Synthetic polynucleotide

SEQ ID NO: 3108 - DNA, 186 bp, Artificial Sequence
  Synthetic polynucleotide
atcatctcaccttgcctcctggcgcgggagatacgtttcctgcaggcaagtaacacgtgacacttgagacaagtaacacgtgacacttgtcgcaagtaacacgtgacacttggaccaagtaacacgtgacacttgctacaagtaacacgtgacacttgactggcgcgccatgcttcatcagactct

SEQ ID NO: 3109 - DNA, 186 bp, Artificial Sequence; identical to SEQ ID NO: 3108
  Synthetic polynucleotide

SEQ ID NO: 3110 - DNA, 196 bp, Artificial Sequence
  Synthetic polynucleotide
atcatctcaccttgcctcctgtcgtggtattggcatcgcctgcaggaggtaaacaaacaagaaggtaaacaaacatcgaggtaaacaaacagacaggtaaacaaacactaaggtaaacaaacaactaggtaaacaaacatgcaggtaaacaaacagtaaggtaaacaaacaggcgcgccatgcttcatcagactct

SEQ ID NO: 3111 - DNA, 196 bp, Artificial Sequence; identical to SEQ ID NO: 3110
  Synthetic polynucleotide

SEQ ID NO: 3112 - DNA, 180 bp, Artificial Sequence
  Synthetic polynucleotide
atcatctcaccttgcctcctggcacaattatgaagtgtcctgcagggccacgcccacagagccacgcccactcggccacgcccacgacgccacgcccacctagccacgcccacactgccacgcccactgcgccacgcccacgtagccacgcccacggcgcgccatgcttcatcagactct

SEQ ID NO: 3113 - DNA, 180 bp, Artificial Sequence; identical to SEQ ID NO: 3112
  Synthetic polynucleotide

SEQ ID NO: 3114 - DNA, 197 bp, Artificial Sequence
  Synthetic polynucleotide
atcatctcaccttgcctcctgcgccagggtattatgtacctgcaggagttaatgattaactagaagttaatgattaacttcgagttaatgattaactgacagttaatgattaactctaagttaatgattaactactagttaatgattaacttgcagttaatgattaactgtaggcgcgccatgcttcatcagactct

SEQ ID NO: 3115 - DNA, 197 bp, Artificial Sequence; identical to SEQ ID NO: 3114
  Synthetic polynucleotide

SEQ ID NO: 3116 - DNA, 197 bp, Artificial Sequence
  Synthetic polynucleotide
atcatctcaccttgcctcctgaattagagtaccaggtccctgcaggaggtgtgacttcacacctagaaggtgtgacttcacaccttcgaggtgtgacttcacacctgacaggtgtgacttcacacctctaaggtgtgacttcacacctactaggtgtgacttcacaccttgcggcgcgccatgcttcatcagactct

SEQ ID NO: 3117 - DNA, 197 bp, Artificial Sequence; identical to SEQ ID NO: 3116
  Synthetic polynucleotide

SEQ ID NO: 3118 - DNA, 197 bp, Artificial Sequence
  Synthetic polynucleotide
atcatctcaccttgcctcctgatcacaaggaattaaggcctgcaggaaatggaccaatcagagaaaatggaccaatcagtcgaaatggaccaatcaggacaaatggaccaatcagctaaaatggaccaatcagactaaatggaccaatcagtgcaaatggaccaatcaggtaggcgcgccatgcttcatcagactct

SEQ ID NO: 3119 - DNA, 197 bp, Artificial Sequence; identical to SEQ ID NO: 3118
  Synthetic polynucleotide

SEQ ID NO: 3120 - DNA, 191 bp, Artificial Sequence
  Synthetic polynucleotide
atcatctcaccttgcctcctgacaatgctgaagcagctcctgcaggttcgtggcatttttctaagattcgtggcatttttctatcgttcgtggcatttttctagacttcgtggcatttttctactattcgtggcatttttctaactttcgtggcatttttctatgcggcgcgccatgcttcatcagactct

SEQ ID NO: 3121 - DNA, 191 bp, Artificial Sequence; identical to SEQ ID NO: 3120
  Synthetic polynucleotide

SEQ ID NO: 3122 - DNA, 180 bp, Artificial Sequence
  Synthetic polynucleotide
atcatctcaccttgcctcctgaagcgcgtcattcgtgtcctgcagggggcgggaaggagagggcgggaaggtcggggcgggaagggacgggcgggaaggctagggcgggaaggactgggcgggaaggtgcgggcgggaagggtagggcgggaaggggcgcgccatgcttcatcagactct

SEQ ID NO: 3123 - DNA, 180 bp, Artificial Sequence; identical to SEQ ID NO: 3122
  Synthetic polynucleotide

SEQ ID NO: 3124 - DNA, 172 bp, Artificial Sequence
  Synthetic polynucleotide
atcatctcaccttgcctcctgaccgtcgcaactcacatcctgcaggttatcgattaagattatcgattatcgttatcgattagacttatcgattactattatcgattaactttatcgattatgcttatcgattagtattatcgattaggcgcgccatgcttcatcagactct

SEQ ID NO: 3125 - DNA, 172 bp, Artificial Sequence; identical to SEQ ID NO: 3124
  Synthetic polynucleotide

SEQ ID NO: 3126 - DNA, 156 bp, Artificial Sequence
  Synthetic polynucleotide
atcatctcaccttgcctcctgccgtttacttagagaaacctgcaggaccgcgtgagaaccgcgtgtcgaccgcgtggacaccgcgtgctaaccgcgtgactaccgcgtgtgcaccgcgtggtaaccgcgtgggcgcgccatgcttcatcagactct

SEQ ID NO: 3127 - DNA, 156 bp, Artificial Sequence; identical to SEQ ID NO: 3126
  Synthetic polynucleotide

SEQ ID NO: 3128 - DNA, 197 bp, Artificial Sequence
  Synthetic polynucleotide
atcatctcaccttgcctcctgtgacttacactgcaaaccctgcaggatcgcgcgcccttatagaatcgcgcgcccttattcgatcgcgcgcccttatgacatcgcgcgcccttatctaatcgcgcgcccttatactatcgcgcgcccttattgcatcgcgcgcccttatgtaggcgcgccatgcttcatcagactct

SEQ ID NO: 3129 - DNA, 197 bp, Artificial Sequence; identical to SEQ ID NO: 3128
  Synthetic polynucleotide

SEQ ID NO: 3130 - DNA, 196 bp, Artificial Sequence
  Synthetic polynucleotide
atcatctcaccttgcctcctgctatgagaaaccactgacctgcaggcgtttcccacagtagacgtttcccacagttcgcgtttcccacagtgaccgtttcccacagtctacgtttcccacagtactcgtttcccacagttgccgtttcccacagtgtacgtttcccacagtggcgcgccatgcttcatcagactct

SEQ ID NO: 3131 - DNA, 196 bp, Artificial Sequence; identical to SEQ ID NO: 3130
  Synthetic polynucleotide

SEQ ID NO: 3132 - DNA, 188 bp, Artificial Sequence
  Synthetic polynucleotide
atcatctcaccttgcctcctggcgtagcttatgtgcaacctgcaggataattggattaagaataattggattatcgataattggattagacataattggattactaataattggattaactataattggattatgcataattggattagtaataattggattaggcgcgccatgcttcatcagactct

SEQ ID NO: 3133 - DNA, 188 bp, Artificial Sequence; identical to SEQ ID NO: 3132
  Synthetic polynucleotide

SEQ ID NO: 3134 - DNA, 172 bp, Artificial Sequence
  Synthetic polynucleotide
atcatctcaccttgcctcctgccagagtatgacatgatcctgcaggccaaatcgggagaccaaatcgggtcgccaaatcggggacccaaatcgggctaccaaatcgggactccaaatcgggtgcccaaatcggggtaccaaatcgggggcgcgccatgcttcatcagactct

SEQ ID NO: 3135 - DNA, 172 bp, Artificial Sequence; identical to SEQ ID NO: 3134
  Synthetic polynucleotide

SEQ ID NO: 3136 - DNA, 196 bp, Artificial Sequence
  Synthetic polynucleotide
atcatctcaccttgcctcctgagtcatctcaaccgacgcctgcaggtattgcatcatccagatattgcatcatcctcgtattgcatcatccgactattgcatcatccctatattgcatcatccacttattgcatcatcctgctattgcatcatccgtatattgcatcatccggcgcgccatgcttcatcagactct

SEQ ID NO: 3137 - DNA, 196 bp, Artificial Sequence; identical to SEQ ID NO: 3136
  Synthetic polynucleotide

SEQ ID NO: 3138 - DNA, 172 bp, Artificial Sequence
  Synthetic polynucleotide
atcatctcaccttgcctcctggttctcacagtgaggtacctgcaggacccgcatgaagaacccgcatgatcgacccgcatgagacacccgcatgactaacccgcatgaactacccgcatgatgcacccgcatgagtaacccgcatgaggcgcgccatgcttcatcagactct

SEQ ID NO: 3139 - DNA, 172 bp, Artificial Sequence; identical to SEQ ID NO: 3138
  Synthetic polynucleotide

SEQ ID NO: 3140 - DNA, 164 bp, Artificial Sequence
  Synthetic polynucleotide
atcatctcaccttgcctcctgagtacagatgggaatcccctgcaggtctatcctaagatctatcctatcgtctatcctagactctatcctactatctatcctaacttctatcctatgctctatcctagtatctatcctaggcgcgccatgcttcatcagactct

SEQ ID NO: 3141 - DNA, 164 bp, Artificial Sequence; identical to SEQ ID NO: 3140
  Synthetic polynucleotide

SEQ ID NO: 3142 - DNA, 196 bp, Artificial Sequence
  Synthetic polynucleotide
atcatctcaccttgcctcctgagtcgtacggtcattctcctgcagggttaatcattaacagagttaatcattaactcggttaatcattaacgacgttaatcattaacctagttaatcattaacactgttaatcattaactgcgttaatcattaacgtagttaatcattaacggcgcgccatgcttcatcagactct

SEQ ID NO: 3143 - DNA, 196 bp, Artificial Sequence; identical to SEQ ID NO: 3142
  Synthetic polynucleotide

SEQ ID NO: 3144 - DNA, 164 bp, Artificial Sequence
  Synthetic polynucleotide
atcatctcaccttgcctcctgagcctaaggacactcttcctgcaggtgctgacggagatgctgacggtcgtgctgacgggactgctgacggctatgctgacggacttgctgacggtgctgctgacgggtatgctgacggggcgcgccatgcttcatcagactct

SEQ ID NO: 3145 - DNA, 164 bp, Artificial Sequence; identical to SEQ ID NO: 3144
  Synthetic polynucleotide

SEQ ID NO: 3146 - DNA, 164 bp, Artificial Sequence
  Synthetic polynucleotide
atcatctcaccttgcctcctgcgaagagcgacaaagaccctgcaggtgacgtcacagatgacgtcactcgtgacgtcacgactgacgtcacctatgacgtcacacttgacgtcactgctgacgtcacgtatgacgtcacggcgcgccatgcttcatcagactct

SEQ ID NO: 3147 - DNA, 164 bp, Artificial Sequence; identical to SEQ ID NO: 3146
  Synthetic polynucleotide

SEQ ID NO: 3148 - DNA, 190 bp, Artificial Sequence
  Synthetic polynucleotide
atcatctcaccttgcctcctgtcaatctggagcataaccctgcaggtttagcaatattagagatttagcaatattagtcgtttagcaatattaggactttagcaatattagctatttagcaatattagacttttagcaatattagtgctttagcaatattaggtaggcgcgccatgcttcatcagactct

SEQ ID NO: 3149 - DNA, 190 bp, Artificial Sequence; identical to SEQ ID NO: 3148
  Synthetic polynucleotide

SEQ ID NO: 3150 - DNA, 172 bp, Artificial Sequence
  Synthetic polynucleotide
atcatctcaccttgcctcctgatcatgacggttaacgtcctgcaggagcaggtgttagaagcaggtgtttcgagcaggtgttgacagcaggtgttctaagcaggtgttactagcaggtgtttgcagcaggtgttgtaagcaggtgttggcgcgccatgcttcatcagactct

SEQ ID NO: 3151 - DNA, 172 bp, Artificial Sequence; identical to SEQ ID NO: 3150
  Synthetic polynucleotide

SEQ ID NO: 3152 - DNA, 197 bp, Artificial Sequence
  Synthetic polynucleotide
atcatctcaccttgcctcctgagtgcctcgtaacggctcctgcaggaacaatgttattgttagaaacaatgttattgtttcgaacaatgttattgttgacaacaatgttattgttctaaacaatgttattgttactaacaatgttattgtttgcaacaatgttattgttgtaggcgcgccatgcttcatcagactct

SEQ ID NO: 3153 - DNA, 197 bp, Artificial Sequence; identical to SEQ ID NO: 3152
  Synthetic polynucleotide

SEQ ID NO: 3154 - DNA, 172 bp, Artificial Sequence
  Synthetic polynucleotide
atcatctcaccttgcctcctgataacagcccggctccacctgcaggacatccgggtagaacatccgggttcgacatccgggtgacacatccgggtctaacatccgggtactacatccgggttgcacatccgggtgtaacatccgggtggcgcgccatgcttcatcagactct

SEQ ID NO: 3155 - DNA, 172 bp, Artificial Sequence; identical to SEQ ID NO: 3154
  Synthetic polynucleotide

SEQ ID NO: 3156 - DNA, 156 bp, Artificial Sequence
  Synthetic polynucleotide
atcatctcaccttgcctcctgggactttcttccgatttcctgcaggttgggagaagattgggagatcgttgggagagacttgggagactattgggagaactttgggagatgcttgggagagtattgggagaggcgcgccatgcttcatcagactct

SEQ ID NO: 3157 - DNA, 156 bp, Artificial Sequence; identical to SEQ ID NO: 3156
  Synthetic polynucleotide

SEQ ID NO: 3158 - DNA, 197 bp, Artificial Sequence
  Synthetic polynucleotide
atcatctcaccttgcctcctgatgataagaggaagaagcctgcaggttaattaccgttaattacagattaattaccgttaattactcgttaattaccgttaattacgacttaattaccgttaattacctattaattaccgttaattacactttaattaccgttaattactgcggcgcgccatgcttcatcagactct

SEQ ID NO: 3159 - DNA, 197 bp, Artificial Sequence; identical to SEQ ID NO: 3158
  Synthetic polynucleotide

SEQ ID NO: 3160 - DNA, 172 bp, Artificial Sequence
  Synthetic polynucleotide
atcatctcaccttgcctcctggtaccgtaatctttcttcctgcagggtcatgtgatagagtcatgtgattcggtcatgtgatgacgtcatgtgatctagtcatgtgatactgtcatgtgattgcgtcatgtgatgtagtcatgtgatggcgcgccatgcttcatcagactct

SEQ ID NO: 3161 - DNA, 172 bp, Artificial Sequence; identical to SEQ ID NO: 3160
  Synthetic polynucleotide

SEQ ID NO: 3162 - DNA, 164 bp, Artificial Sequence
  Synthetic polynucleotide
atcatctcaccttgcctcctgtagccggagtctaccttcctgcaggacacgtggcagaacacgtggctcgacacgtggcgacacacgtggcctaacacgtggcactacacgtggctgcacacgtggcgtaacacgtggcggcgcgccatgcttcatcagactct

SEQ ID NO: 3163 - DNA, 164 bp, Artificial Sequence; identical to SEQ ID NO: 3162
  Synthetic polynucleotide

SEQ ID NO: 3164 - DNA, 197 bp, Artificial Sequence
  Synthetic polynucleotide
atcatctcaccttgcctcctgtatagatgtttgctggacctgcaggagaacagaatgttctagaagaacagaatgttcttcgagaacagaatgttctgacagaacagaatgttctctaagaacagaatgttctactagaacagaatgttcttgcagaacagaatgttctgtaggcgcgccatgcttcatcagactct

SEQ ID NO: 3165 - DNA, 197 bp, Artificial Sequence; identical to SEQ ID NO: 3164
  Synthetic polynucleotide

SEQ ID NO: 3166 - DNA, 172 bp, Artificial Sequence
  Synthetic polynucleotide
atcatctcaccttgcctcctggctctatcaacaaggtgcctgcaggacatcaaaggagaacatcaaaggtcgacatcaaagggacacatcaaaggctaacatcaaaggactacatcaaaggtgcacatcaaagggtaacatcaaaggggcgcgccatgcttcatcagactct

SEQ ID NO: 3167 - DNA, 172 bp, Artificial Sequence; identical to SEQ ID NO: 3166
  Synthetic polynucleotide

SEQ ID NO: 3168 - DNA, 164 bp, Artificial Sequence
  Synthetic polynucleotide
atcatctcaccttgcctcctgttgatgtgagtggtccccctgcaggacccattaaagaacccattaatcgacccattaagacacccattaactaacccattaaactacccattaatgcacccattaagtaacccattaaggcgcgccatgcttcatcagactct

SEQ ID NO: 3169 - DNA, 164 bp, Artificial Sequence; identical to SEQ ID NO: 3168
  Synthetic polynucleotide

SEQ ID NO: 3170 - DNA, 164 bp, Artificial Sequence
  Synthetic polynucleotide
atcatctcaccttgcctcctgctggatgtgttggtgtacctgcaggccgtcagcaagaccgtcagcatcgccgtcagcagacccgtcagcactaccgtcagcaactccgtcagcatgcccgtcagcagtaccgtcagcaggcgcgccatgcttcatcagactct

SEQ ID NO: 3171 - DNA, 164 bp, Artificial Sequence; identical to SEQ ID NO: 3170
  Synthetic polynucleotide

SEQ ID NO: 3172 - DNA, 185 bp, Artificial Sequence
  Synthetic polynucleotide
atcatctcaccttgcctcctgttacaacacgtggcagacctgcaggtttaattaattaattcagatttaattaattaattctcgtttaattaattaattcgactttaattaattaattcctatttaattaattaattcacttttaattaattaattctgcggcgcgccatgcttcatcagactct

SEQ ID NO: 3173 - DNA, 185 bp, Artificial Sequence; identical to SEQ ID NO: 3172
  Synthetic polynucleotide

SEQ ID NO: 3174 - DNA, 164 bp, Artificial Sequence
  Synthetic polynucleotide
atcatctcaccttgcctcctgtgtaggcctatctctgccctgcaggggtgggcatagaggtgggcattcgggtgggcatgacggtgggcatctaggtgggcatactggtgggcattgcggtgggcatgtaggtgggcatggcgcgccatgcttcatcagactct

SEQ ID NO: 3175 - DNA, 164 bp, Artificial Sequence; identical to SEQ ID NO: 3174
  Synthetic polynucleotide

SEQ ID NO: 3176 - DNA, 164 bp, Artificial Sequence
  Synthetic polynucleotide
atcatctcaccttgcctcctggagtaacccaacatggccctgcaggtgcgggcagagatgcgggcagtcgtgcgggcaggactgcgggcagctatgcgggcagacttgcgggcagtgctgcgggcaggtatgcgggcagggcgcgccatgcttcatcagactct

SEQ ID NO: 3177 - DNA, 164 bp, Artificial Sequence; identical to SEQ ID NO: 3176
  Synthetic polynucleotide

SEQ ID NO: 3178 - DNA, 197 bp, Artificial Sequence
  Synthetic polynucleotide
atcatctcaccttgcctcctgttactggcgacgcccttcctgcaggttggtttcggtttatagattggtttcggtttattcgttggtttcggtttatgacttggtttcggtttatctattggtttcggtttatactttggtttcggtttattgcttggtttcggtttatgtaggcgcgccatgcttcatcagactct

SEQ ID NO: 3179 - DNA, 197 bp, Artificial Sequence; identical to SEQ ID NO: 3178
  Synthetic polynucleotide

SEQ ID NO: 3180 - DNA, 172 bp, Artificial Sequence
  Synthetic polynucleotide
atcatctcaccttgcctcctgacgaggtttataggtaccctgcaggtatgtaaacaagatatgtaaacatcgtatgtaaacagactatgtaaacactatatgtaaacaacttatgtaaacatgctatgtaaacagtatatgtaaacaggcgcgccatgcttcatcagactct

SEQ ID NO: 3181 - DNA, 172 bp, Artificial Sequence; identical to SEQ ID NO: 3180
  Synthetic polynucleotide

SEQ ID NO: 3182 - DNA, 164 bp, Artificial Sequence
  Synthetic polynucleotide
atcatctcaccttgcctcctggacagattccttggactcctgcaggccggaaaaaagaccggaaaaatcgccggaaaaagacccggaaaaactaccggaaaaaactccggaaaaatgcccggaaaaagtaccggaaaaaggcgcgccatgcttcatcagactct

SEQ ID NO: 3183 - DNA, 164 bp, Artificial Sequence; identical to SEQ ID NO: 3182
  Synthetic polynucleotide

SEQ ID NO: 3184 - DNA, 180 bp, Artificial Sequence
  Synthetic polynucleotide
atcatctcaccttgcctcctggattggtcgtttgaggacctgcagggaccacgtggtagagaccacgtggttcggaccacgtggtgacgaccacgtggtctagaccacgtggtactgaccacgtggttgcgaccacgtggtgtagaccacgtggtggcgcgccatgcttcatcagactct

SEQ ID NO: 3185 - DNA, 180 bp, Artificial Sequence; identical to SEQ ID NO: 3184
  Synthetic polynucleotide

SEQ ID NO: 3186 - DNA, 164 bp, Artificial Sequence
  Synthetic polynucleotide
atcatctcaccttgcctcctgtgactttcgtaggcatgcctgcaggagaacaatgagaagaacaatgtcgagaacaatggacagaacaatgctaagaacaatgactagaacaatgtgcagaacaatggtaagaacaatgggcgcgccatgcttcatcagactct

SEQ ID NO: 3187 - DNA, 164 bp, Artificial Sequence; identical to SEQ ID NO: 3186
  Synthetic polynucleotide

SEQ ID NO: 3188 - DNA, 197 bp, Artificial Sequence
  Synthetic polynucleotide
atcatctcaccttgcctcctggcggtactatagaaactcctgcaggttggccccgccccctagattggccccgcccccttcgttggccccgccccctgacttggccccgccccctctattggccccgccccctactttggccccgcccccttgcttggccccgccccctgtaggcgcgccatgcttcatcagactct

SEQ ID NO: 3189 - DNA, 197 bp, Artificial Sequence; identical to SEQ ID NO: 3188
  Synthetic polynucleotide

SEQ ID NO: 3190 - DNA, 156 bp, Artificial Sequence
  Synthetic polynucleotide
atcatctcaccttgcctcctgccaccatatttcggcgtcctgcaggcaaggtcaagacaaggtcatcgcaaggtcagaccaaggtcactacaaggtcaactcaaggtcatgccaaggtcagtacaaggtcaggcgcgccatgcttcatcagactct

SEQ ID NO: 3191 - DNA, 156 bp, Artificial Sequence; identical to SEQ ID NO: 3190
  Synthetic polynucleotide

SEQ ID NO: 3192 - DNA, 190 bp, Artificial Sequence
  Synthetic polynucleotide
atcatctcaccttgcctcctggttcctcatccatccaacctgcaggtgctttctaggaaaagatgctttctaggaaatcgtgctttctaggaaagactgctttctaggaaactatgctttctaggaaaacttgctttctaggaaatgctgctttctaggaaagtaggcgcgccatgcttcatcagactct

SEQ ID NO: 3193 - DNA, 190 bp, Artificial Sequence; identical to SEQ ID NO: 3192
  Synthetic polynucleotide

SEQ ID NO: 3194 - DNA, 190 bp, Artificial Sequence
  Synthetic polynucleotide
atcatctcaccttgcctcctgggtatgctttgagtcttcctgcaggtaagaacaatgggaagataagaacaatgggatcgtaagaacaatgggagactaagaacaatgggactataagaacaatgggaacttaagaacaatgggatgctaagaacaatgggagtaggcgcgccatgcttcatcagactct

SEQ ID NO: 3195 - DNA, 190 bp, Artificial Sequence; identical to SEQ ID NO: 3194
  Synthetic polynucleotide

SEQ ID NO: 3196 - DNA, 197 bp, Artificial Sequence
  Synthetic polynucleotide
atcatctcaccttgcctcctggaattaccggaccttaacctgcaggccggaagcggaagtgagaccggaagcggaagtgtcgccggaagcggaagtggacccggaagcggaagtgctaccggaagcggaagtgactccggaagcggaagtgtgcccggaagcggaagtggtaggcgcgccatgcttcatcagactct

SEQ ID NO: 3197 - DNA, 197 bp, Artificial Sequence; identical to SEQ ID NO: 3196
  Synthetic polynucleotide

SEQ ID NO: 3198 - DNA, 185 bp, Artificial Sequence
  Synthetic polynucleotide
atcatctcaccttgcctcctgatgatcgccttaccgtccctgcaggcaggtgacacctgacaagacaggtgacacctgacatcgcaggtgacacctgacagaccaggtgacacctgacactacaggtgacacctgacaactcaggtgacacctgacatgcggcgcgccatgcttcatcagactct

SEQ ID NO: 3199 - DNA, 185 bp, Artificial Sequence; identical to SEQ ID NO: 3198
  Synthetic polynucleotide

SEQ ID NO: 3200 - DNA, 156 bp, Artificial Sequence
  Synthetic polynucleotide
atcatctcaccttgcctcctgctgatgcatctgattagcctgcaggtgtaaacaagatgtaaacatcgtgtaaacagactgtaaacactatgtaaacaacttgtaaacatgctgtaaacagtatgtaaacaggcgcgccatgcttcatcagactct

SEQ ID NO: 3201 - DNA, 156 bp, Artificial Sequence; identical to SEQ ID NO: 3200
  Synthetic polynucleotide

SEQ ID NO: 3202 - DNA, 191 bp, Artificial Sequence
  Synthetic polynucleotide
atcatctcaccttgcctcctgagtcgatcgctggttcccctgcaggtcaggggtcaaaggtcatccgagatcaggggtcaaaggtcatccgtcgtcaggggtcaaaggtcatccggactcaggggtcaaaggtcatccgctatcaggggtcaaaggtcatccgactggcgcgccatgcttcatcagactct

SEQ ID NO: 3203 - DNA, 191 bp, Artificial Sequence; identical to SEQ ID NO: 3202
  Synthetic polynucleotide

SEQ ID NO: 3204 - DNA, 200 bp, Artificial Sequence
  Synthetic polynucleotide
atcatctcaccttgcctcctgtccggactatcagtggtcctgcaggtaaaggtcaaaggtcaacgagataaaggtcaaaggtcaacgtcgtaaaggtcaaaggtcaacggactaaaggtcaaaggtcaacgctataaaggtcaaaggtcaacgacttaaaggtcaaaggtcaacgggcgcgccatgcttcatcagactct

SEQ ID NO: 3205 - DNA, 200 bp, Artificial Sequence; identical to SEQ ID NO: 3204
  Synthetic polynucleotide

SEQ ID NO: 3206 - DNA, 156 bp, Artificial Sequence
  Synthetic polynucleotide
atcatctcaccttgcctcctgtgattgggctgaacttccctgcaggcacttaagagacacttaagtcgcacttaaggaccacttaagctacacttaagactcacttaagtgccacttaaggtacacttaagggcgcgccatgcttcatcagactct

SEQ ID NO: 3207 - DNA, 156 bp, Artificial Sequence; identical to SEQ ID NO: 3206
  Synthetic polynucleotide

SEQ ID NO: 3208 - DNA, 197 bp, Artificial Sequence
  Synthetic polynucleotide
atcatctcaccttgcctcctgacgcagcggattgtatacctgcaggatcaattgcattgatagaatcaattgcattgattcgatcaattgcattgatgacatcaattgcattgatctaatcaattgcattgatactatcaattgcattgattgcatcaattgcattgatgtaggcgcgccatgcttcatcagactct

SEQ ID NO: 3209 - DNA, 197 bp, Artificial Sequence; identical to SEQ ID NO: 3208
  Synthetic polynucleotide

SEQ ID NO: 3210 - DNA, 185 bp, Artificial Sequence
  Synthetic polynucleotide
atcatctcaccttgcctcctgactctagacagtggtgacctgcaggtcgatgacgtcatcgtagatcgatgacgtcatcgttcgtcgatgacgtcatcgtgactcgatgacgtcatcgtctatcgatgacgtcatcgtacttcgatgacgtcatcgttgcggcgcgccatgcttcatcagactct

SEQ ID NO: 3211 - DNA, 185 bp, Artificial Sequence; identical to SEQ ID NO: 3210
  Synthetic polynucleotide

SEQ ID NO: 3212 - DNA, 164 bp, Artificial Sequence
  Synthetic polynucleotide
atcatctcaccttgcctcctgcgtcttggacattacgacctgcaggtcattatcgagatcattatcgtcgtcattatcggactcattatcgctatcattatcgacttcattatcgtgctcattatcggtatcattatcgggcgcgccatgcttcatcagactct

SEQ ID NO: 3213 - DNA, 164 bp, Artificial Sequence; identical to SEQ ID NO: 3212
  Synthetic polynucleotide

SEQ ID NO: 3214 - DNA, 164 bp, Artificial Sequence
  Synthetic polynucleotide
atcatctcaccttgcctcctgggaaagcactaactgcgcctgcaggatttgatacagaatttgatactcgatttgatacgacatttgatacctaatttgatacactatttgatactgcatttgatacgtaatttgatacggcgcgccatgcttcatcagactct

SEQ ID NO: 3215 - DNA, 164 bp, Artificial Sequence; identical to SEQ ID NO: 3214
  Synthetic polynucleotide

SEQ ID NO: 3216 - DNA, 172 bp, Artificial Sequence
  Synthetic polynucleotide
atcatctcaccttgcctcctgccgccgattcgtagttacctgcagggccagttgacagagccagttgactcggccagttgacgacgccagttgacctagccagttgacactgccagttgactgcgccagttgacgtagccagttgacggcgcgccatgcttcatcagactct

SEQ ID NO: 3217 - DNA, 172 bp, Artificial Sequence; identical to SEQ ID NO: 3216
  Synthetic polynucleotide

SEQ ID NO: 3218 - DNA, 185 bp, Artificial Sequence
  Synthetic polynucleotide
atcatctcaccttgcctcctgtgtacgatcagtcggaacctgcaggaacactgaacattgttagaaacactgaacattgtttcgaacactgaacattgttgacaacactgaacattgttctaaacactgaacattgttactaacactgaacattgtttgcggcgcgccatgcttcatcagactct

SEQ ID NO: 3219 - DNA, 185 bp, Artificial Sequence; identical to SEQ ID NO: 3218
  Synthetic polynucleotide

SEQ ID NO: 3220 - DNA, 156 bp, Artificial Sequence
  Synthetic polynucleotide
atcatctcaccttgcctcctggtaacctgttagaggatcctgcaggaagcggaaagaaagcggaatcgaagcggaagacaagcggaactaaagcggaaactaagcggaatgcaagcggaagtaaagcggaaggcgcgccatgcttcatcagactct

SEQ ID NO: 3221 - DNA, 156 bp, Artificial Sequence; identical to SEQ ID NO: 3220
  Synthetic polynucleotide

SEQ ID NO: 3222 - DNA, 172 bp, Artificial Sequence
  Synthetic polynucleotide
atcatctcaccttgcctcctgatcgcagaaagcaagtacctgcaggaacatggcggagaaacatggcggtcgaacatggcgggacaacatggcggctaaacatggcggactaacatggcggtgcaacatggcgggtaaacatggcggggcgcgccatgcttcatcagactct

SEQ ID NO: 3223 - DNA, 172 bp, Artificial Sequence; identical to SEQ ID NO: 3222
  Synthetic polynucleotide

SEQ ID NO: 3224 - DNA, 172 bp, Artificial Sequence
  Synthetic polynucleotide
atcatctcaccttgcctcctgggtttaagtcggtcagtcctgcaggcatcaaagggagacatcaaagggtcgcatcaaaggggaccatcaaagggctacatcaaagggactcatcaaagggtgccatcaaaggggtacatcaaagggggcgcgccatgcttcatcagactct

SEQ ID NO: 3225 - DNA, 172 bp, Artificial Sequence; identical to SEQ ID NO: 3224
  Synthetic polynucleotide

SEQ ID NO: 3226 - DNA, 196 bp, Artificial Sequence
  Synthetic polynucleotide
atcatctcaccttgcctcctgtaatagtgttagctcaccctgcaggataaacaaacagaagaataaacaaacagatcgataaacaaacagagacataaacaaacagactaataaacaaacagaactataaacaaacagatgcataaacaaacagagtaataaacaaacagaggcgcgccatgcttcatcagactct

SEQ ID NO: 3227 - DNA, 196 bp, Artificial Sequence; identical to SEQ ID NO: 3226
  Synthetic polynucleotide

SEQ ID NO: 3228 - DNA, 172 bp, Artificial Sequence
  Synthetic polynucleotide
atcatctcaccttgcctcctgcaagaatagttcatcagcctgcaggcgcccccgcaagacgcccccgcatcgcgcccccgcagaccgcccccgcactacgcccccgcaactcgcccccgcatgccgcccccgcagtacgcccccgcaggcgcgccatgcttcatcagactct

SEQ ID NO: 3229 - DNA, 172 bp, Artificial Sequence; identical to SEQ ID NO: 3228
  Synthetic polynucleotide

SEQ ID NO: 3230 - DNA, 172 bp, Artificial Sequence
  Synthetic polynucleotide
atcatctcaccttgcctcctgaccgatcagcagatgatcctgcaggagcagctggaagaagcagctggatcgagcagctggagacagcagctggactaagcagctggaactagcagctggatgcagcagctggagtaagcagctggaggcgcgccatgcttcatcagactct

SEQ ID NO: 3231 - DNA, 172 bp, Artificial Sequence; identical to SEQ ID NO: 3230
  Synthetic polynucleotide

SEQ ID NO: 3232 - DNA, 156 bp, Artificial Sequence
  Synthetic polynucleotide
atcatctcaccttgcctcctgaaaccgatgaactcaagcctgcagggtactaatagagtactaattcggtactaatgacgtactaatctagtactaatactgtactaattgcgtactaatgtagtactaatggcgcgccatgcttcatcagactct

SEQ ID NO: 3233 - DNA, 156 bp, Artificial Sequence; identical to SEQ ID NO: 3232
  Synthetic polynucleotide

SEQ ID NO: 3234 - DNA, 164 bp, Artificial Sequence
  Synthetic polynucleotide
atcatctcaccttgcctcctgcaccgcaataagactagcctgcaggagcgattaaagaagcgattaatcgagcgattaagacagcgattaactaagcgattaaactagcgattaatgcagcgattaagtaagcgattaaggcgcgccatgcttcatcagactct

SEQ ID NO: 3235 - DNA, 164 bp, Artificial Sequence; identical to SEQ ID NO: 3234
  Synthetic polynucleotide

SEQ ID NO: 3236 - DNA, 172 bp, Artificial Sequence
  Synthetic polynucleotide
atcatctcaccttgcctcctgcttactatccgcttatgcctgcaggccaactgccaagaccaactgccatcgccaactgccagacccaactgccactaccaactgccaactccaactgccatgcccaactgccagtaccaactgccaggcgcgccatgcttcatcagactct

SEQ ID NO: 3237 - DNA, 172 bp, Artificial Sequence; identical to SEQ ID NO: 3236
  Synthetic polynucleotide

SEQ ID NO: 3238 - DNA, 140 bp, Artificial Sequence
  Synthetic polynucleotide
atcatctcaccttgcctcctgcttcgcagggttaagaacctgcaggcgcgccagacgcgcctcgcgcgccgaccgcgccctacgcgccactcgcgcctgccgcgccgtacgcgccggcgcgccatgcttcatcagactct

SEQ ID NO: 3239 - DNA, 140 bp, Artificial Sequence; identical to SEQ ID NO: 3238
  Synthetic polynucleotide

SEQ ID NO: 3240 - DNA, 156 bp, Artificial Sequence
  Synthetic polynucleotide
atcatctcaccttgcctcctggtcttaacgccgttgaacctgcaggaggaagtcagaaggaagtctcgaggaagtcgacaggaagtcctaaggaagtcactaggaagtctgcaggaagtcgtaaggaagtcggcgcgccatgcttcatcagactct

SEQ ID NO: 3241 - DNA, 156 bp, Artificial Sequence; identical to SEQ ID NO: 3240
  Synthetic polynucleotide

SEQ ID NO: 3242 - DNA, 140 bp, Artificial Sequence
  Synthetic polynucleotide
atcatctcaccttgcctcctgagcgtacgacagcctgtcctgcaggttattaagattattatcgttattagacttattactattattaactttattatgcttattagtattattaggcgcgccatgcttcatcagactct

SEQ ID NO: 3243 - DNA, 140 bp, Artificial Sequence; identical to SEQ ID NO: 3242
  Synthetic polynucleotide

SEQ ID NO: 3244 - DNA, 180 bp, Artificial Sequence
  Synthetic polynucleotide
atcatctcaccttgcctcctgcgtttcgtcccatacgccctgcagggccgccattttagagccgccatttttcggccgccattttgacgccgccattttctagccgccattttactgccgccatttttgcgccgccattttgtagccgccattttggcgcgccatgcttcatcagactct

SEQ ID NO: 3245 - DNA, 180 bp, Artificial Sequence; identical to SEQ ID NO: 3244
  Synthetic polynucleotide

SEQ ID NO: 3246 - DNA, 164 bp, Artificial Sequence
  Synthetic polynucleotide
atcatctcaccttgcctcctgacttaacatgccattctcctgcaggaaaacaaaaagaaaaacaaaatcgaaaacaaaagacaaaacaaaactaaaaacaaaaactaaaacaaaatgcaaaacaaaagtaaaaacaaaaggcgcgccatgcttcatcagactct

SEQ ID NO: 3247 - DNA, 164 bp, Artificial Sequence; identical to SEQ ID NO: 3246
  Synthetic polynucleotide

SEQ ID NO: 3248 - DNA, 172 bp, Artificial Sequence
  Synthetic polynucleotide
atcatctcaccttgcctcctgcaacctatgggagcaagcctgcaggccatccatcaagaccatccatcatcgccatccatcagacccatccatcactaccatccatcaactccatccatcatgcccatccatcagtaccatccatcaggcgcgccatgcttcatcagactct

SEQ ID NO: 3249 - DNA, 172 bp, Artificial Sequence; identical to SEQ ID NO: 3248
  Synthetic polynucleotide

SEQ ID NO: 3250 - DNA, 200 bp, Artificial Sequence
  Synthetic polynucleotide
atcatctcaccttgcctcctgcccaaatatttccaccccctgcaggctcttcctccctcctcttctcctctcctctagactcttcctccctcctcttctcctctcctcttcgctcttcctccctcctcttctcctctcctctgacctcttcctccctcctcttctcctctcctctggcgcgccatgcttcatcagactct

SEQ ID NO: 3251 - DNA, 200 bp, Artificial Sequence; identical to SEQ ID NO: 3250
  Synthetic polynucleotide

SEQ ID NO: 3252 - DNA, 190 bp, Artificial Sequence
  Synthetic polynucleotide
atcatctcaccttgcctcctgatgtcggcaacaggcctcctgcaggaaaagtaggtcagaagaaaaagtaggtcagatcgaaaagtaggtcagagacaaaagtaggtcagactaaaaagtaggtcagaactaaaagtaggtcagatgcaaaagtaggtcagagtaggcgcgccatgcttcatcagactct

SEQ ID NO: 3253 - DNA, 190 bp, Artificial Sequence; identical to SEQ ID NO: 3252
  Synthetic polynucleotide

SEQ ID NO: 3254 - DNA, 190 bp, Artificial Sequence
  Synthetic polynucleotide
atcatctcaccttgcctcctgctgcgctacaagggtcacctgcaggccacctgccgcaggagaccacctgccgcaggtcgccacctgccgcagggacccacctgccgcaggctaccacctgccgcaggactccacctgccgcaggtgcccacctgccgcagggtaggcgcgccatgcttcatcagactct

SEQ ID NO: 3255 - DNA, 190 bp, Artificial Sequence; identical to SEQ ID NO: 3254
  Synthetic polynucleotide

SEQ ID NO: 3256 - DNA, 164 bp, Artificial Sequence
  Synthetic polynucleotide
atcatctcaccttgcctcctgctcaggcttgttccattcctgcaggggtcattaaagaggtcattaatcgggtcattaagacggtcattaactaggtcattaaactggtcattaatgcggtcattaagtaggtcattaaggcgcgccatgcttcatcagactct

SEQ ID NO: 3257 - DNA, 164 bp, Artificial Sequence; identical to SEQ ID NO: 3256
  Synthetic polynucleotide

SEQ ID NO: 3258 - DNA, 190 bp, Artificial Sequence
  Synthetic polynucleotide
atcatctcaccttgcctcctggaaagaaatgcggactgcctgcaggcccccccgggggtgagacccccccgggggtgtcgcccccccgggggtggaccccccccgggggtgctacccccccgggggtgactcccccccgggggtgtgccccccccgggggtggtaggcgcgccatgcttcatcagactct

SEQ ID NO: 3259 - DNA, 190 bp, Artificial Sequence; identical to SEQ ID NO: 3258
  Synthetic polynucleotide

SEQ ID NO: 3260 - DNA, 164 bp, Artificial Sequence
  Synthetic polynucleotide
atcatctcaccttgcctcctgacgcatttcggtattaccctgcaggcaggaatttagacaggaattttcgcaggaatttgaccaggaatttctacaggaatttactcaggaattttgccaggaatttgtacaggaatttggcgcgccatgcttcatcagactct

SEQ ID NO: 3261 - DNA, 164 bp, Artificial Sequence; identical to SEQ ID NO: 3260
  Synthetic polynucleotide

SEQ ID NO: 3262 - DNA, 191 bp, Artificial Sequence
  Synthetic polynucleotide
atcatctcaccttgcctcctgttaagacctggaggctgcctgcaggaggtcactcaaaggtcaagaaggtcactcaaaggtcatcgaggtcactcaaaggtcagacaggtcactcaaaggtcactaaggtcactcaaaggtcaactaggtcactcaaaggtcatgcggcgcgccatgcttcatcagactct

SEQ ID NO: 3263 - DNA, 191 bp, Artificial Sequence; identical to SEQ ID NO: 3262
  Synthetic polynucleotide

SEQ ID NO: 3264 - DNA, 164 bp, Artificial Sequence
  Synthetic polynucleotide
atcatctcaccttgcctcctgtctgggttattaaggaacctgcagggcagctgtcagagcagctgtctcggcagctgtcgacgcagctgtcctagcagctgtcactgcagctgtctgcgcagctgtcgtagcagctgtcggcgcgccatgcttcatcagactct

SEQ ID NO: 3265 - DNA, 164 bp, Artificial Sequence; identical to SEQ ID NO: 3264
  Synthetic polynucleotide

SEQ ID NO: 3266 - DNA, 156 bp, Artificial Sequence
  Synthetic polynucleotide
atcatctcaccttgcctcctgtaagcggaaacctaacacctgcagggccaccagagagccaccagtcggccaccaggacgccaccagctagccaccagactgccaccagtgcgccaccaggtagccaccagggcgcgccatgcttcatcagactct

SEQ ID NO: 3267 - DNA, 156 bp, Artificial Sequence; identical to SEQ ID NO: 3266
  Synthetic polynucleotide

SEQ ID NO: 3268 - DNA, 172 bp, Artificial Sequence
  Synthetic polynucleotide
atcatctcaccttgcctcctggtgctgaaccctgaattcctgcaggagtcacgtgaagaagtcacgtgatcgagtcacgtgagacagtcacgtgactaagtcacgtgaactagtcacgtgatgcagtcacgtgagtaagtcacgtgaggcgcgccatgcttcatcagactct

SEQ ID NO: 3269 - DNA, 172 bp, Artificial Sequence; identical to SEQ ID NO: 3268
  Synthetic polynucleotide

SEQ ID NO: 3270 - DNA, 148 bp, Artificial Sequence
  Synthetic polynucleotide
atcatctcaccttgcctcctgacggtctgataggaccgcctgcagggaaatcaagagaaatcatcggaaatcagacgaaatcactagaaatcaactgaaatcatgcgaaatcagtagaaatcaggcgcgccatgcttcatcagactct

SEQ ID NO: 3271 - DNA, 148 bp, Artificial Sequence; identical to SEQ ID NO: 3270
  Synthetic polynucleotide

SEQ ID NO: 3272 - DNA, 185 bp, Artificial Sequence
  Synthetic polynucleotide
atcatctcaccttgcctcctgatacgcgcagtgtaatgcctgcagggcgctagcggacgttaagagcgctagcggacgttatcggcgctagcggacgttagacgcgctagcggacgttactagcgctagcggacgttaactgcgctagcggacgttatgcggcgcgccatgcttcatcagactct

SEQ ID NO: 3273 - DNA, 185 bp, Artificial Sequence; identical to SEQ ID NO: 3272
  Synthetic polynucleotide

SEQ ID NO: 3274 - DNA, 180 bp, Artificial Sequence
  Synthetic polynucleotide
atcatctcaccttgcctcctgatcatgggcagggctctcctgcaggagcacgtggccagaagcacgtggcctcgagcacgtggccgacagcacgtggccctaagcacgtggccactagcacgtggcctgcagcacgtggccgtaagcacgtggccggcgcgccatgcttcatcagactct

SEQ ID NO: 3275 - DNA, 180 bp, Artificial Sequence; identical to SEQ ID NO: 3274
  Synthetic polynucleotide

SEQ ID NO: 3276 - DNA, 188 bp, Artificial Sequence
  Synthetic polynucleotide
atcatctcaccttgcctcctgcttccatcaaatattggcctgcaggtatgtttacattagatatgtttacatttcgtatgtttacattgactatgtttacattctatatgtttacattacttatgtttacatttgctatgtttacattgtatatgtttacattggcgcgccatgcttcatcagactct

SEQ ID NO: 3277 - DNA, 188 bp, Artificial Sequence; identical to SEQ ID NO: 3276
  Synthetic polynucleotide

SEQ ID NO: 3278 - DNA, 172 bp, Artificial Sequence
  Synthetic polynucleotide
atcatctcaccttgcctcctgctccctcgtacgaatcccctgcaggccttagcaacagaccttagcaactcgccttagcaacgacccttagcaacctaccttagcaacactccttagcaactgcccttagcaacgtaccttagcaacggcgcgccatgcttcatcagactct

SEQ ID NO: 3279 - DNA, 172 bp, Artificial Sequence; identical to SEQ ID NO: 3278
  Synthetic polynucleotide

SEQ ID NO: 3280 - DNA, 172 bp, Artificial Sequence
  Synthetic polynucleotide
atcatctcaccttgcctcctgggcttatacaacgccaccctgcaggtgcatatcaaagatgcatatcaatcgtgcatatcaagactgcatatcaactatgcatatcaaacttgcatatcaatgctgcatatcaagtatgcatatcaaggcgcgccatgcttcatcagactct

SEQ ID NO: 3281 - DNA, 172 bp, Artificial Sequence; identical to SEQ ID NO: 3280
  Synthetic polynucleotide

SEQ ID NO: 3282 - DNA, 172 bp, Artificial Sequence
  Synthetic polynucleotide
atcatctcaccttgcctcctgcgggccacattcatttacctgcagggtcaactggcagagtcaactggctcggtcaactggcgacgtcaactggcctagtcaactggcactgtcaactggctgcgtcaactggcgtagtcaactggcggcgcgccatgcttcatcagactct

SEQ ID NO: 3283 - DNA, 172 bp, Artificial Sequence; identical to SEQ ID NO: 3282
  Synthetic polynucleotide

SEQ ID NO: 3284 - DNA, 196 bp, Artificial Sequence
  Synthetic polynucleotide
atcatctcaccttgcctcctgggtgaactgttgcctaccctgcaggatatattcatgagagaatatattcatgagtcgatatattcatgaggacatatattcatgagctaatatattcatgagactatatattcatgagtgcatatattcatgaggtaatatattcatgagggcgcgccatgcttcatcagactct

SEQ ID NO: 3285 - DNA, 196 bp, Artificial Sequence; identical to SEQ ID NO: 3284
  Synthetic polynucleotide

SEQ ID NO: 3286 - DNA, 180 bp, Artificial Sequence
  Synthetic polynucleotide
atcatctcaccttgcctcctgcgcagcatacgatcaaacctgcaggagtcacgatttagaagtcacgattttcgagtcacgatttgacagtcacgatttctaagtcacgatttactagtcacgattttgcagtcacgatttgtaagtcacgatttggcgcgccatgcttcatcagactct

SEQ ID NO: 3287 - DNA, 180 bp, Artificial Sequence; identical to SEQ ID NO: 3286
  Synthetic polynucleotide

SEQ ID NO: 3288 - DNA, 180 bp, Artificial Sequence
  Synthetic polynucleotide
atcatctcaccttgcctcctgtatagccaacaaccgctcctgcaggtttcctggaaaagatttcctggaaatcgtttcctggaaagactttcctggaaactatttcctggaaaacttttcctggaaatgctttcctggaaagtatttcctggaaaggcgcgccatgcttcatcagactct

SEQ ID NO: 3289 - DNA, 180 bp, Artificial Sequence; identical to SEQ ID NO: 3288
  Synthetic polynucleotide

SEQ ID NO: 3290 - DNA, 188 bp, Artificial Sequence
  Synthetic polynucleotide
atcatctcaccttgcctcctgataagcaaacgacattgcctgcaggtggcacgtgccgagatggcacgtgccgtcgtggcacgtgccggactggcacgtgccgctatggcacgtgccgacttggcacgtgccgtgctggcacgtgccggtatggcacgtgccgggcgcgccatgcttcatcagactct

SEQ ID NO: 3291 - DNA, 188 bp, Artificial Sequence; identical to SEQ ID NO: 3290
  Synthetic polynucleotide

SEQ ID NO: 3292 - DNA, 200 bp, Artificial Sequence
  Synthetic polynucleotide
atcatctcaccttgcctcctgaacgattggaacgcgttcctgcaggggggggggagtggagtattggaaatttttcagaggggggggagtggagtattggaaatttttctcgggggggggagtggagtattggaaatttttcgacggggggggagtggagtattggaaatttttcggcgcgccatgcttcatcagactct

SEQ ID NO: 3293 - DNA, 200 bp, Artificial Sequence; identical to SEQ ID NO: 3292
  Synthetic polynucleotide

SEQ ID NO: 3294 - DNA, 140 bp, Artificial Sequence
  Synthetic polynucleotide
atcatctcaccttgcctcctggttagacccagcgttaacctgcaggtaataaagataataatcgtaataagactaataactataataaacttaataatgctaataagtataataaggcgcgccatgcttcatcagactct

SEQ ID NO: 3295 - DNA, 140 bp, Artificial Sequence; identical to SEQ ID NO: 3294
  Synthetic polynucleotide

SEQ ID NO: 3296 - DNA, 188 bp, Artificial Sequence
  Synthetic polynucleotide
atcatctcaccttgcctcctgtcgtgataagacggtcccctgcaggtggcacgtgccaagatggcacgtgccatcgtggcacgtgccagactggcacgtgccactatggcacgtgccaacttggcacgtgccatgctggcacgtgccagtatggcacgtgccaggcgcgccatgcttcatcagactct

SEQ ID NO: 3297 - DNA, 188 bp, Artificial Sequence; identical to SEQ ID NO: 3296
  Synthetic polynucleotide

SEQ ID NO: 3298 - DNA, 196 bp, Artificial Sequence
  Synthetic polynucleotide
atcatctcaccttgcctcctgacgaggtgcctataactcctgcaggcatgactcagcagagacatgactcagcagtcgcatgactcagcaggaccatgactcagcagctacatgactcagcagactcatgactcagcagtgccatgactcagcaggtacatgactcagcagggcgcgccatgcttcatcagactct

SEQ ID NO: 3299 - DNA, 196 bp, Artificial Sequence; identical to SEQ ID NO: 3298
  Synthetic polynucleotide

SEQ ID NO: 3300 - DNA, 180 bp, Artificial Sequence
  Synthetic polynucleotide
atcatctcaccttgcctcctggccatatacgggtcctgcctgcaggaaacaatggaaagaaaacaatggaatcgaaacaatggaagacaaacaatggaactaaaacaatggaaactaaacaatggaatgcaaacaatggaagtaaaacaatggaaggcgcgccatgcttcatcagactct

SEQ ID NO: 3301 - DNA, 180 bp, Artificial Sequence; identical to SEQ ID NO: 3300
  Synthetic polynucleotide

SEQ ID NO: 3302 - DNA, 197 bp, Artificial Sequence
  Synthetic polynucleotide
atcatctcaccttgcctcctgatcgactctgtctggcacctgcaggatcgataacctgatcgatagaatcgataacctgatcgattcgatcgataacctgatcgatgacatcgataacctgatcgatctaatcgataacctgatcgatactatcgataacctgatcgattgcggcgcgccatgcttcatcagactct

SEQ ID NO: 3303 - DNA, 197 bp, Artificial Sequence; identical to SEQ ID NO: 3302
  Synthetic polynucleotide

SEQ ID NO: 3304 - DNA, 185 bp, Artificial Sequence
  Synthetic polynucleotide
atcatctcaccttgcctcctgattggtgcctaagctgccctgcaggccattgtttacttaagagaccattgtttacttaagtcgccattgtttacttaaggacccattgtttacttaagctaccattgtttacttaagactccattgtttacttaagtgcggcgcgccatgcttcatcagactct

SEQ ID NO: 3305 - DNA, 185 bp, Artificial Sequence; identical to SEQ ID NO: 3304
  Synthetic polynucleotide

SEQ ID NO: 3306 - DNA, 180 bp, Artificial Sequence
  Synthetic polynucleotide
atcatctcaccttgcctcctgaagtggtcctcctctaccctgcaggctgtggtttgtagactgtggtttgttcgctgtggtttgtgacctgtggtttgtctactgtggtttgtactctgtggtttgttgcctgtggtttgtgtactgtggtttgtggcgcgccatgcttcatcagactct

SEQ ID NO: 3307 - DNA, 180 bp, Artificial Sequence; identical to SEQ ID NO: 3306
  Synthetic polynucleotide

SEQ ID NO: 3308 - DNA, 188 bp, Artificial Sequence
  Synthetic polynucleotide
atcatctcaccttgcctcctgcggttgaccattgtctccctgcaggccttcttccttaagaccttcttccttatcgccttcttccttagacccttcttccttactaccttcttccttaactccttcttccttatgcccttcttccttagtaccttcttccttaggcgcgccatgcttcatcagactct

SEQ ID NO: 3309 - DNA, 188 bp, Artificial Sequence; identical to SEQ ID NO: 3308
  Synthetic polynucleotide

SEQ ID NO: 3310 - DNA, 190 bp, Artificial Sequence
  Synthetic polynucleotide
atcatctcaccttgcctcctgagatcgtttacaacccacctgcaggtaattgcttaattaagataattgcttaattatcgtaattgcttaattagactaattgcttaattactataattgcttaattaacttaattgcttaattatgctaattgcttaattagtaggcgcgccatgcttcatcagactct

SEQ ID NO: 3311 - DNA, 190 bp, Artificial Sequence; identical to SEQ ID NO: 3310
  Synthetic polynucleotide

SEQ ID NO: 3312 - DNA, 191 bp, Artificial Sequence
  Synthetic polynucleotide
atcatctcaccttgcctcctgggtaattgtgcctcaaccctgcaggaatatacatgtaatattagaaatatacatgtaatatttcgaatatacatgtaatattgacaatatacatgtaatattctaaatatacatgtaatattactaatatacatgtaatatttgcggcgcgccatgcttcatcagactct

SEQ ID NO: 3313 - DNA, 191 bp, Artificial Sequence; identical to SEQ ID NO: 3312
  Synthetic polynucleotide

SEQ ID NO: 3314 - DNA, 172 bp, Artificial Sequence
  Synthetic polynucleotide
atcatctcaccttgcctcctggaacggagtccacaagtcctgcaggaaggaaatgaagaaaggaaatgatcgaaggaaatgagacaaggaaatgactaaaggaaatgaactaaggaaatgatgcaaggaaatgagtaaaggaaatgaggcgcgccatgcttcatcagactct

SEQ ID NO: 3315 - DNA, 172 bp, Artificial Sequence; identical to SEQ ID NO: 3314
  Synthetic polynucleotide

SEQ ID NO: 3316 - DNA, 190 bp, Artificial Sequence
  Synthetic polynucleotide
atcatctcaccttgcctcctggggtagcgccataaagacctgcaggggggtcatgaccccagaggggtcatgacccctcgggggtcatgaccccgacggggtcatgaccccctaggggtcatgaccccactggggtcatgacccctgcggggtcatgaccccgtaggcgcgccatgcttcatcagactct

SEQ ID NO: 3317 - DNA, 190 bp, Artificial Sequence; identical to SEQ ID NO: 3316
  Synthetic polynucleotide

SEQ ID NO: 3318 - DNA, 185 bp, Artificial Sequence
  Synthetic polynucleotide
atcatctcaccttgcctcctgttgatctcagccacggccctgcagggtattgacaggtaattagagtattgacaggtaatttcggtattgacaggtaattgacgtattgacaggtaattctagtattgacaggtaattactgtattgacaggtaatttgcggcgcgccatgcttcatcagactct

SEQ ID NO: 3319 - DNA, 185 bp, Artificial Sequence; identical to SEQ ID NO: 3318
  Synthetic polynucleotide

SEQ ID NO: 3320 - DNA, 190 bp, Artificial Sequence
  Synthetic polynucleotide
atcatctcaccttgcctcctgagcttcttgcgataaggcctgcaggaaaaaatcaataatagaaaaaaatcaataattcgaaaaaatcaataatgacaaaaaatcaataatctaaaaaaatcaataatactaaaaaatcaataattgcaaaaaatcaataatgtaggcgcgccatgcttcatcagactct

SEQ ID NO: 3321 - DNA, 190 bp, Artificial Sequence; identical to SEQ ID NO: 3320
  Synthetic polynucleotide

SEQ ID NO: 3322 - DNA, 196 bp, Artificial Sequence
  Synthetic polynucleotide
atcatctcaccttgcctcctgtagagcagtaatacaagcctgcagggattattctcaggagagattattctcaggtcggattattctcagggacgattattctcaggctagattattctcaggactgattattctcaggtgcgattattctcagggtagattattctcaggggcgcgccatgcttcatcagactct

SEQ ID NO: 3323 - DNA, 196 bp, Artificial Sequence; identical to SEQ ID NO: 3322
  Synthetic polynucleotide

SEQ ID NO: 3324 - DNA, 197 bp, Artificial Sequence
  Synthetic polynucleotide
atcatctcaccttgcctcctgactgttctcgggaatggcctgcaggctggtgggggcagataagagactggtgggggcagataagtcgctggtgggggcagataaggacctggtgggggcagataagctactggtgggggcagataagactctggtgggggcagataagtgcggcgcgccatgcttcatcagactct

SEQ ID NO: 3325 - DNA, 197 bp, Artificial Sequence; identical to SEQ ID NO: 3324
  Synthetic polynucleotide

SEQ ID NO: 3326 - DNA, 164 bp, Artificial Sequence
  Synthetic polynucleotide
atcatctcaccttgcctcctgcagactctgccggcatacctgcaggatgactcatagaatgactcattcgatgactcatgacatgactcatctaatgactcatactatgactcattgcatgactcatgtaatgactcatggcgcgccatgcttcatcagactct

SEQ ID NO: 3327 - DNA, 164 bp, Artificial Sequence; identical to SEQ ID NO: 3326
  Synthetic polynucleotide

SEQ ID NO: 3328 - DNA, 156 bp, Artificial Sequence
  Synthetic polynucleotide
atcatctcaccttgcctcctgcaaacaatcctcccatgcctgcaggttccgcttagattccgctttcgttccgcttgacttccgcttctattccgcttactttccgctttgcttccgcttgtattccgcttggcgcgccatgcttcatcagactct

SEQ ID NO: 3329 - DNA, 156 bp, Artificial Sequence; identical to SEQ ID NO: 3328
  Synthetic polynucleotide

SEQ ID NO: 3330 - DNA, 164 bp, Artificial Sequence
  Synthetic polynucleotide
atcatctcaccttgcctcctgctatgcctcttgaagtgcctgcaggtcaatgagtagatcaatgagttcgtcaatgagtgactcaatgagtctatcaatgagtacttcaatgagttgctcaatgagtgtatcaatgagtggcgcgccatgcttcatcagactct

SEQ ID NO: 3331 - DNA, 164 bp, Artificial Sequence; identical to SEQ ID NO: 3330
  Synthetic polynucleotide

SEQ ID NO: 3332 - DNA, 191 bp, Artificial Sequence
  Synthetic polynucleotide
atcatctcaccttgcctcctgaggcacccactcattcgcctgcaggctgtttgtttacattttagactgtttgtttacatttttcgctgtttgtttacattttgacctgtttgtttacattttctactgtttgtttacattttactctgtttgtttacatttttgcggcgcgccatgcttcatcagactct

SEQ ID NO: 3333 - DNA, 191 bp, Artificial Sequence; identical to SEQ ID NO: 3332
  Synthetic polynucleotide

SEQ ID NO: 3334 - DNA, 196 bp, Artificial Sequence
  Synthetic polynucleotide
atcatctcaccttgcctcctgtcagagtgggattaaatcctgcaggttgacagctgtcaagattgacagctgtcatcgttgacagctgtcagacttgacagctgtcactattgacagctgtcaactttgacagctgtcatgcttgacagctgtcagtattgacagctgtcaggcgcgccatgcttcatcagactct

SEQ ID NO: 3335 - DNA, 196 bp, Artificial Sequence; identical to SEQ ID NO: 3334
  Synthetic polynucleotide

SEQ ID NO: 3336 - DNA, 164 bp, Artificial Sequence
  Synthetic polynucleotide
atcatctcaccttgcctcctgctaacaccaacataacacctgcaggttgcgtaagagattgcgtaagtcgttgcgtaaggacttgcgtaagctattgcgtaagactttgcgtaagtgcttgcgtaaggtattgcgtaagggcgcgccatgcttcatcagactct

SEQ ID NO: 3337 - DNA, 164 bp, Artificial Sequence; identical to SEQ ID NO: 3336
  Synthetic polynucleotide

SEQ ID NO: 3338 - DNA, 172 bp, Artificial Sequence
  Synthetic polynucleotide
atcatctcaccttgcctcctgattagcccgtttgcgaacctgcaggatgagtcataagaatgagtcatatcgatgagtcatagacatgagtcatactaatgagtcataactatgagtcatatgcatgagtcatagtaatgagtcataggcgcgccatgcttcatcagactct

SEQ ID NO: 3339 - DNA, 172 bp, Artificial Sequence; identical to SEQ ID NO: 3338
  Synthetic polynucleotide

SEQ ID NO: 3340 - DNA, 190 bp, Artificial Sequence
  Synthetic polynucleotide
atcatctcaccttgcctcctgcctagtgacccatgcctcctgcaggtcccctatctttacagatcccctatctttactcgtcccctatctttacgactcccctatctttacctatcccctatctttacacttcccctatctttactgctcccctatctttacgtaggcgcgccatgcttcatcagactct

SEQ ID NO: 3341 - DNA, 190 bp, Artificial Sequence; identical to SEQ ID NO: 3340
  Synthetic polynucleotide

SEQ ID NO: 3342 - DNA, 190 bp, Artificial Sequence
  Synthetic polynucleotide
atcatctcaccttgcctcctggctccatatagaaacttcctgcaggtttgccttatatggagatttgccttatatggtcgtttgccttatatgggactttgccttatatggctatttgccttatatggacttttgccttatatggtgctttgccttatatgggtaggcgcgccatgcttcatcagactct

SEQ ID NO: 3343 - DNA, 190 bp, Artificial Sequence; identical to SEQ ID NO: 3342
  Synthetic polynucleotide

SEQ ID NO: 3344 - DNA, 172 bp, Artificial Sequence
  Synthetic polynucleotide
atcatctcaccttgcctcctgatacaataggcctagtccctgcaggatgagtcatcagaatgagtcatctcgatgagtcatcgacatgagtcatcctaatgagtcatcactatgagtcatctgcatgagtcatcgtaatgagtcatcggcgcgccatgcttcatcagactct

SEQ ID NO: 3345 - DNA, 172 bp, Artificial Sequence; identical to SEQ ID NO: 3344
  Synthetic polynucleotide

SEQ ID NO: 3346 - DNA, 172 bp, Artificial Sequence
  Synthetic polynucleotide
atcatctcaccttgcctcctgcaagctggatccgccaacctgcaggatgagtcattagaatgagtcatttcgatgagtcattgacatgagtcattctaatgagtcattactatgagtcatttgcatgagtcattgtaatgagtcattggcgcgccatgcttcatcagactct

SEQ ID NO: 3347 - DNA, 172 bp, Artificial Sequence; identical to SEQ ID NO: 3346
  Synthetic polynucleotide

SEQ ID NO: 3348 - DNA, 188 bp, Artificial Sequence
  Synthetic polynucleotide
atcatctcaccttgcctcctgaggtctaaaggctggatcctgcagggaacagatggtcagagaacagatggtctcggaacagatggtcgacgaacagatggtcctagaacagatggtcactgaacagatggtctgcgaacagatggtcgtagaacagatggtcggcgcgccatgcttcatcagactct

SEQ ID NO: 3349 - DNA, 188 bp, Artificial Sequence; identical to SEQ ID NO: 3348
  Synthetic polynucleotide

SEQ ID NO: 3350 - DNA, 172 bp, Artificial Sequence
  Synthetic polynucleotide
atcatctcaccttgcctcctgaacttcctaagggacagcctgcaggaaggtgacctagaaaggtgaccttcgaaggtgacctgacaaggtgacctctaaaggtgacctactaaggtgaccttgcaaggtgacctgtaaaggtgacctggcgcgccatgcttcatcagactct

SEQ ID NO: 3351 - DNA, 172 bp, Artificial Sequence; identical to SEQ ID NO: 3350
  Synthetic polynucleotide

SEQ ID NO: 3352 - DNA, 197 bp, Artificial Sequence
  Synthetic polynucleotide
atcatctcaccttgcctcctgcatgcgacccagtcgtacctgcaggagtttcggtttcgttagaagtttcggtttcgtttcgagtttcggtttcgttgacagtttcggtttcgttctaagtttcggtttcgttactagtttcggtttcgtttgcagtttcggtttcgttgtaggcgcgccatgcttcatcagactct

SEQ ID NO: 3353 - DNA, 197 bp, Artificial Sequence; identical to SEQ ID NO: 3352
  Synthetic polynucleotide

SEQ ID NO: 3354 - DNA, 148 bp, Artificial Sequence
  Synthetic polynucleotide
atcatctcaccttgcctcctgcacttgacaccgtacatcctgcagggtgatacagagtgatactcggtgatacgacgtgatacctagtgatacactgtgatactgcgtgatacgtagtgatacggcgcgccatgcttcatcagactct

SEQ ID NO: 3355 - DNA, 148 bp, Artificial Sequence; identical to SEQ ID NO: 3354
  Synthetic polynucleotide

SEQ ID NO: 3356 - DNA, 197 bp, Artificial Sequence
  Synthetic polynucleotide
atcatctcaccttgcctcctggttgtagcagtccgccacctgcaggctttcacaccttttcagactttcacaccttttctcgctttcacaccttttcgacctttcacaccttttcctactttcacaccttttcactctttcacaccttttctgcctttcacaccttttcgtaggcgcgccatgcttcatcagactct

SEQ ID NO: 3357 - DNA, 197 bp, Artificial Sequence; identical to SEQ ID NO: 3356
  Synthetic polynucleotide

SEQ ID NO: 3358 - DNA, 197 bp, Artificial Sequence
  Synthetic polynucleotide
atcatctcaccttgcctcctgcctatcgaacagtacggcctgcaggaggggatttccaaggagaaggggatttccaaggtcgaggggatttccaagggacaggggatttccaaggctaaggggatttccaaggactaggggatttccaaggtgcaggggatttccaagggtaggcgcgccatgcttcatcagactct

SEQ ID NO: 3359 - DNA, 197 bp, Artificial Sequence; identical to SEQ ID NO: 3358
  Synthetic polynucleotide

SEQ ID NO: 3360 - DNA, 197 bp, Artificial Sequence
  Synthetic polynucleotide
atcatctcaccttgcctcctgttcagattgctatgagtcctgcaggaacaatttcattgttagaaacaatttcattgtttcgaacaatttcattgttgacaacaatttcattgttctaaacaatttcattgttactaacaatttcattgtttgcaacaatttcattgttgtaggcgcgccatgcttcatcagactct

SEQ ID NO: 3361 - DNA, 197 bp, Artificial Sequence; identical to SEQ ID NO: 3360
  Synthetic polynucleotide

SEQ ID NO: 3362 - DNA, 190 bp, Artificial Sequence
  Synthetic polynucleotide
atcatctcaccttgcctcctgaccaccaatgctgcaggcctgcaggtgaatgttcagtcaagatgaatgttcagtcatcgtgaatgttcagtcagactgaatgttcagtcactatgaatgttcagtcaacttgaatgttcagtcatgctgaatgttcagtcagtaggcgcgccatgcttcatcagactct

SEQ ID NO: 3363 - DNA, 190 bp, Artificial Sequence; identical to SEQ ID NO: 3362
  Synthetic polynucleotide

SEQ ID NO: 3364 - DNA, 164 bp, Artificial Sequence
  Synthetic polynucleotide
atcatctcaccttgcctcctgcagaatcaaggttcgcacctgcaggatgactcaaagaatgactcaatcgatgactcaagacatgactcaactaatgactcaaactatgactcaatgcatgactcaagtaatgactcaaggcgcgccatgcttcatcagactct

SEQ ID NO: 3365 - DNA, 164 bp, Artificial Sequence; identical to SEQ ID NO: 3364
  Synthetic polynucleotide

SEQ ID NO: 3366 - DNA, 197 bp, Artificial Sequence
  Synthetic polynucleotide
atcatctcaccttgcctcctgcgttgaaggcgtattagcctgcaggtgcctgggtgtggctagatgcctgggtgtggcttcgtgcctgggtgtggctgactgcctgggtgtggctctatgcctgggtgtggctacttgcctgggtgtggcttgctgcctgggtgtggctgtaggcgcgccatgcttcatcagactct

SEQ ID NO: 3367 - DNA, 197 bp, Artificial Sequence; identical to SEQ ID NO: 3366
  Synthetic polynucleotide

SEQ ID NO: 3368 - DNA, 191 bp, Artificial Sequence
  Synthetic polynucleotide
atcatctcaccttgcctcctggtcttctgctgtgttgacctgcagggtcttgttattgattttttttagagtcttgttattgatttttttttcggtcttgttattgattttttttgacgtcttgttattgattttttttctagtcttgttattgattttttttactggcgcgccatgcttcatcagactct

SEQ ID NO: 3369 - DNA, 191 bp, Artificial Sequence; identical to SEQ ID NO: 3368
  Synthetic polynucleotide

SEQ ID NO: 3370 - DNA, 148 bp, Artificial Sequence
  Synthetic polynucleotide
atcatctcaccttgcctcctgcgcacctatgatggtagcctgcaggcacctgtagacacctgttcgcacctgtgaccacctgtctacacctgtactcacctgttgccacctgtgtacacctgtggcgcgccatgcttcatcagactct

SEQ ID NO: 3371 - DNA, 148 bp, Artificial Sequence; identical to SEQ ID NO: 3370
  Synthetic polynucleotide

SEQ ID NO: 3372 - DNA, 180 bp, Artificial Sequence
  Synthetic polynucleotide
atcatctcaccttgcctcctgggacatgcaacaaatgacctgcaggataaacaagccagaataaacaagcctcgataaacaagccgacataaacaagccctaataaacaagccactataaacaagcctgcataaacaagccgtaataaacaagccggcgcgccatgcttcatcagactct

SEQ ID NO: 3373 - DNA, 180 bp, Artificial Sequence; identical to SEQ ID NO: 3372
  Synthetic polynucleotide

SEQ ID NO: 3374 - DNA, 164 bp, Artificial Sequence
  Synthetic polynucleotide
atcatctcaccttgcctcctgttaactcaggcggccatcctgcaggggtaaacaaagaggtaaacaatcgggtaaacaagacggtaaacaactaggtaaacaaactggtaaacaatgcggtaaacaagtaggtaaacaaggcgcgccatgcttcatcagactct

SEQ ID NO: 3375 - DNA, 164 bp, Artificial Sequence; identical to SEQ ID NO: 3374
  Synthetic polynucleotide

SEQ ID NO: 3376 - DNA, 180 bp, Artificial Sequence
  Synthetic polynucleotide
atcatctcaccttgcctcctgtatttgcgcaacgtggacctgcagggggattatcccagagggattatccctcggggattatcccgacgggattatcccctagggattatcccactgggattatccctgcgggattatcccgtagggattatcccggcgcgccatgcttcatcagactct

SEQ ID NO: 3377 - DNA, 180 bp, Artificial Sequence; identical to SEQ ID NO: 3376
  Synthetic polynucleotide

SEQ ID NO: 3378 - DNA, 197 bp, Artificial Sequence
  Synthetic polynucleotide
atcatctcaccttgcctcctgcacagtccaatggctgtcctgcaggtcacctgttgctaggagatcacctgttgctaggtcgtcacctgttgctagggactcacctgttgctaggctatcacctgttgctaggacttcacctgttgctaggtgctcacctgttgctagggtaggcgcgccatgcttcatcagactct

SEQ ID NO: 3379 - DNA, 197 bp, Artificial Sequence; identical to SEQ ID NO: 3378
  Synthetic polynucleotide

SEQ ID NO: 3380 - DNA, 172 bp, Artificial Sequence
  Synthetic polynucleotide
atcatctcaccttgcctcctgtcactgatcatatcccacctgcaggcttaattggtagacttaattggttcgcttaattggtgaccttaattggtctacttaattggtactcttaattggttgccttaattggtgtacttaattggtggcgcgccatgcttcatcagactct

SEQ ID NO: 3381 - DNA, 172 bp, Artificial Sequence; identical to SEQ ID NO: 3380
  Synthetic polynucleotide

SEQ ID NO: 3382 - DNA, 140 bp, Artificial Sequence
  Synthetic polynucleotide
atcatctcaccttgcctcctgtcctaagctgtttctgtcctgcaggtaatccagataatcctcgtaatccgactaatccctataatccacttaatcctgctaatccgtataatccggcgcgccatgcttcatcagactct

SEQ ID NO: 3383 - DNA, 140 bp, Artificial Sequence; identical to SEQ ID NO: 3382
  Synthetic polynucleotide

SEQ ID NO: 3384 - DNA, 148 bp, Artificial Sequence
  Synthetic polynucleotide
atcatctcaccttgcctcctgcgagtgttccacgaaatcctgcaggcacctggagacacctggtcgcacctgggaccacctggctacacctggactcacctggtgccacctgggtacacctggggcgcgccatgcttcatcagactct

SEQ ID NO: 3385 - DNA, 148 bp, Artificial Sequence; identical to SEQ ID NO: 3384
  Synthetic polynucleotide

SEQ ID NO: 3386 - DNA, 188 bp, Artificial Sequence
  Synthetic polynucleotide
atcatctcaccttgcctcctgcgaactcgtgatgctatcctgcaggttaatatttaacagattaatatttaactcgttaatatttaacgacttaatatttaacctattaatatttaacactttaatatttaactgcttaatatttaacgtattaatatttaacggcgcgccatgcttcatcagactct

SEQ ID NO: 3387 - DNA, 188 bp, Artificial Sequence; identical to SEQ ID NO: 3386
  Synthetic polynucleotide

SEQ ID NO: 3388 - DNA, 172 bp, Artificial Sequence
  Synthetic polynucleotide
atcatctcaccttgcctcctgtgtctggtccgcgatgacctgcaggccggggggtcagaccggggggtctcgccggggggtcgacccggggggtcctaccggggggtcactccggggggtctgcccggggggtcgtaccggggggtcggcgcgccatgcttcatcagactct

SEQ ID NO: 3389 - DNA, 172 bp, Artificial Sequence; identical to SEQ ID NO: 3388
  Synthetic polynucleotide

SEQ ID NO: 3390 - DNA, 148 bp, Artificial Sequence
  Synthetic polynucleotide
atcatctcaccttgcctcctgacgatctagagtcgggccctgcaggcacctgcagacacctgctcgcacctgcgaccacctgcctacacctgcactcacctgctgccacctgcgtacacctgcggcgcgccatgcttcatcagactct

SEQ ID NO: 3391 - DNA, 148 bp, Artificial Sequence; identical to SEQ ID NO: 3390
  Synthetic polynucleotide

SEQ ID NO: 3392 - DNA, 164 bp, Artificial Sequence
  Synthetic polynucleotide
atcatctcaccttgcctcctgtatgtttgggattgcagcctgcaggagagggaggagaagagggaggtcgagagggagggacagagggaggctaagagggaggactagagggaggtgcagagggagggtaagagggaggggcgcgccatgcttcatcagactct

SEQ ID NO: 3393 - DNA, 164 bp, Artificial Sequence; identical to SEQ ID NO: 3392
  Synthetic polynucleotide

SEQ ID NO: 3394 - DNA, 191 bp, Artificial Sequence
  Synthetic polynucleotide
atcatctcaccttgcctcctgcgatgcctggtatacaccctgcaggtacagctaattagtttaagatacagctaattagtttatcgtacagctaattagtttagactacagctaattagtttactatacagctaattagtttaacttacagctaattagtttatgcggcgcgccatgcttcatcagactct

SEQ ID NO: 3395 - DNA, 191 bp, Artificial Sequence; identical to SEQ ID NO: 3394
  Synthetic polynucleotide

SEQ ID NO: 3396 - DNA, 164 bp, Artificial Sequence
  Synthetic polynucleotide
atcatctcaccttgcctcctgttgcatagacaggacttcctgcaggcactaattaagacactaattatcgcactaattagaccactaattactacactaattaactcactaattatgccactaattagtacactaattaggcgcgccatgcttcatcagactct

SEQ ID NO: 3397 - DNA, 164 bp, Artificial Sequence; identical to SEQ ID NO: 3396
  Synthetic polynucleotide

SEQ ID NO: 3398 - DNA, 200 bp, Artificial Sequence
  Synthetic polynucleotide
atcatctcaccttgcctcctgtcgaattaagtaccgaccctgcaggtggagtcgagcactaatgggggagttggcaagatggagtcgagcactaatgggggagttggcatcgtggagtcgagcactaatgggggagttggcagactggagtcgagcactaatgggggagttggcaggcgcgccatgcttcatcagactct

SEQ ID NO: 3399 - DNA, 200 bp, Artificial Sequence; identical to SEQ ID NO: 3398
  Synthetic polynucleotide

SEQ ID NO: 3400 - DNA, 156 bp, Artificial Sequence
  Synthetic polynucleotide
atcatctcaccttgcctcctgttccacggttgaagatccctgcaggttgtttacagattgtttactcgttgtttacgacttgtttacctattgtttacactttgtttactgcttgtttacgtattgtttacggcgcgccatgcttcatcagactct

SEQ ID NO: 3401 - DNA, 156 bp, Artificial Sequence; identical to SEQ ID NO: 3400
  Synthetic polynucleotide

SEQ ID NO: 3402 - DNA, 172 bp, Artificial Sequence
  Synthetic polynucleotide
atcatctcaccttgcctcctgtagtgtacggctttccacctgcaggactacaactcagaactacaactctcgactacaactcgacactacaactcctaactacaactcactactacaactctgcactacaactcgtaactacaactcggcgcgccatgcttcatcagactct

SEQ ID NO: 3403 - DNA, 172 bp, Artificial Sequence; identical to SEQ ID NO: 3402
  Synthetic polynucleotide

SEQ ID NO: 3404 - DNA, 164 bp, Artificial Sequence
  Synthetic polynucleotide
atcatctcaccttgcctcctgcctcacacggaactaagcctgcaggctcataaaaagactcataaaatcgctcataaaagacctcataaaactactcataaaaactctcataaaatgcctcataaaagtactcataaaaggcgcgccatgcttcatcagactct

SEQ ID NO: 3405 - DNA, 164 bp, Artificial Sequence; identical to SEQ ID NO: 3404
  Synthetic polynucleotide

SEQ ID NO: 3406 - DNA, 191 bp, Artificial Sequence
  Synthetic polynucleotide
atcatctcaccttgcctcctgtcaatctgatgctctcccctgcaggaatgcaataaaatttatagaaatgcaataaaatttattcgaatgcaataaaatttatgacaatgcaataaaatttatctaaatgcaataaaatttatactaatgcaataaaatttattgcggcgcgccatgcttcatcagactct

SEQ ID NO: 3407 - DNA, 191 bp, Artificial Sequence; identical to SEQ ID NO: 3406
  Synthetic polynucleotide

SEQ ID NO: 3408 - DNA, 156 bp, Artificial Sequence
  Synthetic polynucleotide
atcatctcaccttgcctcctgttcaaactgtgcggccccctgcaggaattacaaagaaattacaatcgaattacaagacaattacaactaaattacaaactaattacaatgcaattacaagtaaattacaaggcgcgccatgcttcatcagactct

SEQ ID NO: 3409 - DNA, 156 bp, Artificial Sequence; identical to SEQ ID NO: 3408
  Synthetic polynucleotide

SEQ ID NO: 3410 - DNA, 172 bp, Artificial Sequence
  Synthetic polynucleotide
atcatctcaccttgcctcctgataatcgcgtgtcgtttcctgcaggccgcaataaaagaccgcaataaatcgccgcaataaagacccgcaataaactaccgcaataaaactccgcaataaatgcccgcaataaagtaccgcaataaaggcgcgccatgcttcatcagactct

SEQ ID NO: 3411 - DNA, 172 bp, Artificial Sequence; identical to SEQ ID NO: 3410
  Synthetic polynucleotide

SEQ ID NO: 3412 - DNA, 188 bp, Artificial Sequence
  Synthetic polynucleotide
atcatctcaccttgcctcctgactgttggaataccgaccctgcaggaaaaatcaataaagaaaaaatcaataatcgaaaaatcaataagacaaaaatcaataactaaaaaatcaataaactaaaaatcaataatgcaaaaatcaataagtaaaaaatcaataaggcgcgccatgcttcatcagactct

SEQ ID NO: 3413 - DNA, 188 bp, Artificial Sequence; identical to SEQ ID NO: 3412
  Synthetic polynucleotide

SEQ ID NO: 3414 - DNA, 172 bp, Artificial Sequence
  Synthetic polynucleotide
atcatctcaccttgcctcctgacaccttgcaagccgtccctgcaggcttaattggcagacttaattggctcgcttaattggcgaccttaattggcctacttaattggcactcttaattggctgccttaattggcgtacttaattggcggcgcgccatgcttcatcagactct

SEQ ID NO: 3415 - DNA, 172 bp, Artificial Sequence; identical to SEQ ID NO: 3414
  Synthetic polynucleotide

SEQ ID NO: 3416 - DNA, 172 bp, Artificial Sequence
  Synthetic polynucleotide
atcatctcaccttgcctcctgatgcgagcagtgggagtcctgcaggtcagcaaaatagatcagcaaaattcgtcagcaaaatgactcagcaaaatctatcagcaaaatacttcagcaaaattgctcagcaaaatgtatcagcaaaatggcgcgccatgcttcatcagactct

SEQ ID NO: 3417 - DNA, 172 bp, Artificial Sequence; identical to SEQ ID NO: 3416
  Synthetic polynucleotide

SEQ ID NO: 3418 - DNA, 180 bp, Artificial Sequence
  Synthetic polynucleotide
atcatctcaccttgcctcctgcatcctaaaggcaggcgcctgcaggctggaactcacagactggaactcactcgctggaactcacgacctggaactcacctactggaactcacactctggaactcactgcctggaactcacgtactggaactcacggcgcgccatgcttcatcagactct

SEQ ID NO: 3419 - DNA, 180 bp, Artificial Sequence; identical to SEQ ID NO: 3418
  Synthetic polynucleotide

SEQ ID NO: 3420 - DNA, 164 bp, Artificial Sequence
  Synthetic polynucleotide
atcatctcaccttgcctcctggaattctcttacactgtcctgcaggtttaattggagatttaattggtcgtttaattgggactttaattggctatttaattggacttttaattggtgctttaattgggtatttaattggggcgcgccatgcttcatcagactct

SEQ ID NO: 3421 - DNA, 164 bp, Artificial Sequence; identical to SEQ ID NO: 3420
  Synthetic polynucleotide

SEQ ID NO: 3422 - DNA, 140 bp, Artificial Sequence
  Synthetic polynucleotide
atcatctcaccttgcctcctggtaagcgcactatctatcctgcaggtggactagatggacttcgtggactgactggactctatggactacttggacttgctggactgtatggactggcgcgccatgcttcatcagactct

SEQ ID NO: 3423 - DNA, 140 bp, Artificial Sequence; identical to SEQ ID NO: 3422
  Synthetic polynucleotide

SEQ ID NO: 3424 - DNA, 200 bp, Artificial Sequence
  Synthetic polynucleotide
atcatctcaccttgcctcctggaacagaatgatatgctcctgcaggccttatctgcccccaccagagaccttatctgcccccaccagtcgccttatctgcccccaccaggacccttatctgcccccaccagctaccttatctgcccccaccagactccttatctgcccccaccagggcgcgccatgcttcatcagactct

SEQ ID NO: 3425 - DNA, 200 bp, Artificial Sequence; identical to SEQ ID NO: 3424
  Synthetic polynucleotide

SEQ ID NO: 3426 - DNA, 185 bp, Artificial Sequence
  Synthetic polynucleotide
atcatctcaccttgcctcctgaacatgcacccagccagcctgcagggtacatccggatttttagagtacatccggattttttcggtacatccggatttttgacgtacatccggatttttctagtacatccggatttttactgtacatccggattttttgcggcgcgccatgcttcatcagactct

SEQ ID NO: 3427 - DNA, 185 bp, Artificial Sequence; identical to SEQ ID NO: 3426
  Synthetic polynucleotide

SEQ ID NO: 3428 - DNA, 156 bp, Artificial Sequence
  Synthetic polynucleotide
atcatctcaccttgcctcctgaagggagtcgaacaagtcctgcagggatttccaagagatttccatcggatttccagacgatttccactagatttccaactgatttccatgcgatttccagtagatttccaggcgcgccatgcttcatcagactct

SEQ ID NO: 3429 - DNA, 156 bp, Artificial Sequence; identical to SEQ ID NO: 3428
  Synthetic polynucleotide

SEQ ID NO: 3430 - DNA, 172 bp, Artificial Sequence
  Synthetic polynucleotide
atcatctcaccttgcctcctgcctatagatgaggacaacctgcaggactacaattcagaactacaattctcgactacaattcgacactacaattcctaactacaattcactactacaattctgcactacaattcgtaactacaattcggcgcgccatgcttcatcagactct

SEQ ID NO: 3431 - DNA, 172 bp, Artificial Sequence; identical to SEQ ID NO: 3430
  Synthetic polynucleotide

SEQ ID NO: 3432 - DNA, 186 bp, Artificial Sequence
  Synthetic polynucleotide
atcatctcaccttgcctcctgacgtttgataggcgcgtcctgcaggtaagtcatccctcaggaatgagataagtcatccctcaggaatgtcgtaagtcatccctcaggaatggactaagtcatccctcaggaatgctataagtcatccctcaggaatgactggcgcgccatgcttcatcagactct

SEQ ID NO: 3433 - DNA, 186 bp, Artificial Sequence; identical to SEQ ID NO: 3432
  Synthetic polynucleotide

SEQ ID NO: 3434 - DNA, 180 bp, Artificial Sequence
  Synthetic polynucleotide
atcatctcaccttgcctcctgctgtgttgttagccattcctgcaggggccggaagtgagaggccggaagtgtcgggccggaagtggacggccggaagtgctaggccggaagtgactggccggaagtgtgcggccggaagtggtaggccggaagtgggcgcgccatgcttcatcagactct

SEQ ID NO: 3435 - DNA, 180 bp, Artificial Sequence; identical to SEQ ID NO: 3434
  Synthetic polynucleotide

SEQ ID NO: 3436 - DNA, 156 bp, Artificial Sequence
  Synthetic polynucleotide
atcatctcaccttgcctcctgggtgctttaaggacacacctgcaggccacgtggagaccacgtggtcgccacgtgggacccacgtggctaccacgtggactccacgtggtgcccacgtgggtaccacgtggggcgcgccatgcttcatcagactct

SEQ ID NO: 3437 - DNA, 156 bp, Artificial Sequence; identical to SEQ ID NO: 3436
  Synthetic polynucleotide

SEQ ID NO: 3438 - DNA, 190 bp, Artificial Sequence
  Synthetic polynucleotide
atcatctcaccttgcctcctgctttggaccataaccgacctgcaggggggaaattcccctagaggggaaattccccttcgggggaaattcccctgacggggaaattcccctctaggggaaattcccctactggggaaattccccttgcggggaaattcccctgtaggcgcgccatgcttcatcagactct

SEQ ID NO: 3439 - DNA, 190 bp, Artificial Sequence; identical to SEQ ID NO: 3438
  Synthetic polynucleotide

SEQ ID NO: 3440 - DNA, 172 bp, Artificial Sequence
  Synthetic polynucleotide
atcatctcaccttgcctcctgtgcctaagatagcaggccctgcaggcccataaaaaagacccataaaaatcgcccataaaaagaccccataaaaactacccataaaaaactcccataaaaatgccccataaaaagtacccataaaaaggcgcgccatgcttcatcagactct

SEQ ID NO: 3441 - DNA, 172 bp, Artificial Sequence; identical to SEQ ID NO: 3440
  Synthetic polynucleotide

SEQ ID NO: 3442 - DNA, 172 bp, Artificial Sequence
  Synthetic polynucleotide
atcatctcaccttgcctcctgccttagtgtctatttcccctgcaggggggcggggcagaggggcggggctcgggggcggggcgacggggcggggcctaggggcggggcactggggcggggctgcggggcggggcgtaggggcggggcggcgcgccatgcttcatcagactct

SEQ ID NO: 3443 - DNA, 172 bp, Artificial Sequence; identical to SEQ ID NO: 3442
  Synthetic polynucleotide

SEQ ID NO: 3444 - DNA, 172 bp, Artificial Sequence
  Synthetic polynucleotide
atcatctcaccttgcctcctggttgcgtgggcaatgtccctgcaggaatgagtcatagaaatgagtcattcgaatgagtcatgacaatgagtcatctaaatgagtcatactaatgagtcattgcaatgagtcatgtaaatgagtcatggcgcgccatgcttcatcagactct

SEQ ID NO: 3445 - DNA, 172 bp, Artificial Sequence; identical to SEQ ID NO: 3444
  Synthetic polynucleotide

SEQ ID NO: 3446 - DNA, 180 bp, Artificial Sequence
  Synthetic polynucleotide
atcatctcaccttgcctcctgatacgaagacgcggacccctgcaggcactgacgtcaagacactgacgtcatcgcactgacgtcagaccactgacgtcactacactgacgtcaactcactgacgtcatgccactgacgtcagtacactgacgtcaggcgcgccatgcttcatcagactct

SEQ ID NO: 3447 - DNA, 180 bp, Artificial Sequence; identical to SEQ ID NO: 3446
  Synthetic polynucleotide

SEQ ID NO: 3448 - DNA, 156 bp, Artificial Sequence
  Synthetic polynucleotide
atcatctcaccttgcctcctgccgatcaccagataagtcctgcaggccacgtgcagaccacgtgctcgccacgtgcgacccacgtgcctaccacgtgcactccacgtgctgcccacgtgcgtaccacgtgcggcgcgccatgcttcatcagactct

SEQ ID NO: 3449 - DNA, 156 bp, Artificial Sequence; identical to SEQ ID NO: 3448
  Synthetic polynucleotide

SEQ ID NO: 3450 - DNA, 191 bp, Artificial Sequence
  Synthetic polynucleotide
atcatctcaccttgcctcctgatgagtgcagaacaagacctgcaggtgacctgacctgacctcagatgacctgacctgacctctcgtgacctgacctgacctcgactgacctgacctgacctcctatgacctgacctgacctcacttgacctgacctgacctctgcggcgcgccatgcttcatcagactct

SEQ ID NO: 3451 - DNA, 191 bp, Artificial Sequence; identical to SEQ ID NO: 3450
  Synthetic polynucleotide

SEQ ID NO: 3452 - DNA, 180 bp, Artificial Sequence
  Synthetic polynucleotide
atcatctcaccttgcctcctgacagaggtcagcaactacctgcaggtaattaaattaagataattaaattatcgtaattaaattagactaattaaattactataattaaattaacttaattaaattatgctaattaaattagtataattaaattaggcgcgccatgcttcatcagactct

SEQ ID NO: 3453 - DNA, 180 bp, Artificial Sequence; identical to SEQ ID NO: 3452
  Synthetic polynucleotide

SEQ ID NO: 3454 - DNA, 180 bp, Artificial Sequence
  Synthetic polynucleotide
atcatctcaccttgcctcctgagacttagtagcaccaccctgcaggcaacaggtgttagacaacaggtgtttcgcaacaggtgttgaccaacaggtgttctacaacaggtgttactcaacaggtgtttgccaacaggtgttgtacaacaggtgttggcgcgccatgcttcatcagactct

SEQ ID NO: 3455 - DNA, 180 bp, Artificial Sequence; identical to SEQ ID NO: 3454
  Synthetic polynucleotide

SEQ ID NO: 3456 - DNA, 164 bp, Artificial Sequence
  Synthetic polynucleotide
atcatctcaccttgcctcctggaacttcatccgtctcgcctgcagggtgaaacttagagtgaaactttcggtgaaacttgacgtgaaacttctagtgaaacttactgtgaaactttgcgtgaaacttgtagtgaaacttggcgcgccatgcttcatcagactct

SEQ ID NO: 3457 - DNA, 164 bp, Artificial Sequence; identical to SEQ ID NO: 3456
  Synthetic polynucleotide

SEQ ID NO: 3458 - DNA, 156 bp, Artificial Sequence
  Synthetic polynucleotide
atcatctcaccttgcctcctggcatctgtcctcgtaatcctgcagggatttccgagagatttccgtcggatttccggacgatttccgctagatttccgactgatttccgtgcgatttccggtagatttccgggcgcgccatgcttcatcagactct

SEQ ID NO: 3459 - DNA, 156 bp, Artificial Sequence; identical to SEQ ID NO: 3458
  Synthetic polynucleotide

SEQ ID NO: 3460 - DNA, 190 bp, Artificial Sequence
  Synthetic polynucleotide
atcatctcaccttgcctcctgggctgctcaacaggtatcctgcagggatgacgtcaccccagagatgacgtcacccctcggatgacgtcaccccgacgatgacgtcaccccctagatgacgtcaccccactgatgacgtcacccctgcgatgacgtcaccccgtaggcgcgccatgcttcatcagactct

SEQ ID NO: 3461 - DNA, 190 bp, Artificial Sequence; identical to SEQ ID NO: 3460
  Synthetic polynucleotide

SEQ ID NO: 3462 - DNA, 156 bp, Artificial Sequence
  Synthetic polynucleotide
atcatctcaccttgcctcctggggttgtataaatttgccctgcagggatttcccagagatttccctcggatttcccgacgatttcccctagatttcccactgatttccctgcgatttcccgtagatttcccggcgcgccatgcttcatcagactct

SEQ ID NO: 3463 - DNA, 156 bp, Artificial Sequence; identical to SEQ ID NO: 3462
  Synthetic polynucleotide

SEQ ID NO: 3464 - DNA, 156 bp, Artificial Sequence
  Synthetic polynucleotide
atcatctcaccttgcctcctgactgtctgtcacaccctcctgcaggccacgtgtagaccacgtgttcgccacgtgtgacccacgtgtctaccacgtgtactccacgtgttgcccacgtgtgtaccacgtgtggcgcgccatgcttcatcagactct

SEQ ID NO: 3465 - DNA, 156 bp, Artificial Sequence; identical to SEQ ID NO: 3464
  Synthetic polynucleotide

SEQ ID NO: 3466 - DNA, 188 bp, Artificial Sequence
  Synthetic polynucleotide
atcatctcaccttgcctcctgcaaggatggccgatgtgcctgcaggtataaaaggaccagatataaaaggacctcgtataaaaggaccgactataaaaggaccctatataaaaggaccacttataaaaggacctgctataaaaggaccgtatataaaaggaccggcgcgccatgcttcatcagactct

SEQ ID NO: 3467 - DNA, 188 bp, Artificial Sequence; identical to SEQ ID NO: 3466
  Synthetic polynucleotide

SEQ ID NO: 3468 - DNA, 172 bp, Artificial Sequence
  Synthetic polynucleotide
atcatctcaccttgcctcctggtaaggttgcctactcacctgcaggggggcggggtagaggggcggggttcgggggcggggtgacggggcggggtctaggggcggggtactggggcggggttgcggggcggggtgtaggggcggggtggcgcgccatgcttcatcagactct

SEQ ID NO: 3469 - DNA, 172 bp, Artificial Sequence; identical to SEQ ID NO: 3468
  Synthetic polynucleotide

SEQ ID NO: 3470 - DNA, 140 bp, Artificial Sequence
  Synthetic polynucleotide
atcatctcaccttgcctcctggccagcttcgaggtatacctgcaggtgtggtagatgtggttcgtgtggtgactgtggtctatgtggtacttgtggttgctgtggtgtatgtggtggcgcgccatgcttcatcagactct

SEQ ID NO: 3471 - DNA, 140 bp, Artificial Sequence; identical to SEQ ID NO: 3470
  Synthetic polynucleotide

SEQ ID NO: 3472 - DNA, 180 bp, Artificial Sequence
  Synthetic polynucleotide
atcatctcaccttgcctcctgagcaagccgattgaatgcctgcaggacgttacataaagaacgttacataatcgacgttacataagacacgttacataactaacgttacataaactacgttacataatgcacgttacataagtaacgttacataaggcgcgccatgcttcatcagactct

SEQ ID NO: 3473 - DNA, 180 bp, Artificial Sequence; identical to SEQ ID NO: 3472
  Synthetic polynucleotide

SEQ ID NO: 3474 - DNA, 172 bp, Artificial Sequence
  Synthetic polynucleotide
atcatctcaccttgcctcctgggaggccactctatactcctgcaggcatgcgggtaagacatgcgggtatcgcatgcgggtagaccatgcgggtactacatgcgggtaactcatgcgggtatgccatgcgggtagtacatgcgggtaggcgcgccatgcttcatcagactct

SEQ ID NO: 3475 - DNA, 172 bp, Artificial Sequence; identical to SEQ ID NO: 3474
  Synthetic polynucleotide

SEQ ID NO: 3476 - DNA, 190 bp, Artificial Sequence
  Synthetic polynucleotide
atcatctcaccttgcctcctgcatagacaaatcctccccctgcaggttgttgtttacataagattgttgtttacatatcgttgttgtttacatagacttgttgtttacatactattgttgtttacataactttgttgtttacatatgcttgttgtttacatagtaggcgcgccatgcttcatcagactct

SEQ ID NO: 3477 - DNA, 190 bp, Artificial Sequence; identical to SEQ ID NO: 3476
  Synthetic polynucleotide

SEQ ID NO: 3478 - DNA, 164 bp, Artificial Sequence
  Synthetic polynucleotide
atcatctcaccttgcctcctgcgaagtgccaatcatcccctgcaggcaattacggagacaattacggtcgcaattacgggaccaattacggctacaattacggactcaattacggtgccaattacgggtacaattacggggcgcgccatgcttcatcagactct

SEQ ID NO: 3479 - DNA, 164 bp, Artificial Sequence; identical to SEQ ID NO: 3478
  Synthetic polynucleotide

SEQ ID NO: 3480 - DNA, 148 bp, Artificial Sequence
  Synthetic polynucleotide
atcatctcaccttgcctcctgaccacatccatggaccccctgcagggtgacagagagtgacagtcggtgacaggacgtgacagctagtgacagactgtgacagtgcgtgacaggtagtgacagggcgcgccatgcttcatcagactct

SEQ ID NO: 3481 - DNA, 148 bp, Artificial Sequence; identical to SEQ ID NO: 3480
  Synthetic polynucleotide

SEQ ID NO: 3482 - DNA, 190 bp, Artificial Sequence
  Synthetic polynucleotide
atcatctcaccttgcctcctggcatgattacttctctgcctgcagggagaaccgaaactgagagagaaccgaaactgtcggagaaccgaaactggacgagaaccgaaactgctagagaaccgaaactgactgagaaccgaaactgtgcgagaaccgaaactggtaggcgcgccatgcttcatcagactct

SEQ ID NO: 3483 - DNA, 190 bp, Artificial Sequence; identical to SEQ ID NO: 3482
  Synthetic polynucleotide

SEQ ID NO: 3484 - DNA, 156 bp, Artificial Sequence
  Synthetic polynucleotide
atcatctcaccttgcctcctgaacggataagccaaactcctgcaggttgtttatagattgtttattcgttgtttatgacttgtttatctattgtttatactttgtttattgcttgtttatgtattgtttatggcgcgccatgcttcatcagactct

SEQ ID NO: 3485 - DNA, 156 bp, Artificial Sequence; identical to SEQ ID NO: 3484
  Synthetic polynucleotide

SEQ ID NO: 3486 - DNA, 196 bp, Artificial Sequence
  Synthetic polynucleotide
atcatctcaccttgcctcctgtatcgatggccttcccacctgcaggccaccagggggcgagaccaccagggggcgtcgccaccagggggcggacccaccagggggcgctaccaccagggggcgactccaccagggggcgtgcccaccagggggcggtaccaccagggggcgggcgcgccatgcttcatcagactct

SEQ ID NO: 3487 - DNA, 196 bp, Artificial Sequence; identical to SEQ ID NO: 3486
  Synthetic polynucleotide

SEQ ID NO: 3488 - DNA, 196 bp, Artificial Sequence
  Synthetic polynucleotide
atcatctcaccttgcctcctgttacgccgtcaatacatcctgcaggaagatgatgtcatagaaagatgatgtcattcgaagatgatgtcatgacaagatgatgtcatctaaagatgatgtcatactaagatgatgtcattgcaagatgatgtcatgtaaagatgatgtcatggcgcgccatgcttcatcagactct

SEQ ID NO: 3489 - DNA, 196 bp, Artificial Sequence; identical to SEQ ID NO: 3488
  Synthetic polynucleotide

SEQ ID NO: 3490 - DNA, 148 bp, Artificial Sequence
  Synthetic polynucleotide
atcatctcaccttgcctcctgctggaatccacgtatctcctgcaggccaggtgagaccaggtgtcgccaggtggacccaggtgctaccaggtgactccaggtgtgcccaggtggtaccaggtgggcgcgccatgcttcatcagactct

SEQ ID NO: 3491 - DNA, 148 bp, Artificial Sequence; identical to SEQ ID NO: 3490
  Synthetic polynucleotide

SEQ ID NO: 3492 - DNA, 186 bp, Artificial Sequence
  Synthetic polynucleotide
atcatctcaccttgcctcctgacgtccaataggctgtacctgcaggatagcgccccctggtggccaagaatagcgccccctggtggccatcgatagcgccccctggtggccagacatagcgccccctggtggccactaatagcgccccctggtggccaactggcgcgccatgcttcatcagactct

SEQ ID NO: 3493 - DNA, 186 bp, Artificial Sequence; identical to SEQ ID NO: 3492
  Synthetic polynucleotide

SEQ ID NO: 3494 - DNA, 164 bp, Artificial Sequence
  Synthetic polynucleotide
atcatctcaccttgcctcctggaagtgcaccaatcctacctgcaggcttccgcttagacttccgctttcgcttccgcttgaccttccgcttctacttccgcttactcttccgctttgccttccgcttgtacttccgcttggcgcgccatgcttcatcagactct

SEQ ID NO: 3495 - DNA, 164 bp, Artificial Sequence; identical to SEQ ID NO: 3494
  Synthetic polynucleotide

SEQ ID NO: 3496 - DNA, 190 bp, Artificial Sequence
  Synthetic polynucleotide
atcatctcaccttgcctcctgaactgtgtgtcccagtgcctgcaggtctgacctacttttagatctgacctactttttcgtctgacctacttttgactctgacctacttttctatctgacctacttttacttctgacctactttttgctctgacctacttttgtaggcgcgccatgcttcatcagactct

SEQ ID NO: 3497 - DNA, 190 bp, Artificial Sequence; identical to SEQ ID NO: 3496
  Synthetic polynucleotide

SEQ ID NO: 3498 - DNA, 191 bp, Artificial Sequence
  Synthetic polynucleotide
atcatctcaccttgcctcctggccatttcgttcggtgccctgcaggcgcattaattaattggcagacgcattaattaattggctcgcgcattaattaattggcgaccgcattaattaattggcctacgcattaattaattggcactcgcattaattaattggctgcggcgcgccatgcttcatcagactct

SEQ ID NO: 3499 - DNA, 191 bp, Artificial Sequence; identical to SEQ ID NO: 3498
  Synthetic polynucleotide

SEQ ID NO: 3500 - DNA, 197 bp, Artificial Sequence
  Synthetic polynucleotide
atcatctcaccttgcctcctggctggaaatcatccacacctgcaggtgggaaatgtagtttagatgggaaatgtagttttcgtgggaaatgtagtttgactgggaaatgtagtttctatgggaaatgtagtttacttgggaaatgtagttttgctgggaaatgtagtttgtaggcgcgccatgcttcatcagactct

SEQ ID NO: 3501 - DNA, 197 bp, Artificial Sequence; identical to SEQ ID NO: 3500
  Synthetic polynucleotide

SEQ ID NO: 3502 - DNA, 197 bp, Artificial Sequence
  Synthetic polynucleotide
atcatctcaccttgcctcctgtaaggccatctttccgccctgcaggctggtggggacagataagagactggtggggacagataagtcgctggtggggacagataaggacctggtggggacagataagctactggtggggacagataagactctggtggggacagataagtgcggcgcgccatgcttcatcagactct

SEQ ID NO: 3503 - DNA, 197 bp, Artificial Sequence; identical to SEQ ID NO: 3502
  Synthetic polynucleotide

SEQ ID NO: 3504 - DNA, 197 bp, Artificial Sequence
  Synthetic polynucleotide
atcatctcaccttgcctcctggatgattataggacctacctgcagggaccccccgctgtgcagagaccccccgctgtgctcggaccccccgctgtgcgacgaccccccgctgtgcctagaccccccgctgtgcactgaccccccgctgtgctgcgaccccccgctgtgcgtaggcgcgccatgcttcatcagactct

SEQ ID NO: 3505 - DNA, 197 bp, Artificial Sequence; identical to SEQ ID NO: 3504
  Synthetic polynucleotide

SEQ ID NO: 3506 - DNA, 156 bp, Artificial Sequence
  Synthetic polynucleotide
atcatctcaccttgcctcctgctctatcatcaatagagcctgcaggtatcagatagatatcagattcgtatcagatgactatcagatctatatcagatacttatcagattgctatcagatgtatatcagatggcgcgccatgcttcatcagactct

SEQ ID NO: 3507 - DNA, 156 bp, Artificial Sequence; identical to SEQ ID NO: 3506
  Synthetic polynucleotide

SEQ ID NO: 3508 - DNA, 180 bp, Artificial Sequence
  Synthetic polynucleotide
atcatctcaccttgcctcctgaaagctaatggcagtatcctgcagggccggaagtggagagccggaagtggtcggccggaagtgggacgccggaagtggctagccggaagtggactgccggaagtggtgcgccggaagtgggtagccggaagtggggcgcgccatgcttcatcagactct

SEQ ID NO: 3509 - DNA, 180 bp, Artificial Sequence; identical to SEQ ID NO: 3508
  Synthetic polynucleotide

SEQ ID NO: 3510 - DNA, 197 bp, Artificial Sequence
  Synthetic polynucleotide
atcatctcaccttgcctcctgtgcggtgaatctgtgtacctgcaggaattttggcgccaaaactagaaattttggcgccaaaacttcgaattttggcgccaaaactgacaattttggcgccaaaactctaaattttggcgccaaaactactaattttggcgccaaaacttgcggcgcgccatgcttcatcagactct

SEQ ID NO: 3511 - DNA, 197 bp, Artificial Sequence; identical to SEQ ID NO: 3510
  Synthetic polynucleotide

SEQ ID NO: 3512 - DNA, 180 bp, Artificial Sequence
  Synthetic polynucleotide
atcatctcaccttgcctcctgtacacgtccaacaatgacctgcaggccgcccccgcaagaccgcccccgcatcgccgcccccgcagacccgcccccgcactaccgcccccgcaactccgcccccgcatgcccgcccccgcagtaccgcccccgcaggcgcgccatgcttcatcagactct

SEQ ID NO: 3513 - DNA, 180 bp, Artificial Sequence; identical to SEQ ID NO: 3512
  Synthetic polynucleotide

SEQ ID NO: 3514 - DNA, 185 bp, Artificial Sequence
  Synthetic polynucleotide
atcatctcaccttgcctcctgtgacgcatatgtaagctcctgcaggaaaaaagaaaatgaaaagaaaaaaagaaaatgaaatcgaaaaaagaaaatgaaagacaaaaaagaaaatgaaactaaaaaaagaaaatgaaaactaaaaaagaaaatgaaatgcggcgcgccatgcttcatcagactct

SEQ ID NO: 3515 - DNA, 185 bp, Artificial Sequence; identical to SEQ ID NO: 3514
  Synthetic polynucleotide

SEQ ID NO: 3516 - DNA, 172 bp, Artificial Sequence
  Synthetic polynucleotide
atcatctcaccttgcctcctggtgactaacagcaacaacctgcaggatctagaacaagaatctagaacatcgatctagaacagacatctagaacactaatctagaacaactatctagaacatgcatctagaacagtaatctagaacaggcgcgccatgcttcatcagactct

SEQ ID NO: 3517 - DNA, 172 bp, Artificial Sequence; identical to SEQ ID NO: 3516
  Synthetic polynucleotide

SEQ ID NO: 3518 - DNA, 186 bp, Artificial Sequence
  Synthetic polynucleotide
atcatctcaccttgcctcctgcagttagagacgtagttcctgcaggcaaaggtcacgtgacctttgagacaaaggtcacgtgacctttgtcgcaaaggtcacgtgacctttggaccaaaggtcacgtgacctttgctacaaaggtcacgtgacctttgactggcgcgccatgcttcatcagactct

SEQ ID NO: 3519 - DNA, 186 bp, Artificial Sequence; identical to SEQ ID NO: 3518
  Synthetic polynucleotide

SEQ ID NO: 3520 - DNA, 196 bp, Artificial Sequence
  Synthetic polynucleotide
atcatctcaccttgcctcctgcctgaagctgctagacacctgcaggccccggcctccgcagaccccggcctccgctcgccccggcctccgcgacccccggcctccgcctaccccggcctccgcactccccggcctccgctgcccccggcctccgcgtaccccggcctccgcggcgcgccatgcttcatcagactct

SEQ ID NO: 3521 - DNA, 196 bp, Artificial Sequence; identical to SEQ ID NO: 3520
  Synthetic polynucleotide

SEQ ID NO: 3522 - DNA, 188 bp, Artificial Sequence
  Synthetic polynucleotide
atcatctcaccttgcctcctgccgaaagcttcttgttacctgcaggtccgcccccctcagatccgcccccctctcgtccgcccccctcgactccgcccccctcctatccgcccccctcacttccgcccccctctgctccgcccccctcgtatccgcccccctcggcgcgccatgcttcatcagactct

SEQ ID NO: 3523 - DNA, 188 bp, Artificial Sequence; identical to SEQ ID NO: 3522
  Synthetic polynucleotide

SEQ ID NO: 3524 - DNA, 191 bp, Artificial Sequence
  Synthetic polynucleotide
atcatctcaccttgcctcctgaagaacatccaacgtgccctgcaggggtaattaattaacgcgagaggtaattaattaacgcgtcgggtaattaattaacgcggacggtaattaattaacgcgctaggtaattaattaacgcgactggtaattaattaacgcgtgcggcgcgccatgcttcatcagactct

SEQ ID NO: 3525 - DNA, 191 bp, Artificial Sequence; identical to SEQ ID NO: 3524
  Synthetic polynucleotide

SEQ ID NO: 3526 - DNA, 196 bp, Artificial Sequence
  Synthetic polynucleotide
atcatctcaccttgcctcctggtacatgacgtaaggaccctgcaggcacaatactaaccagacacaatactaacctcgcacaatactaaccgaccacaatactaaccctacacaatactaaccactcacaatactaacctgccacaatactaaccgtacacaatactaaccggcgcgccatgcttcatcagactct

SEQ ID NO: 3527 - DNA, 196 bp, Artificial Sequence; identical to SEQ ID NO: 3526
  Synthetic polynucleotide

SEQ ID NO: 3528 - DNA, 172 bp, Artificial Sequence
  Synthetic polynucleotide
atcatctcaccttgcctcctgcgactactatgtttaggcctgcaggcccccccacgagacccccccacgtcgcccccccacggaccccccccacgctacccccccacgactcccccccacgtgccccccccacggtacccccccacgggcgcgccatgcttcatcagactct

SEQ ID NO: 3529 - DNA, 172 bp, Artificial Sequence; identical to SEQ ID NO: 3528
  Synthetic polynucleotide

SEQ ID NO: 3530 - DNA, 156 bp, Artificial Sequence
  Synthetic polynucleotide
atcatctcaccttgcctcctgcgcactaacagggtatgcctgcaggttgacaagagattgacaagtcgttgacaaggacttgacaagctattgacaagactttgacaagtgcttgacaaggtattgacaagggcgcgccatgcttcatcagactct

SEQ ID NO: 3531 - DNA, 156 bp, Artificial Sequence; identical to SEQ ID NO: 3530
  Synthetic polynucleotide

SEQ ID NO: 3532 - DNA, 164 bp, Artificial Sequence
  Synthetic polynucleotide
atcatctcaccttgcctcctgcttgggagcattcgtatcctgcaggtgtctgtctagatgtctgtcttcgtgtctgtctgactgtctgtctctatgtctgtctacttgtctgtcttgctgtctgtctgtatgtctgtctggcgcgccatgcttcatcagactct

SEQ ID NO: 3533 - DNA, 164 bp, Artificial Sequence; identical to SEQ ID NO: 3532
  Synthetic polynucleotide

SEQ ID NO: 3534 - DNA, 156 bp, Artificial Sequence
  Synthetic polynucleotide
atcatctcaccttgcctcctgtgttctgattgccagtacctgcaggcactaattagacactaatttcgcactaattgaccactaattctacactaattactcactaatttgccactaattgtacactaattggcgcgccatgcttcatcagactct

SEQ ID NO: 3535 - DNA, 156 bp, Artificial Sequence; identical to SEQ ID NO: 3534
  Synthetic polynucleotide

SEQ ID NO: 3536 - DNA, 190 bp, Artificial Sequence
  Synthetic polynucleotide
atcatctcaccttgcctcctgagcaagttggaaggagacctgcagggccgttatggcttcagagccgttatggcttctcggccgttatggcttcgacgccgttatggcttcctagccgttatggcttcactgccgttatggcttctgcgccgttatggcttcgtaggcgcgccatgcttcatcagactct

SEQ ID NO: 3537 - DNA, 190 bp, Artificial Sequence; identical to SEQ ID NO: 3536
  Synthetic polynucleotide

SEQ ID NO: 3538 - DNA, 156 bp, Artificial Sequence
  Synthetic polynucleotide
atcatctcaccttgcctcctgcacctgaacatagcggtcctgcaggccgccaaaagaccgccaaatcgccgccaaagacccgccaaactaccgccaaaactccgccaaatgcccgccaaagtaccgccaaaggcgcgccatgcttcatcagactct

SEQ ID NO: 3539 - DNA, 156 bp, Artificial Sequence; identical to SEQ ID NO: 3538
  Synthetic polynucleotide

SEQ ID NO: 3540 - DNA, 172 bp, Artificial Sequence
  Synthetic polynucleotide
atcatctcaccttgcctcctgcggcgcaatcgtcttgtcctgcaggaactctcgcgagaaactctcgcgtcgaactctcgcggacaactctcgcgctaaactctcgcgactaactctcgcgtgcaactctcgcggtaaactctcgcgggcgcgccatgcttcatcagactct

SEQ ID NO: 3541 - DNA, 172 bp, Artificial Sequence; identical to SEQ ID NO: 3540
  Synthetic polynucleotide

SEQ ID NO: 3542 - DNA, 164 bp, Artificial Sequence
  Synthetic polynucleotide
atcatctcaccttgcctcctgatggcctacgcatataacctgcaggacccggatcagaacccggatctcgacccggatcgacacccggatcctaacccggatcactacccggatctgcacccggatcgtaacccggatcggcgcgccatgcttcatcagactct

SEQ ID NO: 3543 - DNA, 164 bp, Artificial Sequence; identical to SEQ ID NO: 3542
  Synthetic polynucleotide

SEQ ID NO: 3544 - DNA, 156 bp, Artificial Sequence
  Synthetic polynucleotide
atcatctcaccttgcctcctgcgtcacttctctggcaacctgcaggaaaccacaagaaaaccacatcgaaaccacagacaaaccacactaaaaccacaactaaaccacatgcaaaccacagtaaaaccacaggcgcgccatgcttcatcagactct

SEQ ID NO: 3545 - DNA, 156 bp, Artificial Sequence; identical to SEQ ID NO: 3544
  Synthetic polynucleotide

SEQ ID NO: 3546 - DNA, 180 bp, Artificial Sequence
  Synthetic polynucleotide
atcatctcaccttgcctcctgaacacggtgcaatcagacctgcaggtgttaattgctagatgttaattgcttcgtgttaattgctgactgttaattgctctatgttaattgctacttgttaattgcttgctgttaattgctgtatgttaattgctggcgcgccatgcttcatcagactct

SEQ ID NO: 3547 - DNA, 180 bp, Artificial Sequence; identical to SEQ ID NO: 3546
  Synthetic polynucleotide

SEQ ID NO: 3548 - DNA, 156 bp, Artificial Sequence
  Synthetic polynucleotide
atcatctcaccttgcctcctgacctcccttggaagtttcctgcaggttaagtggagattaagtggtcgttaagtgggacttaagtggctattaagtggactttaagtggtgcttaagtgggtattaagtggggcgcgccatgcttcatcagactct

SEQ ID NO: 3549 - DNA, 156 bp, Artificial Sequence; identical to SEQ ID NO: 3548
  Synthetic polynucleotide

SEQ ID NO: 3550 - DNA, 197 bp, Artificial Sequence
  Synthetic polynucleotide
atcatctcaccttgcctcctgcctaggaattacgagcccctgcagggttcagtcatgcgtgacaagagttcagtcatgcgtgacatcggttcagtcatgcgtgacagacgttcagtcatgcgtgacactagttcagtcatgcgtgacaactgttcagtcatgcgtgacatgcggcgcgccatgcttcatcagactct

SEQ ID NO: 3551 - DNA, 197 bp, Artificial Sequence; identical to SEQ ID NO: 3550
  Synthetic polynucleotide

SEQ ID NO: 3552 - DNA, 185 bp, Artificial Sequence
  Synthetic polynucleotide
atcatctcaccttgcctcctgtcgagtgcaatccatagcctgcaggtttactcaattaacctagatttactcaattaaccttcgtttactcaattaacctgactttactcaattaacctctatttactcaattaacctacttttactcaattaaccttgcggcgcgccatgcttcatcagactct

SEQ ID NO: 3553 - DNA, 185 bp, Artificial Sequence; identical to SEQ ID NO: 3552
  Synthetic polynucleotide

SEQ ID NO: 3554 - DNA, 156 bp, Artificial Sequence
  Synthetic polynucleotide
atcatctcaccttgcctcctggggttaacattatcaggcctgcaggttaagtgcagattaagtgctcgttaagtgcgacttaagtgcctattaagtgcactttaagtgctgcttaagtgcgtattaagtgcggcgcgccatgcttcatcagactct

SEQ ID NO: 3555 - DNA, 156 bp, Artificial Sequence; identical to SEQ ID NO: 3554
  Synthetic polynucleotide

SEQ ID NO: 3556 - DNA, 197 bp, Artificial Sequence
  Synthetic polynucleotide
atcatctcaccttgcctcctgataactggattgggtaacctgcagggaacattctgttcttagagaacattctgttctttcggaacattctgttcttgacgaacattctgttcttctagaacattctgttcttactgaacattctgttctttgcgaacattctgttcttgtaggcgcgccatgcttcatcagactct

SEQ ID NO: 3557 - DNA, 197 bp, Artificial Sequence; identical to SEQ ID NO: 3556
  Synthetic polynucleotide

SEQ ID NO: 3558 - DNA, 172 bp, Artificial Sequence
  Synthetic polynucleotide
atcatctcaccttgcctcctgtagttgaagatcactcccctgcaggcccccccacaagacccccccacatcgcccccccacagaccccccccacactacccccccacaactcccccccacatgccccccccacagtacccccccacaggcgcgccatgcttcatcagactct

SEQ ID NO: 3559 - DNA, 172 bp, Artificial Sequence; identical to SEQ ID NO: 3558
  Synthetic polynucleotide

SEQ ID NO: 3560 - DNA, 172 bp, Artificial Sequence
  Synthetic polynucleotide
atcatctcaccttgcctcctggcaacacaatcaccctacctgcaggtctataaaagagatctataaaagtcgtctataaaaggactctataaaagctatctataaaagacttctataaaagtgctctataaaaggtatctataaaagggcgcgccatgcttcatcagactct

SEQ ID NO: 3561 - DNA, 172 bp, Artificial Sequence; identical to SEQ ID NO: 3560
  Synthetic polynucleotide

SEQ ID NO: 3562 - DNA, 196 bp, Artificial Sequence
  Synthetic polynucleotide
atcatctcaccttgcctcctgatgcattagcccaagctcctgcagggccctctagtggcagagccctctagtggctcggccctctagtggcgacgccctctagtggcctagccctctagtggcactgccctctagtggctgcgccctctagtggcgtagccctctagtggcggcgcgccatgcttcatcagactct

SEQ ID NO: 3563 - DNA, 196 bp, Artificial Sequence; identical to SEQ ID NO: 3562
  Synthetic polynucleotide

SEQ ID NO: 3564 - DNA, 164 bp, Artificial Sequence
  Synthetic polynucleotide
atcatctcaccttgcctcctgactcaaccgaagtcctccctgcaggaccacttaaagaaccacttaatcgaccacttaagacaccacttaactaaccacttaaactaccacttaatgcaccacttaagtaaccacttaaggcgcgccatgcttcatcagactct

SEQ ID NO: 3565 - DNA, 164 bp, Artificial Sequence; identical to SEQ ID NO: 3564
  Synthetic polynucleotide

SEQ ID NO: 3566 - DNA, 164 bp, Artificial Sequence
  Synthetic polynucleotide
atcatctcaccttgcctcctggttattataggacgtcgcctgcagggcacgcaacagagcacgcaactcggcacgcaacgacgcacgcaacctagcacgcaacactgcacgcaactgcgcacgcaacgtagcacgcaacggcgcgccatgcttcatcagactct

SEQ ID NO: 3567 - DNA, 164 bp, Artificial Sequence; identical to SEQ ID NO: 3566
  Synthetic polynucleotide

SEQ ID NO: 3568 - DNA, 180 bp, Artificial Sequence
  Synthetic polynucleotide
atcatctcaccttgcctcctgtacggtcctgctcaaagcctgcaggcacgtggttccagacacgtggttcctcgcacgtggttccgaccacgtggttccctacacgtggttccactcacgtggttcctgccacgtggttccgtacacgtggttccggcgcgccatgcttcatcagactct

SEQ ID NO: 3569 - DNA, 180 bp, Artificial Sequence; identical to SEQ ID NO: 3568
  Synthetic polynucleotide

SEQ ID NO: 3570 - DNA, 197 bp, Artificial Sequence
  Synthetic polynucleotide
atcatctcaccttgcctcctgtaccatatgggacccatcctgcagggagtgggggcgggagagagagtgggggcgggagtcggagtgggggcgggaggacgagtgggggcgggagctagagtgggggcgggagactgagtgggggcgggagtgcgagtgggggcgggaggtaggcgcgccatgcttcatcagactct

SEQ ID NO: 3571 - DNA, 197 bp, Artificial Sequence; identical to SEQ ID NO: 3570
  Synthetic polynucleotide

SEQ ID NO: 3572 - DNA, 197 bp, Artificial Sequence
  Synthetic polynucleotide
atcatctcaccttgcctcctgtctccaagaatgctcggcctgcagggaccccccgctgcgcagagaccccccgctgcgctcggaccccccgctgcgcgacgaccccccgctgcgcctagaccccccgctgcgcactgaccccccgctgcgctgcgaccccccgctgcgcgtaggcgcgccatgcttcatcagactct

SEQ ID NO: 3573 - DNA, 197 bp, Artificial Sequence; identical to SEQ ID NO: 3572
  Synthetic polynucleotide

SEQ ID NO: 3574 - DNA, 191 bp, Artificial Sequence
  Synthetic polynucleotide
atcatctcaccttgcctcctgtgagcctagtcgattaccctgcaggcaaattaattaaaaactagacaaattaattaaaaacttcgcaaattaattaaaaactgaccaaattaattaaaaactctacaaattaattaaaaactactcaaattaattaaaaacttgcggcgcgccatgcttcatcagactct

SEQ ID NO: 3575 - DNA, 191 bp, Artificial Sequence; identical to SEQ ID NO: 3574
  Synthetic polynucleotide

SEQ ID NO: 3576 - DNA, 191 bp, Artificial Sequence
  Synthetic polynucleotide
atcatctcaccttgcctcctgtgttgttcagccttactcctgcaggaaccgctaattagtggaagaaaccgctaattagtggatcgaaccgctaattagtggagacaaccgctaattagtggactaaaccgctaattagtggaactaaccgctaattagtggatgcggcgcgccatgcttcatcagactct

SEQ ID NO: 3577 - DNA, 191 bp, Artificial Sequence; identical to SEQ ID NO: 3576
  Synthetic polynucleotide

SEQ ID NO: 3578 - DNA, 197 bp, Artificial Sequence
  Synthetic polynucleotide
atcatctcaccttgcctcctggtgcatcccgttaattgcctgcaggatcaatgttattgatagaatcaatgttattgattcgatcaatgttattgatgacatcaatgttattgatctaatcaatgttattgatactatcaatgttattgattgcatcaatgttattgatgtaggcgcgccatgcttcatcagactct

SEQ ID NO: 3579 - DNA, 197 bp, Artificial Sequence; identical to SEQ ID NO: 3578
  Synthetic polynucleotide

SEQ ID NO: 3580 - DNA, 180 bp, Artificial Sequence
  Synthetic polynucleotide
atcatctcaccttgcctcctgctccgcttaacaagcaacctgcaggtgtaaacaggaagatgtaaacaggatcgtgtaaacaggagactgtaaacaggactatgtaaacaggaacttgtaaacaggatgctgtaaacaggagtatgtaaacaggaggcgcgccatgcttcatcagactct

SEQ ID NO: 3581 - DNA, 180 bp, Artificial Sequence; identical to SEQ ID NO: 3580
  Synthetic polynucleotide

SEQ ID NO: 3582 - DNA, 164 bp, Artificial Sequence
  Synthetic polynucleotide
atcatctcaccttgcctcctgttgaagaacgtgaggcacctgcaggcggccatctagacggccatcttcgcggccatctgaccggccatctctacggccatctactcggccatcttgccggccatctgtacggccatctggcgcgccatgcttcatcagactct

SEQ ID NO: 3583 - DNA, 164 bp, Artificial Sequence; identical to SEQ ID NO: 3582
  Synthetic polynucleotide

SEQ ID NO: 3584 - DNA, 197 bp, Artificial Sequence
  Synthetic polynucleotide
atcatctcaccttgcctcctgtaacctagagcacacaccctgcaggccatataaggagatgagaccatataaggagatgtcgccatataaggagatggacccatataaggagatgctaccatataaggagatgactccatataaggagatgtgcccatataaggagatggtaggcgcgccatgcttcatcagactct

SEQ ID NO: 3585 - DNA, 197 bp, Artificial Sequence; identical to SEQ ID NO: 3584
  Synthetic polynucleotide

SEQ ID NO: 3586 - DNA, 190 bp, Artificial Sequence
  Synthetic polynucleotide
atcatctcaccttgcctcctgctgaaaggatgcgcacacctgcaggattttccgtaaaatagaattttccgtaaaattcgattttccgtaaaatgacattttccgtaaaatctaattttccgtaaaatactattttccgtaaaattgcattttccgtaaaatgtaggcgcgccatgcttcatcagactct

SEQ ID NO: 3587 - DNA, 190 bp, Artificial Sequence; identical to SEQ ID NO: 3586
  Synthetic polynucleotide

SEQ ID NO: 3588 - DNA, 190 bp, Artificial Sequence
  Synthetic polynucleotide
atcatctcaccttgcctcctggatgtgaatgagacatacctgcaggagttactaggcaaaagaagttactaggcaaatcgagttactaggcaaagacagttactaggcaaactaagttactaggcaaaactagttactaggcaaatgcagttactaggcaaagtaggcgcgccatgcttcatcagactct

SEQ ID NO: 3589 - DNA, 190 bp, Artificial Sequence; identical to SEQ ID NO: 3588
  Synthetic polynucleotide

SEQ ID NO: 3590 - DNA, 186 bp, Artificial Sequence
  Synthetic polynucleotide
atcatctcaccttgcctcctgctctatagctacctgttcctgcaggtaaaggaaagccaaaagtgaagataaaggaaagccaaaagtgatcgtaaaggaaagccaaaagtgagactaaaggaaagccaaaagtgactataaaggaaagccaaaagtgaactggcgcgccatgcttcatcagactct

SEQ ID NO: 3591 - DNA, 186 bp, Artificial Sequence; identical to SEQ ID NO: 3590
  Synthetic polynucleotide

SEQ ID NO: 3592 - DNA, 191 bp, Artificial Sequence
  Synthetic polynucleotide
atcatctcaccttgcctcctggtcgcgtgcaattgactcctgcaggggccgttataaccgttaagaggccgttataaccgttatcgggccgttataaccgttagacggccgttataaccgttactaggccgttataaccgttaactggccgttataaccgttatgcggcgcgccatgcttcatcagactct

SEQ ID NO: 3593 - DNA, 191 bp, Artificial Sequence; identical to SEQ ID NO: 3592
  Synthetic polynucleotide

SEQ ID NO: 3594 - DNA, 197 bp, Artificial Sequence
  Synthetic polynucleotide
atcatctcaccttgcctcctgttggagctaggatagaccctgcaggcagcatgactcagcaagacagcatgactcagcatcgcagcatgactcagcagaccagcatgactcagcactacagcatgactcagcaactcagcatgactcagcatgccagcatgactcagcagtaggcgcgccatgcttcatcagactct

SEQ ID NO: 3595 - DNA, 197 bp, Artificial Sequence; identical to SEQ ID NO: 3594
  Synthetic polynucleotide

SEQ ID NO: 3596 - DNA, 180 bp, Artificial Sequence
  Synthetic polynucleotide
atcatctcaccttgcctcctgccagtcgaattcaataacctgcaggaccacttgaaaagaaccacttgaaatcgaccacttgaaagacaccacttgaaactaaccacttgaaaactaccacttgaaatgcaccacttgaaagtaaccacttgaaaggcgcgccatgcttcatcagactct

SEQ ID NO: 3597 - DNA, 180 bp, Artificial Sequence; identical to SEQ ID NO: 3596
  Synthetic polynucleotide

SEQ ID NO: 3598 - DNA, 191 bp, Artificial Sequence
  Synthetic polynucleotide
atcatctcaccttgcctcctgatgggcctgtactcatccctgcagggtaattaattaaataatagagtaattaattaaataattcggtaattaattaaataatgacgtaattaattaaataatctagtaattaattaaataatactgtaattaattaaataattgcggcgcgccatgcttcatcagactct

SEQ ID NO: 3599 - DNA, 191 bp, Artificial Sequence; identical to SEQ ID NO: 3598
  Synthetic polynucleotide

SEQ ID NO: 3600 - DNA, 188 bp, Artificial Sequence
  Synthetic polynucleotide
atcatctcaccttgcctcctgctcgaccagttaagaaccctgcaggtgctgactcagcagatgctgactcagctcgtgctgactcagcgactgctgactcagcctatgctgactcagcacttgctgactcagctgctgctgactcagcgtatgctgactcagcggcgcgccatgcttcatcagactct

SEQ ID NO: 3601 - DNA, 188 bp, Artificial Sequence; identical to SEQ ID NO: 3600
  Synthetic polynucleotide

SEQ ID NO: 3602 - DNA, 185 bp, Artificial Sequence
  Synthetic polynucleotide
atcatctcaccttgcctcctgcgataaatctgcgcaagcctgcaggcgttggggattagcctagacgttggggattagccttcgcgttggggattagcctgaccgttggggattagcctctacgttggggattagcctactcgttggggattagccttgcggcgcgccatgcttcatcagactct

SEQ ID NO: 3603 - DNA, 185 bp, Artificial Sequence; identical to SEQ ID NO: 3602
  Synthetic polynucleotide

SEQ ID NO: 3604 - DNA, 191 bp, Artificial Sequence
  Synthetic polynucleotide
atcatctcaccttgcctcctgtaccttagggcgttgaccctgcagggtgttacttcctgtggcagagtgttacttcctgtggctcggtgttacttcctgtggcgacgtgttacttcctgtggcctagtgttacttcctgtggcactgtgttacttcctgtggctgcggcgcgccatgcttcatcagactct

SEQ ID NO: 3605 - DNA, 191 bp, Artificial Sequence; identical to SEQ ID NO: 3604
  Synthetic polynucleotide

SEQ ID NO: 3606 - DNA, 190 bp, Artificial Sequence
  Synthetic polynucleotide
atcatctcaccttgcctcctggaaccgggtcataaccacctgcaggtatgtgttgtggttagatatgtgttgtggtttcgtatgtgttgtggttgactatgtgttgtggttctatatgtgttgtggttacttatgtgttgtggtttgctatgtgttgtggttgtaggcgcgccatgcttcatcagactct

SEQ ID NO: 3607 - DNA, 190 bp, Artificial Sequence; identical to SEQ ID NO: 3606
  Synthetic polynucleotide

SEQ ID NO: 3608 - DNA, 180 bp, Artificial Sequence
  Synthetic polynucleotide
atcatctcaccttgcctcctgagtcgtagtcggatgagcctgcaggtcttatctcccagatcttatctccctcgtcttatctcccgactcttatctcccctatcttatctcccacttcttatctccctgctcttatctcccgtatcttatctcccggcgcgccatgcttcatcagactct

SEQ ID NO: 3609 - DNA, 180 bp, Artificial Sequence; identical to SEQ ID NO: 3608
  Synthetic polynucleotide

SEQ ID NO: 3610 - DNA, 188 bp, Artificial Sequence
  Synthetic polynucleotide
atcatctcaccttgcctcctgggtacagtacccatacccctgcaggggggggggggcgagaggggggggggcgtcgggggggggggcggacggggggggggcgctaggggggggggcgactggggggggggcgtgcggggggggggcggtaggggggggggcgggcgcgccatgcttcatcagactct

SEQ ID NO: 3611 - DNA, 188 bp, Artificial Sequence; identical to SEQ ID NO: 3610
  Synthetic polynucleotide

SEQ ID NO: 3612 - DNA, 197 bp, Artificial Sequence
  Synthetic polynucleotide
atcatctcaccttgcctcctgtcatgagtcctccataccctgcaggggcgctgtccatggtagaggcgctgtccatggttcgggcgctgtccatggtgacggcgctgtccatggtctaggcgctgtccatggtactggcgctgtccatggttgcggcgctgtccatggtgtaggcgcgccatgcttcatcagactct

SEQ ID NO: 3613 - DNA, 197 bp, Artificial Sequence; identical to SEQ ID NO: 3612
  Synthetic polynucleotide

SEQ ID NO: 3614 - DNA, 172 bp, Artificial Sequence
  Synthetic polynucleotide
atcatctcaccttgcctcctgcttaagggcacacgagccctgcaggcgctatccgcagacgctatccgctcgcgctatccgcgaccgctatccgcctacgctatccgcactcgctatccgctgccgctatccgcgtacgctatccgcggcgcgccatgcttcatcagactct

SEQ ID NO: 3615 - DNA, 172 bp, Artificial Sequence; identical to SEQ ID NO: 3614
  Synthetic polynucleotide

SEQ ID NO: 3616 - DNA, 200 bp, Artificial Sequence
  Synthetic polynucleotide
atcatctcaccttgcctcctgttaaatacctggcctcacctgcaggccgaaatttgcatattgatagaccgaaatttgcatattgattcgccgaaatttgcatattgatgacccgaaatttgcatattgatctaccgaaatttgcatattgatactccgaaatttgcatattgatggcgcgccatgcttcatcagactct

SEQ ID NO: 3617 - DNA, 200 bp, Artificial Sequence; identical to SEQ ID NO: 3616
  Synthetic polynucleotide

SEQ ID NO: 3618 - DNA, 197 bp, Artificial Sequence
  Synthetic polynucleotide
atcatctcaccttgcctcctggtgctccaaattccaatcctgcaggttggcacagtgccagagattggcacagtgccagtcgttggcacagtgccaggacttggcacagtgccagctattggcacagtgccagactttggcacagtgccagtgcttggcacagtgccaggtaggcgcgccatgcttcatcagactct

SEQ ID NO: 3619 - DNA, 197 bp, Artificial Sequence; identical to SEQ ID NO: 3618
  Synthetic polynucleotide

SEQ ID NO: 3620 - DNA, 140 bp, Artificial Sequence
  Synthetic polynucleotide
atcatctcaccttgcctcctggagctcgggaactctaacctgcaggattgttagaattgtttcgattgttgacattgttctaattgttactattgtttgcattgttgtaattgttggcgcgccatgcttcatcagactct

SEQ ID NO: 3621 - DNA, 140 bp, Artificial Sequence; identical to SEQ ID NO: 3620
  Synthetic polynucleotide

SEQ ID NO: 3622 - DNA, 185 bp, Artificial Sequence
  Synthetic polynucleotide
atcatctcaccttgcctcctgtaacccggtaccacaggcctgcaggtaacggttttaacggtagataacggttttaacggttcgtaacggttttaacggtgactaacggttttaacggtctataacggttttaacggtacttaacggttttaacggttgcggcgcgccatgcttcatcagactct

SEQ ID NO: 3623 - DNA, 185 bp, Artificial Sequence; identical to SEQ ID NO: 3622
  Synthetic polynucleotide

SEQ ID NO: 3624 - DNA, 200 bp, Artificial Sequence
  Synthetic polynucleotide
atcatctcaccttgcctcctgaagcatcgctggactcgcctgcaggcaaggtcatttcaaggtcaagacaaggtcatttcaaggtcatcgcaaggtcatttcaaggtcagaccaaggtcatttcaaggtcactacaaggtcatttcaaggtcaactcaaggtcatttcaaggtcaggcgcgccatgcttcatcagactct

SEQ ID NO: 3625 - DNA, 200 bp, Artificial Sequence; identical to SEQ ID NO: 3624
  Synthetic polynucleotide

SEQ ID NO: 3626 - DNA, 191 bp, Artificial Sequence
  Synthetic polynucleotide
atcatctcaccttgcctcctgacaagaatcccgtattacctgcaggatgtttacggtaaacaaagaatgtttacggtaaacaatcgatgtttacggtaaacaagacatgtttacggtaaacaactaatgtttacggtaaacaaactatgtttacggtaaacaatgcggcgcgccatgcttcatcagactct

SEQ ID NO: 3627 - DNA, 191 bp, Artificial Sequence; identical to SEQ ID NO: 3626
  Synthetic polynucleotide

SEQ ID NO: 3628 - DNA, 156 bp, Artificial Sequence
  Synthetic polynucleotide
atcatctcaccttgcctcctggaggccagaggattagccctgcaggttgctgacagattgctgactcgttgctgacgacttgctgacctattgctgacactttgctgactgcttgctgacgtattgctgacggcgcgccatgcttcatcagactct

SEQ ID NO: 3629 - DNA, 156 bp, Artificial Sequence; identical to SEQ ID NO: 3628
  Synthetic polynucleotide

SEQ ID NO: 3630 - DNA, 172 bp, Artificial Sequence
  Synthetic polynucleotide
atcatctcaccttgcctcctggcatactccacgaactgcctgcagggaccgaaaccagagaccgaaacctcggaccgaaaccgacgaccgaaaccctagaccgaaaccactgaccgaaacctgcgaccgaaaccgtagaccgaaaccggcgcgccatgcttcatcagactct

SEQ ID NO: 3631 - DNA, 172 bp, Artificial Sequence; identical to SEQ ID NO: 3630
  Synthetic polynucleotide

SEQ ID NO: 3632 - DNA, 191 bp, Artificial Sequence
  Synthetic polynucleotide
atcatctcaccttgcctcctgcggactcatgtaactggcctgcaggctggggggggcagataaggcaagactggggggggcagataaggcatcgctggggggggcagataaggcagacctggggggggcagataaggcactactggggggggcagataaggcaactggcgcgccatgcttcatcagactct

SEQ ID NO: 3633 - DNA, 191 bp, Artificial Sequence; identical to SEQ ID NO: 3632
  Synthetic polynucleotide

SEQ ID NO: 3634 - DNA, 172 bp, Artificial Sequence
  Synthetic polynucleotide
atcatctcaccttgcctcctgaatttggatgtatccaccctgcaggagatattatcagaagatattatctcgagatattatcgacagatattatcctaagatattatcactagatattatctgcagatattatcgtaagatattatcggcgcgccatgcttcatcagactct

SEQ ID NO: 3635 - DNA, 172 bp, Artificial Sequence; identical to SEQ ID NO: 3634
  Synthetic polynucleotide

SEQ ID NO: 3636 - DNA, 197 bp, Artificial Sequence
  Synthetic polynucleotide
atcatctcaccttgcctcctgtggcttgccagtttacccctgcaggcctctccctcctcccagacctctccctcctccctcgcctctccctcctcccgaccctctccctcctcccctacctctccctcctcccactcctctccctcctccctgccctctccctcctcccgtaggcgcgccatgcttcatcagactct

SEQ ID NO: 3637 - DNA, 197 bp, Artificial Sequence; identical to SEQ ID NO: 3636
  Synthetic polynucleotide

SEQ ID NO: 3638 - DNA, 188 bp, Artificial Sequence
  Synthetic polynucleotide
atcatctcaccttgcctcctgacttaacgcaccctgaccctgcaggaagatcaaagggagaaagatcaaagggtcgaagatcaaaggggacaagatcaaagggctaaagatcaaagggactaagatcaaagggtgcaagatcaaaggggtaaagatcaaagggggcgcgccatgcttcatcagactct

SEQ ID NO: 3639 - DNA, 188 bp, Artificial Sequence; identical to SEQ ID NO: 3638
  Synthetic polynucleotide

SEQ ID NO: 3640 - DNA, 185 bp, Artificial Sequence
  Synthetic polynucleotide
atcatctcaccttgcctcctgatccgctcagttgcaagcctgcaggttgcattaattactacagattgcattaattactactcgttgcattaattactacgacttgcattaattactacctattgcattaattactacactttgcattaattactactgcggcgcgccatgcttcatcagactct

SEQ ID NO: 3641 - DNA, 185 bp, Artificial Sequence; identical to SEQ ID NO: 3640
  Synthetic polynucleotide

SEQ ID NO: 3642 - DNA, 148 bp, Artificial Sequence
  Synthetic polynucleotide
atcatctcaccttgcctcctgtgtgccagatcttgcatcctgcaggttagcggagattagcggtcgttagcgggacttagcggctattagcggactttagcggtgcttagcgggtattagcggggcgcgccatgcttcatcagactct

SEQ ID NO: 3643 - DNA, 148 bp, Artificial Sequence; identical to SEQ ID NO: 3642
  Synthetic polynucleotide

SEQ ID NO: 3644 - DNA, 190 bp, Artificial Sequence
  Synthetic polynucleotide
atcatctcaccttgcctcctggttcgcatttacgtttccctgcaggcagccaatcagcgcagacagccaatcagcgctcgcagccaatcagcgcgaccagccaatcagcgcctacagccaatcagcgcactcagccaatcagcgctgccagccaatcagcgcgtaggcgcgccatgcttcatcagactct

SEQ ID NO: 3645 - DNA, 190 bp, Artificial Sequence; identical to SEQ ID NO: 3644
  Synthetic polynucleotide

SEQ ID NO: 3646 - DNA, 191 bp, Artificial Sequence
  Synthetic polynucleotide
atcatctcaccttgcctcctgactagccgaaccctgctcctgcaggttacacttccggtattgagattacacttccggtattgtcgttacacttccggtattggacttacacttccggtattgctattacacttccggtattgactttacacttccggtattgtgcggcgcgccatgcttcatcagactct

SEQ ID NO: 3647 - DNA, 191 bp, Artificial Sequence; identical to SEQ ID NO: 3646
  Synthetic polynucleotide

SEQ ID NO: 3648 - DNA, 190 bp, Artificial Sequence
  Synthetic polynucleotide
atcatctcaccttgcctcctgaccattgggcatggacccctgcaggaaaaaatcaataaaagaaaaaaatcaataaatcgaaaaaatcaataaagacaaaaaatcaataaactaaaaaaatcaataaaactaaaaaatcaataaatgcaaaaaatcaataaagtaggcgcgccatgcttcatcagactct

SEQ ID NO: 3649 - DNA, 190 bp, Artificial Sequence; identical to SEQ ID NO: 3648
  Synthetic polynucleotide

SEQ ID NO: 3650 - DNA, 185 bp, Artificial Sequence
  Synthetic polynucleotide
atcatctcaccttgcctcctgctcaaattctatccggccctgcagggccccgctgccgccgcagagccccgctgccgccgctcggccccgctgccgccgcgacgccccgctgccgccgcctagccccgctgccgccgcactgccccgctgccgccgctgcggcgcgccatgcttcatcagactct

SEQ ID NO: 3651 - DNA, 185 bp, Artificial Sequence; identical to SEQ ID NO: 3650
  Synthetic polynucleotide

SEQ ID NO: 3652 - DNA, 197 bp, Artificial Sequence
  Synthetic polynucleotide
atcatctcaccttgcctcctgaccttacgcacattaatcctgcaggtaaattgattgatggagataaattgattgatggtcgtaaattgattgatgggactaaattgattgatggctataaattgattgatggacttaaattgattgatggtgctaaattgattgatgggtaggcgcgccatgcttcatcagactct

SEQ ID NO: 3653 - DNA, 197 bp, Artificial Sequence; identical to SEQ ID NO: 3652
  Synthetic polynucleotide

SEQ ID NO: 3654 - DNA, 200 bp, Artificial Sequence
  Synthetic polynucleotide
atcatctcaccttgcctcctggtactttatagccgacgcctgcaggccacggcggtgtcacatgcagaccacggcggtgtcacatgctcgccacggcggtgtcacatgcgacccacggcggtgtcacatgcctaccacggcggtgtcacatgcactccacggcggtgtcacatgcggcgcgccatgcttcatcagactct

SEQ ID NO: 3655 - DNA, 200 bp, Artificial Sequence; identical to SEQ ID NO: 3654
  Synthetic polynucleotide

SEQ ID NO: 3656 - DNA, 185 bp, Artificial Sequence
  Synthetic polynucleotide
atcatctcaccttgcctcctggctgagcacgcaagttgcctgcaggaattattgaattgattagaaattattgaattgatttcgaattattgaattgattgacaattattgaattgattctaaattattgaattgattactaattattgaattgatttgcggcgcgccatgcttcatcagactct

SEQ ID NO: 3657 - DNA, 185 bp, Artificial Sequence; identical to SEQ ID NO: 3656
  Synthetic polynucleotide

SEQ ID NO: 3658 - DNA, 196 bp, Artificial Sequence
  Synthetic polynucleotide
atcatctcaccttgcctcctgccgaaccgtcatgctagcctgcaggttaaaaatatgcataatcagtaagattaaaaatatgcataatcagtatcgttaaaaatatgcataatcagtagacttaaaaatatgcataatcagtactattaaaaatatgcataatcagtaactggcgcgccatgcttcatcagactct

SEQ ID NO: 3659 - DNA, 196 bp, Artificial Sequence; identical to SEQ ID NO: 3658
  Synthetic polynucleotide

SEQ ID NO: 3660 - DNA, 200 bp, Artificial Sequence
  Synthetic polynucleotide
atcatctcaccttgcctcctgaatgttgatcggtgagtcctgcaggccgaaatttgcatattgaaagaccgaaatttgcatattgaatcgccgaaatttgcatattgaagacccgaaatttgcatattgaactaccgaaatttgcatattgaaactccgaaatttgcatattgaaggcgcgccatgcttcatcagactct

SEQ ID NO: 3661 - DNA, 200 bp, Artificial Sequence; identical to SEQ ID NO: 3660
  Synthetic polynucleotide

SEQ ID NO: 3662 - DNA, 180 bp, Artificial Sequence
  Synthetic polynucleotide
atcatctcaccttgcctcctgtgaactagcccagacttcctgcaggtgatttgcataagatgatttgcatatcgtgatttgcatagactgatttgcatactatgatttgcataacttgatttgcatatgctgatttgcatagtatgatttgcataggcgcgccatgcttcatcagactct

SEQ ID NO: 3663 - DNA, 180 bp, Artificial Sequence; identical to SEQ ID NO: 3662
  Synthetic polynucleotide

SEQ ID NO: 3664 - DNA, 156 bp, Artificial Sequence
  Synthetic polynucleotide
atcatctcaccttgcctcctggtgcgcatcaaataggtcctgcaggccactagaagaccactagatcgccactagagacccactagactaccactagaactccactagatgcccactagagtaccactagaggcgcgccatgcttcatcagactct

SEQ ID NO: 3665 - DNA, 156 bp, Artificial Sequence; identical to SEQ ID NO: 3664
  Synthetic polynucleotide

SEQ ID NO: 3666 - DNA, 188 bp, Artificial Sequence
  Synthetic polynucleotide
atcatctcaccttgcctcctgtagtcgcgagggagcaacctgcaggctgcacctgtgcagactgcacctgtgctcgctgcacctgtgcgacctgcacctgtgcctactgcacctgtgcactctgcacctgtgctgcctgcacctgtgcgtactgcacctgtgcggcgcgccatgcttcatcagactct

SEQ ID NO: 3667 - DNA, 188 bp, Artificial Sequence; identical to SEQ ID NO: 3666
  Synthetic polynucleotide

SEQ ID NO: 3668 - DNA, 180 bp, Artificial Sequence
  Synthetic polynucleotide
atcatctcaccttgcctcctgagtcggctatattggcacctgcaggcaacaggtggtagacaacaggtggttcgcaacaggtggtgaccaacaggtggtctacaacaggtggtactcaacaggtggttgccaacaggtggtgtacaacaggtggtggcgcgccatgcttcatcagactct

SEQ ID NO: 3669 - DNA, 180 bp, Artificial Sequence; identical to SEQ ID NO: 3668
  Synthetic polynucleotide

SEQ ID NO: 3670 - DNA, 180 bp, Artificial Sequence
  Synthetic polynucleotide
atcatctcaccttgcctcctgagtgggtaatgattcctcctgcaggtttcccgccccagatttcccgcccctcgtttcccgccccgactttcccgccccctatttcccgccccacttttcccgcccctgctttcccgccccgtatttcccgccccggcgcgccatgcttcatcagactct

SEQ ID NO: 3671 - DNA, 180 bp, Artificial Sequence; identical to SEQ ID NO: 3670
  Synthetic polynucleotide

SEQ ID NO: 3672 - DNA, 197 bp, Artificial Sequence
  Synthetic polynucleotide
atcatctcaccttgcctcctgattacatagcgcgaaaccctgcaggctaattggcaattaaagactaattggcaattaatcgctaattggcaattaagacctaattggcaattaactactaattggcaattaaactctaattggcaattaatgcctaattggcaattaagtaggcgcgccatgcttcatcagactct

SEQ ID NO: 3673 - DNA, 197 bp, Artificial Sequence; identical to SEQ ID NO: 3672
  Synthetic polynucleotide

SEQ ID NO: 3674 - DNA, 185 bp, Artificial Sequence
  Synthetic polynucleotide
atcatctcaccttgcctcctgcctttgcttcatagtatcctgcaggaattgagtgggcgtagagaaattgagtgggcgtagtcgaattgagtgggcgtaggacaattgagtgggcgtagctaaattgagtgggcgtagactaattgagtgggcgtagtgcggcgcgccatgcttcatcagactct

SEQ ID NO: 3675 - DNA, 185 bp, Artificial Sequence; identical to SEQ ID NO: 3674
  Synthetic polynucleotide

SEQ ID NO: 3676 - DNA, 185 bp, Artificial Sequence
  Synthetic polynucleotide
atcatctcaccttgcctcctgctttagggtgtgacttacctgcagggcgggcacgtgacaacagagcgggcacgtgacaactcggcgggcacgtgacaacgacgcgggcacgtgacaacctagcgggcacgtgacaacactgcgggcacgtgacaactgcggcgcgccatgcttcatcagactct

SEQ ID NO: 3677 - DNA, 185 bp, Artificial Sequence; identical to SEQ ID NO: 3676
  Synthetic polynucleotide

SEQ ID NO: 3678 - DNA, 197 bp, Artificial Sequence
  Synthetic polynucleotide
atcatctcaccttgcctcctgaaaccgaggattcagagcctgcaggtaggggatttcccagagataggggatttcccagtcgtaggggatttcccaggactaggggatttcccagctataggggatttcccagacttaggggatttcccagtgctaggggatttcccaggtaggcgcgccatgcttcatcagactct

SEQ ID NO: 3679 - DNA, 197 bp, Artificial Sequence; identical to SEQ ID NO: 3678
  Synthetic polynucleotide

SEQ ID NO: 3680 - DNA, 197 bp, Artificial Sequence
  Synthetic polynucleotide
atcatctcaccttgcctcctgggagaacctacagtcaccctgcagggaaaaggtgtgaaagagagaaaaggtgtgaaagtcggaaaaggtgtgaaaggacgaaaaggtgtgaaagctagaaaaggtgtgaaagactgaaaaggtgtgaaagtgcgaaaaggtgtgaaaggtaggcgcgccatgcttcatcagactct

SEQ ID NO: 3681 - DNA, 197 bp, Artificial Sequence; identical to SEQ ID NO: 3680
  Synthetic polynucleotide

SEQ ID NO: 3682 - DNA, 190 bp, Artificial Sequence
  Synthetic polynucleotide
atcatctcaccttgcctcctgggtagctataatgaactcctgcagggtgttgtttacgttagagtgttgtttacgtttcggtgttgtttacgttgacgtgttgtttacgttctagtgttgtttacgttactgtgttgtttacgtttgcgtgttgtttacgttgtaggcgcgccatgcttcatcagactct

SEQ ID NO: 3683 - DNA, 190 bp, Artificial Sequence; identical to SEQ ID NO: 3682
  Synthetic polynucleotide

SEQ ID NO: 3684 - DNA, 148 bp, Artificial Sequence
  Synthetic polynucleotide
atcatctcaccttgcctcctgataaagtacgtgttagccctgcaggttacgtaagattacgtatcgttacgtagacttacgtactattacgtaactttacgtatgcttacgtagtattacgtaggcgcgccatgcttcatcagactct

SEQ ID NO: 3685 - DNA, 148 bp, Artificial Sequence; identical to SEQ ID NO: 3684
  Synthetic polynucleotide

SEQ ID NO: 3686 - DNA, 172 bp, Artificial Sequence
  Synthetic polynucleotide
atcatctcaccttgcctcctggcgacgcgcatctataccctgcaggacacgcccctagaacacgccccttcgacacgcccctgacacacgcccctctaacacgcccctactacacgccccttgcacacgcccctgtaacacgcccctggcgcgccatgcttcatcagactct

SEQ ID NO: 3687 - DNA, 172 bp, Artificial Sequence; identical to SEQ ID NO: 3686
  Synthetic polynucleotide

SEQ ID NO: 3688 - DNA, 164 bp, Artificial Sequence
  Synthetic polynucleotide
atcatctcaccttgcctcctgtcctgtcttacggctctcctgcaggttgcggtttagattgcggttttcgttgcggtttgacttgcggtttctattgcggtttactttgcggttttgcttgcggtttgtattgcggtttggcgcgccatgcttcatcagactct

SEQ ID NO: 3689 - DNA, 164 bp, Artificial Sequence; identical to SEQ ID NO: 3688
  Synthetic polynucleotide

SEQ ID NO: 3690 - DNA, 156 bp, Artificial Sequence
  Synthetic polynucleotide
atcatctcaccttgcctcctgcacccagcgcgaactaacctgcaggggcttcccagaggcttccctcgggcttcccgacggcttcccctaggcttcccactggcttccctgcggcttcccgtaggcttcccggcgcgccatgcttcatcagactct

SEQ ID NO: 3691 - DNA, 156 bp, Artificial Sequence; identical to SEQ ID NO: 3690
  Synthetic polynucleotide

SEQ ID NO: 3692 - DNA, 197 bp, Artificial Sequence
  Synthetic polynucleotide
atcatctcaccttgcctcctgacacaacgtttcagagccctgcagggtttcacttcctcttagagtttcacttcctctttcggtttcacttcctcttgacgtttcacttcctcttctagtttcacttcctcttactgtttcacttcctctttgcgtttcacttcctcttgtaggcgcgccatgcttcatcagactct

SEQ ID NO: 3693 - DNA, 197 bp, Artificial Sequence; identical to SEQ ID NO: 3692
  Synthetic polynucleotide

SEQ ID NO: 3694 - DNA, 190 bp, Artificial Sequence
  Synthetic polynucleotide
atcatctcaccttgcctcctgtcagtgaaggacgctgccctgcaggtttccaggaaatggagatttccaggaaatggtcgtttccaggaaatgggactttccaggaaatggctatttccaggaaatggacttttccaggaaatggtgctttccaggaaatgggtaggcgcgccatgcttcatcagactct

SEQ ID NO: 3695 - DNA, 190 bp, Artificial Sequence; identical to SEQ ID NO: 3694
  Synthetic polynucleotide

SEQ ID NO: 3696 - DNA, 164 bp, Artificial Sequence
  Synthetic polynucleotide
atcatctcaccttgcctcctgtatcggctgaatttacccctgcaggctgttgccaagactgttgccatcgctgttgccagacctgttgccactactgttgccaactctgttgccatgcctgttgccagtactgttgccaggcgcgccatgcttcatcagactct

SEQ ID NO: 3697 - DNA, 164 bp, Artificial Sequence; identical to SEQ ID NO: 3696
  Synthetic polynucleotide

SEQ ID NO: 3698 - DNA, 164 bp, Artificial Sequence
  Synthetic polynucleotide
atcatctcaccttgcctcctggtatttctacgctggatcctgcaggcgtgccaagagacgtgccaagtcgcgtgccaaggaccgtgccaagctacgtgccaagactcgtgccaagtgccgtgccaaggtacgtgccaagggcgcgccatgcttcatcagactct

SEQ ID NO: 3699 - DNA, 164 bp, Artificial Sequence; identical to SEQ ID NO: 3698
  Synthetic polynucleotide

SEQ ID NO: 3700 - DNA, 180 bp, Artificial Sequence
  Synthetic polynucleotide
atcatctcaccttgcctcctggcgtcactatcaatgggcctgcagggccagctgcggagagccagctgcggtcggccagctgcgggacgccagctgcggctagccagctgcggactgccagctgcggtgcgccagctgcgggtagccagctgcggggcgcgccatgcttcatcagactct

SEQ ID NO: 3701 - DNA, 180 bp, Artificial Sequence; identical to SEQ ID NO: 3700
  Synthetic polynucleotide

SEQ ID NO: 3702 - DNA, 172 bp, Artificial Sequence
  Synthetic polynucleotide
atcatctcaccttgcctcctggtaagctacttacgttacctgcagggtgacgtcatagagtgacgtcattcggtgacgtcatgacgtgacgtcatctagtgacgtcatactgtgacgtcattgcgtgacgtcatgtagtgacgtcatggcgcgccatgcttcatcagactct

SEQ ID NO: 3703 - DNA, 172 bp, Artificial Sequence; identical to SEQ ID NO: 3702
  Synthetic polynucleotide

SEQ ID NO: 3704 - DNA, 197 bp, Artificial Sequence
  Synthetic polynucleotide
atcatctcaccttgcctcctgactcaagcacgtccgcacctgcaggtgtccatggtgctgaagatgtccatggtgctgatcgtgtccatggtgctgagactgtccatggtgctgactatgtccatggtgctgaacttgtccatggtgctgatgctgtccatggtgctgagtaggcgcgccatgcttcatcagactct

SEQ ID NO: 3705 - DNA, 197 bp, Artificial Sequence; identical to SEQ ID NO: 3704
  Synthetic polynucleotide

SEQ ID NO: 3706 - DNA, 148 bp, Artificial Sequence
  Synthetic polynucleotide
atcatctcaccttgcctcctgtttgaatgcctcgtcatcctgcaggcttccggagacttccggtcgcttccgggaccttccggctacttccggactcttccggtgccttccgggtacttccggggcgcgccatgcttcatcagactct

SEQ ID NO: 3707 - DNA, 148 bp, Artificial Sequence; identical to SEQ ID NO: 3706
  Synthetic polynucleotide

SEQ ID NO: 3708 - DNA, 156 bp, Artificial Sequence
  Synthetic polynucleotide
atcatctcaccttgcctcctgtgagtatgcacatgcatcctgcaggaaggggcgagaaaggggcgtcgaaggggcggacaaggggcgctaaaggggcgactaaggggcgtgcaaggggcggtaaaggggcgggcgcgccatgcttcatcagactct

SEQ ID NO: 3709 - DNA, 156 bp, Artificial Sequence; identical to SEQ ID NO: 3708
  Synthetic polynucleotide

SEQ ID NO: 3710 - DNA, 190 bp, Artificial Sequence
  Synthetic polynucleotide
atcatctcaccttgcctcctgaggtaccatgttcgggacctgcagggattgtgcaataccagagattgtgcaatacctcggattgtgcaataccgacgattgtgcaataccctagattgtgcaataccactgattgtgcaatacctgcgattgtgcaataccgtaggcgcgccatgcttcatcagactct

SEQ ID NO: 3711 - DNA, 190 bp, Artificial Sequence; identical to SEQ ID NO: 3710
  Synthetic polynucleotide

SEQ ID NO: 3712 - DNA, 172 bp, Artificial Sequence
  Synthetic polynucleotide
atcatctcaccttgcctcctgtacagatgtgtatgcatcctgcagggccagttgagagagccagttgagtcggccagttgaggacgccagttgagctagccagttgagactgccagttgagtgcgccagttgaggtagccagttgagggcgcgccatgcttcatcagactct

SEQ ID NO: 3713 - DNA, 172 bp, Artificial Sequence; identical to SEQ ID NO: 3712
  Synthetic polynucleotide

SEQ ID NO: 3714 - DNA, 180 bp, Artificial Sequence
  Synthetic polynucleotide
atcatctcaccttgcctcctgcacgagtttcacgttgccctgcaggaggaagtgcaaagaaggaagtgcaatcgaggaagtgcaagacaggaagtgcaactaaggaagtgcaaactaggaagtgcaatgcaggaagtgcaagtaaggaagtgcaaggcgcgccatgcttcatcagactct

SEQ ID NO: 3715 - DNA, 180 bp, Artificial Sequence; identical to SEQ ID NO: 3714
  Synthetic polynucleotide

SEQ ID NO: 3716 - DNA, 172 bp, Artificial Sequence
  Synthetic polynucleotide
atcatctcaccttgcctcctgataactgccgacgctcacctgcagggtgacgtcagagagtgacgtcagtcggtgacgtcaggacgtgacgtcagctagtgacgtcagactgtgacgtcagtgcgtgacgtcaggtagtgacgtcagggcgcgccatgcttcatcagactct

SEQ ID NO: 3717 - DNA, 172 bp, Artificial Sequence; identical to SEQ ID NO: 3716
  Synthetic polynucleotide

SEQ ID NO: 3718 - DNA, 172 bp, Artificial Sequence
  Synthetic polynucleotide
atcatctcaccttgcctcctgccgaaacggagttcaaacctgcaggtgagtaaacaagatgagtaaacatcgtgagtaaacagactgagtaaacactatgagtaaacaacttgagtaaacatgctgagtaaacagtatgagtaaacaggcgcgccatgcttcatcagactct

SEQ ID NO: 3719 - DNA, 172 bp, Artificial Sequence; identical to SEQ ID NO: 3718
  Synthetic polynucleotide

SEQ ID NO: 3720 - DNA, 188 bp, Artificial Sequence
  Synthetic polynucleotide
atcatctcaccttgcctcctgtttcagacgtgttctctcctgcaggagtgggcgtggcagaagtgggcgtggctcgagtgggcgtggcgacagtgggcgtggcctaagtgggcgtggcactagtgggcgtggctgcagtgggcgtggcgtaagtgggcgtggcggcgcgccatgcttcatcagactct

SEQ ID NO: 3721 - DNA, 188 bp, Artificial Sequence; identical to SEQ ID NO: 3720
  Synthetic polynucleotide

SEQ ID NO: 3722 - DNA, 180 bp, Artificial Sequence
  Synthetic polynucleotide
atcatctcaccttgcctcctgatcagtagaaacccacccctgcaggtatgaccttgaagatatgaccttgatcgtatgaccttgagactatgaccttgactatatgaccttgaacttatgaccttgatgctatgaccttgagtatatgaccttgaggcgcgccatgcttcatcagactct

SEQ ID NO: 3723 - DNA, 180 bp, Artificial Sequence; identical to SEQ ID NO: 3722
  Synthetic polynucleotide

SEQ ID NO: 3724 - DNA, 180 bp, Artificial Sequence
  Synthetic polynucleotide
atcatctcaccttgcctcctggttccataacggcaccacctgcaggaaggtgtgaaaagaaaggtgtgaaatcgaaggtgtgaaagacaaggtgtgaaactaaaggtgtgaaaactaaggtgtgaaatgcaaggtgtgaaagtaaaggtgtgaaaggcgcgccatgcttcatcagactct

SEQ ID NO: 3725 - DNA, 180 bp, Artificial Sequence; identical to SEQ ID NO: 3724
  Synthetic polynucleotide

SEQ ID NO: 3726 - DNA, 190 bp, Artificial Sequence
  Synthetic polynucleotide
atcatctcaccttgcctcctgccgaacgtttgtctaggcctgcagggaacccggaagtggagagaacccggaagtggtcggaacccggaagtgggacgaacccggaagtggctagaacccggaagtggactgaacccggaagtggtgcgaacccggaagtgggtaggcgcgccatgcttcatcagactct

SEQ ID NO: 3727 - DNA, 190 bp, Artificial Sequence; identical to SEQ ID NO: 3726
  Synthetic polynucleotide

SEQ ID NO: 3728 - DNA, 185 bp, Artificial Sequence
  Synthetic polynucleotide
atcatctcaccttgcctcctgtgactcgcgttagatgacctgcaggtaaagtcgtaaaacgtagataaagtcgtaaaacgttcgtaaagtcgtaaaacgtgactaaagtcgtaaaacgtctataaagtcgtaaaacgtacttaaagtcgtaaaacgttgcggcgcgccatgcttcatcagactct

SEQ ID NO: 3729 - DNA, 185 bp, Artificial Sequence; identical to SEQ ID NO: 3728
  Synthetic polynucleotide

SEQ ID NO: 3730 - DNA, 172 bp, Artificial Sequence
  Synthetic polynucleotide
atcatctcaccttgcctcctgcataaagcatgattacgcctgcaggctgttctttcagactgttctttctcgctgttctttcgacctgttctttcctactgttctttcactctgttctttctgcctgttctttcgtactgttctttcggcgcgccatgcttcatcagactct

SEQ ID NO: 3731 - DNA, 172 bp, Artificial Sequence; identical to SEQ ID NO: 3730
  Synthetic polynucleotide

SEQ ID NO: 3732 - DNA, 188 bp, Artificial Sequence
  Synthetic polynucleotide
atcatctcaccttgcctcctgcgctaagccgcatagcacctgcaggtttcgcgccaaaagatttcgcgccaaatcgtttcgcgccaaagactttcgcgccaaactatttcgcgccaaaacttttcgcgccaaatgctttcgcgccaaagtatttcgcgccaaaggcgcgccatgcttcatcagactct

SEQ ID NO: 3733 - DNA, 188 bp, Artificial Sequence; identical to SEQ ID NO: 3732
  Synthetic polynucleotide

SEQ ID NO: 3734 - DNA, 197 bp, Artificial Sequence
  Synthetic polynucleotide
atcatctcaccttgcctcctgcaacagcagggtggtgtcctgcaggggtacagggtgttctagaggtacagggtgttcttcgggtacagggtgttctgacggtacagggtgttctctaggtacagggtgttctactggtacagggtgttcttgcggtacagggtgttctgtaggcgcgccatgcttcatcagactct

SEQ ID NO: 3735 - DNA, 197 bp, Artificial Sequence; identical to SEQ ID NO: 3734
  Synthetic polynucleotide

SEQ ID NO: 3736 - DNA, 197 bp, Artificial Sequence
  Synthetic polynucleotide
atcatctcaccttgcctcctgtggcagcgtctattatacctgcaggaaaaatggcgccaaaatgagaaaaaatggcgccaaaatgtcgaaaaatggcgccaaaatggacaaaaatggcgccaaaatgctaaaaaatggcgccaaaatgactaaaaatggcgccaaaatgtgcggcgcgccatgcttcatcagactct

SEQ ID NO: 3737 - DNA, 197 bp, Artificial Sequence; identical to SEQ ID NO: 3736
  Synthetic polynucleotide

SEQ ID NO: 3738 - DNA, 156 bp, Artificial Sequence
  Synthetic polynucleotide
atcatctcaccttgcctcctgtaaactccatcctgtcgcctgcagggtacgtaaagagtacgtaatcggtacgtaagacgtacgtaactagtacgtaaactgtacgtaatgcgtacgtaagtagtacgtaaggcgcgccatgcttcatcagactct

SEQ ID NO: 3739 - DNA, 156 bp, Artificial Sequence; identical to SEQ ID NO: 3738
  Synthetic polynucleotide

SEQ ID NO: 3740 - DNA, 191 bp, Artificial Sequence
  Synthetic polynucleotide
atcatctcaccttgcctcctggatgagagcctacagatcctgcaggtccactaattagcggttagatccactaattagcggtttcgtccactaattagcggttgactccactaattagcggttctatccactaattagcggttacttccactaattagcggtttgcggcgcgccatgcttcatcagactct

SEQ ID NO: 3741 - DNA, 191 bp, Artificial Sequence; identical to SEQ ID NO: 3740
  Synthetic polynucleotide

SEQ ID NO: 3742 - DNA, 172 bp, Artificial Sequence
  Synthetic polynucleotide
atcatctcaccttgcctcctgctgcacaagatctaaagcctgcaggctaaaaataaagactaaaaataatcgctaaaaataagacctaaaaataactactaaaaataaactctaaaaataatgcctaaaaataagtactaaaaataaggcgcgccatgcttcatcagactct

SEQ ID NO: 3743 - DNA, 172 bp, Artificial Sequence; identical to SEQ ID NO: 3742
  Synthetic polynucleotide

SEQ ID NO: 3744 - DNA, 172 bp, Artificial Sequence
  Synthetic polynucleotide
atcatctcaccttgcctcctgtctgagatacccattaacctgcaggaacagctgatagaaacagctgattcgaacagctgatgacaacagctgatctaaacagctgatactaacagctgattgcaacagctgatgtaaacagctgatggcgcgccatgcttcatcagactct

SEQ ID NO: 3745 - DNA, 172 bp, Artificial Sequence; identical to SEQ ID NO: 3744
  Synthetic polynucleotide

SEQ ID NO: 3746 - DNA, 180 bp, Artificial Sequence
  Synthetic polynucleotide
atcatctcaccttgcctcctggcccgtatcatgtttaacctgcaggtgtgaccttggagatgtgaccttggtcgtgtgaccttgggactgtgaccttggctatgtgaccttggacttgtgaccttggtgctgtgaccttgggtatgtgaccttggggcgcgccatgcttcatcagactct

SEQ ID NO: 3747 - DNA, 180 bp, Artificial Sequence; identical to SEQ ID NO: 3746
  Synthetic polynucleotide

SEQ ID NO: 3748 - DNA, 185 bp, Artificial Sequence
  Synthetic polynucleotide
atcatctcaccttgcctcctggacagtccgtgtcattgcctgcaggccacacccaggggttgagaccacacccaggggttgtcgccacacccaggggttggacccacacccaggggttgctaccacacccaggggttgactccacacccaggggttgtgcggcgcgccatgcttcatcagactct

SEQ ID NO: 3749 - DNA, 185 bp, Artificial Sequence; identical to SEQ ID NO: 3748
  Synthetic polynucleotide

SEQ ID NO: 3750 - DNA, 172 bp, Artificial Sequence
  Synthetic polynucleotide
atcatctcaccttgcctcctgaacgcaaagcccggaagcctgcaggttttgttttaagattttgttttatcgttttgttttagacttttgttttactattttgttttaactttttgttttatgcttttgttttagtattttgttttaggcgcgccatgcttcatcagactct

SEQ ID NO: 3751 - DNA, 172 bp, Artificial Sequence; identical to SEQ ID NO: 3750
  Synthetic polynucleotide

SEQ ID NO: 3752 - DNA, 156 bp, Artificial Sequence
  Synthetic polynucleotide
atcatctcaccttgcctcctgtgcgtcttaaccgaccacctgcaggttgcgaaaagattgcgaaatcgttgcgaaagacttgcgaaactattgcgaaaactttgcgaaatgcttgcgaaagtattgcgaaaggcgcgccatgcttcatcagactct

SEQ ID NO: 3753 - DNA, 156 bp, Artificial Sequence; identical to SEQ ID NO: 3752
  Synthetic polynucleotide

SEQ ID NO: 3754 - DNA, 172 bp, Artificial Sequence
  Synthetic polynucleotide
atcatctcaccttgcctcctggaaggctttgaaggcctcctgcaggtagagataagagatagagataagtcgtagagataaggactagagataagctatagagataagacttagagataagtgctagagataaggtatagagataagggcgcgccatgcttcatcagactct

SEQ ID NO: 3755 - DNA, 172 bp, Artificial Sequence; identical to SEQ ID NO: 3754
  Synthetic polynucleotide

SEQ ID NO: 3756 - DNA, 190 bp, Artificial Sequence
  Synthetic polynucleotide
atcatctcaccttgcctcctgaatagagactctccgtacctgcaggaacgtaaccacgtaagaaacgtaaccacgtatcgaacgtaaccacgtagacaacgtaaccacgtactaaacgtaaccacgtaactaacgtaaccacgtatgcaacgtaaccacgtagtaggcgcgccatgcttcatcagactct

SEQ ID NO: 3757 - DNA, 190 bp, Artificial Sequence; identical to SEQ ID NO: 3756
  Synthetic polynucleotide

SEQ ID NO: 3758 - DNA, 172 bp, Artificial Sequence
  Synthetic polynucleotide
atcatctcaccttgcctcctgcgtgtggtgaagtgagacctgcaggcgttgctaagagacgttgctaagtcgcgttgctaaggaccgttgctaagctacgttgctaagactcgttgctaagtgccgttgctaaggtacgttgctaagggcgcgccatgcttcatcagactct

SEQ ID NO: 3759 - DNA, 172 bp, Artificial Sequence; identical to SEQ ID NO: 3758
  Synthetic polynucleotide

SEQ ID NO: 3760 - DNA, 190 bp, Artificial Sequence
  Synthetic polynucleotide
atcatctcaccttgcctcctggatcacttggtgtaaatcctgcaggtcggctcctttgatagatcggctcctttgattcgtcggctcctttgatgactcggctcctttgatctatcggctcctttgatacttcggctcctttgattgctcggctcctttgatgtaggcgcgccatgcttcatcagactct

SEQ ID NO: 3761 - DNA, 190 bp, Artificial Sequence; identical to SEQ ID NO: 3760
  Synthetic polynucleotide

SEQ ID NO: 3762 - DNA, 164 bp, Artificial Sequence
  Synthetic polynucleotide
atcatctcaccttgcctcctgctttacttcgtctcgcccctgcaggcaaaacaatagacaaaacaattcgcaaaacaatgaccaaaacaatctacaaaacaatactcaaaacaattgccaaaacaatgtacaaaacaatggcgcgccatgcttcatcagactct

SEQ ID NO: 3763 - DNA, 164 bp, Artificial Sequence; identical to SEQ ID NO: 3762
  Synthetic polynucleotide

SEQ ID NO: 3764 - DNA, 197 bp, Artificial Sequence
  Synthetic polynucleotide
atcatctcaccttgcctcctgtcacatagggccctcgtcctgcaggccatgccctgaggctagaccatgccctgaggcttcgccatgccctgaggctgacccatgccctgaggctctaccatgccctgaggctactccatgccctgaggcttgcccatgccctgaggctgtaggcgcgccatgcttcatcagactct

SEQ ID NO: 3765 - DNA, 197 bp, Artificial Sequence; identical to SEQ ID NO: 3764
  Synthetic polynucleotide

SEQ ID NO: 3766 - DNA, 156 bp, Artificial Sequence
  Synthetic polynucleotide
atcatctcaccttgcctcctgcaaggttgttcaagtggcctgcaggacataaatagaacataaattcgacataaatgacacataaatctaacataaatactacataaattgcacataaatgtaacataaatggcgcgccatgcttcatcagactct

SEQ ID NO: 3767 - DNA, 156 bp, Artificial Sequence; identical to SEQ ID NO: 3766
  Synthetic polynucleotide

SEQ ID NO: 3768 - DNA, 172 bp, Artificial Sequence
  Synthetic polynucleotide
atcatctcaccttgcctcctgagtcgctgcgccatcatcctgcaggatgcgggtacagaatgcgggtactcgatgcgggtacgacatgcgggtacctaatgcgggtacactatgcgggtactgcatgcgggtacgtaatgcgggtacggcgcgccatgcttcatcagactct

SEQ ID NO: 3769 - DNA, 172 bp, Artificial Sequence; identical to SEQ ID NO: 3768
  Synthetic polynucleotide

SEQ ID NO: 3770 - DNA, 188 bp, Artificial Sequence
  Synthetic polynucleotide
atcatctcaccttgcctcctgtgctatcttaatttgcccctgcaggtgattgcaattaagatgattgcaattatcgtgattgcaattagactgattgcaattactatgattgcaattaacttgattgcaattatgctgattgcaattagtatgattgcaattaggcgcgccatgcttcatcagactct

SEQ ID NO: 3771 - DNA, 188 bp, Artificial Sequence; identical to SEQ ID NO: 3770
  Synthetic polynucleotide

SEQ ID NO: 3772 - DNA, 172 bp, Artificial Sequence
  Synthetic polynucleotide
atcatctcaccttgcctcctggataacagaaacaccgccctgcaggctaattatacagactaattatactcgctaattatacgacctaattatacctactaattatacactctaattatactgcctaattatacgtactaattatacggcgcgccatgcttcatcagactct

SEQ ID NO: 3773 - DNA, 172 bp, Artificial Sequence; identical to SEQ ID NO: 3772
  Synthetic polynucleotide

SEQ ID NO: 3774 - DNA, 188 bp, Artificial Sequence
  Synthetic polynucleotide
atcatctcaccttgcctcctgtgctccctgtctcagaacctgcaggttcggtggtcgcagattcggtggtcgctcgttcggtggtcgcgacttcggtggtcgcctattcggtggtcgcactttcggtggtcgctgcttcggtggtcgcgtattcggtggtcgcggcgcgccatgcttcatcagactct

SEQ ID NO: 3775 - DNA, 188 bp, Artificial Sequence; identical to SEQ ID NO: 3774
  Synthetic polynucleotide

SEQ ID NO: 3776 - DNA, 186 bp, Artificial Sequence
  Synthetic polynucleotide
atcatctcaccttgcctcctgcaaagtgtcggtactaccctgcaggaggtgtgaaatttcacacctagaaggtgtgaaatttcacaccttcgaggtgtgaaatttcacacctgacaggtgtgaaatttcacacctctaaggtgtgaaatttcacacctactggcgcgccatgcttcatcagactct

SEQ ID NO: 3777 - DNA, 186 bp, Artificial Sequence; identical to SEQ ID NO: 3776
  Synthetic polynucleotide

SEQ ID NO: 3778 - DNA, 164 bp, Artificial Sequence
  Synthetic polynucleotide
atcatctcaccttgcctcctgagcgatattgtcacttccctgcagggtcacgtgaagagtcacgtgatcggtcacgtgagacgtcacgtgactagtcacgtgaactgtcacgtgatgcgtcacgtgagtagtcacgtgaggcgcgccatgcttcatcagactct

SEQ ID NO: 3779 - DNA, 164 bp, Artificial Sequence; identical to SEQ ID NO: 3778
  Synthetic polynucleotide

SEQ ID NO: 3780 - DNA, 180 bp, Artificial Sequence
  Synthetic polynucleotide
atcatctcaccttgcctcctgattaccagaaaccacgacctgcaggactaattaattagaactaattaatttcgactaattaattgacactaattaattctaactaattaattactactaattaatttgcactaattaattgtaactaattaattggcgcgccatgcttcatcagactct

SEQ ID NO: 3781 - DNA, 180 bp, Artificial Sequence; identical to SEQ ID NO: 3780
  Synthetic polynucleotide

SEQ ID NO: 3782 - DNA, 156 bp, Artificial Sequence
  Synthetic polynucleotide
atcatctcaccttgcctcctgtgtaccatagatgaactcctgcaggaagtgcgaagaaagtgcgatcgaagtgcgagacaagtgcgactaaagtgcgaactaagtgcgatgcaagtgcgagtaaagtgcgaggcgcgccatgcttcatcagactct

SEQ ID NO: 3783 - DNA, 156 bp, Artificial Sequence; identical to SEQ ID NO: 3782
  Synthetic polynucleotide

SEQ ID NO: 3784 - DNA, 197 bp, Artificial Sequence
  Synthetic polynucleotide
atcatctcaccttgcctcctgtcactacagatgggagtcctgcaggtgacctctggtgacctttagatgacctctggtgaccttttcgtgacctctggtgacctttgactgacctctggtgacctttctatgacctctggtgacctttacttgacctctggtgaccttttgcggcgcgccatgcttcatcagactct

SEQ ID NO: 3785 - DNA, 197 bp, Artificial Sequence; identical to SEQ ID NO: 3784
  Synthetic polynucleotide

SEQ ID NO: 3786 - DNA, 190 bp, Artificial Sequence
  Synthetic polynucleotide
atcatctcaccttgcctcctgtcttctcggatggagaacctgcaggtttgattcgatcatagatttgattcgatcattcgtttgattcgatcatgactttgattcgatcatctatttgattcgatcatacttttgattcgatcattgctttgattcgatcatgtaggcgcgccatgcttcatcagactct

SEQ ID NO: 3787 - DNA, 190 bp, Artificial Sequence; identical to SEQ ID NO: 3786
  Synthetic polynucleotide

SEQ ID NO: 3788 - DNA, 200 bp, Artificial Sequence
  Synthetic polynucleotide
atcatctcaccttgcctcctgccttataccaaggcttgcctgcaggagtttcacttcctctttttagaagtttcacttcctcttttttcgagtttcacttcctctttttgacagtttcacttcctctttttctaagtttcacttcctctttttactagtttcacttcctctttttggcgcgccatgcttcatcagactct

SEQ ID NO: 3789 - DNA, 200 bp, Artificial Sequence; identical to SEQ ID NO: 3788
  Synthetic polynucleotide

SEQ ID NO: 3790 - DNA, 185 bp, Artificial Sequence
  Synthetic polynucleotide
atcatctcaccttgcctcctgtactgttaccctaccagcctgcaggctgaacagatggtcggagactgaacagatggtcggtcgctgaacagatggtcgggacctgaacagatggtcggctactgaacagatggtcggactctgaacagatggtcggtgcggcgcgccatgcttcatcagactct

SEQ ID NO: 3791 - DNA, 185 bp, Artificial Sequence; identical to SEQ ID NO: 3790
  Synthetic polynucleotide

SEQ ID NO: 3792 - DNA, 186 bp, Artificial Sequence
  Synthetic polynucleotide
atcatctcaccttgcctcctggagaccacgagtcagcacctgcaggtcatctttgtttacttttaaagatcatctttgtttacttttaatcgtcatctttgtttacttttaagactcatctttgtttacttttaactatcatctttgtttacttttaaactggcgcgccatgcttcatcagactct

SEQ ID NO: 3793 - DNA, 186 bp, Artificial Sequence; identical to SEQ ID NO: 3792
  Synthetic polynucleotide

SEQ ID NO: 3794 - DNA, 197 bp, Artificial Sequence
  Synthetic polynucleotide
atcatctcaccttgcctcctggttccgctagtgtgagccctgcagggtgaccttataaggtcacagagtgaccttataaggtcactcggtgaccttataaggtcacgacgtgaccttataaggtcacctagtgaccttataaggtcacactgtgaccttataaggtcactgcggcgcgccatgcttcatcagactct

SEQ ID NO: 3795 - DNA, 197 bp, Artificial Sequence; identical to SEQ ID NO: 3794
  Synthetic polynucleotide

SEQ ID NO: 3796 - DNA, 156 bp, Artificial Sequence
  Synthetic polynucleotide
atcatctcaccttgcctcctgatttccctcgtctgtagcctgcaggcctgctgaagacctgctgatcgcctgctgagaccctgctgactacctgctgaactcctgctgatgccctgctgagtacctgctgaggcgcgccatgcttcatcagactct

SEQ ID NO: 3797 - DNA, 156 bp, Artificial Sequence; identical to SEQ ID NO: 3796
  Synthetic polynucleotide

SEQ ID NO: 3798 - DNA, 191 bp, Artificial Sequence
  Synthetic polynucleotide
atcatctcaccttgcctcctgcaaatgacatcgccagtcctgcaggttatctattgttctttaagattatctattgttctttatcgttatctattgttctttagacttatctattgttctttactattatctattgttctttaactttatctattgttctttatgcggcgcgccatgcttcatcagactct

SEQ ID NO: 3799 - DNA, 191 bp, Artificial Sequence; identical to SEQ ID NO: 3798
  Synthetic polynucleotide

SEQ ID NO: 3800 - DNA, 156 bp, Artificial Sequence
  Synthetic polynucleotide
atcatctcaccttgcctcctgtttaccgatacgtcacacctgcaggaccccggaagaaccccggatcgaccccggagacaccccggactaaccccggaactaccccggatgcaccccggagtaaccccggaggcgcgccatgcttcatcagactct

SEQ ID NO: 3801 - DNA, 156 bp, Artificial Sequence; identical to SEQ ID NO: 3800
  Synthetic polynucleotide

SEQ ID NO: 3802 - DNA, 148 bp, Artificial Sequence
  Synthetic polynucleotide
atcatctcaccttgcctcctgacttacccggaccatgtcctgcaggtttaattagatttaatttcgtttaattgactttaattctatttaattacttttaatttgctttaattgtatttaattggcgcgccatgcttcatcagactct

SEQ ID NO: 3803 - DNA, 148 bp, Artificial Sequence; identical to SEQ ID NO: 3802
  Synthetic polynucleotide

SEQ ID NO: 3804 - DNA, 190 bp, Artificial Sequence
  Synthetic polynucleotide
atcatctcaccttgcctcctgaggacacttaggtgcggcctgcaggaattacttcctgtcagaaattacttcctgtctcgaattacttcctgtcgacaattacttcctgtcctaaattacttcctgtcactaattacttcctgtctgcaattacttcctgtcgtaggcgcgccatgcttcatcagactct

SEQ ID NO: 3805 - DNA, 190 bp, Artificial Sequence; identical to SEQ ID NO: 3804
  Synthetic polynucleotide

SEQ ID NO: 3806 - DNA, 172 bp, Artificial Sequence
  Synthetic polynucleotide
atcatctcaccttgcctcctggtgggacgttcccttagcctgcaggggaaatccccagaggaaatcccctcgggaaatccccgacggaaatccccctaggaaatccccactggaaatcccctgcggaaatccccgtaggaaatccccggcgcgccatgcttcatcagactct

SEQ ID NO: 3807 - DNA, 172 bp, Artificial Sequence; identical to SEQ ID NO: 3806
  Synthetic polynucleotide

SEQ ID NO: 3808 - DNA, 188 bp, Artificial Sequence
  Synthetic polynucleotide
atcatctcaccttgcctcctgaacagtccgaggaccatcctgcaggttctagaaagacagattctagaaagactcgttctagaaagacgacttctagaaagacctattctagaaagacactttctagaaagactgcttctagaaagacgtattctagaaagacggcgcgccatgcttcatcagactct

SEQ ID NO: 3809 - DNA, 188 bp, Artificial Sequence; identical to SEQ ID NO: 3808
  Synthetic polynucleotide

SEQ ID NO: 3810 - DNA, 200 bp, Artificial Sequence
  Synthetic polynucleotide
atcatctcaccttgcctcctgctgcatgtgaaggatagcctgcagggtcacgcttggctgcccccagagtcacgcttggctgccccctcggtcacgcttggctgcccccgacgtcacgcttggctgcccccctagtcacgcttggctgcccccactgtcacgcttggctgcccccggcgcgccatgcttcatcagactct

SEQ ID NO: 3811 - DNA, 200 bp, Artificial Sequence; identical to SEQ ID NO: 3810
  Synthetic polynucleotide

SEQ ID NO: 3812 - DNA, 180 bp, Artificial Sequence
  Synthetic polynucleotide
atcatctcaccttgcctcctgagtagcgctttgccgtgcctgcagggaggcggggggagagaggcggggggtcggaggcgggggggacgaggcggggggctagaggcggggggactgaggcggggggtgcgaggcgggggggtagaggcggggggggcgcgccatgcttcatcagactct

SEQ ID NO: 3813 - DNA, 180 bp, Artificial Sequence; identical to SEQ ID NO: 3812
  Synthetic polynucleotide

SEQ ID NO: 3814 - DNA, 190 bp, Artificial Sequence
  Synthetic polynucleotide
atcatctcaccttgcctcctgacctcctgcgatcaagccctgcaggagtaaatattttttagaagtaaatatttttttcgagtaaatattttttgacagtaaatattttttctaagtaaatattttttactagtaaatatttttttgcagtaaatattttttgtaggcgcgccatgcttcatcagactct

SEQ ID NO: 3815 - DNA, 190 bp, Artificial Sequence; identical to SEQ ID NO: 3814
  Synthetic polynucleotide

SEQ ID NO: 3816 - DNA, 172 bp, Artificial Sequence
  Synthetic polynucleotide
atcatctcaccttgcctcctgcacgaggtaacatcgctcctgcaggcctaatccgcagacctaatccgctcgcctaatccgcgaccctaatccgcctacctaatccgcactcctaatccgctgccctaatccgcgtacctaatccgcggcgcgccatgcttcatcagactct

SEQ ID NO: 3817 - DNA, 172 bp, Artificial Sequence; identical to SEQ ID NO: 3816
  Synthetic polynucleotide

SEQ ID NO: 3818 - DNA, 156 bp, Artificial Sequence
  Synthetic polynucleotide
atcatctcaccttgcctcctgacaagtgaaggcccttccctgcagggtacgtcaagagtacgtcatcggtacgtcagacgtacgtcactagtacgtcaactgtacgtcatgcgtacgtcagtagtacgtcaggcgcgccatgcttcatcagactct

SEQ ID NO: 3819 - DNA, 156 bp, Artificial Sequence; identical to SEQ ID NO: 3818
  Synthetic polynucleotide

SEQ ID NO: 3820 - DNA, 180 bp, Artificial Sequence
  Synthetic polynucleotide
atcatctcaccttgcctcctgctgttggtctgctaaatcctgcagggaggtcagggcagagaggtcagggctcggaggtcagggcgacgaggtcagggcctagaggtcagggcactgaggtcagggctgcgaggtcagggcgtagaggtcagggcggcgcgccatgcttcatcagactct

SEQ ID NO: 3821 - DNA, 180 bp, Artificial Sequence; identical to SEQ ID NO: 3820
  Synthetic polynucleotide

SEQ ID NO: 3822 - DNA, 188 bp, Artificial Sequence
  Synthetic polynucleotide
atcatctcaccttgcctcctgatcatcatcttccagatcctgcaggttgcatattcatagattgcatattcattcgttgcatattcatgacttgcatattcatctattgcatattcatactttgcatattcattgcttgcatattcatgtattgcatattcatggcgcgccatgcttcatcagactct

SEQ ID NO: 3823 - DNA, 188 bp, Artificial Sequence; identical to SEQ ID NO: 3822
  Synthetic polynucleotide

SEQ ID NO: 3824 - DNA, 191 bp, Artificial Sequence
  Synthetic polynucleotide
atcatctcaccttgcctcctgcgacagaaagtggtccccctgcaggtactaagtacttaaatgagatactaagtacttaaatgtcgtactaagtacttaaatggactactaagtacttaaatgctatactaagtacttaaatgacttactaagtacttaaatgtgcggcgcgccatgcttcatcagactct

SEQ ID NO: 3825 - DNA, 191 bp, Artificial Sequence; identical to SEQ ID NO: 3824
  Synthetic polynucleotide

SEQ ID NO: 3826 - DNA, 191 bp, Artificial Sequence
  Synthetic polynucleotide
atcatctcaccttgcctcctgtagaagatccactggtgcctgcaggaatagggtatcatatatagaaatagggtatcatatattcgaatagggtatcatatatgacaatagggtatcatatatctaaatagggtatcatatatactaatagggtatcatatattgcggcgcgccatgcttcatcagactct

SEQ ID NO: 3827 - DNA, 191 bp, Artificial Sequence; identical to SEQ ID NO: 3826
  Synthetic polynucleotide

SEQ ID NO: 3828 - DNA, 191 bp, Artificial Sequence
  Synthetic polynucleotide
atcatctcaccttgcctcctgatctcggcctatagcggcctgcaggacccctaattagcggtgagaacccctaattagcggtgtcgacccctaattagcggtggacacccctaattagcggtgctaacccctaattagcggtgactacccctaattagcggtgtgcggcgcgccatgcttcatcagactct

SEQ ID NO: 3829 - DNA, 191 bp, Artificial Sequence; identical to SEQ ID NO: 3828
  Synthetic polynucleotide

SEQ ID NO: 3830 - DNA, 190 bp, Artificial Sequence
  Synthetic polynucleotide
atcatctcaccttgcctcctgaatcgtcaccctgtaaccctgcaggagttaatatttactagaagttaatatttacttcgagttaatatttactgacagttaatatttactctaagttaatatttactactagttaatatttacttgcagttaatatttactgtaggcgcgccatgcttcatcagactct

SEQ ID NO: 3831 - DNA, 190 bp, Artificial Sequence; identical to SEQ ID NO: 3830
  Synthetic polynucleotide

SEQ ID NO: 3832 - DNA, 188 bp, Artificial Sequence
  Synthetic polynucleotide
atcatctcaccttgcctcctgtccatccactcctataccctgcagggggtcatgacccagagggtcatgaccctcggggtcatgacccgacgggtcatgacccctagggtcatgacccactgggtcatgaccctgcgggtcatgacccgtagggtcatgacccggcgcgccatgcttcatcagactct

SEQ ID NO: 3833 - DNA, 188 bp, Artificial Sequence; identical to SEQ ID NO: 3832
  Synthetic polynucleotide

SEQ ID NO: 3834 - DNA, 172 bp, Artificial Sequence
  Synthetic polynucleotide
atcatctcaccttgcctcctgaatgagacgttcggatacctgcaggcccgccccccagacccgcccccctcgcccgccccccgaccccgccccccctacccgccccccactcccgcccccctgccccgccccccgtacccgccccccggcgcgccatgcttcatcagactct

SEQ ID NO: 3835 - DNA, 172 bp, Artificial Sequence; identical to SEQ ID NO: 3834
  Synthetic polynucleotide

SEQ ID NO: 3836 - DNA, 200 bp, Artificial Sequence
  Synthetic polynucleotide
atcatctcaccttgcctcctgtactcgctcaaggtcctcctgcagggagggcttaatggcttcgtagagagggcttaatggcttcgttcggagggcttaatggcttcgtgacgagggcttaatggcttcgtctagagggcttaatggcttcgtactgagggcttaatggcttcgtggcgcgccatgcttcatcagactct

SEQ ID NO: 3837 - DNA, 200 bp, Artificial Sequence; identical to SEQ ID NO: 3836
  Synthetic polynucleotide

SEQ ID NO: 3838 - DNA, 190 bp, Artificial Sequence
  Synthetic polynucleotide
atcatctcaccttgcctcctgaatcggaagagcaccatcctgcaggaatgtaaacaacacagaaatgtaaacaacactcgaatgtaaacaacacgacaatgtaaacaacacctaaatgtaaacaacacactaatgtaaacaacactgcaatgtaaacaacacgtaggcgcgccatgcttcatcagactct

SEQ ID NO: 3839 - DNA, 190 bp, Artificial Sequence; identical to SEQ ID NO: 3838
  Synthetic polynucleotide

SEQ ID NO: 3840 - DNA, 190 bp, Artificial Sequence
  Synthetic polynucleotide
atcatctcaccttgcctcctgcagacacgatagtaccccctgcaggtaattggccaattaagataattggccaattatcgtaattggccaattagactaattggccaattactataattggccaattaacttaattggccaattatgctaattggccaattagtaggcgcgccatgcttcatcagactct

SEQ ID NO: 3841 - DNA, 190 bp, Artificial Sequence; identical to SEQ ID NO: 3840
  Synthetic polynucleotide

SEQ ID NO: 3842 - DNA, 197 bp, Artificial Sequence
  Synthetic polynucleotide
atcatctcaccttgcctcctgaaagtgtttggtggccgcctgcagggagacaggaagtgggagagagacaggaagtgggtcggagacaggaagtggggacgagacaggaagtgggctagagacaggaagtgggactgagacaggaagtgggtgcgagacaggaagtggggtaggcgcgccatgcttcatcagactct

SEQ ID NO: 3843 - DNA, 197 bp, Artificial Sequence; identical to SEQ ID NO: 3842
  Synthetic polynucleotide

SEQ ID NO: 3844 - DNA, 191 bp, Artificial Sequence
  Synthetic polynucleotide
atcatctcaccttgcctcctgagacagtcatccatacccctgcaggaggattttacgaccttaagaaggattttacgaccttatcgaggattttacgaccttagacaggattttacgaccttactaaggattttacgaccttaactaggattttacgaccttatgcggcgcgccatgcttcatcagactct

SEQ ID NO: 3845 - DNA, 191 bp, Artificial Sequence; identical to SEQ ID NO: 3844
  Synthetic polynucleotide

SEQ ID NO: 3846 - DNA, 188 bp, Artificial Sequence
  Synthetic polynucleotide
atcatctcaccttgcctcctgtttgataaagacccagacctgcaggcgccggcgggcgagacgccggcgggcgtcgcgccggcgggcggaccgccggcgggcgctacgccggcgggcgactcgccggcgggcgtgccgccggcgggcggtacgccggcgggcgggcgcgccatgcttcatcagactct

SEQ ID NO: 3847 - DNA, 188 bp, Artificial Sequence; identical to SEQ ID NO: 3846
  Synthetic polynucleotide

SEQ ID NO: 3848 - DNA, 185 bp, Artificial Sequence
  Synthetic polynucleotide
atcatctcaccttgcctcctgagacactgtgcagacctcctgcaggataattaatgacctccagaataattaatgacctcctcgataattaatgacctccgacataattaatgacctccctaataattaatgacctccactataattaatgacctcctgcggcgcgccatgcttcatcagactct

SEQ ID NO: 3849 - DNA, 185 bp, Artificial Sequence; identical to SEQ ID NO: 3848
  Synthetic polynucleotide

SEQ ID NO: 3850 - DNA, 148 bp, Artificial Sequence
  Synthetic polynucleotide
atcatctcaccttgcctcctgtcccaagcaatcggtgacctgcaggagataagagaagataagtcgagataaggacagataagctaagataagactagataagtgcagataaggtaagataagggcgcgccatgcttcatcagactct

SEQ ID NO: 3851 - DNA, 148 bp, Artificial Sequence; identical to SEQ ID NO: 3850
  Synthetic polynucleotide

SEQ ID NO: 3852 - DNA, 186 bp, Artificial Sequence
  Synthetic polynucleotide
atcatctcaccttgcctcctgtgttagtgcgatggtgccctgcagggggggggggcggggccggggagagggggggggcggggccggggtcggggggggggcggggccgggggacgggggggggcggggccggggctagggggggggcggggccggggactggcgcgccatgcttcatcagactct

SEQ ID NO: 3853 - DNA, 186 bp, Artificial Sequence; identical to SEQ ID NO: 3852
  Synthetic polynucleotide

SEQ ID NO: 3854 - DNA, 172 bp, Artificial Sequence
  Synthetic polynucleotide
atcatctcaccttgcctcctgactagtccttcacttgccctgcaggatcacgtggtagaatcacgtggttcgatcacgtggtgacatcacgtggtctaatcacgtggtactatcacgtggttgcatcacgtggtgtaatcacgtggtggcgcgccatgcttcatcagactct

SEQ ID NO: 3855 - DNA, 172 bp, Artificial Sequence; identical to SEQ ID NO: 3854
  Synthetic polynucleotide

SEQ ID NO: 3856 - DNA, 172 bp, Artificial Sequence
  Synthetic polynucleotide
atcatctcaccttgcctcctggcaccatcgtagctttgcctgcaggaatgacactaagaaatgacactatcgaatgacactagacaatgacactactaaatgacactaactaatgacactatgcaatgacactagtaaatgacactaggcgcgccatgcttcatcagactct

SEQ ID NO: 3857 - DNA, 172 bp, Artificial Sequence; identical to SEQ ID NO: 3856
  Synthetic polynucleotide

SEQ ID NO: 3858 - DNA, 188 bp, Artificial Sequence
  Synthetic polynucleotide
atcatctcaccttgcctcctgtcaagacccaaggacaacctgcaggatcaaccgatagagaatcaaccgatagtcgatcaaccgataggacatcaaccgatagctaatcaaccgatagactatcaaccgatagtgcatcaaccgataggtaatcaaccgatagggcgcgccatgcttcatcagactct

SEQ ID NO: 3859 - DNA, 188 bp, Artificial Sequence; identical to SEQ ID NO: 3858
  Synthetic polynucleotide

SEQ ID NO: 3860 - DNA, 156 bp, Artificial Sequence
  Synthetic polynucleotide
atcatctcaccttgcctcctggaaacatggacgtacatcctgcaggttaataaaagattaataaatcgttaataaagacttaataaactattaataaaactttaataaatgcttaataaagtattaataaaggcgcgccatgcttcatcagactct

SEQ ID NO: 3861 - DNA, 156 bp, Artificial Sequence; identical to SEQ ID NO: 3860
  Synthetic polynucleotide

SEQ ID NO: 3862 - DNA, 188 bp, Artificial Sequence
  Synthetic polynucleotide
atcatctcaccttgcctcctggttatgctcgacactgacctgcaggtttgacacctttagatttgacaccttttcgtttgacacctttgactttgacacctttctatttgacacctttacttttgacaccttttgctttgacacctttgtatttgacacctttggcgcgccatgcttcatcagactct

SEQ ID NO: 3863 - DNA, 188 bp, Artificial Sequence; identical to SEQ ID NO: 3862
  Synthetic polynucleotide

SEQ ID NO: 3864 - DNA, 188 bp, Artificial Sequence
  Synthetic polynucleotide
atcatctcaccttgcctcctgcgttactggtgttccaacctgcagggccacgcccattagagccacgcccatttcggccacgcccattgacgccacgcccattctagccacgcccattactgccacgcccatttgcgccacgcccattgtagccacgcccattggcgcgccatgcttcatcagactct

SEQ ID NO: 3865 - DNA, 188 bp, Artificial Sequence; identical to SEQ ID NO: 3864
  Synthetic polynucleotide

SEQ ID NO: 3866 - DNA, 200 bp, Artificial Sequence
  Synthetic polynucleotide
atcatctcaccttgcctcctgccgcctcatccgttacacctgcaggggaaaagaacaatgggttcagaggaaaagaacaatgggttctcgggaaaagaacaatgggttcgacggaaaagaacaatgggttcctaggaaaagaacaatgggttcactggaaaagaacaatgggttcggcgcgccatgcttcatcagactct

SEQ ID NO: 3867 - DNA, 200 bp, Artificial Sequence; identical to SEQ ID NO: 3866
  Synthetic polynucleotide

SEQ ID NO: 3868 - DNA, 172 bp, Artificial Sequence
  Synthetic polynucleotide
atcatctcaccttgcctcctgcgatgtattctatcaaccctgcaggcccgccccctagacccgcccccttcgcccgccccctgaccccgccccctctacccgccccctactcccgcccccttgccccgccccctgtacccgccccctggcgcgccatgcttcatcagactct

SEQ ID NO: 3869 - DNA, 172 bp, Artificial Sequence; identical to SEQ ID NO: 3868
  Synthetic polynucleotide

SEQ ID NO: 3870 - DNA, 191 bp, Artificial Sequence
  Synthetic polynucleotide
atcatctcaccttgcctcctgaacatagggatggagagcctgcagggaacaatgttattgttcagagaacaatgttattgttctcggaacaatgttattgttcgacgaacaatgttattgttcctagaacaatgttattgttcactgaacaatgttattgttctgcggcgcgccatgcttcatcagactct

SEQ ID NO: 3871 - DNA, 191 bp, Artificial Sequence; identical to SEQ ID NO: 3870
  Synthetic polynucleotide

SEQ ID NO: 3872 - DNA, 188 bp, Artificial Sequence
  Synthetic polynucleotide
atcatctcaccttgcctcctgacttcattatccgaggacctgcagggtctgagtcatgagagtctgagtcatgtcggtctgagtcatggacgtctgagtcatgctagtctgagtcatgactgtctgagtcatgtgcgtctgagtcatggtagtctgagtcatgggcgcgccatgcttcatcagactct

SEQ ID NO: 3873 - DNA, 188 bp, Artificial Sequence; identical to SEQ ID NO: 3872
  Synthetic polynucleotide

SEQ ID NO: 3874 - DNA, 164 bp, Artificial Sequence
  Synthetic polynucleotide
atcatctcaccttgcctcctgagatctcaatgtggacgcctgcagggtcacgtgcagagtcacgtgctcggtcacgtgcgacgtcacgtgcctagtcacgtgcactgtcacgtgctgcgtcacgtgcgtagtcacgtgcggcgcgccatgcttcatcagactct

SEQ ID NO: 3875 - DNA, 164 bp, Artificial Sequence; identical to SEQ ID NO: 3874
  Synthetic polynucleotide

SEQ ID NO: 3876 - DNA, 172 bp, Artificial Sequence
  Synthetic polynucleotide
atcatctcaccttgcctcctgcggcatgcaataagcgccctgcagggggggcggggagagggggcggggtcggggggcgggggacgggggcggggctagggggcggggactgggggcggggtgcgggggcgggggtagggggcggggggcgcgccatgcttcatcagactct

SEQ ID NO: 3877 - DNA, 172 bp, Artificial Sequence; identical to SEQ ID NO: 3876
  Synthetic polynucleotide

SEQ ID NO: 3878 - DNA, 197 bp, Artificial Sequence
  Synthetic polynucleotide
atcatctcaccttgcctcctgtcttgttagcttatgtccctgcaggggcacccaagggtgcagaggcacccaagggtgctcgggcacccaagggtgcgacggcacccaagggtgcctaggcacccaagggtgcactggcacccaagggtgctgcggcacccaagggtgcgtaggcgcgccatgcttcatcagactct

SEQ ID NO: 3879 - DNA, 197 bp, Artificial Sequence; identical to SEQ ID NO: 3878
  Synthetic polynucleotide

SEQ ID NO: 3880 - DNA, 188 bp, Artificial Sequence
  Synthetic polynucleotide
atcatctcaccttgcctcctggtgatgagcatccgtcacctgcaggttgcgtgggcgtagattgcgtgggcgttcgttgcgtgggcgtgacttgcgtgggcgtctattgcgtgggcgtactttgcgtgggcgttgcttgcgtgggcgtgtattgcgtgggcgtggcgcgccatgcttcatcagactct

SEQ ID NO: 3881 - DNA, 188 bp, Artificial Sequence; identical to SEQ ID NO: 3880
  Synthetic polynucleotide

SEQ ID NO: 3882 - DNA, 164 bp, Artificial Sequence
  Synthetic polynucleotide
atcatctcaccttgcctcctgatacaacggcagcatgtcctgcagggtccttgaaagagtccttgaatcggtccttgaagacgtccttgaactagtccttgaaactgtccttgaatgcgtccttgaagtagtccttgaaggcgcgccatgcttcatcagactct

SEQ ID NO: 3883 - DNA, 164 bp, Artificial Sequence; identical to SEQ ID NO: 3882
  Synthetic polynucleotide

SEQ ID NO: 3884 - DNA, 200 bp, Artificial Sequence
  Synthetic polynucleotide
atcatctcaccttgcctcctgatgagtcatattcggtccctgcaggtttcacgcatgactgcacaagatttcacgcatgactgcacatcgtttcacgcatgactgcacagactttcacgcatgactgcacactatttcacgcatgactgcacaacttttcacgcatgactgcacaggcgcgccatgcttcatcagactct

SEQ ID NO: 3885 - DNA, 200 bp, Artificial Sequence; identical to SEQ ID NO: 3884
  Synthetic polynucleotide

SEQ ID NO: 3886 - DNA, 164 bp, Artificial Sequence
  Synthetic polynucleotide
atcatctcaccttgcctcctgaaagcattccaatccaacctgcagggagtttattagagagtttatttcggagtttattgacgagtttattctagagtttattactgagtttatttgcgagtttattgtagagtttattggcgcgccatgcttcatcagactct

SEQ ID NO: 3887 - DNA, 164 bp, Artificial Sequence; identical to SEQ ID NO: 3886
  Synthetic polynucleotide

SEQ ID NO: 3888 - DNA, 185 bp, Artificial Sequence
  Synthetic polynucleotide
atcatctcaccttgcctcctgcagaccttcgaggcgatcctgcaggttaattagctcattaaagattaattagctcattaatcgttaattagctcattaagacttaattagctcattaactattaattagctcattaaactttaattagctcattaatgcggcgcgccatgcttcatcagactct

SEQ ID NO: 3889 - DNA, 185 bp, Artificial Sequence; identical to SEQ ID NO: 3888
  Synthetic polynucleotide

SEQ ID NO: 3890 - DNA, 172 bp, Artificial Sequence
  Synthetic polynucleotide
atcatctcaccttgcctcctgactcgcgaactgttgttcctgcaggcgcacctgctagacgcacctgcttcgcgcacctgctgaccgcacctgctctacgcacctgctactcgcacctgcttgccgcacctgctgtacgcacctgctggcgcgccatgcttcatcagactct

SEQ ID NO: 3891 - DNA, 172 bp, Artificial Sequence; identical to SEQ ID NO: 3890
  Synthetic polynucleotide

SEQ ID NO: 3892 - DNA, 200 bp, Artificial Sequence
  Synthetic polynucleotide
atcatctcaccttgcctcctggggacaaacgttaacggcctgcaggttcaatatgcaaatttcggagattcaatatgcaaatttcggtcgttcaatatgcaaatttcgggacttcaatatgcaaatttcggctattcaatatgcaaatttcggactttcaatatgcaaatttcggggcgcgccatgcttcatcagactct

SEQ ID NO: 3893 - DNA, 200 bp, Artificial Sequence; identical to SEQ ID NO: 3892
  Synthetic polynucleotide

SEQ ID NO: 3894 - DNA, 197 bp, Artificial Sequence
  Synthetic polynucleotide
atcatctcaccttgcctcctgaagggctggttacatagcctgcaggaaaaagaggaagtgaagaaaaaagaggaagtgatcgaaaaagaggaagtgagacaaaaagaggaagtgactaaaaaagaggaagtgaactaaaaagaggaagtgatgcaaaaagaggaagtgagtaggcgcgccatgcttcatcagactct

SEQ ID NO: 3895 - DNA, 197 bp, Artificial Sequence; identical to SEQ ID NO: 3894
  Synthetic polynucleotide

SEQ ID NO: 3896 - DNA, 185 bp, Artificial Sequence
  Synthetic polynucleotide
atcatctcaccttgcctcctgcagaagtgcttaaacagcctgcaggagaattttattggtagagaagaattttattggtagtcgagaattttattggtaggacagaattttattggtagctaagaattttattggtagactagaattttattggtagtgcggcgcgccatgcttcatcagactct

SEQ ID NO: 3897 - DNA, 185 bp, Artificial Sequence; identical to SEQ ID NO: 3896
  Synthetic polynucleotide

SEQ ID NO: 3898 - DNA, 197 bp, Artificial Sequence
  Synthetic polynucleotide
atcatctcaccttgcctcctgtattcagtgaagaagcccctgcaggaaaaagaggaagtggagaaaaaagaggaagtggtcgaaaaagaggaagtgggacaaaaagaggaagtggctaaaaaagaggaagtggactaaaaagaggaagtggtgcaaaaagaggaagtgggtaggcgcgccatgcttcatcagactct

SEQ ID NO: 3899 - DNA, 197 bp, Artificial Sequence; identical to SEQ ID NO: 3898
  Synthetic polynucleotide

SEQ ID NO: 3900 - DNA, 197 bp, Artificial Sequence
  Synthetic polynucleotide
atcatctcaccttgcctcctggactgaacatagtagtccctgcaggaacactgcaattgttagaaacactgcaattgtttcgaacactgcaattgttgacaacactgcaattgttctaaacactgcaattgttactaacactgcaattgtttgcaacactgcaattgttgtaggcgcgccatgcttcatcagactct

SEQ ID NO: 3901 - DNA, 197 bp, Artificial Sequence; identical to SEQ ID NO: 3900
  Synthetic polynucleotide

SEQ ID NO: 3902 - DNA, 200 bp, Artificial Sequence
  Synthetic polynucleotide
atcatctcaccttgcctcctggttggtaagatctggaccctgcaggaacacggatatctgtggtcagaaacacggatatctgtggtctcgaacacggatatctgtggtcgacaacacggatatctgtggtcctaaacacggatatctgtggtcactaacacggatatctgtggtcggcgcgccatgcttcatcagactct

SEQ ID NO: 3903 - DNA, 200 bp, Artificial Sequence; identical to SEQ ID NO: 3902
  Synthetic polynucleotide

SEQ ID NO: 3904 - DNA, 197 bp, Artificial Sequence
  Synthetic polynucleotide
atcatctcaccttgcctcctgtactcaaagtgagcttacctgcaggcccgggtgcccggggagacccgggtgcccggggtcgcccgggtgcccgggggaccccgggtgcccggggctacccgggtgcccggggactcccgggtgcccggggtgccccgggtgcccgggggtaggcgcgccatgcttcatcagactct

SEQ ID NO: 3905 - DNA, 197 bp, Artificial Sequence; identical to SEQ ID NO: 3904
  Synthetic polynucleotide

SEQ ID NO: 3906 - DNA, 172 bp, Artificial Sequence
  Synthetic polynucleotide
atcatctcaccttgcctcctgtgaaatggcgcgataggcctgcaggattgcgtaatagaattgcgtaattcgattgcgtaatgacattgcgtaatctaattgcgtaatactattgcgtaattgcattgcgtaatgtaattgcgtaatggcgcgccatgcttcatcagactct

SEQ ID NO: 3907 - DNA, 172 bp, Artificial Sequence; identical to SEQ ID NO: 3906
  Synthetic polynucleotide

SEQ ID NO: 3908 - DNA, 132 bp, Artificial Sequence
  Synthetic polynucleotide
atcatctcaccttgcctcctgtctaggccgattcggaacctgcaggaattaagaaattatcgaattagacaattactaaattaactaattatgcaattagtaaattaggcgcgccatgcttcatcagactct

SEQ ID NO: 3909 - DNA, 132 bp, Artificial Sequence; identical to SEQ ID NO: 3908
  Synthetic polynucleotide

SEQ ID NO: 3910 - DNA, 180 bp, Artificial Sequence
  Synthetic polynucleotide
atcatctcaccttgcctcctgactcgccctcggaaatacctgcagggttgctcatttagagttgctcattttcggttgctcatttgacgttgctcatttctagttgctcatttactgttgctcattttgcgttgctcatttgtagttgctcatttggcgcgccatgcttcatcagactct

SEQ ID NO: 3911 - DNA, 180 bp, Artificial Sequence; identical to SEQ ID NO: 3910
  Synthetic polynucleotide

SEQ ID NO: 3912 - DNA, 180 bp, Artificial Sequence
  Synthetic polynucleotide
atcatctcaccttgcctcctgctagggactagattggccctgcaggaaaagtaaacaagaaaaagtaaacatcgaaaagtaaacagacaaaagtaaacactaaaaagtaaacaactaaaagtaaacatgcaaaagtaaacagtaaaaagtaaacaggcgcgccatgcttcatcagactct

SEQ ID NO: 3913 - DNA, 180 bp, Artificial Sequence; identical to SEQ ID NO: 3912
  Synthetic polynucleotide

SEQ ID NO: 3914 - DNA, 196 bp, Artificial Sequence
  Synthetic polynucleotide
atcatctcaccttgcctcctgaagatgggtcgcaatatcctgcaggtgccacgtcatcaagatgccacgtcatcatcgtgccacgtcatcagactgccacgtcatcactatgccacgtcatcaacttgccacgtcatcatgctgccacgtcatcagtatgccacgtcatcaggcgcgccatgcttcatcagactct

SEQ ID NO: 3915 - DNA, 196 bp, Artificial Sequence; identical to SEQ ID NO: 3914
  Synthetic polynucleotide

SEQ ID NO: 3916 - DNA, 188 bp, Artificial Sequence
  Synthetic polynucleotide
atcatctcaccttgcctcctgcggctacatcaaggtagcctgcaggaattttacgaccagaaattttacgacctcgaattttacgaccgacaattttacgaccctaaattttacgaccactaattttacgacctgcaattttacgaccgtaaattttacgaccggcgcgccatgcttcatcagactct

SEQ ID NO: 3917 - DNA, 188 bp, Artificial Sequence; identical to SEQ ID NO: 3916
  Synthetic polynucleotide

SEQ ID NO: 3918 - DNA, 196 bp, Artificial Sequence
  Synthetic polynucleotide
atcatctcaccttgcctcctgtcgttatttgtcgcttgcctgcaggacacaggtaagtaagaacacaggtaagtatcgacacaggtaagtagacacacaggtaagtactaacacaggtaagtaactacacaggtaagtatgcacacaggtaagtagtaacacaggtaagtaggcgcgccatgcttcatcagactct

SEQ ID NO: 3919 - DNA, 196 bp, Artificial Sequence; identical to SEQ ID NO: 3918
  Synthetic polynucleotide

SEQ ID NO: 3920 - DNA, 197 bp, Artificial Sequence
  Synthetic polynucleotide
atcatctcaccttgcctcctgtgcgttccggatgatgccctgcagggccaccagggggcacagagccaccagggggcactcggccaccagggggcacgacgccaccagggggcacctagccaccagggggcacactgccaccagggggcactgcgccaccagggggcacgtaggcgcgccatgcttcatcagactct

SEQ ID NO: 3921 - DNA, 197 bp, Artificial Sequence; identical to SEQ ID NO: 3920
  Synthetic polynucleotide

SEQ ID NO: 3922 - DNA, 188 bp, Artificial Sequence
  Synthetic polynucleotide
atcatctcaccttgcctcctgtcaagctcgccgacttgcctgcagggcttgtttacatagagcttgtttacattcggcttgtttacatgacgcttgtttacatctagcttgtttacatactgcttgtttacattgcgcttgtttacatgtagcttgtttacatggcgcgccatgcttcatcagactct

SEQ ID NO: 3923 - DNA, 188 bp, Artificial Sequence; identical to SEQ ID NO: 3922
  Synthetic polynucleotide

SEQ ID NO: 3924 - DNA, 185 bp, Artificial Sequence
  Synthetic polynucleotide
atcatctcaccttgcctcctgttgcacttgagttcaagcctgcaggtaaagtcgtaaaacatagataaagtcgtaaaacattcgtaaagtcgtaaaacatgactaaagtcgtaaaacatctataaagtcgtaaaacatacttaaagtcgtaaaacattgcggcgcgccatgcttcatcagactct

SEQ ID NO: 3925 - DNA, 185 bp, Artificial Sequence; identical to SEQ ID NO: 3924
  Synthetic polynucleotide

SEQ ID NO: 3926 - DNA, 190 bp, Artificial Sequence
  Synthetic polynucleotide
atcatctcaccttgcctcctgaagttccatcaacgtgtcctgcaggtgtttatgtaaatgagatgtttatgtaaatgtcgtgtttatgtaaatggactgtttatgtaaatgctatgtttatgtaaatgacttgtttatgtaaatgtgctgtttatgtaaatggtaggcgcgccatgcttcatcagactct

SEQ ID NO: 3927 - DNA, 190 bp, Artificial Sequence; identical to SEQ ID NO: 3926
  Synthetic polynucleotide

SEQ ID NO: 3928 - DNA, 180 bp, Artificial Sequence
  Synthetic polynucleotide
atcatctcaccttgcctcctgcttattggcgacagcaccctgcaggtatgcaaatcaagatatgcaaatcatcgtatgcaaatcagactatgcaaatcactatatgcaaatcaacttatgcaaatcatgctatgcaaatcagtatatgcaaatcaggcgcgccatgcttcatcagactct

SEQ ID NO: 3929 - DNA, 180 bp, Artificial Sequence; identical to SEQ ID NO: 3928
  Synthetic polynucleotide

SEQ ID NO: 3930 - DNA, 148 bp, Artificial Sequence
  Synthetic polynucleotide
atcatctcaccttgcctcctgctttaacagtctgcgtacctgcaggaagcttgagaaagcttgtcgaagcttggacaagcttgctaaagcttgactaagcttgtgcaagcttggtaaagcttgggcgcgccatgcttcatcagactct

SEQ ID NO: 3931 - DNA, 148 bp, Artificial Sequence; identical to SEQ ID NO: 3930
  Synthetic polynucleotide

SEQ ID NO: 3932 - DNA, 156 bp, Artificial Sequence
  Synthetic polynucleotide
atcatctcaccttgcctcctggcagatgtgacttcagacctgcaggcttccgttagacttccgtttcgcttccgttgaccttccgttctacttccgttactcttccgtttgccttccgttgtacttccgttggcgcgccatgcttcatcagactct

SEQ ID NO: 3933 - DNA, 156 bp, Artificial Sequence; identical to SEQ ID NO: 3932
  Synthetic polynucleotide

SEQ ID NO: 3934 - DNA, 197 bp, Artificial Sequence
  Synthetic polynucleotide
atcatctcaccttgcctcctgaatcccgataagaagagcctgcaggcagtccgaaggtcaccgcagacagtccgaaggtcaccgctcgcagtccgaaggtcaccgcgaccagtccgaaggtcaccgcctacagtccgaaggtcaccgcactcagtccgaaggtcaccgctgcggcgcgccatgcttcatcagactct

SEQ ID NO: 3935 - DNA, 197 bp, Artificial Sequence; identical to SEQ ID NO: 3934
  Synthetic polynucleotide

SEQ ID NO: 3936 - DNA, 172 bp, Artificial Sequence
  Synthetic polynucleotide
atcatctcaccttgcctcctgaagtctgagaagaggtgcctgcagggattgcgtaaagagattgcgtaatcggattgcgtaagacgattgcgtaactagattgcgtaaactgattgcgtaatgcgattgcgtaagtagattgcgtaaggcgcgccatgcttcatcagactct

SEQ ID NO: 3937 - DNA, 172 bp, Artificial Sequence; identical to SEQ ID NO: 3936
  Synthetic polynucleotide

SEQ ID NO: 3938 - DNA, 188 bp, Artificial Sequence
  Synthetic polynucleotide
atcatctcaccttgcctcctgcggtccttaagccctgtcctgcaggaattcctggaaaagaaattcctggaaatcgaattcctggaaagacaattcctggaaactaaattcctggaaaactaattcctggaaatgcaattcctggaaagtaaattcctggaaaggcgcgccatgcttcatcagactct

SEQ ID NO: 3939 - DNA, 188 bp, Artificial Sequence; identical to SEQ ID NO: 3938
  Synthetic polynucleotide

SEQ ID NO: 3940 - DNA, 196 bp, Artificial Sequence
  Synthetic polynucleotide
atcatctcaccttgcctcctgcctcagtcgacttcacacctgcaggctaattaaattagagactaattaaattagtcgctaattaaattaggacctaattaaattagctactaattaaattagactctaattaaattagtgcctaattaaattaggtactaattaaattagggcgcgccatgcttcatcagactct

SEQ ID NO: 3941 - DNA, 196 bp, Artificial Sequence; identical to SEQ ID NO: 3940
  Synthetic polynucleotide

SEQ ID NO: 3942 - DNA, 180 bp, Artificial Sequence
  Synthetic polynucleotide
atcatctcaccttgcctcctgccagcccatctcaacgtcctgcaggagcaataaaaaagaagcaataaaaatcgagcaataaaaagacagcaataaaaactaagcaataaaaaactagcaataaaaatgcagcaataaaaagtaagcaataaaaaggcgcgccatgcttcatcagactct

SEQ ID NO: 3943 - DNA, 180 bp, Artificial Sequence; identical to SEQ ID NO: 3942
  Synthetic polynucleotide

SEQ ID NO: 3944 - DNA, 197 bp, Artificial Sequence
  Synthetic polynucleotide
atcatctcaccttgcctcctgaccggacagcgaacaaccctgcaggaaggtcaactaaaggtcaagaaaggtcaactaaaggtcatcgaaggtcaactaaaggtcagacaaggtcaactaaaggtcactaaaggtcaactaaaggtcaactaaggtcaactaaaggtcatgcggcgcgccatgcttcatcagactct

SEQ ID NO: 3945 - DNA, 197 bp, Artificial Sequence; identical to SEQ ID NO: 3944
  Synthetic polynucleotide

SEQ ID NO: 3946 - DNA, 172 bp, Artificial Sequence
  Synthetic polynucleotide
atcatctcaccttgcctcctgagtgcttaattccgttccctgcaggggggccccccagaggggcccccctcgggggccccccgacggggccccccctaggggccccccactggggcccccctgcggggccccccgtaggggccccccggcgcgccatgcttcatcagactct

SEQ ID NO: 3947 - DNA, 172 bp, Artificial Sequence; identical to SEQ ID NO: 3946
  Synthetic polynucleotide

SEQ ID NO: 3948 - DNA, 180 bp, Artificial Sequence
  Synthetic polynucleotide
atcatctcaccttgcctcctgatatgtaacccactgtgcctgcaggaattgtgcaatagaaattgtgcaattcgaattgtgcaatgacaattgtgcaatctaaattgtgcaatactaattgtgcaattgcaattgtgcaatgtaaattgtgcaatggcgcgccatgcttcatcagactct

SEQ ID NO: 3949 - DNA, 180 bp, Artificial Sequence; identical to SEQ ID NO: 3948
  Synthetic polynucleotide

SEQ ID NO: 3950 - DNA, 196 bp, Artificial Sequence
  Synthetic polynucleotide
atcatctcaccttgcctcctggtatctcttgtcgtccgcctgcaggctaattaaattaaagactaattaaattaatcgctaattaaattaagacctaattaaattaactactaattaaattaaactctaattaaattaatgcctaattaaattaagtactaattaaattaaggcgcgccatgcttcatcagactct

SEQ ID NO: 3951 - DNA, 196 bp, Artificial Sequence; identical to SEQ ID NO: 3950
  Synthetic polynucleotide

SEQ ID NO: 3952 - DNA, 140 bp, Artificial Sequence
  Synthetic polynucleotide
atcatctcaccttgcctcctgcaaactgctactactcccctgcaggcattccagacattcctcgcattccgaccattccctacattccactcattcctgccattccgtacattccggcgcgccatgcttcatcagactct

SEQ ID NO: 3953 - DNA, 140 bp, Artificial Sequence; identical to SEQ ID NO: 3952
  Synthetic polynucleotide

SEQ ID NO: 3954 - DNA, 191 bp, Artificial Sequence
  Synthetic polynucleotide
atcatctcaccttgcctcctgtattgcagcgtgcggcacctgcaggccacgaagaacaccatgtccccaccccagaccacgaagaacaccatgtccccacccctcgccacgaagaacaccatgtccccaccccgacccacgaagaacaccatgtccccaccccctaggcgcgccatgcttcatcagactct

SEQ ID NO: 3955 - DNA, 191 bp, Artificial Sequence; identical to SEQ ID NO: 3954
  Synthetic polynucleotide

SEQ ID NO: 3956 - DNA, 200 bp, Artificial Sequence
  Synthetic polynucleotide
atcatctcaccttgcctcctgcagatgcaagctcttcccctgcagggagggcagccaagcgtgacagagagggcagccaagcgtgactcggagggcagccaagcgtgacgacgagggcagccaagcgtgacctagagggcagccaagcgtgacactgagggcagccaagcgtgacggcgcgccatgcttcatcagactct

SEQ ID NO: 3957 - DNA, 200 bp, Artificial Sequence; identical to SEQ ID NO: 3956
  Synthetic polynucleotide

SEQ ID NO: 3958 - DNA, 197 bp, Artificial Sequence
  Synthetic polynucleotide
atcatctcaccttgcctcctgaaatactccgctaaacccctgcaggttcgcctcaggcaatagattcgcctcaggcaattcgttcgcctcaggcaatgacttcgcctcaggcaatctattcgcctcaggcaatactttcgcctcaggcaattgcttcgcctcaggcaatgtaggcgcgccatgcttcatcagactct

SEQ ID NO: 3959 - DNA, 197 bp, Artificial Sequence; identical to SEQ ID NO: 3958
  Synthetic polynucleotide

SEQ ID NO: 3960 - DNA, 172 bp, Artificial Sequence
  Synthetic polynucleotide
atcatctcaccttgcctcctggacgacatggtaatgtgcctgcaggacggattagcagaacggattagctcgacggattagcgacacggattagcctaacggattagcactacggattagctgcacggattagcgtaacggattagcggcgcgccatgcttcatcagactct

SEQ ID NO: 3961 - DNA, 172 bp, Artificial Sequence; identical to SEQ ID NO: 3960
  Synthetic polynucleotide

SEQ ID NO: 3962 - DNA, 197 bp, Artificial Sequence
  Synthetic polynucleotide
atcatctcaccttgcctcctgcttgagtgatcttaggccctgcagggagcactcatgcgtgacgagagagcactcatgcgtgacgtcggagcactcatgcgtgacggacgagcactcatgcgtgacgctagagcactcatgcgtgacgactgagcactcatgcgtgacgtgcggcgcgccatgcttcatcagactct

SEQ ID NO: 3963 - DNA, 197 bp, Artificial Sequence; identical to SEQ ID NO: 3962
  Synthetic polynucleotide

SEQ ID NO: 3964 - DNA, 191 bp, Artificial Sequence
  Synthetic polynucleotide
atcatctcaccttgcctcctgagatgagggcaccttcacctgcaggaaaattgctgagtcatgagaaaaattgctgagtcatgtcgaaaattgctgagtcatggacaaaattgctgagtcatgctaaaaattgctgagtcatgactaaaattgctgagtcatgtgcggcgcgccatgcttcatcagactct

SEQ ID NO: 3965 - DNA, 191 bp, Artificial Sequence; identical to SEQ ID NO: 3964
  Synthetic polynucleotide

SEQ ID NO: 3966 - DNA, 196 bp, Artificial Sequence
  Synthetic polynucleotide
atcatctcaccttgcctcctggcgccctttacctactccctgcaggagcttgattgatgagaagcttgattgatgtcgagcttgattgatggacagcttgattgatgctaagcttgattgatgactagcttgattgatgtgcagcttgattgatggtaagcttgattgatgggcgcgccatgcttcatcagactct

SEQ ID NO: 3967 - DNA, 196 bp, Artificial Sequence; identical to SEQ ID NO: 3966
  Synthetic polynucleotide

SEQ ID NO: 3968 - DNA, 164 bp, Artificial Sequence
  Synthetic polynucleotide
atcatctcaccttgcctcctgacactatcgaacaagttcctgcaggactaattagagaactaattagtcgactaattaggacactaattagctaactaattagactactaattagtgcactaattaggtaactaattagggcgcgccatgcttcatcagactct

SEQ ID NO: 3969 - DNA, 164 bp, Artificial Sequence; identical to SEQ ID NO: 3968
  Synthetic polynucleotide

SEQ ID NO: 3970 - DNA, 197 bp, Artificial Sequence
  Synthetic polynucleotide
atcatctcaccttgcctcctgtaccacttccctcctgccctgcaggaattgctgactcagcagaaattgctgactcagctcgaattgctgactcagcgacaattgctgactcagcctaaattgctgactcagcactaattgctgactcagctgcaattgctgactcagcgtaggcgcgccatgcttcatcagactct

SEQ ID NO: 3971 - DNA, 197 bp, Artificial Sequence; identical to SEQ ID NO: 3970
  Synthetic polynucleotide

SEQ ID NO: 3972 - DNA, 172 bp, Artificial Sequence
  Synthetic polynucleotide
atcatctcaccttgcctcctgtttggactatgtgggatcctgcaggttacgtcataagattacgtcatatcgttacgtcatagacttacgtcatactattacgtcataactttacgtcatatgcttacgtcatagtattacgtcataggcgcgccatgcttcatcagactct

SEQ ID NO: 3973 - DNA, 172 bp, Artificial Sequence; identical to SEQ ID NO: 3972
  Synthetic polynucleotide

SEQ ID NO: 3974 - DNA, 164 bp, Artificial Sequence
  Synthetic polynucleotide
atcatctcaccttgcctcctgctagatcccggtatcgtcctgcaggcgtacgtcaagacgtacgtcatcgcgtacgtcagaccgtacgtcactacgtacgtcaactcgtacgtcatgccgtacgtcagtacgtacgtcaggcgcgccatgcttcatcagactct

SEQ ID NO: 3975 - DNA, 164 bp, Artificial Sequence; identical to SEQ ID NO: 3974
  Synthetic polynucleotide

SEQ ID NO: 3976 - DNA, 172 bp, Artificial Sequence
  Synthetic polynucleotide
atcatctcaccttgcctcctggctatcagttataagaccctgcaggttcaggtcagagattcaggtcagtcgttcaggtcaggacttcaggtcagctattcaggtcagactttcaggtcagtgcttcaggtcaggtattcaggtcagggcgcgccatgcttcatcagactct

SEQ ID NO: 3977 - DNA, 172 bp, Artificial Sequence; identical to SEQ ID NO: 3976
  Synthetic polynucleotide

SEQ ID NO: 3978 - DNA, 172 bp, Artificial Sequence
  Synthetic polynucleotide
atcatctcaccttgcctcctgctcctgagttgaaggtacctgcagggccacttaaaagagccacttaaatcggccacttaaagacgccacttaaactagccacttaaaactgccacttaaatgcgccacttaaagtagccacttaaaggcgcgccatgcttcatcagactct

SEQ ID NO: 3979 - DNA, 172 bp, Artificial Sequence; identical to SEQ ID NO: 3978
  Synthetic polynucleotide

SEQ ID NO: 3980 - DNA, 172 bp, Artificial Sequence
  Synthetic polynucleotide
atcatctcaccttgcctcctgagagccgttgatgaaagcctgcaggttacgtcatcagattacgtcatctcgttacgtcatcgacttacgtcatcctattacgtcatcactttacgtcatctgcttacgtcatcgtattacgtcatcggcgcgccatgcttcatcagactct

SEQ ID NO: 3981 - DNA, 172 bp, Artificial Sequence; identical to SEQ ID NO: 3980
  Synthetic polynucleotide

SEQ ID NO: 3982 - DNA, 195 bp, Artificial Sequence
  Synthetic polynucleotide
atcatctcaccttgcctcctgcgtgcaaagaagcccagcctgcaggaaacagatacctgaagcgtgaccatacaagaaaacagatacctgaagcgtgaccatacatcgaaacagatacctgaagcgtgaccatacagacaaacagatacctgaagcgtgaccatacactaggcgcgccatgcttcatcagactct

SEQ ID NO: 3983 - DNA, 195 bp, Artificial Sequence; identical to SEQ ID NO: 3982
  Synthetic polynucleotide

SEQ ID NO: 3984 - DNA, 185 bp, Artificial Sequence
  Synthetic polynucleotide
atcatctcaccttgcctcctgatacagaaccaggtaggcctgcaggaagctataaatagaatagaaagctataaatagaattcgaagctataaatagaatgacaagctataaatagaatctaaagctataaatagaatactaagctataaatagaattgcggcgcgccatgcttcatcagactct

SEQ ID NO: 3985 - DNA, 185 bp, Artificial Sequence; identical to SEQ ID NO: 3984
  Synthetic polynucleotide

SEQ ID NO: 3986 - DNA, 188 bp, Artificial Sequence
  Synthetic polynucleotide
atcatctcaccttgcctcctgtccgattcaccagtccgcctgcaggccgcccacgcatagaccgcccacgcattcgccgcccacgcatgacccgcccacgcatctaccgcccacgcatactccgcccacgcattgcccgcccacgcatgtaccgcccacgcatggcgcgccatgcttcatcagactct

SEQ ID NO: 3987 - DNA, 188 bp, Artificial Sequence; identical to SEQ ID NO: 3986
  Synthetic polynucleotide

SEQ ID NO: 3988 - DNA, 185 bp, Artificial Sequence
  Synthetic polynucleotide
atcatctcaccttgcctcctggcaattgtactacactacctgcaggaacaatgttcagtgttagaaacaatgttcagtgtttcgaacaatgttcagtgttgacaacaatgttcagtgttctaaacaatgttcagtgttactaacaatgttcagtgtttgcggcgcgccatgcttcatcagactct

SEQ ID NO: 3989 - DNA, 185 bp, Artificial Sequence; identical to SEQ ID NO: 3988
  Synthetic polynucleotide

SEQ ID NO: 3990 - DNA, 197 bp, Artificial Sequence
  Synthetic polynucleotide
atcatctcaccttgcctcctgccaatgagtcccagtttcctgcaggaggtcagggtgacctggaagaaggtcagggtgacctggatcgaggtcagggtgacctggagacaggtcagggtgacctggactaaggtcagggtgacctggaactaggtcagggtgacctggatgcggcgcgccatgcttcatcagactct

SEQ ID NO: 3991 - DNA, 197 bp, Artificial Sequence; identical to SEQ ID NO: 3990
  Synthetic polynucleotide

SEQ ID NO: 3992 - DNA, 180 bp, Artificial Sequence
  Synthetic polynucleotide
atcatctcaccttgcctcctgtacggctgcattctcgtcctgcagggggggcgtggcagagggggcgtggctcggggggcgtggcgacgggggcgtggcctagggggcgtggcactgggggcgtggctgcgggggcgtggcgtagggggcgtggcggcgcgccatgcttcatcagactct

SEQ ID NO: 3993 - DNA, 180 bp, Artificial Sequence; identical to SEQ ID NO: 3992
  Synthetic polynucleotide

SEQ ID NO: 3994 - DNA, 190 bp, Artificial Sequence
  Synthetic polynucleotide
atcatctcaccttgcctcctgcctactgagtatttacacctgcaggccccggacagcgccagaccccggacagcgcctcgccccggacagcgccgacccccggacagcgccctaccccggacagcgccactccccggacagcgcctgcccccggacagcgccgtaggcgcgccatgcttcatcagactct

SEQ ID NO: 3995 - DNA, 190 bp, Artificial Sequence; identical to SEQ ID NO: 3994
  Synthetic polynucleotide

SEQ ID NO: 3996 - DNA, 197 bp, Artificial Sequence
  Synthetic polynucleotide
atcatctcaccttgcctcctgggacatacaggattgtccctgcaggctccctggcaacagcagactccctggcaacagctcgctccctggcaacagcgacctccctggcaacagcctactccctggcaacagcactctccctggcaacagctgcctccctggcaacagcgtaggcgcgccatgcttcatcagactct

SEQ ID NO: 3997 - DNA, 197 bp, Artificial Sequence; identical to SEQ ID NO: 3996
  Synthetic polynucleotide

SEQ ID NO: 3998 - DNA, 180 bp, Artificial Sequence
  Synthetic polynucleotide
atcatctcaccttgcctcctgccagccgggtctagaaacctgcaggccacgtgctctagaccacgtgctcttcgccacgtgctctgacccacgtgctctctaccacgtgctctactccacgtgctcttgcccacgtgctctgtaccacgtgctctggcgcgccatgcttcatcagactct

SEQ ID NO: 3999 - DNA, 180 bp, Artificial Sequence; identical to SEQ ID NO: 3998
  Synthetic polynucleotide

SEQ ID NO: 4000 - DNA, 196 bp, Artificial Sequence
  Synthetic polynucleotide
atcatctcaccttgcctcctgagcgcgcagtttaacaacctgcagggaaccggaagtggagagaaccggaagtggtcggaaccggaagtgggacgaaccggaagtggctagaaccggaagtggactgaaccggaagtggtgcgaaccggaagtgggtagaaccggaagtggggcgcgccatgcttcatcagactct

SEQ ID NO: 4001 - DNA, 196 bp, Artificial Sequence; identical to SEQ ID NO: 4000
  Synthetic polynucleotide

SEQ ID NO: 4002 - DNA, 180 bp, Artificial Sequence
  Synthetic polynucleotide
atcatctcaccttgcctcctgtgcggttaatcgcttatcctgcaggataaccgttaaagaataaccgttaatcgataaccgttaagacataaccgttaactaataaccgttaaactataaccgttaatgcataaccgttaagtaataaccgttaaggcgcgccatgcttcatcagactct

SEQ ID NO: 4003 - DNA, 180 bp, Artificial Sequence; identical to SEQ ID NO: 4002
  Synthetic polynucleotide

SEQ ID NO: 4004 - DNA, 191 bp, Artificial Sequence
  Synthetic polynucleotide
atcatctcaccttgcctcctgacggaagaaaccagcggcctgcagggatggggtatcatttttagagatggggtatcattttttcggatggggtatcatttttgacgatggggtatcatttttctagatggggtatcatttttactgatggggtatcattttttgcggcgcgccatgcttcatcagactct

SEQ ID NO: 4005 - DNA, 191 bp, Artificial Sequence; identical to SEQ ID NO: 4004
  Synthetic polynucleotide

SEQ ID NO: 4006 - DNA, 188 bp, Artificial Sequence
  Synthetic polynucleotide
atcatctcaccttgcctcctgtagctacacactaagagcctgcaggctaagtaaacaaagactaagtaaacaatcgctaagtaaacaagacctaagtaaacaactactaagtaaacaaactctaagtaaacaatgcctaagtaaacaagtactaagtaaacaaggcgcgccatgcttcatcagactct

SEQ ID NO: 4007 - DNA, 188 bp, Artificial Sequence; identical to SEQ ID NO: 4006
  Synthetic polynucleotide

SEQ ID NO: 4008 - DNA, 164 bp, Artificial Sequence
  Synthetic polynucleotide
atcatctcaccttgcctcctgccagtactacatacggtcctgcagggataaacaaagagataaacaatcggataaacaagacgataaacaactagataaacaaactgataaacaatgcgataaacaagtagataaacaaggcgcgccatgcttcatcagactct

SEQ ID NO: 4009 - DNA, 164 bp, Artificial Sequence; identical to SEQ ID NO: 4008
  Synthetic polynucleotide

SEQ ID NO: 4010 - DNA, 188 bp, Artificial Sequence
  Synthetic polynucleotide
atcatctcaccttgcctcctgctagatcgacatcgtcgcctgcaggtgttacgtaatgagatgttacgtaatgtcgtgttacgtaatggactgttacgtaatgctatgttacgtaatgacttgttacgtaatgtgctgttacgtaatggtatgttacgtaatgggcgcgccatgcttcatcagactct

SEQ ID NO: 4011 - DNA, 188 bp, Artificial Sequence; identical to SEQ ID NO: 4010
  Synthetic polynucleotide

SEQ ID NO: 4012 - DNA, 191 bp, Artificial Sequence
  Synthetic polynucleotide
atcatctcaccttgcctcctgatgtcacgggcagcttgcctgcaggctgacctgaagtgacccagactgacctgaagtgaccctcgctgacctgaagtgacccgacctgacctgaagtgacccctactgacctgaagtgacccactctgacctgaagtgaccctgcggcgcgccatgcttcatcagactct

SEQ ID NO: 4013 - DNA, 191 bp, Artificial Sequence; identical to SEQ ID NO: 4012
  Synthetic polynucleotide

SEQ ID NO: 4014 - DNA, 172 bp, Artificial Sequence
  Synthetic polynucleotide
atcatctcaccttgcctcctgcaatccgcttgctacgtcctgcaggttgtttacaaagattgtttacaatcgttgtttacaagacttgtttacaactattgtttacaaactttgtttacaatgcttgtttacaagtattgtttacaaggcgcgccatgcttcatcagactct

SEQ ID NO: 4015 - DNA, 172 bp, Artificial Sequence; identical to SEQ ID NO: 4014
  Synthetic polynucleotide

SEQ ID NO: 4016 - DNA, 191 bp, Artificial Sequence
  Synthetic polynucleotide
atcatctcaccttgcctcctgctaaagggtgaacatgtcctgcaggacttagttaactaaaaaagaacttagttaactaaaaatcgacttagttaactaaaaagacacttagttaactaaaaactaacttagttaactaaaaaactacttagttaactaaaaatgcggcgcgccatgcttcatcagactct

SEQ ID NO: 4017 - DNA, 191 bp, Artificial Sequence; identical to SEQ ID NO: 4016
  Synthetic polynucleotide

SEQ ID NO: 4018 - DNA, 172 bp, Artificial Sequence
  Synthetic polynucleotide
atcatctcaccttgcctcctgggaactttgtctgttagcctgcagggtgtgagtcaagagtgtgagtcatcggtgtgagtcagacgtgtgagtcactagtgtgagtcaactgtgtgagtcatgcgtgtgagtcagtagtgtgagtcaggcgcgccatgcttcatcagactct

SEQ ID NO: 4019 - DNA, 172 bp, Artificial Sequence; identical to SEQ ID NO: 4018
  Synthetic polynucleotide

SEQ ID NO: 4020 - DNA, 172 bp, Artificial Sequence
  Synthetic polynucleotide
atcatctcaccttgcctcctgtgagaccctttaggtaccctgcaggttgatatgcaagattgatatgcatcgttgatatgcagacttgatatgcactattgatatgcaactttgatatgcatgcttgatatgcagtattgatatgcaggcgcgccatgcttcatcagactct

SEQ ID NO: 4021 - DNA, 172 bp, Artificial Sequence; identical to SEQ ID NO: 4020
  Synthetic polynucleotide

SEQ ID NO: 4022 - DNA, 164 bp, Artificial Sequence
  Synthetic polynucleotide
atcatctcaccttgcctcctgcaaactgttatgcagcgcctgcaggacacctgctagaacacctgcttcgacacctgctgacacacctgctctaacacctgctactacacctgcttgcacacctgctgtaacacctgctggcgcgccatgcttcatcagactct

SEQ ID NO: 4023 - DNA, 164 bp, Artificial Sequence; identical to SEQ ID NO: 4022
  Synthetic polynucleotide

SEQ ID NO: 4024 - DNA, 180 bp, Artificial Sequence
  Synthetic polynucleotide
atcatctcaccttgcctcctgttcagtacgagactctacctgcaggtgctgagtcacagatgctgagtcactcgtgctgagtcacgactgctgagtcacctatgctgagtcacacttgctgagtcactgctgctgagtcacgtatgctgagtcacggcgcgccatgcttcatcagactct

SEQ ID NO: 4025 - DNA, 180 bp, Artificial Sequence; identical to SEQ ID NO: 4024
  Synthetic polynucleotide

SEQ ID NO: 4026 - DNA, 191 bp, Artificial Sequence
  Synthetic polynucleotide
atcatctcaccttgcctcctgaggaccggcaaccgaaacctgcagggggggggggagggagggagagggggggggagggagggtcggggggggggagggaggggacgggggggggagggagggctagggggggggagggagggactgggggggggagggagggtgcggcgcgccatgcttcatcagactct

SEQ ID NO: 4027 - DNA, 191 bp, Artificial Sequence; identical to SEQ ID NO: 4026
  Synthetic polynucleotide

SEQ ID NO: 4028 - DNA, 190 bp, Artificial Sequence
  Synthetic polynucleotide
atcatctcaccttgcctcctggactcgcgccctagtaacctgcagggcgtacgtgcggcaagagcgtacgtgcggcatcggcgtacgtgcggcagacgcgtacgtgcggcactagcgtacgtgcggcaactgcgtacgtgcggcatgcgcgtacgtgcggcagtaggcgcgccatgcttcatcagactct

SEQ ID NO: 4029 - DNA, 190 bp, Artificial Sequence; identical to SEQ ID NO: 4028
  Synthetic polynucleotide

SEQ ID NO: 4030 - DNA, 188 bp, Artificial Sequence
  Synthetic polynucleotide
atcatctcaccttgcctcctggcacgatatggaatatgcctgcaggtgttacgtaataagatgttacgtaatatcgtgttacgtaatagactgttacgtaatactatgttacgtaataacttgttacgtaatatgctgttacgtaatagtatgttacgtaataggcgcgccatgcttcatcagactct

SEQ ID NO: 4031 - DNA, 188 bp, Artificial Sequence; identical to SEQ ID NO: 4030
  Synthetic polynucleotide

SEQ ID NO: 4032 - DNA, 148 bp, Artificial Sequence
  Synthetic polynucleotide
atcatctcaccttgcctcctgtcttgtacgttctttaccctgcaggttcctctagattcctcttcgttcctctgacttcctctctattcctctactttcctcttgcttcctctgtattcctctggcgcgccatgcttcatcagactct

SEQ ID NO: 4033 - DNA, 148 bp, Artificial Sequence; identical to SEQ ID NO: 4032
  Synthetic polynucleotide

SEQ ID NO: 4034 - DNA, 148 bp, Artificial Sequence
  Synthetic polynucleotide
atcatctcaccttgcctcctgtgaacaccgtctttctccctgcaggtcaagtgagatcaagtgtcgtcaagtggactcaagtgctatcaagtgacttcaagtgtgctcaagtggtatcaagtgggcgcgccatgcttcatcagactct

SEQ ID NO: 4035 - DNA, 148 bp, Artificial Sequence; identical to SEQ ID NO: 4034
  Synthetic polynucleotide

SEQ ID NO: 4036 - DNA, 188 bp, Artificial Sequence
  Synthetic polynucleotide
atcatctcaccttgcctcctgactgccctaacatcactcctgcaggtctcaagtggccagatctcaagtggcctcgtctcaagtggccgactctcaagtggccctatctcaagtggccacttctcaagtggcctgctctcaagtggccgtatctcaagtggccggcgcgccatgcttcatcagactct

SEQ ID NO: 4037 - DNA, 188 bp, Artificial Sequence; identical to SEQ ID NO: 4036
  Synthetic polynucleotide

SEQ ID NO: 4038 - DNA, 164 bp, Artificial Sequence
  Synthetic polynucleotide
atcatctcaccttgcctcctgaagtgagggagtgaaggcctgcaggttgacttttagattgactttttcgttgacttttgacttgacttttctattgacttttactttgactttttgcttgacttttgtattgacttttggcgcgccatgcttcatcagactct

SEQ ID NO: 4039 - DNA, 164 bp, Artificial Sequence; identical to SEQ ID NO: 4038
  Synthetic polynucleotide

SEQ ID NO: 4040 - DNA, 185 bp, Artificial Sequence
  Synthetic polynucleotide
atcatctcaccttgcctcctgggttggtcaggaggatacctgcaggaagctataaatagactagaaagctataaatagacttcgaagctataaatagactgacaagctataaatagactctaaagctataaatagactactaagctataaatagacttgcggcgcgccatgcttcatcagactct

SEQ ID NO: 4041 - DNA, 185 bp, Artificial Sequence; identical to SEQ ID NO: 4040
  Synthetic polynucleotide

SEQ ID NO: 4042 - DNA, 191 bp, Artificial Sequence
  Synthetic polynucleotide
atcatctcaccttgcctcctgctcacttcagcaaagcacctgcaggtagtactaattagttcgagatagtactaattagttcgtcgtagtactaattagttcggactagtactaattagttcgctatagtactaattagttcgacttagtactaattagttcgtgcggcgcgccatgcttcatcagactct

SEQ ID NO: 4043 - DNA, 191 bp, Artificial Sequence; identical to SEQ ID NO: 4042
  Synthetic polynucleotide

SEQ ID NO: 4044 - DNA, 180 bp, Artificial Sequence
  Synthetic polynucleotide
atcatctcaccttgcctcctgtctcctgttacctgcgccctgcaggtgctgagtcatagatgctgagtcattcgtgctgagtcatgactgctgagtcatctatgctgagtcatacttgctgagtcattgctgctgagtcatgtatgctgagtcatggcgcgccatgcttcatcagactct

SEQ ID NO: 4045 - DNA, 180 bp, Artificial Sequence; identical to SEQ ID NO: 4044
  Synthetic polynucleotide

SEQ ID NO: 4046 - DNA, 180 bp, Artificial Sequence
  Synthetic polynucleotide
atcatctcaccttgcctcctggtttgatccgagatttgcctgcaggtgatttatggcagatgatttatggctcgtgatttatggcgactgatttatggcctatgatttatggcacttgatttatggctgctgatttatggcgtatgatttatggcggcgcgccatgcttcatcagactct

SEQ ID NO: 4047 - DNA, 180 bp, Artificial Sequence; identical to SEQ ID NO: 4046
  Synthetic polynucleotide

SEQ ID NO: 4048 - DNA, 197 bp, Artificial Sequence
  Synthetic polynucleotide
atcatctcaccttgcctcctgatcaggtcaatgcagtccctgcaggtacgcccacgcatttagatacgcccacgcattttcgtacgcccacgcatttgactacgcccacgcatttctatacgcccacgcatttacttacgcccacgcattttgctacgcccacgcatttgtaggcgcgccatgcttcatcagactct

SEQ ID NO: 4049 - DNA, 197 bp, Artificial Sequence; identical to SEQ ID NO: 4048
  Synthetic polynucleotide

SEQ ID NO: 4050 - DNA, 197 bp, Artificial Sequence
  Synthetic polynucleotide
atcatctcaccttgcctcctggatctgcaccaccttgtcctgcaggtactggagagaaaccagatactggagagaaacctcgtactggagagaaaccgactactggagagaaaccctatactggagagaaaccacttactggagagaaacctgctactggagagaaaccgtaggcgcgccatgcttcatcagactct

SEQ ID NO: 4051 - DNA, 197 bp, Artificial Sequence; identical to SEQ ID NO: 4050
  Synthetic polynucleotide

SEQ ID NO: 4052 - DNA, 172 bp, Artificial Sequence
  Synthetic polynucleotide
atcatctcaccttgcctcctggccgtataggctgttcgcctgcaggaaagtcaattagaaaagtcaatttcgaaagtcaattgacaaagtcaattctaaaagtcaattactaaagtcaatttgcaaagtcaattgtaaaagtcaattggcgcgccatgcttcatcagactct

SEQ ID NO: 4053 - DNA, 172 bp, Artificial Sequence; identical to SEQ ID NO: 4052
  Synthetic polynucleotide

SEQ ID NO: 4054 - DNA, 185 bp, Artificial Sequence
  Synthetic polynucleotide
atcatctcaccttgcctcctgataggcaatagacgctacctgcaggttgcggtttgcggttaagattgcggtttgcggttatcgttgcggtttgcggttagacttgcggtttgcggttactattgcggtttgcggttaactttgcggtttgcggttatgcggcgcgccatgcttcatcagactct

SEQ ID NO: 4055 - DNA, 185 bp, Artificial Sequence; identical to SEQ ID NO: 4054
  Synthetic polynucleotide

SEQ ID NO: 4056 - DNA, 191 bp, Artificial Sequence
  Synthetic polynucleotide
atcatctcaccttgcctcctgccttatgtgatgatgctcctgcaggcccaaaagaacaccgtgtacctcccctagacccaaaagaacaccgtgtacctccccttcgcccaaaagaacaccgtgtacctcccctgaccccaaaagaacaccgtgtacctcccctctaggcgcgccatgcttcatcagactct

SEQ ID NO: 4057 - DNA, 191 bp, Artificial Sequence; identical to SEQ ID NO: 4056
  Synthetic polynucleotide

SEQ ID NO: 4058 - DNA, 191 bp, Artificial Sequence
  Synthetic polynucleotide
atcatctcaccttgcctcctggtctaccaaggccgatccctgcaggaatcactgaaattgattagaaatcactgaaattgatttcgaatcactgaaattgattgacaatcactgaaattgattctaaatcactgaaattgattactaatcactgaaattgatttgcggcgcgccatgcttcatcagactct

SEQ ID NO: 4059 - DNA, 191 bp, Artificial Sequence; identical to SEQ ID NO: 4058
  Synthetic polynucleotide

SEQ ID NO: 4060 - DNA, 197 bp, Artificial Sequence
  Synthetic polynucleotide
atcatctcaccttgcctcctgtggctcgtgtaaccgaacctgcaggttcgttgtatgcgggagattcgttgtatgcgggtcgttcgttgtatgcggggacttcgttgtatgcgggctattcgttgtatgcgggactttcgttgtatgcgggtgcttcgttgtatgcggggtaggcgcgccatgcttcatcagactct

SEQ ID NO: 4061 - DNA, 197 bp, Artificial Sequence; identical to SEQ ID NO: 4060
  Synthetic polynucleotide

SEQ ID NO: 4062 - DNA, 172 bp, Artificial Sequence
  Synthetic polynucleotide
atcatctcaccttgcctcctgcccaggttaaaggtggacctgcaggtgactcacacagatgactcacactcgtgactcacacgactgactcacacctatgactcacacacttgactcacactgctgactcacacgtatgactcacacggcgcgccatgcttcatcagactct

SEQ ID NO: 4063 - DNA, 172 bp, Artificial Sequence; identical to SEQ ID NO: 4062
  Synthetic polynucleotide

SEQ ID NO: 4064 - DNA, 172 bp, Artificial Sequence
  Synthetic polynucleotide
atcatctcaccttgcctcctgttgcacacactgctagacctgcaggttaagtgcttagattaagtgctttcgttaagtgcttgacttaagtgcttctattaagtgcttactttaagtgctttgcttaagtgcttgtattaagtgcttggcgcgccatgcttcatcagactct

SEQ ID NO: 4065 - DNA, 172 bp, Artificial Sequence; identical to SEQ ID NO: 4064
  Synthetic polynucleotide

SEQ ID NO: 4066 - DNA, 172 bp, Artificial Sequence
  Synthetic polynucleotide
atcatctcaccttgcctcctggtcagcaactttactcacctgcaggggtttcggtcagaggtttcggtctcgggtttcggtcgacggtttcggtcctaggtttcggtcactggtttcggtctgcggtttcggtcgtaggtttcggtcggcgcgccatgcttcatcagactct

SEQ ID NO: 4067 - DNA, 172 bp, Artificial Sequence; identical to SEQ ID NO: 4066
  Synthetic polynucleotide

SEQ ID NO: 4068 - DNA, 196 bp, Artificial Sequence
  Synthetic polynucleotide
atcatctcaccttgcctcctggcaacctatcaacccgtcctgcaggttaatttaattagagattaatttaattagtcgttaatttaattaggacttaatttaattagctattaatttaattagactttaatttaattagtgcttaatttaattaggtattaatttaattagggcgcgccatgcttcatcagactct

SEQ ID NO: 4069 - DNA, 196 bp, Artificial Sequence; identical to SEQ ID NO: 4068
  Synthetic polynucleotide

SEQ ID NO: 4070 - DNA, 148 bp, Artificial Sequence
  Synthetic polynucleotide
atcatctcaccttgcctcctgtgtgcaatatggatgaacctgcaggtgatttcagatgatttctcgtgatttcgactgatttcctatgatttcacttgatttctgctgatttcgtatgatttcggcgcgccatgcttcatcagactct

SEQ ID NO: 4071 - DNA, 148 bp, Artificial Sequence; identical to SEQ ID NO: 4070
  Synthetic polynucleotide

SEQ ID NO: 4072 - DNA, 185 bp, Artificial Sequence
  Synthetic polynucleotide
atcatctcaccttgcctcctgacaacttagagacgctccctgcagggcattaattagttcgcagagcattaattagttcgctcggcattaattagttcgcgacgcattaattagttcgcctagcattaattagttcgcactgcattaattagttcgctgcggcgcgccatgcttcatcagactct

SEQ ID NO: 4073 - DNA, 185 bp, Artificial Sequence; identical to SEQ ID NO: 4072
  Synthetic polynucleotide

SEQ ID NO: 4074 - DNA, 191 bp, Artificial Sequence
  Synthetic polynucleotide
atcatctcaccttgcctcctgtcgatctatgcggagtacctgcaggtaaactaattagctgtaagataaactaattagctgtatcgtaaactaattagctgtagactaaactaattagctgtactataaactaattagctgtaacttaaactaattagctgtatgcggcgcgccatgcttcatcagactct

SEQ ID NO: 4075 - DNA, 191 bp, Artificial Sequence; identical to SEQ ID NO: 4074
  Synthetic polynucleotide

SEQ ID NO: 4076 - DNA, 196 bp, Artificial Sequence
  Synthetic polynucleotide
atcatctcaccttgcctcctgagaggagcaggtatattcctgcaggttaatttaattaaagattaatttaattaatcgttaatttaattaagacttaatttaattaactattaatttaattaaactttaatttaattaatgcttaatttaattaagtattaatttaattaaggcgcgccatgcttcatcagactct

SEQ ID NO: 4077 - DNA, 196 bp, Artificial Sequence; identical to SEQ ID NO: 4076
  Synthetic polynucleotide

SEQ ID NO: 4078 - DNA, 190 bp, Artificial Sequence
  Synthetic polynucleotide
atcatctcaccttgcctcctgtcactctcccgaaagcccctgcaggaatacccgcatgtgagaaatacccgcatgtgtcgaatacccgcatgtggacaatacccgcatgtgctaaatacccgcatgtgactaatacccgcatgtgtgcaatacccgcatgtggtaggcgcgccatgcttcatcagactct

SEQ ID NO: 4079 - DNA, 190 bp, Artificial Sequence; identical to SEQ ID NO: 4078
  Synthetic polynucleotide

SEQ ID NO: 4080 - DNA, 200 bp, Artificial Sequence
  Synthetic polynucleotide
atcatctcaccttgcctcctgtattgtgaaccgtgcaccctgcaggatgttaaatgtagattaagagaatgttaaatgtagattaagtcgatgttaaatgtagattaaggacatgttaaatgtagattaagctaatgttaaatgtagattaagactatgttaaatgtagattaagggcgcgccatgcttcatcagactct

SEQ ID NO: 4081 - DNA, 200 bp, Artificial Sequence; identical to SEQ ID NO: 4080
  Synthetic polynucleotide

SEQ ID NO: 4082 - DNA, 188 bp, Artificial Sequence
  Synthetic polynucleotide
atcatctcaccttgcctcctgacaacggccgctttctgcctgcaggtcgcatatgttgagatcgcatatgttgtcgtcgcatatgttggactcgcatatgttgctatcgcatatgttgacttcgcatatgttgtgctcgcatatgttggtatcgcatatgttgggcgcgccatgcttcatcagactct

SEQ ID NO: 4083 - DNA, 188 bp, Artificial Sequence; identical to SEQ ID NO: 4082
  Synthetic polynucleotide

SEQ ID NO: 4084 - DNA, 180 bp, Artificial Sequence
  Synthetic polynucleotide
atcatctcaccttgcctcctgtgggcaatggcctgcatcctgcaggtgcgtgggcgtagatgcgtgggcgttcgtgcgtgggcgtgactgcgtgggcgtctatgcgtgggcgtacttgcgtgggcgttgctgcgtgggcgtgtatgcgtgggcgtggcgcgccatgcttcatcagactct

SEQ ID NO: 4085 - DNA, 180 bp, Artificial Sequence; identical to SEQ ID NO: 4084
  Synthetic polynucleotide

SEQ ID NO: 4086 - DNA, 197 bp, Artificial Sequence
  Synthetic polynucleotide
atcatctcaccttgcctcctgcctcatagcggagaatgcctgcagggagtccaaagtccagagagagtccaaagtccagtcggagtccaaagtccaggacgagtccaaagtccagctagagtccaaagtccagactgagtccaaagtccagtgcgagtccaaagtccaggtaggcgcgccatgcttcatcagactct

SEQ ID NO: 4087 - DNA, 197 bp, Artificial Sequence; identical to SEQ ID NO: 4086
  Synthetic polynucleotide

SEQ ID NO: 4088 - DNA, 196 bp, Artificial Sequence
  Synthetic polynucleotide
atcatctcaccttgcctcctgtgcgggaatcgaacgaccctgcagggtattggtcacgtgactcttccagagtattggtcacgtgactcttcctcggtattggtcacgtgactcttccgacgtattggtcacgtgactcttccctagtattggtcacgtgactcttccactggcgcgccatgcttcatcagactct

SEQ ID NO: 4089 - DNA, 196 bp, Artificial Sequence; identical to SEQ ID NO: 4088
  Synthetic polynucleotide

SEQ ID NO: 4090 - DNA, 190 bp, Artificial Sequence
  Synthetic polynucleotide
atcatctcaccttgcctcctgtgaagtacggagactaacctgcaggtacgcccacgcattagatacgcccacgcatttcgtacgcccacgcattgactacgcccacgcattctatacgcccacgcattacttacgcccacgcatttgctacgcccacgcattgtaggcgcgccatgcttcatcagactct

SEQ ID NO: 4091 - DNA, 190 bp, Artificial Sequence; identical to SEQ ID NO: 4090
  Synthetic polynucleotide

SEQ ID NO: 4092 - DNA, 191 bp, Artificial Sequence
  Synthetic polynucleotide
atcatctcaccttgcctcctgaccatctgctacgttcacctgcaggatcgataactgatcgatagaatcgataactgatcgattcgatcgataactgatcgatgacatcgataactgatcgatctaatcgataactgatcgatactatcgataactgatcgattgcggcgcgccatgcttcatcagactct

SEQ ID NO: 4093 - DNA, 191 bp, Artificial Sequence; identical to SEQ ID NO: 4092
  Synthetic polynucleotide

SEQ ID NO: 4094 - DNA, 197 bp, Artificial Sequence
  Synthetic polynucleotide
atcatctcaccttgcctcctgtcgtgtgcgcaaactcccctgcaggaaggtcaaaggtcaaagaaaggtcaaaggtcaatcgaaggtcaaaggtcaagacaaggtcaaaggtcaactaaaggtcaaaggtcaaactaaggtcaaaggtcaatgcaaggtcaaaggtcaagtaggcgcgccatgcttcatcagactct

SEQ ID NO: 4095 - DNA, 197 bp, Artificial Sequence; identical to SEQ ID NO: 4094
  Synthetic polynucleotide

SEQ ID NO: 4096 - DNA, 172 bp, Artificial Sequence
  Synthetic polynucleotide
atcatctcaccttgcctcctggtgaccttcagagaagacctgcaggctgactcatcagactgactcatctcgctgactcatcgacctgactcatcctactgactcatcactctgactcatctgcctgactcatcgtactgactcatcggcgcgccatgcttcatcagactct

SEQ ID NO: 4097 - DNA, 172 bp, Artificial Sequence; identical to SEQ ID NO: 4096
  Synthetic polynucleotide

SEQ ID NO: 4098 - DNA, 197 bp, Artificial Sequence
  Synthetic polynucleotide
atcatctcaccttgcctcctgtgaagttgtcgtaactgcctgcaggtgggttatttttaaaccgagatgggttatttttaaaccgtcgtgggttatttttaaaccggactgggttatttttaaaccgctatgggttatttttaaaccgacttgggttatttttaaaccgtgcggcgcgccatgcttcatcagactct

SEQ ID NO: 4099 - DNA, 197 bp, Artificial Sequence; identical to SEQ ID NO: 4098
  Synthetic polynucleotide

SEQ ID NO: 4100 - DNA, 164 bp, Artificial Sequence
  Synthetic polynucleotide
atcatctcaccttgcctcctgtcctggccgccattgaacctgcaggtcgcgtgatagatcgcgtgattcgtcgcgtgatgactcgcgtgatctatcgcgtgatacttcgcgtgattgctcgcgtgatgtatcgcgtgatggcgcgccatgcttcatcagactct

SEQ ID NO: 4101 - DNA, 164 bp, Artificial Sequence; identical to SEQ ID NO: 4100
  Synthetic polynucleotide

SEQ ID NO: 4102 - DNA, 190 bp, Artificial Sequence
  Synthetic polynucleotide
atcatctcaccttgcctcctgtgaggactatcccgcaacctgcaggtaggacaaaggtcaagataggacaaaggtcatcgtaggacaaaggtcagactaggacaaaggtcactataggacaaaggtcaacttaggacaaaggtcatgctaggacaaaggtcagtaggcgcgccatgcttcatcagactct

SEQ ID NO: 4103 - DNA, 190 bp, Artificial Sequence; identical to SEQ ID NO: 4102
  Synthetic polynucleotide

SEQ ID NO: 4104 - DNA, 191 bp, Artificial Sequence
  Synthetic polynucleotide
atcatctcaccttgcctcctgattcaagcgtcaggtaccctgcaggttggttaataattaactagattggttaataattaacttcgttggttaataattaactgacttggttaataattaactctattggttaataattaactactttggttaataattaacttgcggcgcgccatgcttcatcagactct

SEQ ID NO: 4105 - DNA, 191 bp, Artificial Sequence; identical to SEQ ID NO: 4104
  Synthetic polynucleotide

SEQ ID NO: 4106 - DNA, 172 bp, Artificial Sequence
  Synthetic polynucleotide
atcatctcaccttgcctcctgtatcagtcaacgttacccctgcaggatgacgtcacagaatgacgtcactcgatgacgtcacgacatgacgtcacctaatgacgtcacactatgacgtcactgcatgacgtcacgtaatgacgtcacggcgcgccatgcttcatcagactct

SEQ ID NO: 4107 - DNA, 172 bp, Artificial Sequence; identical to SEQ ID NO: 4106
  Synthetic polynucleotide

SEQ ID NO: 4108 - DNA, 188 bp, Artificial Sequence
  Synthetic polynucleotide
atcatctcaccttgcctcctggtcctggtgtacttaaacctgcaggaatggcgccaaaagaaatggcgccaaatcgaatggcgccaaagacaatggcgccaaactaaatggcgccaaaactaatggcgccaaatgcaatggcgccaaagtaaatggcgccaaaggcgcgccatgcttcatcagactct

SEQ ID NO: 4109 - DNA, 188 bp, Artificial Sequence; identical to SEQ ID NO: 4108
  Synthetic polynucleotide

SEQ ID NO: 4110 - DNA, 156 bp, Artificial Sequence
  Synthetic polynucleotide
atcatctcaccttgcctcctgtcctaaaggtggtagctcctgcaggatgtttacagaatgtttactcgatgtttacgacatgtttacctaatgtttacactatgtttactgcatgtttacgtaatgtttacggcgcgccatgcttcatcagactct

SEQ ID NO: 4111 - DNA, 156 bp, Artificial Sequence; identical to SEQ ID NO: 4110
  Synthetic polynucleotide

SEQ ID NO: 4112 - DNA, 156 bp, Artificial Sequence
  Synthetic polynucleotide
atcatctcaccttgcctcctgccttgctattcatcagccctgcaggccagtagcagaccagtagctcgccagtagcgacccagtagcctaccagtagcactccagtagctgcccagtagcgtaccagtagcggcgcgccatgcttcatcagactct

SEQ ID NO: 4113 - DNA, 156 bp, Artificial Sequence; identical to SEQ ID NO: 4112
  Synthetic polynucleotide

SEQ ID NO: 4114 - DNA, 186 bp, Artificial Sequence
  Synthetic polynucleotide
atcatctcaccttgcctcctgaattcccaacgcgcgaccctgcaggcaaaggtcaaattgaggtcaagacaaaggtcaaattgaggtcatcgcaaaggtcaaattgaggtcagaccaaaggtcaaattgaggtcactacaaaggtcaaattgaggtcaactggcgcgccatgcttcatcagactct

SEQ ID NO: 4115 - DNA, 186 bp, Artificial Sequence; identical to SEQ ID NO: 4114
  Synthetic polynucleotide

SEQ ID NO: 4116 - DNA, 191 bp, Artificial Sequence
  Synthetic polynucleotide
atcatctcaccttgcctcctgttcgctacgactgtgatcctgcaggcgaactaattagtactaagacgaactaattagtactatcgcgaactaattagtactagaccgaactaattagtactactacgaactaattagtactaactcgaactaattagtactatgcggcgcgccatgcttcatcagactct

SEQ ID NO: 4117 - DNA, 191 bp, Artificial Sequence; identical to SEQ ID NO: 4116
  Synthetic polynucleotide

SEQ ID NO: 4118 - DNA, 191 bp, Artificial Sequence
  Synthetic polynucleotide
atcatctcaccttgcctcctgcatccatttaattgcctcctgcaggaaatcgattttcgttttagaaaatcgattttcgtttttcgaaatcgattttcgttttgacaaatcgattttcgttttctaaaatcgattttcgttttactaaatcgattttcgtttttgcggcgcgccatgcttcatcagactct

SEQ ID NO: 4119 - DNA, 191 bp, Artificial Sequence; identical to SEQ ID NO: 4118
  Synthetic polynucleotide

SEQ ID NO: 4120 - DNA, 156 bp, Artificial Sequence
  Synthetic polynucleotide
atcatctcaccttgcctcctggaacccaaatagagttccctgcagggctaatgaagagctaatgatcggctaatgagacgctaatgactagctaatgaactgctaatgatgcgctaatgagtagctaatgaggcgcgccatgcttcatcagactct

SEQ ID NO: 4121 - DNA, 156 bp, Artificial Sequence; identical to SEQ ID NO: 4120
  Synthetic polynucleotide

SEQ ID NO: 4122 - DNA, 188 bp, Artificial Sequence
  Synthetic polynucleotide
atcatctcaccttgcctcctgtcctttggagactgatccctgcaggcctgggtggtccagacctgggtggtcctcgcctgggtggtccgaccctgggtggtccctacctgggtggtccactcctgggtggtcctgccctgggtggtccgtacctgggtggtccggcgcgccatgcttcatcagactct

SEQ ID NO: 4123 - DNA, 188 bp, Artificial Sequence; identical to SEQ ID NO: 4122
  Synthetic polynucleotide

SEQ ID NO: 4124 - DNA, 164 bp, Artificial Sequence
  Synthetic polynucleotide
atcatctcaccttgcctcctgtaagcaggagatgctcccctgcaggttaacagcgagattaacagcgtcgttaacagcggacttaacagcgctattaacagcgactttaacagcgtgcttaacagcggtattaacagcgggcgcgccatgcttcatcagactct

SEQ ID NO: 4125 - DNA, 164 bp, Artificial Sequence; identical to SEQ ID NO: 4124
  Synthetic polynucleotide

SEQ ID NO: 4126 - DNA, 172 bp, Artificial Sequence
  Synthetic polynucleotide
atcatctcaccttgcctcctggcgaaacagatggcttgcctgcaggtctattgcccagatctattgccctcgtctattgcccgactctattgcccctatctattgcccacttctattgccctgctctattgcccgtatctattgcccggcgcgccatgcttcatcagactct

SEQ ID NO: 4127 - DNA, 172 bp, Artificial Sequence; identical to SEQ ID NO: 4126
  Synthetic polynucleotide

SEQ ID NO: 4128 - DNA, 180 bp, Artificial Sequence
  Synthetic polynucleotide
atcatctcaccttgcctcctggataaacgtaccttatccctgcagggcagcagctgtagagcagcagctgttcggcagcagctgtgacgcagcagctgtctagcagcagctgtactgcagcagctgttgcgcagcagctgtgtagcagcagctgtggcgcgccatgcttcatcagactct

SEQ ID NO: 4129 - DNA, 180 bp, Artificial Sequence; identical to SEQ ID NO: 4128
  Synthetic polynucleotide

SEQ ID NO: 4130 - DNA, 188 bp, Artificial Sequence
  Synthetic polynucleotide
atcatctcaccttgcctcctgatacccggtgtacgcttcctgcagggacgtgtcattaagagacgtgtcattatcggacgtgtcattagacgacgtgtcattactagacgtgtcattaactgacgtgtcattatgcgacgtgtcattagtagacgtgtcattaggcgcgccatgcttcatcagactct

SEQ ID NO: 4131 - DNA, 188 bp, Artificial Sequence; identical to SEQ ID NO: 4130
  Synthetic polynucleotide

SEQ ID NO: 4132 - DNA, 197 bp, Artificial Sequence
  Synthetic polynucleotide
atcatctcaccttgcctcctgaatgagccttcccactgcctgcagggggggtatgcgtcatagagggggtatgcgtcattcggggggtatgcgtcatgacgggggtatgcgtcatctagggggtatgcgtcatactgggggtatgcgtcattgcgggggtatgcgtcatgtaggcgcgccatgcttcatcagactct

SEQ ID NO: 4133 - DNA, 197 bp, Artificial Sequence; identical to SEQ ID NO: 4132
  Synthetic polynucleotide

SEQ ID NO: 4134 - DNA, 164 bp, Artificial Sequence
  Synthetic polynucleotide
atcatctcaccttgcctcctgcatcctgaacgtgcatgcctgcaggtacttccttagatacttcctttcgtacttccttgactacttccttctatacttccttacttacttcctttgctacttccttgtatacttccttggcgcgccatgcttcatcagactct

SEQ ID NO: 4135 - DNA, 164 bp, Artificial Sequence; identical to SEQ ID NO: 4134
  Synthetic polynucleotide

SEQ ID NO: 4136 - DNA, 197 bp, Artificial Sequence
  Synthetic polynucleotide
atcatctcaccttgcctcctgtaatgggtgggatatgccctgcaggcatctccttatatggagacatctccttatatggtcgcatctccttatatgggaccatctccttatatggctacatctccttatatggactcatctccttatatggtgccatctccttatatgggtaggcgcgccatgcttcatcagactct

SEQ ID NO: 4137 - DNA, 197 bp, Artificial Sequence; identical to SEQ ID NO: 4136
  Synthetic polynucleotide

SEQ ID NO: 4138 - DNA, 196 bp, Artificial Sequence
  Synthetic polynucleotide
atcatctcaccttgcctcctgcggcagatagtctacctcctgcaggttaatctaattaaagattaatctaattaatcgttaatctaattaagacttaatctaattaactattaatctaattaaactttaatctaattaatgcttaatctaattaagtattaatctaattaaggcgcgccatgcttcatcagactct

SEQ ID NO: 4139 - DNA, 196 bp, Artificial Sequence; identical to SEQ ID NO: 4138
  Synthetic polynucleotide

SEQ ID NO: 4140 - DNA, 172 bp, Artificial Sequence
  Synthetic polynucleotide
atcatctcaccttgcctcctggctagtgccaatgggaccctgcaggatgacgtcatagaatgacgtcattcgatgacgtcatgacatgacgtcatctaatgacgtcatactatgacgtcattgcatgacgtcatgtaatgacgtcatggcgcgccatgcttcatcagactct

SEQ ID NO: 4141 - DNA, 172 bp, Artificial Sequence; identical to SEQ ID NO: 4140
  Synthetic polynucleotide

SEQ ID NO: 4142 - DNA, 185 bp, Artificial Sequence
  Synthetic polynucleotide
atcatctcaccttgcctcctgataggagggtctaaggccctgcagggtgaactcgttgacccagagtgaactcgttgaccctcggtgaactcgttgacccgacgtgaactcgttgacccctagtgaactcgttgacccactgtgaactcgttgaccctgcggcgcgccatgcttcatcagactct

SEQ ID NO: 4143 - DNA, 185 bp, Artificial Sequence; identical to SEQ ID NO: 4142
  Synthetic polynucleotide

SEQ ID NO: 4144 - DNA, 197 bp, Artificial Sequence
  Synthetic polynucleotide
atcatctcaccttgcctcctgggcacggtaacttgcctcctgcaggcatgcccatataaggcaaagacatgcccatataaggcaatcgcatgcccatataaggcaagaccatgcccatataaggcaactacatgcccatataaggcaaactcatgcccatataaggcaatgcggcgcgccatgcttcatcagactct

SEQ ID NO: 4145 - DNA, 197 bp, Artificial Sequence; identical to SEQ ID NO: 4144
  Synthetic polynucleotide

SEQ ID NO: 4146 - DNA, 197 bp, Artificial Sequence
  Synthetic polynucleotide
atcatctcaccttgcctcctgggattgccttgcctggtcctgcaggcaagatggcggcggcagacaagatggcggcggctcgcaagatggcggcggcgaccaagatggcggcggcctacaagatggcggcggcactcaagatggcggcggctgccaagatggcggcggcgtaggcgcgccatgcttcatcagactct

SEQ ID NO: 4147 - DNA, 197 bp, Artificial Sequence; identical to SEQ ID NO: 4146
  Synthetic polynucleotide

SEQ ID NO: 4148 - DNA, 164 bp, Artificial Sequence
  Synthetic polynucleotide
atcatctcaccttgcctcctgccaccggttcatgtacacctgcagggtcacgtacagagtcacgtactcggtcacgtacgacgtcacgtacctagtcacgtacactgtcacgtactgcgtcacgtacgtagtcacgtacggcgcgccatgcttcatcagactct

SEQ ID NO: 4149 - DNA, 164 bp, Artificial Sequence; identical to SEQ ID NO: 4148
  Synthetic polynucleotide

SEQ ID NO: 4150 - DNA, 190 bp, Artificial Sequence
  Synthetic polynucleotide
atcatctcaccttgcctcctgtagcttctttcacatagcctgcagggggtcacgtgtccaagagggtcacgtgtccatcggggtcacgtgtccagacgggtcacgtgtccactagggtcacgtgtccaactgggtcacgtgtccatgcgggtcacgtgtccagtaggcgcgccatgcttcatcagactct

SEQ ID NO: 4151 - DNA, 190 bp, Artificial Sequence; identical to SEQ ID NO: 4150
  Synthetic polynucleotide

SEQ ID NO: 4152 - DNA, 156 bp, Artificial Sequence
  Synthetic polynucleotide
atcatctcaccttgcctcctgggagcatgatacctggacctgcaggagaaaaatagaagaaaaattcgagaaaaatgacagaaaaatctaagaaaaatactagaaaaattgcagaaaaatgtaagaaaaatggcgcgccatgcttcatcagactct

SEQ ID NO: 4153 - DNA, 156 bp, Artificial Sequence; identical to SEQ ID NO: 4152
  Synthetic polynucleotide

SEQ ID NO: 4154 - DNA, 196 bp, Artificial Sequence
  Synthetic polynucleotide
atcatctcaccttgcctcctgcgcagtgagttacttggcctgcaggtgattggctaaggagatgattggctaaggtcgtgattggctaagggactgattggctaaggctatgattggctaaggacttgattggctaaggtgctgattggctaagggtatgattggctaaggggcgcgccatgcttcatcagactct

SEQ ID NO: 4155 - DNA, 196 bp, Artificial Sequence; identical to SEQ ID NO: 4154
  Synthetic polynucleotide

SEQ ID NO: 4156 - DNA, 180 bp, Artificial Sequence
  Synthetic polynucleotide
atcatctcaccttgcctcctgtctcgatgggtagaaaccctgcaggataacggtactagaataacggtacttcgataacggtactgacataacggtactctaataacggtactactataacggtacttgcataacggtactgtaataacggtactggcgcgccatgcttcatcagactct

SEQ ID NO: 4157 - DNA, 180 bp, Artificial Sequence; identical to SEQ ID NO: 4156
  Synthetic polynucleotide

SEQ ID NO: 4158 - DNA, 180 bp, Artificial Sequence
  Synthetic polynucleotide
atcatctcaccttgcctcctgcttcaagctgatcctttcctgcagggcaggaaatgaagagcaggaaatgatcggcaggaaatgagacgcaggaaatgactagcaggaaatgaactgcaggaaatgatgcgcaggaaatgagtagcaggaaatgaggcgcgccatgcttcatcagactct

SEQ ID NO: 4159 - DNA, 180 bp, Artificial Sequence; identical to SEQ ID NO: 4158
  Synthetic polynucleotide

SEQ ID NO: 4160 - DNA, 172 bp, Artificial Sequence
  Synthetic polynucleotide
atcatctcaccttgcctcctgctcactccgttattaatcctgcaggagctcattatagaagctcattattcgagctcattatgacagctcattatctaagctcattatactagctcattattgcagctcattatgtaagctcattatggcgcgccatgcttcatcagactct

SEQ ID NO: 4161 - DNA, 172 bp, Artificial Sequence; identical to SEQ ID NO: 4160
  Synthetic polynucleotide

SEQ ID NO: 4162 - DNA, 188 bp, Artificial Sequence
  Synthetic polynucleotide
atcatctcaccttgcctcctgccctgtcctctgtgtgacctgcaggaccgttaacggtagaaccgttaacggttcgaccgttaacggtgacaccgttaacggtctaaccgttaacggtactaccgttaacggttgcaccgttaacggtgtaaccgttaacggtggcgcgccatgcttcatcagactct

SEQ ID NO: 4163 - DNA, 188 bp, Artificial Sequence; identical to SEQ ID NO: 4162
  Synthetic polynucleotide

SEQ ID NO: 4164 - DNA, 191 bp, Artificial Sequence
  Synthetic polynucleotide
atcatctcaccttgcctcctggttctacactccctgatcctgcagggagaagggggcgggaccagagagaagggggcgggacctcggagaagggggcgggaccgacgagaagggggcgggaccctagagaagggggcgggaccactgagaagggggcgggacctgcggcgcgccatgcttcatcagactct

SEQ ID NO: 4165 - DNA, 191 bp, Artificial Sequence; identical to SEQ ID NO: 4164
  Synthetic polynucleotide

SEQ ID NO: 4166 - DNA, 196 bp, Artificial Sequence
  Synthetic polynucleotide
atcatctcaccttgcctcctgcgaggttctttcacttccctgcaggggcgcaatgcattgtgggtaaaagaggcgcaatgcattgtgggtaaatcgggcgcaatgcattgtgggtaaagacggcgcaatgcattgtgggtaaactaggcgcaatgcattgtgggtaaaactggcgcgccatgcttcatcagactct

SEQ ID NO: 4167 - DNA, 196 bp, Artificial Sequence; identical to SEQ ID NO: 4166
  Synthetic polynucleotide

SEQ ID NO: 4168 - DNA, 179 bp, Artificial Sequence
  Synthetic polynucleotide
atcatctcaccttgcctcctgcattctttgtaggtgcacctgcaggctctaggaaacgcaattctgggaaagactctaggaaacgcaattctgggaatcgctctaggaaacgcaattctgggaagacctctaggaaacgcaattctgggaactaggcgcgccatgcttcatcagactct

SEQ ID NO: 4169 - DNA, 179 bp, Artificial Sequence; identical to SEQ ID NO: 4168
  Synthetic polynucleotide

SEQ ID NO: 4170 - DNA, 197 bp, Artificial Sequence
  Synthetic polynucleotide
atcatctcaccttgcctcctggatagaaagtggaagaccctgcaggagaacatcatgtactagaagaacatcatgtacttcgagaacatcatgtactgacagaacatcatgtactctaagaacatcatgtactactagaacatcatgtacttgcagaacatcatgtactgtaggcgcgccatgcttcatcagactct

SEQ ID NO: 4171 - DNA, 197 bp, Artificial Sequence; identical to SEQ ID NO: 4170
  Synthetic polynucleotide

SEQ ID NO: 4172 - DNA, 140 bp, Artificial Sequence
  Synthetic polynucleotide
atcatctcaccttgcctcctgcacgatcaaggacatttcctgcaggagtccaagaagtccatcgagtccagacagtccactaagtccaactagtccatgcagtccagtaagtccaggcgcgccatgcttcatcagactct

SEQ ID NO: 4173 - DNA, 140 bp, Artificial Sequence; identical to SEQ ID NO: 4172
  Synthetic polynucleotide

SEQ ID NO: 4174 - DNA, 196 bp, Artificial Sequence
  Synthetic polynucleotide
atcatctcaccttgcctcctggttaggcaccaagcgaacctgcaggacgtcagcaatttagaacgtcagcaattttcgacgtcagcaatttgacacgtcagcaatttctaacgtcagcaatttactacgtcagcaattttgcacgtcagcaatttgtaacgtcagcaatttggcgcgccatgcttcatcagactct

SEQ ID NO: 4175 - DNA, 196 bp, Artificial Sequence; identical to SEQ ID NO: 4174
  Synthetic polynucleotide

SEQ ID NO: 4176 - DNA, 180 bp, Artificial Sequence
  Synthetic polynucleotide
atcatctcaccttgcctcctgtatacagcaagggctggcctgcaggctcacgtgcacagactcacgtgcactcgctcacgtgcacgacctcacgtgcacctactcacgtgcacactctcacgtgcactgcctcacgtgcacgtactcacgtgcacggcgcgccatgcttcatcagactct

SEQ ID NO: 4177 - DNA, 180 bp, Artificial Sequence; identical to SEQ ID NO: 4176
  Synthetic polynucleotide

SEQ ID NO: 4178 - DNA, 148 bp, Artificial Sequence
  Synthetic polynucleotide
atcatctcaccttgcctcctgtcagtctgccgagggatcctgcaggtggaaaaagatggaaaatcgtggaaaagactggaaaactatggaaaaacttggaaaatgctggaaaagtatggaaaaggcgcgccatgcttcatcagactct

SEQ ID NO: 4179 - DNA, 148 bp, Artificial Sequence; identical to SEQ ID NO: 4178
  Synthetic polynucleotide

SEQ ID NO: 4180 - DNA, 200 bp, Artificial Sequence
  Synthetic polynucleotide
atcatctcaccttgcctcctgcccaccgtatctgagaccctgcagggcggacgttgaacgtccgcagagcggacgttgaacgtccgctcggcggacgttgaacgtccgcgacgcggacgttgaacgtccgcctagcggacgttgaacgtccgcactgcggacgttgaacgtccgcggcgcgccatgcttcatcagactct

SEQ ID NO: 4181 - DNA, 200 bp, Artificial Sequence; identical to SEQ ID NO: 4180
  Synthetic polynucleotide

SEQ ID NO: 4182 - DNA, 185 bp, Artificial Sequence
  Synthetic polynucleotide
atcatctcaccttgcctcctgtctcctagggttaatgacctgcagggaggtcaaaaggtcaaagagaggtcaaaaggtcaatcggaggtcaaaaggtcaagacgaggtcaaaaggtcaactagaggtcaaaaggtcaaactgaggtcaaaaggtcaatgcggcgcgccatgcttcatcagactct

SEQ ID NO: 4183 - DNA, 185 bp, Artificial Sequence; identical to SEQ ID NO: 4182
  Synthetic polynucleotide

SEQ ID NO: 4184 - DNA, 185 bp, Artificial Sequence
  Synthetic polynucleotide
atcatctcaccttgcctcctggcctgttaaacctctcacctgcagggaggtcaaaaggtcacagagaggtcaaaaggtcactcggaggtcaaaaggtcacgacgaggtcaaaaggtcacctagaggtcaaaaggtcacactgaggtcaaaaggtcactgcggcgcgccatgcttcatcagactct

SEQ ID NO: 4185 - DNA, 185 bp, Artificial Sequence; identical to SEQ ID NO: 4184
  Synthetic polynucleotide

SEQ ID NO: 4186 - DNA, 172 bp, Artificial Sequence
  Synthetic polynucleotide
atcatctcaccttgcctcctggcttactacctctagtccctgcaggaatgactcatagaaatgactcattcgaatgactcatgacaatgactcatctaaatgactcatactaatgactcattgcaatgactcatgtaaatgactcatggcgcgccatgcttcatcagactct

SEQ ID NO: 4187 - DNA, 172 bp, Artificial Sequence; identical to SEQ ID NO: 4186
  Synthetic polynucleotide

SEQ ID NO: 4188 - DNA, 172 bp, Artificial Sequence
  Synthetic polynucleotide
atcatctcaccttgcctcctgtgcgcgtctatgcgtgtcctgcaggtgacccggaaagatgacccggaatcgtgacccggaagactgacccggaactatgacccggaaacttgacccggaatgctgacccggaagtatgacccggaaggcgcgccatgcttcatcagactct

SEQ ID NO: 4189 - DNA, 172 bp, Artificial Sequence; identical to SEQ ID NO: 4188
  Synthetic polynucleotide

SEQ ID NO: 4190 - DNA, 197 bp, Artificial Sequence
  Synthetic polynucleotide
atcatctcaccttgcctcctgaaaggcatctgaagcgccctgcaggcatgccctggggccaagacatgccctggggccatcgcatgccctggggccagaccatgccctggggccactacatgccctggggccaactcatgccctggggccatgccatgccctggggccagtaggcgcgccatgcttcatcagactct

SEQ ID NO: 4191 - DNA, 197 bp, Artificial Sequence; identical to SEQ ID NO: 4190
  Synthetic polynucleotide

SEQ ID NO: 4192 - DNA, 197 bp, Artificial Sequence
  Synthetic polynucleotide
atcatctcaccttgcctcctgagcaggtgtgtcggtaacctgcagggtggggcagccacctagagtggggcagccaccttcggtggggcagccacctgacgtggggcagccacctctagtggggcagccacctactgtggggcagccaccttgcgtggggcagccacctgtaggcgcgccatgcttcatcagactct

SEQ ID NO: 4193 - DNA, 197 bp, Artificial Sequence; identical to SEQ ID NO: 4192
  Synthetic polynucleotide

SEQ ID NO: 4194 - DNA, 179 bp, Artificial Sequence
  Synthetic polynucleotide
atcatctcaccttgcctcctgctcagttgatgcggcttcctgcaggtttttatcacctaattctctacctagatttttatcacctaattctctaccttcgtttttatcacctaattctctacctgactttttatcacctaattctctacctctaggcgcgccatgcttcatcagactct

SEQ ID NO: 4195 - DNA, 179 bp, Artificial Sequence; identical to SEQ ID NO: 4194
  Synthetic polynucleotide

SEQ ID NO: 4196 - DNA, 190 bp, Artificial Sequence
  Synthetic polynucleotide
atcatctcaccttgcctcctgggaatagcaaacgtgatcctgcaggtacgtggttacgttagatacgtggttacgtttcgtacgtggttacgttgactacgtggttacgttctatacgtggttacgttacttacgtggttacgtttgctacgtggttacgttgtaggcgcgccatgcttcatcagactct

SEQ ID NO: 4197 - DNA, 190 bp, Artificial Sequence; identical to SEQ ID NO: 4196
  Synthetic polynucleotide

SEQ ID NO: 4198 - DNA, 140 bp, Artificial Sequence
  Synthetic polynucleotide
atcatctcaccttgcctcctgtaacttcaggtctactccctgcaggatgacgagaatgacgtcgatgacggacatgacgctaatgacgactatgacgtgcatgacggtaatgacgggcgcgccatgcttcatcagactct

SEQ ID NO: 4199 - DNA, 140 bp, Artificial Sequence; identical to SEQ ID NO: 4198
  Synthetic polynucleotide

SEQ ID NO: 4200 - DNA, 172 bp, Artificial Sequence
  Synthetic polynucleotide
atcatctcaccttgcctcctgagctcgccctctgatgtcctgcaggcgcgcgtggcagacgcgcgtggctcgcgcgcgtggcgaccgcgcgtggcctacgcgcgtggcactcgcgcgtggctgccgcgcgtggcgtacgcgcgtggcggcgcgccatgcttcatcagactct

SEQ ID NO: 4201 - DNA, 172 bp, Artificial Sequence; identical to SEQ ID NO: 4200
  Synthetic polynucleotide

SEQ ID NO: 4202 - DNA, 156 bp, Artificial Sequence
  Synthetic polynucleotide
atcatctcaccttgcctcctggaatatgcgtagcgcgccctgcagggttgctatagagttgctattcggttgctatgacgttgctatctagttgctatactgttgctattgcgttgctatgtagttgctatggcgcgccatgcttcatcagactct

SEQ ID NO: 4203 - DNA, 156 bp, Artificial Sequence; identical to SEQ ID NO: 4202
  Synthetic polynucleotide

SEQ ID NO: 4204 - DNA, 191 bp, Artificial Sequence
  Synthetic polynucleotide
atcatctcaccttgcctcctggtcctactcaccatggccctgcaggttcatactggagagaaaagattcatactggagagaaatcgttcatactggagagaaagacttcatactggagagaaactattcatactggagagaaaactttcatactggagagaaatgcggcgcgccatgcttcatcagactct

SEQ ID NO: 4205 - DNA, 191 bp, Artificial Sequence; identical to SEQ ID NO: 4204
  Synthetic polynucleotide

SEQ ID NO: 4206 - DNA, 172 bp, Artificial Sequence
  Synthetic polynucleotide
atcatctcaccttgcctcctgacctgtagactactggccctgcaggcaataaacaaagacaataaacaatcgcaataaacaagaccaataaacaactacaataaacaaactcaataaacaatgccaataaacaagtacaataaacaaggcgcgccatgcttcatcagactct

SEQ ID NO: 4207 - DNA, 172 bp, Artificial Sequence; identical to SEQ ID NO: 4206
  Synthetic polynucleotide

SEQ ID NO: 4208 - DNA, 190 bp, Artificial Sequence
  Synthetic polynucleotide
atcatctcaccttgcctcctgcggtacataccctctcacctgcaggtgctgagtcatgctagatgctgagtcatgcttcgtgctgagtcatgctgactgctgagtcatgctctatgctgagtcatgctacttgctgagtcatgcttgctgctgagtcatgctgtaggcgcgccatgcttcatcagactct

SEQ ID NO: 4209 - DNA, 190 bp, Artificial Sequence; identical to SEQ ID NO: 4208
  Synthetic polynucleotide

SEQ ID NO: 4210 - DNA, 172 bp, Artificial Sequence
  Synthetic polynucleotide
atcatctcaccttgcctcctgggcctcataagagtcggcctgcaggaacaggtggtagaaacaggtggttcgaacaggtggtgacaacaggtggtctaaacaggtggtactaacaggtggttgcaacaggtggtgtaaacaggtggtggcgcgccatgcttcatcagactct

SEQ ID NO: 4211 - DNA, 172 bp, Artificial Sequence; identical to SEQ ID NO: 4210
  Synthetic polynucleotide

SEQ ID NO: 4212 - DNA, 188 bp, Artificial Sequence
  Synthetic polynucleotide
atcatctcaccttgcctcctggataacgttacgcaagacctgcaggtaatccaattatagataatccaattattcgtaatccaattatgactaatccaattatctataatccaattatacttaatccaattattgctaatccaattatgtataatccaattatggcgcgccatgcttcatcagactct

SEQ ID NO: 4213 - DNA, 188 bp, Artificial Sequence; identical to SEQ ID NO: 4212
  Synthetic polynucleotide

SEQ ID NO: 4214 - DNA, 164 bp, Artificial Sequence
  Synthetic polynucleotide
atcatctcaccttgcctcctgagatctaagtatatgcgcctgcaggcagcaccttagacagcacctttcgcagcaccttgaccagcaccttctacagcaccttactcagcacctttgccagcaccttgtacagcaccttggcgcgccatgcttcatcagactct

SEQ ID NO: 4215 - DNA, 164 bp, Artificial Sequence; identical to SEQ ID NO: 4214
  Synthetic polynucleotide

SEQ ID NO: 4216 - DNA, 197 bp, Artificial Sequence
  Synthetic polynucleotide
atcatctcaccttgcctcctggtatgggtttaaccgaacctgcagggccaccagggggcgcagagccaccagggggcgctcggccaccagggggcgcgacgccaccagggggcgcctagccaccagggggcgcactgccaccagggggcgctgcgccaccagggggcgcgtaggcgcgccatgcttcatcagactct

SEQ ID NO: 4217 - DNA, 197 bp, Artificial Sequence; identical to SEQ ID NO: 4216
  Synthetic polynucleotide

SEQ ID NO: 4218 - DNA, 172 bp, Artificial Sequence
  Synthetic polynucleotide
atcatctcaccttgcctcctgaggccggatctgatattcctgcaggtattaataatagatattaataattcgtattaataatgactattaataatctatattaataatacttattaataattgctattaataatgtatattaataatggcgcgccatgcttcatcagactct

SEQ ID NO: 4219 - DNA, 172 bp, Artificial Sequence; identical to SEQ ID NO: 4218
  Synthetic polynucleotide

SEQ ID NO: 4220 - DNA, 156 bp, Artificial Sequence
  Synthetic polynucleotide
atcatctcaccttgcctcctggttagaagacagctatccctgcaggtttggcggagatttggcggtcgtttggcgggactttggcggctatttggcggacttttggcggtgctttggcgggtatttggcggggcgcgccatgcttcatcagactct

SEQ ID NO: 4221 - DNA, 156 bp, Artificial Sequence; identical to SEQ ID NO: 4220
  Synthetic polynucleotide

SEQ ID NO: 4222 - DNA, 185 bp, Artificial Sequence
  Synthetic polynucleotide
atcatctcaccttgcctcctgcttacctgcaactcggccctgcaggaaggagctgtcaatacagaaaggagctgtcaatactcgaaggagctgtcaatacgacaaggagctgtcaatacctaaaggagctgtcaatacactaaggagctgtcaatactgcggcgcgccatgcttcatcagactct

SEQ ID NO: 4223 - DNA, 185 bp, Artificial Sequence; identical to SEQ ID NO: 4222
  Synthetic polynucleotide

SEQ ID NO: 4224 - DNA, 148 bp, Artificial Sequence
  Synthetic polynucleotide
atcatctcaccttgcctcctggttgagttcgagcaactcctgcaggcataaatagacataaattcgcataaatgaccataaatctacataaatactcataaattgccataaatgtacataaatggcgcgccatgcttcatcagactct

SEQ ID NO: 4225 - DNA, 148 bp, Artificial Sequence; identical to SEQ ID NO: 4224
  Synthetic polynucleotide

SEQ ID NO: 4226 - DNA, 200 bp, Artificial Sequence
  Synthetic polynucleotide
atcatctcaccttgcctcctgcgcaagatgagagtcgtcctgcaggtccatcatgcgtgacgaggagatccatcatgcgtgacgaggtcgtccatcatgcgtgacgagggactccatcatgcgtgacgaggctatccatcatgcgtgacgaggacttccatcatgcgtgacgaggggcgcgccatgcttcatcagactct

SEQ ID NO: 4227 - DNA, 200 bp, Artificial Sequence; identical to SEQ ID NO: 4226
  Synthetic polynucleotide

SEQ ID NO: 4228 - DNA, 196 bp, Artificial Sequence
  Synthetic polynucleotide
atcatctcaccttgcctcctgattaatgggtcctactgcctgcaggactgttactaaaaatagaaactagaactgttactaaaaatagaaacttcgactgttactaaaaatagaaactgacactgttactaaaaatagaaactctaactgttactaaaaatagaaactactggcgcgccatgcttcatcagactct

SEQ ID NO: 4229 - DNA, 196 bp, Artificial Sequence; identical to SEQ ID NO: 4228
  Synthetic polynucleotide

SEQ ID NO: 4230 - DNA, 140 bp, Artificial Sequence
  Synthetic polynucleotide
atcatctcaccttgcctcctgagccgctgtactgacgacctgcaggaccacaagaaccacatcgaccacagacaccacactaaccacaactaccacatgcaccacagtaaccacaggcgcgccatgcttcatcagactct

SEQ ID NO: 4231 - DNA, 140 bp, Artificial Sequence; identical to SEQ ID NO: 4230
  Synthetic polynucleotide

SEQ ID NO: 4232 - DNA, 197 bp, Artificial Sequence
  Synthetic polynucleotide
atcatctcaccttgcctcctgatgaagtgcaacaactacctgcaggacatgcccagacatgagaacatgcccagacatgtcgacatgcccagacatggacacatgcccagacatgctaacatgcccagacatgactacatgcccagacatgtgcacatgcccagacatggtaggcgcgccatgcttcatcagactct

SEQ ID NO: 4233 - DNA, 197 bp, Artificial Sequence; identical to SEQ ID NO: 4232
  Synthetic polynucleotide

SEQ ID NO: 4234 - DNA, 185 bp, Artificial Sequence
  Synthetic polynucleotide
atcatctcaccttgcctcctgacggtccaaactcctgccctgcaggtaaagtcgtaaaatagagataaagtcgtaaaatagtcgtaaagtcgtaaaataggactaaagtcgtaaaatagctataaagtcgtaaaatagacttaaagtcgtaaaatagtgcggcgcgccatgcttcatcagactct

SEQ ID NO: 4235 - DNA, 185 bp, Artificial Sequence; identical to SEQ ID NO: 4234
  Synthetic polynucleotide

SEQ ID NO: 4236 - DNA, 156 bp, Artificial Sequence
  Synthetic polynucleotide
atcatctcaccttgcctcctgaccgacgagcaataccccctgcaggcttgtaatagacttgtaattcgcttgtaatgaccttgtaatctacttgtaatactcttgtaattgccttgtaatgtacttgtaatggcgcgccatgcttcatcagactct

SEQ ID NO: 4237 - DNA, 156 bp, Artificial Sequence; identical to SEQ ID NO: 4236
  Synthetic polynucleotide

SEQ ID NO: 4238 - DNA, 188 bp, Artificial Sequence
  Synthetic polynucleotide
atcatctcaccttgcctcctgttccgcaacgtgctcaacctgcaggagggctatttttagaagggctattttttcgagggctatttttgacagggctatttttctaagggctatttttactagggctattttttgcagggctatttttgtaagggctatttttggcgcgccatgcttcatcagactct

SEQ ID NO: 4239 - DNA, 188 bp, Artificial Sequence; identical to SEQ ID NO: 4238
  Synthetic polynucleotide

SEQ ID NO: 4240 - DNA, 156 bp, Artificial Sequence
  Synthetic polynucleotide
atcatctcaccttgcctcctgcgccgcattgcctacatcctgcaggtttggcgcagatttggcgctcgtttggcgcgactttggcgcctatttggcgcacttttggcgctgctttggcgcgtatttggcgcggcgcgccatgcttcatcagactct

SEQ ID NO: 4241 - DNA, 156 bp, Artificial Sequence; identical to SEQ ID NO: 4240
  Synthetic polynucleotide

SEQ ID NO: 4242 - DNA, 191 bp, Artificial Sequence
  Synthetic polynucleotide
atcatctcaccttgcctcctgcatgatggcggtcacgacctgcaggtattcaaggtcatgcgaagatattcaaggtcatgcgatcgtattcaaggtcatgcgagactattcaaggtcatgcgactatattcaaggtcatgcgaacttattcaaggtcatgcgatgcggcgcgccatgcttcatcagactct

SEQ ID NO: 4243 - DNA, 191 bp, Artificial Sequence; identical to SEQ ID NO: 4242
  Synthetic polynucleotide

SEQ ID NO: 4244 - DNA, 172 bp, Artificial Sequence
  Synthetic polynucleotide
atcatctcaccttgcctcctggcttggagcacaatggccctgcaggtgctttaattagatgctttaatttcgtgctttaattgactgctttaattctatgctttaattacttgctttaatttgctgctttaattgtatgctttaattggcgcgccatgcttcatcagactct

SEQ ID NO: 4245 - DNA, 172 bp, Artificial Sequence; identical to SEQ ID NO: 4244
  Synthetic polynucleotide

SEQ ID NO: 4246 - DNA, 164 bp, Artificial Sequence
  Synthetic polynucleotide
atcatctcaccttgcctcctggagatgtgatgcagttgcctgcaggaagtcacgtagaaagtcacgttcgaagtcacgtgacaagtcacgtctaaagtcacgtactaagtcacgttgcaagtcacgtgtaaagtcacgtggcgcgccatgcttcatcagactct

SEQ ID NO: 4247 - DNA, 164 bp, Artificial Sequence; identical to SEQ ID NO: 4246
  Synthetic polynucleotide

SEQ ID NO: 4248 - DNA, 200 bp, Artificial Sequence
  Synthetic polynucleotide
atcatctcaccttgcctcctgtccgcgaattgacgcgtcctgcaggtcacggttgattgcttttgagatcacggttgattgcttttgtcgtcacggttgattgcttttggactcacggttgattgcttttgctatcacggttgattgcttttgacttcacggttgattgcttttgggcgcgccatgcttcatcagactct

SEQ ID NO: 4249 - DNA, 200 bp, Artificial Sequence; identical to SEQ ID NO: 4248
  Synthetic polynucleotide

SEQ ID NO: 4250 - DNA, 172 bp, Artificial Sequence
  Synthetic polynucleotide
atcatctcaccttgcctcctgtcgttaaccaaacaacgcctgcaggctaattacgcagactaattacgctcgctaattacgcgacctaattacgcctactaattacgcactctaattacgctgcctaattacgcgtactaattacgcggcgcgccatgcttcatcagactct

SEQ ID NO: 4251 - DNA, 172 bp, Artificial Sequence; identical to SEQ ID NO: 4250
  Synthetic polynucleotide

SEQ ID NO: 4252 - DNA, 196 bp, Artificial Sequence
  Synthetic polynucleotide
atcatctcaccttgcctcctgatcagaatcgaatcggacctgcaggggggattgcatctagaggggattgcatcttcgggggattgcatctgacggggattgcatctctaggggattgcatctactggggattgcatcttgcggggattgcatctgtaggggattgcatctggcgcgccatgcttcatcagactct

SEQ ID NO: 4253 - DNA, 196 bp, Artificial Sequence; identical to SEQ ID NO: 4252
  Synthetic polynucleotide

SEQ ID NO: 4254 - DNA, 172 bp, Artificial Sequence
  Synthetic polynucleotide
atcatctcaccttgcctcctgattccaaacgctttcgccctgcaggaaccttatatagaaaccttatattcgaaccttatatgacaaccttatatctaaaccttatatactaaccttatattgcaaccttatatgtaaaccttatatggcgcgccatgcttcatcagactct

SEQ ID NO: 4255 - DNA, 172 bp, Artificial Sequence; identical to SEQ ID NO: 4254
  Synthetic polynucleotide

SEQ ID NO: 4256 - DNA, 197 bp, Artificial Sequence
  Synthetic polynucleotide
atcatctcaccttgcctcctgcaagcatactcgatccccctgcaggtctcacgctagccgggggagatctcacgctagccgggggtcgtctcacgctagccggggggactctcacgctagccgggggctatctcacgctagccgggggacttctcacgctagccgggggtgcggcgcgccatgcttcatcagactct

SEQ ID NO: 4257 - DNA, 197 bp, Artificial Sequence; identical to SEQ ID NO: 4256
  Synthetic polynucleotide

SEQ ID NO: 4258 - DNA, 185 bp, Artificial Sequence
  Synthetic polynucleotide
atcatctcaccttgcctcctgccgtgattgaacgcgttcctgcaggaaattttacgaggtttagaaaattttacgaggttttcgaaattttacgaggtttgacaaattttacgaggtttctaaaattttacgaggtttactaaattttacgaggttttgcggcgcgccatgcttcatcagactct

SEQ ID NO: 4259 - DNA, 185 bp, Artificial Sequence; identical to SEQ ID NO: 4258
  Synthetic polynucleotide

SEQ ID NO: 4260 - DNA, 180 bp, Artificial Sequence
  Synthetic polynucleotide
atcatctcaccttgcctcctgtagcttgcttgtgtaagcctgcaggaatgtatcaatagaaatgtatcaattcgaatgtatcaatgacaatgtatcaatctaaatgtatcaatactaatgtatcaattgcaatgtatcaatgtaaatgtatcaatggcgcgccatgcttcatcagactct

SEQ ID NO: 4261 - DNA, 180 bp, Artificial Sequence; identical to SEQ ID NO: 4260
  Synthetic polynucleotide

SEQ ID NO: 4262 - DNA, 191 bp, Artificial Sequence
  Synthetic polynucleotide
atcatctcaccttgcctcctgcatacatacattcgacgcctgcagggaacaccatttttgaacagagaacaccatttttgaactcggaacaccatttttgaacgacgaacaccatttttgaacctagaacaccatttttgaacactgaacaccatttttgaactgcggcgcgccatgcttcatcagactct

SEQ ID NO: 4263 - DNA, 191 bp, Artificial Sequence; identical to SEQ ID NO: 4262
  Synthetic polynucleotide

SEQ ID NO: 4264 - DNA, 191 bp, Artificial Sequence
  Synthetic polynucleotide
atcatctcaccttgcctcctgctttcgccacagtctctcctgcaggtgaccttgaatgaccttagatgaccttgaatgacctttcgtgaccttgaatgaccttgactgaccttgaatgaccttctatgaccttgaatgaccttacttgaccttgaatgacctttgcggcgcgccatgcttcatcagactct

SEQ ID NO: 4265 - DNA, 191 bp, Artificial Sequence; identical to SEQ ID NO: 4264
  Synthetic polynucleotide

SEQ ID NO: 4266 - DNA, 191 bp, Artificial Sequence
  Synthetic polynucleotide
atcatctcaccttgcctcctgctgcgtatgccgtttcccctgcaggaccttaaccgtgacgaaatttagaaccttaaccgtgacgaaattttcgaccttaaccgtgacgaaatttgacaccttaaccgtgacgaaatttctaaccttaaccgtgacgaaatttactggcgcgccatgcttcatcagactct

SEQ ID NO: 4267 - DNA, 191 bp, Artificial Sequence; identical to SEQ ID NO: 4266
  Synthetic polynucleotide

SEQ ID NO: 4268 - DNA, 180 bp, Artificial Sequence
  Synthetic polynucleotide
atcatctcaccttgcctcctgtggattcccacgcatgacctgcaggcagacggacacagacagacggacactcgcagacggacacgaccagacggacacctacagacggacacactcagacggacactgccagacggacacgtacagacggacacggcgcgccatgcttcatcagactct

SEQ ID NO: 4269 - DNA, 180 bp, Artificial Sequence; identical to SEQ ID NO: 4268
  Synthetic polynucleotide

SEQ ID NO: 4270 - DNA, 191 bp, Artificial Sequence
  Synthetic polynucleotide
atcatctcaccttgcctcctggtctgagtatatgcaatcctgcagggccagaaccggtttgaaccggagagccagaaccggtttgaaccggtcggccagaaccggtttgaaccgggacgccagaaccggtttgaaccggctagccagaaccggtttgaaccggactggcgcgccatgcttcatcagactct

SEQ ID NO: 4271 - DNA, 191 bp, Artificial Sequence; identical to SEQ ID NO: 4270
  Synthetic polynucleotide

SEQ ID NO: 4272 - DNA, 197 bp, Artificial Sequence
  Synthetic polynucleotide
atcatctcaccttgcctcctgatgcttacttcatagaccctgcagggccaccagggggcgctatagagccaccagggggcgctattcggccaccagggggcgctatgacgccaccagggggcgctatctagccaccagggggcgctatactgccaccagggggcgctattgcggcgcgccatgcttcatcagactct

SEQ ID NO: 4273 - DNA, 197 bp, Artificial Sequence; identical to SEQ ID NO: 4272
  Synthetic polynucleotide

SEQ ID NO: 4274 - DNA, 191 bp, Artificial Sequence
  Synthetic polynucleotide
atcatctcaccttgcctcctgcagccactgttcactgccctgcaggtagtagcctggcaacaaagatagtagcctggcaacaatcgtagtagcctggcaacaagactagtagcctggcaacaactatagtagcctggcaacaaacttagtagcctggcaacaatgcggcgcgccatgcttcatcagactct

SEQ ID NO: 4275 - DNA, 191 bp, Artificial Sequence; identical to SEQ ID NO: 4274
  Synthetic polynucleotide

SEQ ID NO: 4276 - DNA, 191 bp, Artificial Sequence
  Synthetic polynucleotide
atcatctcaccttgcctcctgtacctaacaggctaatacctgcagggccaccagggggcgccaagagccaccagggggcgccatcggccaccagggggcgccagacgccaccagggggcgccactagccaccagggggcgccaactgccaccagggggcgccatgcggcgcgccatgcttcatcagactct

SEQ ID NO: 4277 - DNA, 191 bp, Artificial Sequence; identical to SEQ ID NO: 4276
  Synthetic polynucleotide

SEQ ID NO: 4278 - DNA, 185 bp, Artificial Sequence
  Synthetic polynucleotide
atcatctcaccttgcctcctggagatgtggttgcacggcctgcaggaccggcaattaataaaagaaccggcaattaataaatcgaccggcaattaataaagacaccggcaattaataaactaaccggcaattaataaaactaccggcaattaataaatgcggcgcgccatgcttcatcagactct

SEQ ID NO: 4279 - DNA, 185 bp, Artificial Sequence; identical to SEQ ID NO: 4278
  Synthetic polynucleotide

SEQ ID NO: 4280 - DNA, 185 bp, Artificial Sequence
  Synthetic polynucleotide
atcatctcaccttgcctcctgtcaaggaggttcgtcatcctgcaggaaattaattgattttgagaaaattaattgattttgtcgaaattaattgattttggacaaattaattgattttgctaaaattaattgattttgactaaattaattgattttgtgcggcgcgccatgcttcatcagactct

SEQ ID NO: 4281 - DNA, 185 bp, Artificial Sequence; identical to SEQ ID NO: 4280
  Synthetic polynucleotide

SEQ ID NO: 4282 - DNA, 140 bp, Artificial Sequence
  Synthetic polynucleotide
atcatctcaccttgcctcctgagcaactcctgagcggacctgcaggagttcaagaagttcatcgagttcagacagttcactaagttcaactagttcatgcagttcagtaagttcaggcgcgccatgcttcatcagactct

SEQ ID NO: 4283 - DNA, 140 bp, Artificial Sequence; identical to SEQ ID NO: 4282
  Synthetic polynucleotide

SEQ ID NO: 4284 - DNA, 190 bp, Artificial Sequence
  Synthetic polynucleotide
atcatctcaccttgcctcctggttcctatttgataggccctgcaggccccgcccacgcacagaccccgcccacgcactcgccccgcccacgcacgacccccgcccacgcacctaccccgcccacgcacactccccgcccacgcactgcccccgcccacgcacgtaggcgcgccatgcttcatcagactct

SEQ ID NO: 4285 - DNA, 190 bp, Artificial Sequence; identical to SEQ ID NO: 4284
  Synthetic polynucleotide

SEQ ID NO: 4286 - DNA, 164 bp, Artificial Sequence
  Synthetic polynucleotide
atcatctcaccttgcctcctggtagtggcgaccaatagcctgcagggcagctggtagagcagctggttcggcagctggtgacgcagctggtctagcagctggtactgcagctggttgcgcagctggtgtagcagctggtggcgcgccatgcttcatcagactct

SEQ ID NO: 4287 - DNA, 164 bp, Artificial Sequence; identical to SEQ ID NO: 4286
  Synthetic polynucleotide

SEQ ID NO: 4288 - DNA, 188 bp, Artificial Sequence
  Synthetic polynucleotide
atcatctcaccttgcctcctgggcgtcatattcccagccctgcagggtattcccaaacagagtattcccaaactcggtattcccaaacgacgtattcccaaacctagtattcccaaacactgtattcccaaactgcgtattcccaaacgtagtattcccaaacggcgcgccatgcttcatcagactct

SEQ ID NO: 4289 - DNA, 188 bp, Artificial Sequence; identical to SEQ ID NO: 4288
  Synthetic polynucleotide

SEQ ID NO: 4290 - DNA, 180 bp, Artificial Sequence
  Synthetic polynucleotide
atcatctcaccttgcctcctgcataacgtccaacataacctgcaggaacagctgcagagaaacagctgcagtcgaacagctgcaggacaacagctgcagctaaacagctgcagactaacagctgcagtgcaacagctgcaggtaaacagctgcagggcgcgccatgcttcatcagactct

SEQ ID NO: 4291 - DNA, 180 bp, Artificial Sequence; identical to SEQ ID NO: 4290
  Synthetic polynucleotide

SEQ ID NO: 4292 - DNA, 148 bp, Artificial Sequence
  Synthetic polynucleotide
atcatctcaccttgcctcctgacatgaaagaacgcttccctgcaggcagctgcagacagctgctcgcagctgcgaccagctgcctacagctgcactcagctgctgccagctgcgtacagctgcggcgcgccatgcttcatcagactct

SEQ ID NO: 4293 - DNA, 148 bp, Artificial Sequence; identical to SEQ ID NO: 4292
  Synthetic polynucleotide

SEQ ID NO: 4294 - DNA, 164 bp, Artificial Sequence
  Synthetic polynucleotide
atcatctcaccttgcctcctgcccggatctacaatccgcctgcaggtatttacgcagatatttacgctcgtatttacgcgactatttacgcctatatttacgcacttatttacgctgctatttacgcgtatatttacgcggcgcgccatgcttcatcagactct

SEQ ID NO: 4295 - DNA, 164 bp, Artificial Sequence; identical to SEQ ID NO: 4294
  Synthetic polynucleotide

SEQ ID NO: 4296 - DNA, 156 bp, Artificial Sequence
  Synthetic polynucleotide
atcatctcaccttgcctcctgctctcgtcaagttcccgcctgcaggccaggtgtagaccaggtgttcgccaggtgtgacccaggtgtctaccaggtgtactccaggtgttgcccaggtgtgtaccaggtgtggcgcgccatgcttcatcagactct

SEQ ID NO: 4297 - DNA, 156 bp, Artificial Sequence; identical to SEQ ID NO: 4296
  Synthetic polynucleotide

SEQ ID NO: 4298 - DNA, 197 bp, Artificial Sequence
  Synthetic polynucleotide
atcatctcaccttgcctcctgtaatgacgcggtaggttcctgcagggacccggaagcggttagagacccggaagcggtttcggacccggaagcggttgacgacccggaagcggttctagacccggaagcggttactgacccggaagcggtttgcgacccggaagcggttgtaggcgcgccatgcttcatcagactct

SEQ ID NO: 4299 - DNA, 197 bp, Artificial Sequence; identical to SEQ ID NO: 4298
  Synthetic polynucleotide

SEQ ID NO: 4300 - DNA, 197 bp, Artificial Sequence
  Synthetic polynucleotide
atcatctcaccttgcctcctgccgatgtcacaggagagcctgcaggaaccacctgttgctcagaaaccacctgttgctctcgaaccacctgttgctcgacaaccacctgttgctcctaaaccacctgttgctcactaaccacctgttgctctgcaaccacctgttgctcgtaggcgcgccatgcttcatcagactct

SEQ ID NO: 4301 - DNA, 197 bp, Artificial Sequence; identical to SEQ ID NO: 4300
  Synthetic polynucleotide

SEQ ID NO: 4302 - DNA, 188 bp, Artificial Sequence
  Synthetic polynucleotide
atcatctcaccttgcctcctgataggtctacccgaaggcctgcagggccgcacgtacgagagccgcacgtacgtcggccgcacgtacggacgccgcacgtacgctagccgcacgtacgactgccgcacgtacgtgcgccgcacgtacggtagccgcacgtacgggcgcgccatgcttcatcagactct

SEQ ID NO: 4303 - DNA, 188 bp, Artificial Sequence; identical to SEQ ID NO: 4302
  Synthetic polynucleotide

SEQ ID NO: 4304 - DNA, 190 bp, Artificial Sequence
  Synthetic polynucleotide
atcatctcaccttgcctcctggtcgaattcgctcacatcctgcaggttaagaggaagttaagattaagaggaagttatcgttaagaggaagttagacttaagaggaagttactattaagaggaagttaactttaagaggaagttatgcttaagaggaagttagtaggcgcgccatgcttcatcagactct

SEQ ID NO: 4305 - DNA, 190 bp, Artificial Sequence; identical to SEQ ID NO: 4304
  Synthetic polynucleotide

SEQ ID NO: 4306 - DNA, 191 bp, Artificial Sequence
  Synthetic polynucleotide
atcatctcaccttgcctcctgatgcatggcctccatcccctgcaggtgttgtgtccgtgccatctggagatgttgtgtccgtgccatctggtcgtgttgtgtccgtgccatctgggactgttgtgtccgtgccatctggctatgttgtgtccgtgccatctggactggcgcgccatgcttcatcagactct

SEQ ID NO: 4307 - DNA, 191 bp, Artificial Sequence; identical to SEQ ID NO: 4306
  Synthetic polynucleotide

SEQ ID NO: 4308 - DNA, 188 bp, Artificial Sequence
  Synthetic polynucleotide
atcatctcaccttgcctcctgtaattcgttcgaatctccctgcaggtctatttttagaagatctatttttagatcgtctatttttagagactctatttttagactatctatttttagaacttctatttttagatgctctatttttagagtatctatttttagaggcgcgccatgcttcatcagactct

SEQ ID NO: 4309 - DNA, 188 bp, Artificial Sequence; identical to SEQ ID NO: 4308
  Synthetic polynucleotide

SEQ ID NO: 4310 - DNA, 196 bp, Artificial Sequence
  Synthetic polynucleotide
atcatctcaccttgcctcctggactgttgagcggatatcctgcaggcggctctatcatcagacggctctatcatctcgcggctctatcatcgaccggctctatcatcctacggctctatcatcactcggctctatcatctgccggctctatcatcgtacggctctatcatcggcgcgccatgcttcatcagactct

SEQ ID NO: 4311 - DNA, 196 bp, Artificial Sequence; identical to SEQ ID NO: 4310
  Synthetic polynucleotide

SEQ ID NO: 4312 - DNA, 196 bp, Artificial Sequence
  Synthetic polynucleotide
atcatctcaccttgcctcctgatcatctgaggagaatgcctgcaggcacttcctggttcagacacttcctggttctcgcacttcctggttcgaccacttcctggttcctacacttcctggttcactcacttcctggttctgccacttcctggttcgtacacttcctggttcggcgcgccatgcttcatcagactct

SEQ ID NO: 4313 - DNA, 196 bp, Artificial Sequence; identical to SEQ ID NO: 4312
  Synthetic polynucleotide

SEQ ID NO: 4314 - DNA, 140 bp, Artificial Sequence
  Synthetic polynucleotide
atcatctcaccttgcctcctgcactcactggtgcaacacctgcaggtagttaagatagttatcgtagttagactagttactatagttaacttagttatgctagttagtatagttaggcgcgccatgcttcatcagactct

SEQ ID NO: 4315 - DNA, 140 bp, Artificial Sequence; identical to SEQ ID NO: 4314
  Synthetic polynucleotide

SEQ ID NO: 4316 - DNA, 200 bp, Artificial Sequence
  Synthetic polynucleotide
atcatctcaccttgcctcctgccagccgtcgttaattccctgcaggtcagcaccacggacagcgcagatcagcaccacggacagcgctcgtcagcaccacggacagcgcgactcagcaccacggacagcgcctatcagcaccacggacagcgcacttcagcaccacggacagcgcggcgcgccatgcttcatcagactct

SEQ ID NO: 4317 - DNA, 200 bp, Artificial Sequence; identical to SEQ ID NO: 4316
  Synthetic polynucleotide

SEQ ID NO: 4318 - DNA, 190 bp, Artificial Sequence
  Synthetic polynucleotide
atcatctcaccttgcctcctgatgaccgcgacagtcgacctgcaggctggtttgaactggagactggtttgaactggtcgctggtttgaactgggacctggtttgaactggctactggtttgaactggactctggtttgaactggtgcctggtttgaactgggtaggcgcgccatgcttcatcagactct

SEQ ID NO: 4319 - DNA, 190 bp, Artificial Sequence; identical to SEQ ID NO: 4318
  Synthetic polynucleotide

SEQ ID NO: 4320 - DNA, 180 bp, Artificial Sequence
  Synthetic polynucleotide
atcatctcaccttgcctcctgccgcttgtcctcatcgacctgcagggattgcacaatagagattgcacaattcggattgcacaatgacgattgcacaatctagattgcacaatactgattgcacaattgcgattgcacaatgtagattgcacaatggcgcgccatgcttcatcagactct

SEQ ID NO: 4321 - DNA, 180 bp, Artificial Sequence; identical to SEQ ID NO: 4320
  Synthetic polynucleotide

SEQ ID NO: 4322 - DNA, 156 bp, Artificial Sequence
  Synthetic polynucleotide
atcatctcaccttgcctcctgtcactccagagtgcgctcctgcagggctaattgagagctaattgtcggctaattggacgctaattgctagctaattgactgctaattgtgcgctaattggtagctaattgggcgcgccatgcttcatcagactct

SEQ ID NO: 4323 - DNA, 156 bp, Artificial Sequence; identical to SEQ ID NO: 4322
  Synthetic polynucleotide

SEQ ID NO: 4324 - DNA, 156 bp, Artificial Sequence
  Synthetic polynucleotide
atcatctcaccttgcctcctggatcacccttataacaacctgcagggagcgggaagagagcgggatcggagcgggagacgagcgggactagagcgggaactgagcgggatgcgagcgggagtagagcgggaggcgcgccatgcttcatcagactct

SEQ ID NO: 4325 - DNA, 156 bp, Artificial Sequence; identical to SEQ ID NO: 4324
  Synthetic polynucleotide

SEQ ID NO: 4326 - DNA, 180 bp, Artificial Sequence
  Synthetic polynucleotide
atcatctcaccttgcctcctgtgagtgtgcagagtatgcctgcaggggcaggtgccgagaggcaggtgccgtcgggcaggtgccggacggcaggtgccgctaggcaggtgccgactggcaggtgccgtgcggcaggtgccggtaggcaggtgccgggcgcgccatgcttcatcagactct

SEQ ID NO: 4327 - DNA, 180 bp, Artificial Sequence; identical to SEQ ID NO: 4326
  Synthetic polynucleotide

SEQ ID NO: 4328 - DNA, 164 bp, Artificial Sequence
  Synthetic polynucleotide
atcatctcaccttgcctcctgtggtgatgggtggtactcctgcaggtttaattagagatttaattagtcgtttaattaggactttaattagctatttaattagacttttaattagtgctttaattaggtatttaattagggcgcgccatgcttcatcagactct

SEQ ID NO: 4329 - DNA, 164 bp, Artificial Sequence; identical to SEQ ID NO: 4328
  Synthetic polynucleotide

SEQ ID NO: 4330 - DNA, 188 bp, Artificial Sequence
  Synthetic polynucleotide
atcatctcaccttgcctcctggcttgtccagtatagcacctgcaggtgacagctgtcaagatgacagctgtcatcgtgacagctgtcagactgacagctgtcactatgacagctgtcaacttgacagctgtcatgctgacagctgtcagtatgacagctgtcaggcgcgccatgcttcatcagactct

SEQ ID NO: 4331 - DNA, 188 bp, Artificial Sequence; identical to SEQ ID NO: 4330
  Synthetic polynucleotide

SEQ ID NO: 4332 - DNA, 180 bp, Artificial Sequence
  Synthetic polynucleotide
atcatctcaccttgcctcctggcaggaggtgttctagtcctgcaggggggcagctggagaggggcagctggtcgggggcagctgggacggggcagctggctaggggcagctggactggggcagctggtgcggggcagctgggtaggggcagctggggcgcgccatgcttcatcagactct

SEQ ID NO: 4333 - DNA, 180 bp, Artificial Sequence; identical to SEQ ID NO: 4332
  Synthetic polynucleotide

SEQ ID NO: 4334 - DNA, 191 bp, Artificial Sequence
  Synthetic polynucleotide
atcatctcaccttgcctcctgcttcgcgaagtactcgccctgcaggttatccatcccataataagattatccatcccataatatcgttatccatcccataatagacttatccatcccataatactattatccatcccataataactttatccatcccataatatgcggcgcgccatgcttcatcagactct

SEQ ID NO: 4335 - DNA, 191 bp, Artificial Sequence; identical to SEQ ID NO: 4334
  Synthetic polynucleotide

SEQ ID NO: 4336 - DNA, 156 bp, Artificial Sequence
  Synthetic polynucleotide
atcatctcaccttgcctcctgaaccagccatgataccacctgcagggctaattaagagctaattatcggctaattagacgctaattactagctaattaactgctaattatgcgctaattagtagctaattaggcgcgccatgcttcatcagactct

SEQ ID NO: 4337 - DNA, 156 bp, Artificial Sequence; identical to SEQ ID NO: 4336
  Synthetic polynucleotide

SEQ ID NO: 4338 - DNA, 190 bp, Artificial Sequence
  Synthetic polynucleotide
atcatctcaccttgcctcctgccttaagtagaaatgtccctgcaggttgacagctgtcaaagattgacagctgtcaatcgttgacagctgtcaagacttgacagctgtcaactattgacagctgtcaaactttgacagctgtcaatgcttgacagctgtcaagtaggcgcgccatgcttcatcagactct

SEQ ID NO: 4339 - DNA, 190 bp, Artificial Sequence; identical to SEQ ID NO: 4338
  Synthetic polynucleotide

SEQ ID NO: 4340 - DNA, 172 bp, Artificial Sequence
  Synthetic polynucleotide
atcatctcaccttgcctcctgttcgatcgttaggacatcctgcaggcaggtgtgtgagacaggtgtgtgtcgcaggtgtgtggaccaggtgtgtgctacaggtgtgtgactcaggtgtgtgtgccaggtgtgtggtacaggtgtgtgggcgcgccatgcttcatcagactct

SEQ ID NO: 4341 - DNA, 172 bp, Artificial Sequence; identical to SEQ ID NO: 4340
  Synthetic polynucleotide

SEQ ID NO: 4342 - DNA, 156 bp, Artificial Sequence
  Synthetic polynucleotide
atcatctcaccttgcctcctggtaacgaccctctagttcctgcaggtgacacctagatgacaccttcgtgacacctgactgacacctctatgacacctacttgacaccttgctgacacctgtatgacacctggcgcgccatgcttcatcagactct

SEQ ID NO: 4343 - DNA, 156 bp, Artificial Sequence; identical to SEQ ID NO: 4342
  Synthetic polynucleotide

SEQ ID NO: 4344 - DNA, 148 bp, Artificial Sequence
  Synthetic polynucleotide
atcatctcaccttgcctcctggacgcgatgatagtcaccctgcaggcaccccaagacaccccatcgcaccccagaccaccccactacaccccaactcaccccatgccaccccagtacaccccaggcgcgccatgcttcatcagactct

SEQ ID NO: 4345 - DNA, 148 bp, Artificial Sequence; identical to SEQ ID NO: 4344
  Synthetic polynucleotide

SEQ ID NO: 4346 - DNA, 185 bp, Artificial Sequence
  Synthetic polynucleotide
atcatctcaccttgcctcctgctctaactgtggcaattcctgcaggtacttaattaatacatagatacttaattaatacattcgtacttaattaatacatgactacttaattaatacatctatacttaattaatacatacttacttaattaatacattgcggcgcgccatgcttcatcagactct

SEQ ID NO: 4347 - DNA, 185 bp, Artificial Sequence; identical to SEQ ID NO: 4346
  Synthetic polynucleotide

SEQ ID NO: 4348 - DNA, 191 bp, Artificial Sequence
  Synthetic polynucleotide
atcatctcaccttgcctcctgcgaattcgttattgacccctgcaggaatgctgactcagcacaagaaatgctgactcagcacatcgaatgctgactcagcacagacaatgctgactcagcacactaaatgctgactcagcacaactaatgctgactcagcacatgcggcgcgccatgcttcatcagactct

SEQ ID NO: 4349 - DNA, 191 bp, Artificial Sequence; identical to SEQ ID NO: 4348
  Synthetic polynucleotide

SEQ ID NO: 4350 - DNA, 191 bp, Artificial Sequence
  Synthetic polynucleotide
atcatctcaccttgcctcctgacgatatcatgaaagagcctgcaggtaattaattaataattaagataattaattaataattatcgtaattaattaataattagactaattaattaataattactataattaattaataattaacttaattaattaataattatgcggcgcgccatgcttcatcagactct

SEQ ID NO: 4351 - DNA, 191 bp, Artificial Sequence; identical to SEQ ID NO: 4350
  Synthetic polynucleotide

SEQ ID NO: 4352 - DNA, 164 bp, Artificial Sequence
  Synthetic polynucleotide
atcatctcaccttgcctcctggactattgatggtgcctcctgcaggtcatttcctagatcatttccttcgtcatttcctgactcatttcctctatcatttcctacttcatttccttgctcatttcctgtatcatttcctggcgcgccatgcttcatcagactct

SEQ ID NO: 4353 - DNA, 164 bp, Artificial Sequence; identical to SEQ ID NO: 4352
  Synthetic polynucleotide

SEQ ID NO: 4354 - DNA, 172 bp, Artificial Sequence
  Synthetic polynucleotide
atcatctcaccttgcctcctggtacaagacggaacccacctgcaggaaaagtcaaaagaaaaagtcaaatcgaaaagtcaaagacaaaagtcaaactaaaaagtcaaaactaaaagtcaaatgcaaaagtcaaagtaaaaagtcaaaggcgcgccatgcttcatcagactct

SEQ ID NO: 4355 - DNA, 172 bp, Artificial Sequence; identical to SEQ ID NO: 4354
  Synthetic polynucleotide

SEQ ID NO: 4356 - DNA, 188 bp, Artificial Sequence
  Synthetic polynucleotide
atcatctcaccttgcctcctgtcagaatccgcatgactcctgcaggcccaattaggaaagacccaattaggaatcgcccaattaggaagaccccaattaggaactacccaattaggaaactcccaattaggaatgccccaattaggaagtacccaattaggaaggcgcgccatgcttcatcagactct

SEQ ID NO: 4357 - DNA, 188 bp, Artificial Sequence; identical to SEQ ID NO: 4356
  Synthetic polynucleotide

SEQ ID NO: 4358 - DNA, 200 bp, Artificial Sequence
  Synthetic polynucleotide
atcatctcaccttgcctcctgcgacaggcaaatggtaacctgcagggggggcagccaagcgtgacagagggggcagccaagcgtgactcggggggcagccaagcgtgacgacgggggcagccaagcgtgacctagggggcagccaagcgtgacactgggggcagccaagcgtgacggcgcgccatgcttcatcagactct

SEQ ID NO: 4359 - DNA, 200 bp, Artificial Sequence; identical to SEQ ID NO: 4358
  Synthetic polynucleotide

SEQ ID NO: 4360 - DNA, 185 bp, Artificial Sequence
  Synthetic polynucleotide
atcatctcaccttgcctcctgtaggtcttgattggcaacctgcaggaaattcaagtggcttaagaaaattcaagtggcttatcgaaattcaagtggcttagacaaattcaagtggcttactaaaattcaagtggcttaactaaattcaagtggcttatgcggcgcgccatgcttcatcagactct

SEQ ID NO: 4361 - DNA, 185 bp, Artificial Sequence; identical to SEQ ID NO: 4360
  Synthetic polynucleotide

SEQ ID NO: 4362 - DNA, 164 bp, Artificial Sequence
  Synthetic polynucleotide
atcatctcaccttgcctcctgacgtatcccttacatagcctgcaggaagtccagtagaaagtccagttcgaagtccagtgacaagtccagtctaaagtccagtactaagtccagttgcaagtccagtgtaaagtccagtggcgcgccatgcttcatcagactct

SEQ ID NO: 4363 - DNA, 164 bp, Artificial Sequence; identical to SEQ ID NO: 4362
  Synthetic polynucleotide

SEQ ID NO: 4364 - DNA, 172 bp, Artificial Sequence
  Synthetic polynucleotide
atcatctcaccttgcctcctgcaccacaaagtaaacagcctgcagggatgactcatagagatgactcattcggatgactcatgacgatgactcatctagatgactcatactgatgactcattgcgatgactcatgtagatgactcatggcgcgccatgcttcatcagactct

SEQ ID NO: 4365 - DNA, 172 bp, Artificial Sequence; identical to SEQ ID NO: 4364
  Synthetic polynucleotide

SEQ ID NO: 4366 - DNA, 185 bp, Artificial Sequence
  Synthetic polynucleotide
atcatctcaccttgcctcctggaaatctgtaacggtaacctgcaggataggggcggggtcgaagaataggggcggggtcgatcgataggggcggggtcgagacataggggcggggtcgactaataggggcggggtcgaactataggggcggggtcgatgcggcgcgccatgcttcatcagactct

SEQ ID NO: 4367 - DNA, 185 bp, Artificial Sequence; identical to SEQ ID NO: 4366
  Synthetic polynucleotide

SEQ ID NO: 4368 - DNA, 191 bp, Artificial Sequence
  Synthetic polynucleotide
atcatctcaccttgcctcctgatcatgtggtggcatttcctgcaggcaccgctaattaggggtagacaccgctaattaggggttcgcaccgctaattaggggtgaccaccgctaattaggggtctacaccgctaattaggggtactcaccgctaattaggggttgcggcgcgccatgcttcatcagactct

SEQ ID NO: 4369 - DNA, 191 bp, Artificial Sequence; identical to SEQ ID NO: 4368
  Synthetic polynucleotide

SEQ ID NO: 4370 - DNA, 172 bp, Artificial Sequence
  Synthetic polynucleotide
atcatctcaccttgcctcctgaatagttatgccggcgacctgcaggtgtaaacaaaagatgtaaacaaatcgtgtaaacaaagactgtaaacaaactatgtaaacaaaacttgtaaacaaatgctgtaaacaaagtatgtaaacaaaggcgcgccatgcttcatcagactct

SEQ ID NO: 4371 - DNA, 172 bp, Artificial Sequence; identical to SEQ ID NO: 4370
  Synthetic polynucleotide

SEQ ID NO: 4372 - DNA, 185 bp, Artificial Sequence
  Synthetic polynucleotide
atcatctcaccttgcctcctgagcgatacgcgactgaccctgcagggcttcgtggggggtctagagcttcgtggggggtcttcggcttcgtggggggtctgacgcttcgtggggggtctctagcttcgtggggggtctactgcttcgtggggggtcttgcggcgcgccatgcttcatcagactct

SEQ ID NO: 4373 - DNA, 185 bp, Artificial Sequence; identical to SEQ ID NO: 4372
  Synthetic polynucleotide

SEQ ID NO: 4374 - DNA, 156 bp, Artificial Sequence
  Synthetic polynucleotide
atcatctcaccttgcctcctgtgtaccgtaagcaataccctgcaggccaggtggagaccaggtggtcgccaggtgggacccaggtggctaccaggtggactccaggtggtgcccaggtgggtaccaggtggggcgcgccatgcttcatcagactct

SEQ ID NO: 4375 - DNA, 156 bp, Artificial Sequence; identical to SEQ ID NO: 4374
  Synthetic polynucleotide

SEQ ID NO: 4376 - DNA, 188 bp, Artificial Sequence
  Synthetic polynucleotide
atcatctcaccttgcctcctgaatacagctcgcggcatcctgcaggtgcagtgatttaagatgcagtgatttatcgtgcagtgatttagactgcagtgatttactatgcagtgatttaacttgcagtgatttatgctgcagtgatttagtatgcagtgatttaggcgcgccatgcttcatcagactct

SEQ ID NO: 4377 - DNA, 188 bp, Artificial Sequence; identical to SEQ ID NO: 4376
  Synthetic polynucleotide

SEQ ID NO: 4378 - DNA, 190 bp, Artificial Sequence
  Synthetic polynucleotide
atcatctcaccttgcctcctgcgtgaccggtccctattcctgcagggcaacagctgttgtagagcaacagctgttgttcggcaacagctgttgtgacgcaacagctgttgtctagcaacagctgttgtactgcaacagctgttgttgcgcaacagctgttgtgtaggcgcgccatgcttcatcagactct

SEQ ID NO: 4379 - DNA, 190 bp, Artificial Sequence; identical to SEQ ID NO: 4378
  Synthetic polynucleotide

SEQ ID NO: 4380 - DNA, 188 bp, Artificial Sequence
  Synthetic polynucleotide
atcatctcaccttgcctcctgataagtgggttggtgttcctgcaggcctttgatctttagacctttgatcttttcgcctttgatctttgaccctttgatctttctacctttgatctttactcctttgatcttttgccctttgatctttgtacctttgatctttggcgcgccatgcttcatcagactct

SEQ ID NO: 4381 - DNA, 188 bp, Artificial Sequence; identical to SEQ ID NO: 4380
  Synthetic polynucleotide

SEQ ID NO: 4382 - DNA, 172 bp, Artificial Sequence
  Synthetic polynucleotide
atcatctcaccttgcctcctgagttgtagcttccaagccctgcagggacacgtggtagagacacgtggttcggacacgtggtgacgacacgtggtctagacacgtggtactgacacgtggttgcgacacgtggtgtagacacgtggtggcgcgccatgcttcatcagactct

SEQ ID NO: 4383 - DNA, 172 bp, Artificial Sequence; identical to SEQ ID NO: 4382
  Synthetic polynucleotide

SEQ ID NO: 4384 - DNA, 180 bp, Artificial Sequence
  Synthetic polynucleotide
atcatctcaccttgcctcctgtgccatcaggaggtaaacctgcaggcagggtgtggcagacagggtgtggctcgcagggtgtggcgaccagggtgtggcctacagggtgtggcactcagggtgtggctgccagggtgtggcgtacagggtgtggcggcgcgccatgcttcatcagactct

SEQ ID NO: 4385 - DNA, 180 bp, Artificial Sequence; identical to SEQ ID NO: 4384
  Synthetic polynucleotide

SEQ ID NO: 4386 - DNA, 185 bp, Artificial Sequence
  Synthetic polynucleotide
atcatctcaccttgcctcctgcttgcttggtataagaccctgcaggtaacgtccgctagcgcagataacgtccgctagcgctcgtaacgtccgctagcgcgactaacgtccgctagcgcctataacgtccgctagcgcacttaacgtccgctagcgctgcggcgcgccatgcttcatcagactct

SEQ ID NO: 4387 - DNA, 185 bp, Artificial Sequence; identical to SEQ ID NO: 4386
  Synthetic polynucleotide

SEQ ID NO: 4388 - DNA, 185 bp, Artificial Sequence
  Synthetic polynucleotide
atcatctcaccttgcctcctgtgatagcccaggctcgacctgcaggtacccacaatgcattgagatacccacaatgcattgtcgtacccacaatgcattggactacccacaatgcattgctatacccacaatgcattgacttacccacaatgcattgtgcggcgcgccatgcttcatcagactct

SEQ ID NO: 4389 - DNA, 185 bp, Artificial Sequence; identical to SEQ ID NO: 4388
  Synthetic polynucleotide

SEQ ID NO: 4390 - DNA, 197 bp, Artificial Sequence
  Synthetic polynucleotide
atcatctcaccttgcctcctgttaggtccctggtcgatcctgcagggccatatatggccagagagccatatatggccagtcggccatatatggccaggacgccatatatggccagctagccatatatggccagactgccatatatggccagtgcgccatatatggccaggtaggcgcgccatgcttcatcagactct

SEQ ID NO: 4391 - DNA, 197 bp, Artificial Sequence; identical to SEQ ID NO: 4390
  Synthetic polynucleotide

SEQ ID NO: 4392 - DNA, 197 bp, Artificial Sequence
  Synthetic polynucleotide
atcatctcaccttgcctcctgttacaattacgccagttcctgcaggattgcctgaggcgatagaattgcctgaggcgattcgattgcctgaggcgatgacattgcctgaggcgatctaattgcctgaggcgatactattgcctgaggcgattgcattgcctgaggcgatgtaggcgcgccatgcttcatcagactct

SEQ ID NO: 4393 - DNA, 197 bp, Artificial Sequence; identical to SEQ ID NO: 4392
  Synthetic polynucleotide

SEQ ID NO: 4394 - DNA, 188 bp, Artificial Sequence
  Synthetic polynucleotide
atcatctcaccttgcctcctgtatcagcgaccggaatccctgcaggctatcggttgatagactatcggttgattcgctatcggttgatgacctatcggttgatctactatcggttgatactctatcggttgattgcctatcggttgatgtactatcggttgatggcgcgccatgcttcatcagactct

SEQ ID NO: 4395 - DNA, 188 bp, Artificial Sequence; identical to SEQ ID NO: 4394
  Synthetic polynucleotide

SEQ ID NO: 4396 - DNA, 197 bp, Artificial Sequence
  Synthetic polynucleotide
atcatctcaccttgcctcctggtcgaccgaatagacggcctgcagggaggtcaaaggtcaaagagaggtcaaaggtcaatcggaggtcaaaggtcaagacgaggtcaaaggtcaactagaggtcaaaggtcaaactgaggtcaaaggtcaatgcgaggtcaaaggtcaagtaggcgcgccatgcttcatcagactct

SEQ ID NO: 4397 - DNA, 197 bp, Artificial Sequence; identical to SEQ ID NO: 4396
  Synthetic polynucleotide

SEQ ID NO: 4398 - DNA, 196 bp, Artificial Sequence
  Synthetic polynucleotide
atcatctcaccttgcctcctggaccagcccgttctattcctgcaggatcccccccaccgagaatcccccccaccgtcgatcccccccaccggacatcccccccaccgctaatcccccccaccgactatcccccccaccgtgcatcccccccaccggtaatcccccccaccgggcgcgccatgcttcatcagactct

SEQ ID NO: 4399 - DNA, 196 bp, Artificial Sequence; identical to SEQ ID NO: 4398
  Synthetic polynucleotide

SEQ ID NO: 4400 - DNA, 197 bp, Artificial Sequence
  Synthetic polynucleotide
atcatctcaccttgcctcctgacctagtacctcgtaagcctgcaggaaaaacggattattgagaaaaaacggattattgtcgaaaaacggattattggacaaaaacggattattgctaaaaaacggattattgactaaaaacggattattgtgcaaaaacggattattggtaggcgcgccatgcttcatcagactct

SEQ ID NO: 4401 - DNA, 197 bp, Artificial Sequence; identical to SEQ ID NO: 4400
  Synthetic polynucleotide

SEQ ID NO: 4402 - DNA, 185 bp, Artificial Sequence
  Synthetic polynucleotide
atcatctcaccttgcctcctgaataacctaaacgcccgcctgcagggataattataattagcagagataattataattagctcggataattataattagcgacgataattataattagcctagataattataattagcactgataattataattagctgcggcgcgccatgcttcatcagactct

SEQ ID NO: 4403 - DNA, 185 bp, Artificial Sequence; identical to SEQ ID NO: 4402
  Synthetic polynucleotide

SEQ ID NO: 4404 - DNA, 180 bp, Artificial Sequence
  Synthetic polynucleotide
atcatctcaccttgcctcctgtcaatgaaagccgaagacctgcaggtctgagtcaccagatctgagtcacctcgtctgagtcaccgactctgagtcaccctatctgagtcaccacttctgagtcacctgctctgagtcaccgtatctgagtcaccggcgcgccatgcttcatcagactct

SEQ ID NO: 4405 - DNA, 180 bp, Artificial Sequence; identical to SEQ ID NO: 4404
  Synthetic polynucleotide

SEQ ID NO: 4406 - DNA, 190 bp, Artificial Sequence
  Synthetic polynucleotide
atcatctcaccttgcctcctgttctaatgaggcgatagcctgcaggcggtgacgtcatcaagacggtgacgtcatcatcgcggtgacgtcatcagaccggtgacgtcatcactacggtgacgtcatcaactcggtgacgtcatcatgccggtgacgtcatcagtaggcgcgccatgcttcatcagactct

SEQ ID NO: 4407 - DNA, 190 bp, Artificial Sequence; identical to SEQ ID NO: 4406
  Synthetic polynucleotide

SEQ ID NO: 4408 - DNA, 188 bp, Artificial Sequence
  Synthetic polynucleotide
atcatctcaccttgcctcctgcctaattgcctgggtctcctgcaggttccctggcaacagattccctggcaactcgttccctggcaacgacttccctggcaacctattccctggcaacactttccctggcaactgcttccctggcaacgtattccctggcaacggcgcgccatgcttcatcagactct

SEQ ID NO: 4409 - DNA, 188 bp, Artificial Sequence; identical to SEQ ID NO: 4408
  Synthetic polynucleotide

SEQ ID NO: 4410 - DNA, 197 bp, Artificial Sequence
  Synthetic polynucleotide
atcatctcaccttgcctcctggaagctacaactcgaagcctgcaggattgcctgaggcgaaagaattgcctgaggcgaatcgattgcctgaggcgaagacattgcctgaggcgaactaattgcctgaggcgaaactattgcctgaggcgaatgcattgcctgaggcgaagtaggcgcgccatgcttcatcagactct

SEQ ID NO: 4411 - DNA, 197 bp, Artificial Sequence; identical to SEQ ID NO: 4410
  Synthetic polynucleotide

SEQ ID NO: 4412 - DNA, 197 bp, Artificial Sequence
  Synthetic polynucleotide
atcatctcaccttgcctcctgaacgatctgctcgtagtcctgcaggtgacctcacatgacctttagatgacctcacatgaccttttcgtgacctcacatgacctttgactgacctcacatgacctttctatgacctcacatgacctttacttgacctcacatgaccttttgcggcgcgccatgcttcatcagactct

SEQ ID NO: 4413 - DNA, 197 bp, Artificial Sequence; identical to SEQ ID NO: 4412
  Synthetic polynucleotide

SEQ ID NO: 4414 - DNA, 172 bp, Artificial Sequence
  Synthetic polynucleotide
atcatctcaccttgcctcctgtgcaactaaccctcccacctgcaggttgtagttttagattgtagtttttcgttgtagttttgacttgtagttttctattgtagttttactttgtagtttttgcttgtagttttgtattgtagttttggcgcgccatgcttcatcagactct

SEQ ID NO: 4415 - DNA, 172 bp, Artificial Sequence; identical to SEQ ID NO: 4414
  Synthetic polynucleotide

SEQ ID NO: 4416 - DNA, 190 bp, Artificial Sequence
  Synthetic polynucleotide
atcatctcaccttgcctcctggccgtacaaatgtgcgccctgcaggagggggatcgatggagaagggggatcgatggtcgagggggatcgatgggacagggggatcgatggctaagggggatcgatggactagggggatcgatggtgcagggggatcgatgggtaggcgcgccatgcttcatcagactct

SEQ ID NO: 4417 - DNA, 190 bp, Artificial Sequence; identical to SEQ ID NO: 4416
  Synthetic polynucleotide

SEQ ID NO: 4418 - DNA, 197 bp, Artificial Sequence
  Synthetic polynucleotide
atcatctcaccttgcctcctgatgattaggctgtggtgcctgcaggggggtcaggaaagttcagagaggggtcaggaaagttcagtcgggggtcaggaaagttcaggacggggtcaggaaagttcagctaggggtcaggaaagttcagactggggtcaggaaagttcagtgcggcgcgccatgcttcatcagactct

SEQ ID NO: 4419 - DNA, 197 bp, Artificial Sequence; identical to SEQ ID NO: 4418
  Synthetic polynucleotide

SEQ ID NO: 4420 - DNA, 197 bp, Artificial Sequence
  Synthetic polynucleotide
atcatctcaccttgcctcctgtcagccagcctgaggttcctgcaggagataagataagataagaagataagataagatatcgagataagataagatagacagataagataagatactaagataagataagataactagataagataagatatgcagataagataagatagtaggcgcgccatgcttcatcagactct

SEQ ID NO: 4421 - DNA, 197 bp, Artificial Sequence; identical to SEQ ID NO: 4420
  Synthetic polynucleotide

SEQ ID NO: 4422 - DNA, 190 bp, Artificial Sequence
  Synthetic polynucleotide
atcatctcaccttgcctcctgtcatttaccgtggaagtcctgcaggtgctgagtcatggtagatgctgagtcatggttcgtgctgagtcatggtgactgctgagtcatggtctatgctgagtcatggtacttgctgagtcatggttgctgctgagtcatggtgtaggcgcgccatgcttcatcagactct

SEQ ID NO: 4423 - DNA, 190 bp, Artificial Sequence; identical to SEQ ID NO: 4422
  Synthetic polynucleotide

SEQ ID NO: 4424 - DNA, 196 bp, Artificial Sequence
  Synthetic polynucleotide
atcatctcaccttgcctcctgacgaagcgtttaagggacctgcaggcaattacgtaactagacaattacgtaacttcgcaattacgtaactgaccaattacgtaactctacaattacgtaactactcaattacgtaacttgccaattacgtaactgtacaattacgtaactggcgcgccatgcttcatcagactct

SEQ ID NO: 4425 - DNA, 196 bp, Artificial Sequence; identical to SEQ ID NO: 4424
  Synthetic polynucleotide

SEQ ID NO: 4426 - DNA, 197 bp, Artificial Sequence
  Synthetic polynucleotide
atcatctcaccttgcctcctggtctcttcttgtagctgcctgcaggaacgaaaccgaaactagaaacgaaaccgaaacttcgaacgaaaccgaaactgacaacgaaaccgaaactctaaacgaaaccgaaactactaacgaaaccgaaacttgcaacgaaaccgaaactgtaggcgcgccatgcttcatcagactct

SEQ ID NO: 4427 - DNA, 197 bp, Artificial Sequence; identical to SEQ ID NO: 4426
  Synthetic polynucleotide

SEQ ID NO: 4428 - DNA, 180 bp, Artificial Sequence
  Synthetic polynucleotide
atcatctcaccttgcctcctgacctgactaccggtttacctgcaggacccggatgtaagaacccggatgtatcgacccggatgtagacacccggatgtactaacccggatgtaactacccggatgtatgcacccggatgtagtaacccggatgtaggcgcgccatgcttcatcagactct

SEQ ID NO: 4429 - DNA, 180 bp, Artificial Sequence; identical to SEQ ID NO: 4428
  Synthetic polynucleotide

SEQ ID NO: 4430 - DNA, 196 bp, Artificial Sequence
  Synthetic polynucleotide
atcatctcaccttgcctcctgtacgccttcccgatggacctgcaggtcaatgttattgaagatcaatgttattgatcgtcaatgttattgagactcaatgttattgactatcaatgttattgaacttcaatgttattgatgctcaatgttattgagtatcaatgttattgaggcgcgccatgcttcatcagactct

SEQ ID NO: 4431 - DNA, 196 bp, Artificial Sequence; identical to SEQ ID NO: 4430
  Synthetic polynucleotide

SEQ ID NO: 4432 - DNA, 188 bp, Artificial Sequence
  Synthetic polynucleotide
atcatctcaccttgcctcctggatgttacttccgcatgcctgcaggccacgtcaccacagaccacgtcaccactcgccacgtcaccacgacccacgtcaccacctaccacgtcaccacactccacgtcaccactgcccacgtcaccacgtaccacgtcaccacggcgcgccatgcttcatcagactct

SEQ ID NO: 4433 - DNA, 188 bp, Artificial Sequence; identical to SEQ ID NO: 4432
  Synthetic polynucleotide

SEQ ID NO: 4434 - DNA, 156 bp, Artificial Sequence
  Synthetic polynucleotide
atcatctcaccttgcctcctgtggtgtggaagtgcgaacctgcaggccacgtcaagaccacgtcatcgccacgtcagacccacgtcactaccacgtcaactccacgtcatgcccacgtcagtaccacgtcaggcgcgccatgcttcatcagactct

SEQ ID NO: 4435 - DNA, 156 bp, Artificial Sequence; identical to SEQ ID NO: 4434
  Synthetic polynucleotide

SEQ ID NO: 4436 - DNA, 191 bp, Artificial Sequence
  Synthetic polynucleotide
atcatctcaccttgcctcctgttggctgagccattagacctgcaggtggcatttcccggaaatgattagatggcatttcccggaaatgatttcgtggcatttcccggaaatgattgactggcatttcccggaaatgattctatggcatttcccggaaatgattactggcgcgccatgcttcatcagactct

SEQ ID NO: 4437 - DNA, 191 bp, Artificial Sequence; identical to SEQ ID NO: 4436
  Synthetic polynucleotide

SEQ ID NO: 4438 - DNA, 172 bp, Artificial Sequence
  Synthetic polynucleotide
atcatctcaccttgcctcctgccttactcacggatccccctgcaggtaacacctcaagataacacctcatcgtaacacctcagactaacacctcactataacacctcaacttaacacctcatgctaacacctcagtataacacctcaggcgcgccatgcttcatcagactct

SEQ ID NO: 4439 - DNA, 172 bp, Artificial Sequence; identical to SEQ ID NO: 4438
  Synthetic polynucleotide

SEQ ID NO: 4440 - DNA, 180 bp, Artificial Sequence
  Synthetic polynucleotide
atcatctcaccttgcctcctgaaatccgtctttctaggcctgcaggtgacctatttaagatgacctatttatcgtgacctatttagactgacctatttactatgacctatttaacttgacctatttatgctgacctatttagtatgacctatttaggcgcgccatgcttcatcagactct

SEQ ID NO: 4441 - DNA, 180 bp, Artificial Sequence; identical to SEQ ID NO: 4440
  Synthetic polynucleotide

SEQ ID NO: 4442 - DNA, 172 bp, Artificial Sequence
  Synthetic polynucleotide
atcatctcaccttgcctcctgtgaaacatttagcgcaacctgcaggttcacttcctagattcacttccttcgttcacttcctgacttcacttcctctattcacttcctactttcacttccttgcttcacttcctgtattcacttcctggcgcgccatgcttcatcagactct

SEQ ID NO: 4443 - DNA, 172 bp, Artificial Sequence; identical to SEQ ID NO: 4442
  Synthetic polynucleotide

SEQ ID NO: 4444 - DNA, 196 bp, Artificial Sequence
  Synthetic polynucleotide
atcatctcaccttgcctcctgatggtcgtgtgaattaccctgcaggccttagccaatcaagaccttagccaatcatcgccttagccaatcagacccttagccaatcactaccttagccaatcaactccttagccaatcatgcccttagccaatcagtaccttagccaatcaggcgcgccatgcttcatcagactct

SEQ ID NO: 4445 - DNA, 196 bp, Artificial Sequence; identical to SEQ ID NO: 4444
  Synthetic polynucleotide

SEQ ID NO: 4446 - DNA, 191 bp, Artificial Sequence
  Synthetic polynucleotide
atcatctcaccttgcctcctgggcatttccatagggttcctgcaggtaattaattaataacttagataattaattaataactttcgtaattaattaataacttgactaattaattaataacttctataattaattaataacttacttaattaattaataactttgcggcgcgccatgcttcatcagactct

SEQ ID NO: 4447 - DNA, 191 bp, Artificial Sequence; identical to SEQ ID NO: 4446
  Synthetic polynucleotide

SEQ ID NO: 4448 - DNA, 180 bp, Artificial Sequence
  Synthetic polynucleotide
atcatctcaccttgcctcctgttggcgttgtggcaatacctgcaggtttttacgagaagatttttacgagatcgtttttacgagagactttttacgagactatttttacgagaacttttttacgagatgctttttacgagagtatttttacgagaggcgcgccatgcttcatcagactct

SEQ ID NO: 4449 - DNA, 180 bp, Artificial Sequence; identical to SEQ ID NO: 4448
  Synthetic polynucleotide

SEQ ID NO: 4450 - DNA, 164 bp, Artificial Sequence
  Synthetic polynucleotide
atcatctcaccttgcctcctgaaagcttaggaacacggcctgcaggtaattggtcagataattggtctcgtaattggtcgactaattggtcctataattggtcacttaattggtctgctaattggtcgtataattggtcggcgcgccatgcttcatcagactct

SEQ ID NO: 4451 - DNA, 164 bp, Artificial Sequence; identical to SEQ ID NO: 4450
  Synthetic polynucleotide

SEQ ID NO: 4452 - DNA, 180 bp, Artificial Sequence
  Synthetic polynucleotide
atcatctcaccttgcctcctgcaccggcgacaagcttacctgcaggtttttacgagcagatttttacgagctcgtttttacgagcgactttttacgagcctatttttacgagcacttttttacgagctgctttttacgagcgtatttttacgagcggcgcgccatgcttcatcagactct

SEQ ID NO: 4453 - DNA, 180 bp, Artificial Sequence; identical to SEQ ID NO: 4452
  Synthetic polynucleotide

SEQ ID NO: 4454 - DNA, 191 bp, Artificial Sequence
  Synthetic polynucleotide
atcatctcaccttgcctcctgacggcaacgctatccaccctgcagggatagggtatcacttatagagatagggtatcacttattcggatagggtatcacttatgacgatagggtatcacttatctagatagggtatcacttatactgatagggtatcacttattgcggcgcgccatgcttcatcagactct

SEQ ID NO: 4455 - DNA, 191 bp, Artificial Sequence; identical to SEQ ID NO: 4454
  Synthetic polynucleotide

SEQ ID NO: 4456 - DNA, 197 bp, Artificial Sequence
  Synthetic polynucleotide
atcatctcaccttgcctcctgacgtcgagcgacttgcacctgcaggggtttctctccagtaagaggtttctctccagtatcgggtttctctccagtagacggtttctctccagtactaggtttctctccagtaactggtttctctccagtatgcggtttctctccagtagtaggcgcgccatgcttcatcagactct

SEQ ID NO: 4457 - DNA, 197 bp, Artificial Sequence; identical to SEQ ID NO: 4456
  Synthetic polynucleotide

SEQ ID NO: 4458 - DNA, 172 bp, Artificial Sequence
  Synthetic polynucleotide
atcatctcaccttgcctcctgaccctcaattggccaaacctgcaggatttattcatagaatttattcattcgatttattcatgacatttattcatctaatttattcatactatttattcattgcatttattcatgtaatttattcatggcgcgccatgcttcatcagactct

SEQ ID NO: 4459 - DNA, 172 bp, Artificial Sequence; identical to SEQ ID NO: 4458
  Synthetic polynucleotide

SEQ ID NO: 4460 - DNA, 172 bp, Artificial Sequence
  Synthetic polynucleotide
atcatctcaccttgcctcctgaggatggtcagtgtcgccctgcaggtgccaaaattagatgccaaaatttcgtgccaaaattgactgccaaaattctatgccaaaattacttgccaaaatttgctgccaaaattgtatgccaaaattggcgcgccatgcttcatcagactct

SEQ ID NO: 4461 - DNA, 172 bp, Artificial Sequence; identical to SEQ ID NO: 4460
  Synthetic polynucleotide

SEQ ID NO: 4462 - DNA, 197 bp, Artificial Sequence
  Synthetic polynucleotide
atcatctcaccttgcctcctgataagactatactggctcctgcaggccccgcccccgcaccagaccccgcccccgcacctcgccccgcccccgcaccgacccccgcccccgcaccctaccccgcccccgcaccactccccgcccccgcacctgcccccgcccccgcaccgtaggcgcgccatgcttcatcagactct

SEQ ID NO: 4463 - DNA, 197 bp, Artificial Sequence; identical to SEQ ID NO: 4462
  Synthetic polynucleotide

SEQ ID NO: 4464 - DNA, 185 bp, Artificial Sequence
  Synthetic polynucleotide
atcatctcaccttgcctcctgttgtggttcgacgctcgcctgcaggccgtcgccatggcaacagaccgtcgccatggcaactcgccgtcgccatggcaacgacccgtcgccatggcaacctaccgtcgccatggcaacactccgtcgccatggcaactgcggcgcgccatgcttcatcagactct

SEQ ID NO: 4465 - DNA, 185 bp, Artificial Sequence; identical to SEQ ID NO: 4464
  Synthetic polynucleotide

SEQ ID NO: 4466 - DNA, 196 bp, Artificial Sequence
  Synthetic polynucleotide
atcatctcaccttgcctcctgacaccatcttggacaagcctgcaggaatgtaacaatttagaaatgtaacaattttcgaatgtaacaatttgacaatgtaacaatttctaaatgtaacaatttactaatgtaacaattttgcaatgtaacaatttgtaaatgtaacaatttggcgcgccatgcttcatcagactct

SEQ ID NO: 4467 - DNA, 196 bp, Artificial Sequence; identical to SEQ ID NO: 4466
  Synthetic polynucleotide

SEQ ID NO: 4468 - DNA, 190 bp, Artificial Sequence
  Synthetic polynucleotide
atcatctcaccttgcctcctggctggctttccaacgaccctgcaggaggggatttcccagagaaggggatttcccagtcgaggggatttcccaggacaggggatttcccagctaaggggatttcccagactaggggatttcccagtgcaggggatttcccaggtaggcgcgccatgcttcatcagactct

SEQ ID NO: 4469 - DNA, 190 bp, Artificial Sequence; identical to SEQ ID NO: 4468
  Synthetic polynucleotide

SEQ ID NO: 4470 - DNA, 180 bp, Artificial Sequence
  Synthetic polynucleotide
atcatctcaccttgcctcctgccgggaacggtaatcgtcctgcaggtgcgtgggcggagatgcgtgggcggtcgtgcgtgggcgggactgcgtgggcggctatgcgtgggcggacttgcgtgggcggtgctgcgtgggcgggtatgcgtgggcggggcgcgccatgcttcatcagactct

SEQ ID NO: 4471 - DNA, 180 bp, Artificial Sequence; identical to SEQ ID NO: 4470
  Synthetic polynucleotide

SEQ ID NO: 4472 - DNA, 156 bp, Artificial Sequence
  Synthetic polynucleotide
atcatctcaccttgcctcctgggttcaacatcgtttcgcctgcaggatgaacttagaatgaactttcgatgaacttgacatgaacttctaatgaacttactatgaactttgcatgaacttgtaatgaacttggcgcgccatgcttcatcagactct

SEQ ID NO: 4473 - DNA, 156 bp, Artificial Sequence; identical to SEQ ID NO: 4472
  Synthetic polynucleotide

SEQ ID NO: 4474 - DNA, 200 bp, Artificial Sequence
  Synthetic polynucleotide
atcatctcaccttgcctcctgtcgtggctcggtacacacctgcagggccatcatgcgtgacgaggagagccatcatgcgtgacgaggtcggccatcatgcgtgacgagggacgccatcatgcgtgacgaggctagccatcatgcgtgacgaggactgccatcatgcgtgacgaggggcgcgccatgcttcatcagactct

SEQ ID NO: 4475 - DNA, 200 bp, Artificial Sequence; identical to SEQ ID NO: 4474
  Synthetic polynucleotide

SEQ ID NO: 4476 - DNA, 172 bp, Artificial Sequence
  Synthetic polynucleotide
atcatctcaccttgcctcctgtaggctcttatgttcggcctgcaggagggttcaaaagaagggttcaaatcgagggttcaaagacagggttcaaactaagggttcaaaactagggttcaaatgcagggttcaaagtaagggttcaaaggcgcgccatgcttcatcagactct

SEQ ID NO: 4477 - DNA, 172 bp, Artificial Sequence; identical to SEQ ID NO: 4476
  Synthetic polynucleotide

SEQ ID NO: 4478 - DNA, 197 bp, Artificial Sequence
  Synthetic polynucleotide
atcatctcaccttgcctcctgccttccgtgactaccaacctgcaggcatgcccaaataaggcaaagacatgcccaaataaggcaatcgcatgcccaaataaggcaagaccatgcccaaataaggcaactacatgcccaaataaggcaaactcatgcccaaataaggcaatgcggcgcgccatgcttcatcagactct

SEQ ID NO: 4479 - DNA, 197 bp, Artificial Sequence; identical to SEQ ID NO: 4478
  Synthetic polynucleotide

SEQ ID NO: 4480 - DNA, 172 bp, Artificial Sequence
  Synthetic polynucleotide
atcatctcaccttgcctcctgataaggacaatgatccgcctgcaggaaaccggtttagaaaaccggttttcgaaaccggtttgacaaaccggtttctaaaaccggtttactaaaccggttttgcaaaccggtttgtaaaaccggtttggcgcgccatgcttcatcagactct

SEQ ID NO: 4481 - DNA, 172 bp, Artificial Sequence; identical to SEQ ID NO: 4480
  Synthetic polynucleotide

SEQ ID NO: 4482 - DNA, 156 bp, Artificial Sequence
  Synthetic polynucleotide
atcatctcaccttgcctcctgcaagattaagtatccgacctgcaggccgtgactagaccgtgacttcgccgtgactgacccgtgactctaccgtgactactccgtgacttgcccgtgactgtaccgtgactggcgcgccatgcttcatcagactct

SEQ ID NO: 4483 - DNA, 156 bp, Artificial Sequence; identical to SEQ ID NO: 4482
  Synthetic polynucleotide

SEQ ID NO: 4484 - DNA, 180 bp, Artificial Sequence
  Synthetic polynucleotide
atcatctcaccttgcctcctgagcccgacgaatacttacctgcaggggggatttccaagaggggatttccatcgggggatttccagacggggatttccactaggggatttccaactggggatttccatgcggggatttccagtaggggatttccaggcgcgccatgcttcatcagactct

SEQ ID NO: 4485 - DNA, 180 bp, Artificial Sequence; identical to SEQ ID NO: 4484
  Synthetic polynucleotide

SEQ ID NO: 4486 - DNA, 188 bp, Artificial Sequence
  Synthetic polynucleotide
atcatctcaccttgcctcctgcaactttcacccgcatccctgcaggaaaactaggtcaagaaaaactaggtcatcgaaaactaggtcagacaaaactaggtcactaaaaactaggtcaactaaaactaggtcatgcaaaactaggtcagtaaaaactaggtcaggcgcgccatgcttcatcagactct

SEQ ID NO: 4487 - DNA, 188 bp, Artificial Sequence; identical to SEQ ID NO: 4486
  Synthetic polynucleotide

SEQ ID NO: 4488 - DNA, 185 bp, Artificial Sequence
  Synthetic polynucleotide
atcatctcaccttgcctcctgttgaagtctaagggcttcctgcaggaaagctcgtaaaatttagaaaagctcgtaaaattttcgaaagctcgtaaaatttgacaaagctcgtaaaatttctaaaagctcgtaaaatttactaaagctcgtaaaattttgcggcgcgccatgcttcatcagactct

SEQ ID NO: 4489 - DNA, 185 bp, Artificial Sequence; identical to SEQ ID NO: 4488
  Synthetic polynucleotide

SEQ ID NO: 4490 - DNA, 180 bp, Artificial Sequence
  Synthetic polynucleotide
atcatctcaccttgcctcctgtaacgggtacgttacttcctgcaggtttttacgactagatttttacgacttcgtttttacgactgactttttacgactctatttttacgactacttttttacgacttgctttttacgactgtatttttacgactggcgcgccatgcttcatcagactct

SEQ ID NO: 4491 - DNA, 180 bp, Artificial Sequence; identical to SEQ ID NO: 4490
  Synthetic polynucleotide

SEQ ID NO: 4492 - DNA, 180 bp, Artificial Sequence
  Synthetic polynucleotide
atcatctcaccttgcctcctgcagtatcggtgcgcattcctgcaggaatgtaaacaaagaaatgtaaacaatcgaatgtaaacaagacaatgtaaacaactaaatgtaaacaaactaatgtaaacaatgcaatgtaaacaagtaaatgtaaacaaggcgcgccatgcttcatcagactct

SEQ ID NO: 4493 - DNA, 180 bp, Artificial Sequence; identical to SEQ ID NO: 4492
  Synthetic polynucleotide

SEQ ID NO: 4494 - DNA, 172 bp, Artificial Sequence
  Synthetic polynucleotide
atcatctcaccttgcctcctgtgcgcagatcggaaggtcctgcaggattgtacaatagaattgtacaattcgattgtacaatgacattgtacaatctaattgtacaatactattgtacaattgcattgtacaatgtaattgtacaatggcgcgccatgcttcatcagactct

SEQ ID NO: 4495 - DNA, 172 bp, Artificial Sequence; identical to SEQ ID NO: 4494
  Synthetic polynucleotide

SEQ ID NO: 4496 - DNA, 185 bp, Artificial Sequence
  Synthetic polynucleotide
atcatctcaccttgcctcctgaatccacgctctcattacctgcaggtaattggtgctaattgagataattggtgctaattgtcgtaattggtgctaattggactaattggtgctaattgctataattggtgctaattgacttaattggtgctaattgtgcggcgcgccatgcttcatcagactct

SEQ ID NO: 4497 - DNA, 185 bp, Artificial Sequence; identical to SEQ ID NO: 4496
  Synthetic polynucleotide

SEQ ID NO: 4498 - DNA, 164 bp, Artificial Sequence
  Synthetic polynucleotide
atcatctcaccttgcctcctgttgacctaatggctatgcctgcaggagttttccaagaagttttccatcgagttttccagacagttttccactaagttttccaactagttttccatgcagttttccagtaagttttccaggcgcgccatgcttcatcagactct

SEQ ID NO: 4499 - DNA, 164 bp, Artificial Sequence; identical to SEQ ID NO: 4498
  Synthetic polynucleotide

SEQ ID NO: 4500 - DNA, 172 bp, Artificial Sequence
  Synthetic polynucleotide
atcatctcaccttgcctcctggcccatgaggtgtggatcctgcaggaagaacaatgagaaagaacaatgtcgaagaacaatggacaagaacaatgctaaagaacaatgactaagaacaatgtgcaagaacaatggtaaagaacaatgggcgcgccatgcttcatcagactct

SEQ ID NO: 4501 - DNA, 172 bp, Artificial Sequence; identical to SEQ ID NO: 4500
  Synthetic polynucleotide

SEQ ID NO: 4502 - DNA, 197 bp, Artificial Sequence
  Synthetic polynucleotide
atcatctcaccttgcctcctgtagtgccctcttacgtgcctgcaggaccgcctgaggggatagaaccgcctgaggggattcgaccgcctgaggggatgacaccgcctgaggggatctaaccgcctgaggggatactaccgcctgaggggattgcaccgcctgaggggatgtaggcgcgccatgcttcatcagactct

SEQ ID NO: 4503 - DNA, 197 bp, Artificial Sequence; identical to SEQ ID NO: 4502
  Synthetic polynucleotide

SEQ ID NO: 4504 - DNA, 180 bp, Artificial Sequence
  Synthetic polynucleotide
atcatctcaccttgcctcctgcggcctgcttatcgattcctgcaggctgggttgtgcagactgggttgtgctcgctgggttgtgcgacctgggttgtgcctactgggttgtgcactctgggttgtgctgcctgggttgtgcgtactgggttgtgcggcgcgccatgcttcatcagactct

SEQ ID NO: 4505 - DNA, 180 bp, Artificial Sequence; identical to SEQ ID NO: 4504
  Synthetic polynucleotide

SEQ ID NO: 4506 - DNA, 172 bp, Artificial Sequence
  Synthetic polynucleotide
atcatctcaccttgcctcctgctagcagaacaggtgggcctgcagggcgcatgcgcagagcgcatgcgctcggcgcatgcgcgacgcgcatgcgcctagcgcatgcgcactgcgcatgcgctgcgcgcatgcgcgtagcgcatgcgcggcgcgccatgcttcatcagactct

SEQ ID NO: 4507 - DNA, 172 bp, Artificial Sequence; identical to SEQ ID NO: 4506
  Synthetic polynucleotide

SEQ ID NO: 4508 - DNA, 156 bp, Artificial Sequence
  Synthetic polynucleotide
atcatctcaccttgcctcctgactaaccgttggacgaccctgcaggtcgcgtgaagatcgcgtgatcgtcgcgtgagactcgcgtgactatcgcgtgaacttcgcgtgatgctcgcgtgagtatcgcgtgaggcgcgccatgcttcatcagactct

SEQ ID NO: 4509 - DNA, 156 bp, Artificial Sequence; identical to SEQ ID NO: 4508
  Synthetic polynucleotide

SEQ ID NO: 4510 - DNA, 196 bp, Artificial Sequence
  Synthetic polynucleotide
atcatctcaccttgcctcctgaactggcgccatgagatcctgcagggacaggaagtaacagagacaggaagtaactcggacaggaagtaacgacgacaggaagtaacctagacaggaagtaacactgacaggaagtaactgcgacaggaagtaacgtagacaggaagtaacggcgcgccatgcttcatcagactct

SEQ ID NO: 4511 - DNA, 196 bp, Artificial Sequence; identical to SEQ ID NO: 4510
  Synthetic polynucleotide

SEQ ID NO: 4512 - DNA, 180 bp, Artificial Sequence
  Synthetic polynucleotide
atcatctcaccttgcctcctgatataaggcgcctacgtcctgcaggaagtagtgcccagaaagtagtgccctcgaagtagtgcccgacaagtagtgcccctaaagtagtgcccactaagtagtgccctgcaagtagtgcccgtaaagtagtgcccggcgcgccatgcttcatcagactct

SEQ ID NO: 4513 - DNA, 180 bp, Artificial Sequence; identical to SEQ ID NO: 4512
  Synthetic polynucleotide

SEQ ID NO: 4514 - DNA, 188 bp, Artificial Sequence
  Synthetic polynucleotide
atcatctcaccttgcctcctggattcgagctggtggagcctgcaggactataaatagaagaactataaatagatcgactataaatagagacactataaatagactaactataaatagaactactataaatagatgcactataaatagagtaactataaatagaggcgcgccatgcttcatcagactct

SEQ ID NO: 4515 - DNA, 188 bp, Artificial Sequence; identical to SEQ ID NO: 4514
  Synthetic polynucleotide

SEQ ID NO: 4516 - DNA, 172 bp, Artificial Sequence
  Synthetic polynucleotide
atcatctcaccttgcctcctggcgcggtacaaactcgacctgcagggataattaggagagataattaggtcggataattagggacgataattaggctagataattaggactgataattaggtgcgataattagggtagataattaggggcgcgccatgcttcatcagactct

SEQ ID NO: 4517 - DNA, 172 bp, Artificial Sequence; identical to SEQ ID NO: 4516
  Synthetic polynucleotide

SEQ ID NO: 4518 - DNA, 196 bp, Artificial Sequence
  Synthetic polynucleotide
atcatctcaccttgcctcctgaggtccaaacacggtctcctgcaggttaatttaattatagattaatttaattattcgttaatttaattatgacttaatttaattatctattaatttaattatactttaatttaattattgcttaatttaattatgtattaatttaattatggcgcgccatgcttcatcagactct

SEQ ID NO: 4519 - DNA, 196 bp, Artificial Sequence; identical to SEQ ID NO: 4518
  Synthetic polynucleotide

SEQ ID NO: 4520 - DNA, 197 bp, Artificial Sequence
  Synthetic polynucleotide
atcatctcaccttgcctcctgtcggcgtgtaacggaatcctgcagggtgacctcataaggtcacagagtgacctcataaggtcactcggtgacctcataaggtcacgacgtgacctcataaggtcacctagtgacctcataaggtcacactgtgacctcataaggtcactgcggcgcgccatgcttcatcagactct

SEQ ID NO: 4521 - DNA, 197 bp, Artificial Sequence; identical to SEQ ID NO: 4520
  Synthetic polynucleotide

SEQ ID NO: 4522 - DNA, 172 bp, Artificial Sequence
  Synthetic polynucleotide
atcatctcaccttgcctcctgcaaaggctttatatgcgcctgcaggccacccccccagaccaccccccctcgccacccccccgacccacccccccctaccacccccccactccaccccccctgcccacccccccgtaccacccccccggcgcgccatgcttcatcagactct

SEQ ID NO: 4523 - DNA, 172 bp, Artificial Sequence; identical to SEQ ID NO: 4522
  Synthetic polynucleotide

SEQ ID NO: 4524 - DNA, 164 bp, Artificial Sequence
  Synthetic polynucleotide
atcatctcaccttgcctcctgccgattcccgaacagtacctgcaggggtaattaaagaggtaattaatcgggtaattaagacggtaattaactaggtaattaaactggtaattaatgcggtaattaagtaggtaattaaggcgcgccatgcttcatcagactct

SEQ ID NO: 4525 - DNA, 164 bp, Artificial Sequence; identical to SEQ ID NO: 4524
  Synthetic polynucleotide

SEQ ID NO: 4526 - DNA, 164 bp, Artificial Sequence
  Synthetic polynucleotide
atcatctcaccttgcctcctgtaacgctccaagatagacctgcaggaaaccgcaaagaaaaccgcaatcgaaaccgcaagacaaaccgcaactaaaaccgcaaactaaaccgcaatgcaaaccgcaagtaaaaccgcaaggcgcgccatgcttcatcagactct

SEQ ID NO: 4527 - DNA, 164 bp, Artificial Sequence; identical to SEQ ID NO: 4526
  Synthetic polynucleotide

SEQ ID NO: 4528 - DNA, 156 bp, Artificial Sequence
  Synthetic polynucleotide
atcatctcaccttgcctcctgccgatttaaggtcctctcctgcaggatgacacaagaatgacacatcgatgacacagacatgacacactaatgacacaactatgacacatgcatgacacagtaatgacacaggcgcgccatgcttcatcagactct

SEQ ID NO: 4529 - DNA, 156 bp, Artificial Sequence; identical to SEQ ID NO: 4528
  Synthetic polynucleotide

SEQ ID NO: 4530 - DNA, 180 bp, Artificial Sequence
  Synthetic polynucleotide
atcatctcaccttgcctcctgagattggtggaggttaacctgcaggcgggccggaggagacgggccggaggtcgcgggccggagggaccgggccggaggctacgggccggaggactcgggccggaggtgccgggccggagggtacgggccggaggggcgcgccatgcttcatcagactct

SEQ ID NO: 4531 - DNA, 180 bp, Artificial Sequence; identical to SEQ ID NO: 4530
  Synthetic polynucleotide

SEQ ID NO: 4532 - DNA, 164 bp, Artificial Sequence
  Synthetic polynucleotide
atcatctcaccttgcctcctggtgtttcgtgtagaaatcctgcaggggtaattagagaggtaattagtcgggtaattaggacggtaattagctaggtaattagactggtaattagtgcggtaattaggtaggtaattagggcgcgccatgcttcatcagactct

SEQ ID NO: 4533 - DNA, 164 bp, Artificial Sequence; identical to SEQ ID NO: 4532
  Synthetic polynucleotide

SEQ ID NO: 4534 - DNA, 190 bp, Artificial Sequence
  Synthetic polynucleotide
atcatctcaccttgcctcctgttgtgcccgtcattatacctgcaggattcccttgggaatagaattcccttgggaattcgattcccttgggaatgacattcccttgggaatctaattcccttgggaatactattcccttgggaattgcattcccttgggaatgtaggcgcgccatgcttcatcagactct

SEQ ID NO: 4535 - DNA, 190 bp, Artificial Sequence; identical to SEQ ID NO: 4534
  Synthetic polynucleotide

SEQ ID NO: 4536 - DNA, 180 bp, Artificial Sequence
  Synthetic polynucleotide
atcatctcaccttgcctcctgtcgggaaactagcaactcctgcaggggagtcagcggagaggagtcagcggtcgggagtcagcgggacggagtcagcggctaggagtcagcggactggagtcagcggtgcggagtcagcgggtaggagtcagcggggcgcgccatgcttcatcagactct

SEQ ID NO: 4537 - DNA, 180 bp, Artificial Sequence; identical to SEQ ID NO: 4536
  Synthetic polynucleotide

SEQ ID NO: 4538 - DNA, 190 bp, Artificial Sequence
  Synthetic polynucleotide
atcatctcaccttgcctcctgttacgtaagctttgccacctgcagggttaattacctccaagagttaattacctccatcggttaattacctccagacgttaattacctccactagttaattacctccaactgttaattacctccatgcgttaattacctccagtaggcgcgccatgcttcatcagactct

SEQ ID NO: 4539 - DNA, 190 bp, Artificial Sequence; identical to SEQ ID NO: 4538
  Synthetic polynucleotide

SEQ ID NO: 4540 - DNA, 190 bp, Artificial Sequence
  Synthetic polynucleotide
atcatctcaccttgcctcctgacatgggagggaagagacctgcagggcattatttacatgagagcattatttacatgtcggcattatttacatggacgcattatttacatgctagcattatttacatgactgcattatttacatgtgcgcattatttacatggtaggcgcgccatgcttcatcagactct

SEQ ID NO: 4541 - DNA, 190 bp, Artificial Sequence; identical to SEQ ID NO: 4540
  Synthetic polynucleotide

SEQ ID NO: 4542 - DNA, 191 bp, Artificial Sequence
  Synthetic polynucleotide
atcatctcaccttgcctcctgaacccaatgttctccggcctgcaggaatattgataccctattagaaatattgataccctatttcgaatattgataccctattgacaatattgataccctattctaaatattgataccctattactaatattgataccctatttgcggcgcgccatgcttcatcagactct

SEQ ID NO: 4543 - DNA, 191 bp, Artificial Sequence; identical to SEQ ID NO: 4542
  Synthetic polynucleotide

SEQ ID NO: 4544 - DNA, 197 bp, Artificial Sequence
  Synthetic polynucleotide
atcatctcaccttgcctcctgaggataattaccgcctacctgcaggccaccaccgctattgagaccaccaccgctattgtcgccaccaccgctattggacccaccaccgctattgctaccaccaccgctattgactccaccaccgctattgtgcccaccaccgctattggtaggcgcgccatgcttcatcagactct

SEQ ID NO: 4545 - DNA, 197 bp, Artificial Sequence; identical to SEQ ID NO: 4544
  Synthetic polynucleotide

SEQ ID NO: 4546 - DNA, 148 bp, Artificial Sequence
  Synthetic polynucleotide
atcatctcaccttgcctcctgttgcgtcgtacagcttacctgcagggcaattaagagcaattatcggcaattagacgcaattactagcaattaactgcaattatgcgcaattagtagcaattaggcgcgccatgcttcatcagactct

SEQ ID NO: 4547 - DNA, 148 bp, Artificial Sequence; identical to SEQ ID NO: 4546
  Synthetic polynucleotide

SEQ ID NO: 4548 - DNA, 172 bp, Artificial Sequence
  Synthetic polynucleotide
atcatctcaccttgcctcctgaacggacaggcttaaaccctgcagggaaagaacagagagaaagaacagtcggaaagaacaggacgaaagaacagctagaaagaacagactgaaagaacagtgcgaaagaacaggtagaaagaacagggcgcgccatgcttcatcagactct

SEQ ID NO: 4549 - DNA, 172 bp, Artificial Sequence; identical to SEQ ID NO: 4548
  Synthetic polynucleotide

SEQ ID NO: 4550 - DNA, 191 bp, Artificial Sequence
  Synthetic polynucleotide
atcatctcaccttgcctcctgtttgtgaaactaacgcgcctgcaggtgacctttgagtgacctagatgacctttgagtgaccttcgtgacctttgagtgacctgactgacctttgagtgacctctatgacctttgagtgacctacttgacctttgagtgaccttgcggcgcgccatgcttcatcagactct

SEQ ID NO: 4551 - DNA, 191 bp, Artificial Sequence; identical to SEQ ID NO: 4550
  Synthetic polynucleotide

SEQ ID NO: 4552 - DNA, 180 bp, Artificial Sequence
  Synthetic polynucleotide
atcatctcaccttgcctcctggccagttatacacgcaccctgcaggggcacgtgccaagaggcacgtgccatcgggcacgtgccagacggcacgtgccactaggcacgtgccaactggcacgtgccatgcggcacgtgccagtaggcacgtgccaggcgcgccatgcttcatcagactct

SEQ ID NO: 4553 - DNA, 180 bp, Artificial Sequence; identical to SEQ ID NO: 4552
  Synthetic polynucleotide

SEQ ID NO: 4554 - DNA, 196 bp, Artificial Sequence
  Synthetic polynucleotide
atcatctcaccttgcctcctgttccaccatgaagtacgcctgcagggtgacctttgaccagagtgacctttgacctcggtgacctttgaccgacgtgacctttgaccctagtgacctttgaccactgtgacctttgacctgcgtgacctttgaccgtagtgacctttgaccggcgcgccatgcttcatcagactct

SEQ ID NO: 4555 - DNA, 196 bp, Artificial Sequence; identical to SEQ ID NO: 4554
  Synthetic polynucleotide

SEQ ID NO: 4556 - DNA, 172 bp, Artificial Sequence
  Synthetic polynucleotide
atcatctcaccttgcctcctgatatgaaactgttcgagcctgcagggacacgtgccagagacacgtgcctcggacacgtgccgacgacacgtgccctagacacgtgccactgacacgtgcctgcgacacgtgccgtagacacgtgccggcgcgccatgcttcatcagactct

SEQ ID NO: 4557 - DNA, 172 bp, Artificial Sequence; identical to SEQ ID NO: 4556
  Synthetic polynucleotide

SEQ ID NO: 4558 - DNA, 197 bp, Artificial Sequence
  Synthetic polynucleotide
atcatctcaccttgcctcctgcataatgatactccaagcctgcaggaaggtcaagcaaaggtcaagaaaggtcaagcaaaggtcatcgaaggtcaagcaaaggtcagacaaggtcaagcaaaggtcactaaaggtcaagcaaaggtcaactaaggtcaagcaaaggtcatgcggcgcgccatgcttcatcagactct

SEQ ID NO: 4559 - DNA, 197 bp, Artificial Sequence; identical to SEQ ID NO: 4558
  Synthetic polynucleotide

SEQ ID NO: 4560 - DNA, 190 bp, Artificial Sequence
  Synthetic polynucleotide
atcatctcaccttgcctcctgaacggaggcattaggaccctgcaggtgacttattgacttagatgacttattgactttcgtgacttattgacttgactgacttattgacttctatgacttattgacttacttgacttattgactttgctgacttattgacttgtaggcgcgccatgcttcatcagactct

SEQ ID NO: 4561 - DNA, 190 bp, Artificial Sequence; identical to SEQ ID NO: 4560
  Synthetic polynucleotide

SEQ ID NO: 4562 - DNA, 197 bp, Artificial Sequence
  Synthetic polynucleotide
atcatctcaccttgcctcctggccttaagcgtggattgcctgcaggcagcaccatggacagagacagcaccatggacagtcgcagcaccatggacaggaccagcaccatggacagctacagcaccatggacagactcagcaccatggacagtgccagcaccatggacaggtaggcgcgccatgcttcatcagactct

SEQ ID NO: 4563 - DNA, 197 bp, Artificial Sequence; identical to SEQ ID NO: 4562
  Synthetic polynucleotide

SEQ ID NO: 4564 - DNA, 197 bp, Artificial Sequence
  Synthetic polynucleotide
atcatctcaccttgcctcctgtggtacatttgacctatcctgcaggatttctcaggaaatgagaatttctcaggaaatgtcgatttctcaggaaatggacatttctcaggaaatgctaatttctcaggaaatgactatttctcaggaaatgtgcatttctcaggaaatggtaggcgcgccatgcttcatcagactct

SEQ ID NO: 4565 - DNA, 197 bp, Artificial Sequence; identical to SEQ ID NO: 4564
  Synthetic polynucleotide

SEQ ID NO: 4566 - DNA, 180 bp, Artificial Sequence
  Synthetic polynucleotide
atcatctcaccttgcctcctgggatataacgaaccctacctgcaggatgactcagcaagaatgactcagcatcgatgactcagcagacatgactcagcactaatgactcagcaactatgactcagcatgcatgactcagcagtaatgactcagcaggcgcgccatgcttcatcagactct

SEQ ID NO: 4567 - DNA, 180 bp, Artificial Sequence; identical to SEQ ID NO: 4566
  Synthetic polynucleotide

SEQ ID NO: 4568 - DNA, 164 bp, Artificial Sequence
  Synthetic polynucleotide
atcatctcaccttgcctcctgcaattctcaacgggccacctgcagggacacgtgcagagacacgtgctcggacacgtgcgacgacacgtgcctagacacgtgcactgacacgtgctgcgacacgtgcgtagacacgtgcggcgcgccatgcttcatcagactct

SEQ ID NO: 4569 - DNA, 164 bp, Artificial Sequence; identical to SEQ ID NO: 4568
  Synthetic polynucleotide

SEQ ID NO: 4570 - DNA, 197 bp, Artificial Sequence
  Synthetic polynucleotide
atcatctcaccttgcctcctgtagtggccgcatagacccctgcaggccgtcacgcaccaatagaccgtcacgcaccaattcgccgtcacgcaccaatgacccgtcacgcaccaatctaccgtcacgcaccaatactccgtcacgcaccaattgcccgtcacgcaccaatgtaggcgcgccatgcttcatcagactct

SEQ ID NO: 4571 - DNA, 197 bp, Artificial Sequence; identical to SEQ ID NO: 4570
  Synthetic polynucleotide

SEQ ID NO: 4572 - DNA, 188 bp, Artificial Sequence
  Synthetic polynucleotide
atcatctcaccttgcctcctgttggacctctcttgcggcctgcaggttacatgacatgagattacatgacatgtcgttacatgacatggacttacatgacatgctattacatgacatgactttacatgacatgtgcttacatgacatggtattacatgacatgggcgcgccatgcttcatcagactct

SEQ ID NO: 4573 - DNA, 188 bp, Artificial Sequence; identical to SEQ ID NO: 4572
  Synthetic polynucleotide

SEQ ID NO: 4574 - DNA, 185 bp, Artificial Sequence
  Synthetic polynucleotide
atcatctcaccttgcctcctgcaaagtcagcgtagctacctgcaggacgttaattaacccagagaacgttaattaacccagtcgacgttaattaacccaggacacgttaattaacccagctaacgttaattaacccagactacgttaattaacccagtgcggcgcgccatgcttcatcagactct

SEQ ID NO: 4575 - DNA, 185 bp, Artificial Sequence; identical to SEQ ID NO: 4574
  Synthetic polynucleotide

SEQ ID NO: 4576 - DNA, 188 bp, Artificial Sequence
  Synthetic polynucleotide
atcatctcaccttgcctcctggtgatagagtaatgtgccctgcagggggggatttcccagagggggatttccctcggggggatttcccgacgggggatttcccctagggggatttcccactgggggatttccctgcgggggatttcccgtagggggatttcccggcgcgccatgcttcatcagactct

SEQ ID NO: 4577 - DNA, 188 bp, Artificial Sequence; identical to SEQ ID NO: 4576
  Synthetic polynucleotide

SEQ ID NO: 4578 - DNA, 188 bp, Artificial Sequence
  Synthetic polynucleotide
atcatctcaccttgcctcctggctaaggatgtactgaccctgcaggtctatttatagtagatctatttatagttcgtctatttatagtgactctatttatagtctatctatttatagtacttctatttatagttgctctatttatagtgtatctatttatagtggcgcgccatgcttcatcagactct

SEQ ID NO: 4579 - DNA, 188 bp, Artificial Sequence; identical to SEQ ID NO: 4578
  Synthetic polynucleotide

SEQ ID NO: 4580 - DNA, 164 bp, Artificial Sequence
  Synthetic polynucleotide
atcatctcaccttgcctcctgaaccatggcgaaatcgtcctgcaggacacgtgccagaacacgtgcctcgacacgtgccgacacacgtgccctaacacgtgccactacacgtgcctgcacacgtgccgtaacacgtgccggcgcgccatgcttcatcagactct

SEQ ID NO: 4581 - DNA, 164 bp, Artificial Sequence; identical to SEQ ID NO: 4580
  Synthetic polynucleotide

SEQ ID NO: 4582 - DNA, 186 bp, Artificial Sequence
  Synthetic polynucleotide
atcatctcaccttgcctcctgtggtagggccaaaggagcctgcaggttaaaagtaaacaaagatgaagattaaaagtaaacaaagatgatcgttaaaagtaaacaaagatgagacttaaaagtaaacaaagatgactattaaaagtaaacaaagatgaactggcgcgccatgcttcatcagactct

SEQ ID NO: 4583 - DNA, 186 bp, Artificial Sequence; identical to SEQ ID NO: 4582
  Synthetic polynucleotide

SEQ ID NO: 4584 - DNA, 172 bp, Artificial Sequence
  Synthetic polynucleotide
atcatctcaccttgcctcctgagagtttgttctgcccacctgcaggcgttgctatgagacgttgctatgtcgcgttgctatggaccgttgctatgctacgttgctatgactcgttgctatgtgccgttgctatggtacgttgctatgggcgcgccatgcttcatcagactct

SEQ ID NO: 4585 - DNA, 172 bp, Artificial Sequence; identical to SEQ ID NO: 4584
  Synthetic polynucleotide

SEQ ID NO: 4586 - DNA, 196 bp, Artificial Sequence
  Synthetic polynucleotide
atcatctcaccttgcctcctggtacgagctactttattcctgcaggtgacctttgacccagatgacctttgaccctcgtgacctttgacccgactgacctttgacccctatgacctttgacccacttgacctttgaccctgctgacctttgacccgtatgacctttgacccggcgcgccatgcttcatcagactct

SEQ ID NO: 4587 - DNA, 196 bp, Artificial Sequence; identical to SEQ ID NO: 4586
  Synthetic polynucleotide

SEQ ID NO: 4588 - DNA, 164 bp, Artificial Sequence
  Synthetic polynucleotide
atcatctcaccttgcctcctgccttcttgaccctgacgcctgcaggaggaaatgaagaaggaaatgatcgaggaaatgagacaggaaatgactaaggaaatgaactaggaaatgatgcaggaaatgagtaaggaaatgaggcgcgccatgcttcatcagactct

SEQ ID NO: 4589 - DNA, 164 bp, Artificial Sequence; identical to SEQ ID NO: 4588
  Synthetic polynucleotide

SEQ ID NO: 4590 - DNA, 191 bp, Artificial Sequence
  Synthetic polynucleotide
atcatctcaccttgcctcctgatgggataaagatccatcctgcaggtaaggtcgtaaaatcctagataaggtcgtaaaatccttcgtaaggtcgtaaaatcctgactaaggtcgtaaaatcctctataaggtcgtaaaatcctacttaaggtcgtaaaatccttgcggcgcgccatgcttcatcagactct

SEQ ID NO: 4591 - DNA, 191 bp, Artificial Sequence; identical to SEQ ID NO: 4590
  Synthetic polynucleotide

SEQ ID NO: 4592 - DNA, 164 bp, Artificial Sequence
  Synthetic polynucleotide
atcatctcaccttgcctcctggacctttgcggcagtatcctgcaggtaggtcaccagataggtcacctcgtaggtcaccgactaggtcaccctataggtcaccacttaggtcacctgctaggtcaccgtataggtcaccggcgcgccatgcttcatcagactct

SEQ ID NO: 4593 - DNA, 164 bp, Artificial Sequence; identical to SEQ ID NO: 4592
  Synthetic polynucleotide

SEQ ID NO: 4594 - DNA, 190 bp, Artificial Sequence
  Synthetic polynucleotide
atcatctcaccttgcctcctgtcgactttatagtgtagcctgcaggggaacattctgttcagaggaacattctgttctcgggaacattctgttcgacggaacattctgttcctaggaacattctgttcactggaacattctgttctgcggaacattctgttcgtaggcgcgccatgcttcatcagactct

SEQ ID NO: 4595 - DNA, 190 bp, Artificial Sequence; identical to SEQ ID NO: 4594
  Synthetic polynucleotide

SEQ ID NO: 4596 - DNA, 185 bp, Artificial Sequence
  Synthetic polynucleotide
atcatctcaccttgcctcctgatcttctcataggctcccctgcagggtactaattagtggcgagagtactaattagtggcgtcggtactaattagtggcggacgtactaattagtggcgctagtactaattagtggcgactgtactaattagtggcgtgcggcgcgccatgcttcatcagactct

SEQ ID NO: 4597 - DNA, 185 bp, Artificial Sequence; identical to SEQ ID NO: 4596
  Synthetic polynucleotide

SEQ ID NO: 4598 - DNA, 164 bp, Artificial Sequence
  Synthetic polynucleotide
atcatctcaccttgcctcctggctcctagtgaaccaaacctgcaggtccgcccccagatccgccccctcgtccgcccccgactccgcccccctatccgcccccacttccgccccctgctccgcccccgtatccgcccccggcgcgccatgcttcatcagactct

SEQ ID NO: 4599 - DNA, 164 bp, Artificial Sequence; identical to SEQ ID NO: 4598
  Synthetic polynucleotide

SEQ ID NO: 4600 - DNA, 156 bp, Artificial Sequence
  Synthetic polynucleotide
atcatctcaccttgcctcctgctatggctctcgaccctcctgcagggcgggaaaagagcgggaaatcggcgggaaagacgcgggaaactagcgggaaaactgcgggaaatgcgcgggaaagtagcgggaaaggcgcgccatgcttcatcagactct

SEQ ID NO: 4601 - DNA, 156 bp, Artificial Sequence; identical to SEQ ID NO: 4600
  Synthetic polynucleotide

SEQ ID NO: 4602 - DNA, 180 bp, Artificial Sequence
  Synthetic polynucleotide
atcatctcaccttgcctcctgcacgtagtcaaacgtcccctgcaggaagaggattagagaaagaggattagtcgaagaggattaggacaagaggattagctaaagaggattagactaagaggattagtgcaagaggattaggtaaagaggattagggcgcgccatgcttcatcagactct

SEQ ID NO: 4603 - DNA, 180 bp, Artificial Sequence; identical to SEQ ID NO: 4602
  Synthetic polynucleotide

SEQ ID NO: 4604 - DNA, 180 bp, Artificial Sequence
  Synthetic polynucleotide
atcatctcaccttgcctcctgcagctcgcacattagggcctgcagggccacgcccccagagccacgccccctcggccacgcccccgacgccacgcccccctagccacgcccccactgccacgccccctgcgccacgcccccgtagccacgcccccggcgcgccatgcttcatcagactct

SEQ ID NO: 4605 - DNA, 180 bp, Artificial Sequence; identical to SEQ ID NO: 4604
  Synthetic polynucleotide

SEQ ID NO: 4606 - DNA, 196 bp, Artificial Sequence
  Synthetic polynucleotide
atcatctcaccttgcctcctgtcaacctaacggagccgcctgcaggcctcaccccacccagacctcaccccaccctcgcctcaccccacccgaccctcaccccacccctacctcaccccacccactcctcaccccaccctgccctcaccccacccgtacctcaccccacccggcgcgccatgcttcatcagactct

SEQ ID NO: 4607 - DNA, 196 bp, Artificial Sequence; identical to SEQ ID NO: 4606
  Synthetic polynucleotide

SEQ ID NO: 4608 - DNA, 196 bp, Artificial Sequence
  Synthetic polynucleotide
atcatctcaccttgcctcctggctccgggtaatgagtacctgcaggtgacctttgacctagatgacctttgaccttcgtgacctttgacctgactgacctttgacctctatgacctttgacctacttgacctttgaccttgctgacctttgacctgtatgacctttgacctggcgcgccatgcttcatcagactct

SEQ ID NO: 4609 - DNA, 196 bp, Artificial Sequence; identical to SEQ ID NO: 4608
  Synthetic polynucleotide

SEQ ID NO: 4610 - DNA, 172 bp, Artificial Sequence
  Synthetic polynucleotide
atcatctcaccttgcctcctgcgcccattgcttcagagcctgcaggccacttaagaagaccacttaagatcgccacttaagagacccacttaagactaccacttaagaactccacttaagatgcccacttaagagtaccacttaagaggcgcgccatgcttcatcagactct

SEQ ID NO: 4611 - DNA, 172 bp, Artificial Sequence; identical to SEQ ID NO: 4610
  Synthetic polynucleotide

SEQ ID NO: 4612 - DNA, 197 bp, Artificial Sequence
  Synthetic polynucleotide
atcatctcaccttgcctcctgctgttagcatccacgaccctgcaggaaggtcaaaaggtcaagaaaggtcaaaaggtcatcgaaggtcaaaaggtcagacaaggtcaaaaggtcactaaaggtcaaaaggtcaactaaggtcaaaaggtcatgcaaggtcaaaaggtcagtaggcgcgccatgcttcatcagactct

SEQ ID NO: 4613 - DNA, 197 bp, Artificial Sequence; identical to SEQ ID NO: 4612
  Synthetic polynucleotide

SEQ ID NO: 4614 - DNA, 196 bp, Artificial Sequence
  Synthetic polynucleotide
atcatctcaccttgcctcctgttcaagggccagagaatcctgcaggtacacttcccagaatgccttgcagatacacttcccagaatgccttgctcgtacacttcccagaatgccttgcgactacacttcccagaatgccttgcctatacacttcccagaatgccttgcactggcgcgccatgcttcatcagactct

SEQ ID NO: 4615 - DNA, 196 bp, Artificial Sequence; identical to SEQ ID NO: 4614
  Synthetic polynucleotide

SEQ ID NO: 4616 - DNA, 197 bp, Artificial Sequence
  Synthetic polynucleotide
atcatctcaccttgcctcctgtgaggcaccaggtaagtcctgcaggggtcacgtgaccgggagaggtcacgtgaccgggtcgggtcacgtgaccggggacggtcacgtgaccgggctaggtcacgtgaccgggactggtcacgtgaccgggtgcggtcacgtgaccggggtaggcgcgccatgcttcatcagactct

SEQ ID NO: 4617 - DNA, 197 bp, Artificial Sequence; identical to SEQ ID NO: 4616
  Synthetic polynucleotide

SEQ ID NO: 4618 - DNA, 180 bp, Artificial Sequence
  Synthetic polynucleotide
atcatctcaccttgcctcctgcctgaacctgtagtacccctgcaggaccatatggcgagaaccatatggcgtcgaccatatggcggacaccatatggcgctaaccatatggcgactaccatatggcgtgcaccatatggcggtaaccatatggcgggcgcgccatgcttcatcagactct

SEQ ID NO: 4619 - DNA, 180 bp, Artificial Sequence; identical to SEQ ID NO: 4618
  Synthetic polynucleotide

SEQ ID NO: 4620 - DNA, 197 bp, Artificial Sequence
  Synthetic polynucleotide
atcatctcaccttgcctcctgattctctcacggtccttcctgcaggcttaagtaaacaacgagacttaagtaaacaacgtcgcttaagtaaacaacggaccttaagtaaacaacgctacttaagtaaacaacgactcttaagtaaacaacgtgccttaagtaaacaacggtaggcgcgccatgcttcatcagactct

SEQ ID NO: 4621 - DNA, 197 bp, Artificial Sequence; identical to SEQ ID NO: 4620
  Synthetic polynucleotide

SEQ ID NO: 4622 - DNA, 188 bp, Artificial Sequence
  Synthetic polynucleotide
atcatctcaccttgcctcctggttagcggccgtcctaacctgcaggtgattgcaatcaagatgattgcaatcatcgtgattgcaatcagactgattgcaatcactatgattgcaatcaacttgattgcaatcatgctgattgcaatcagtatgattgcaatcaggcgcgccatgcttcatcagactct

SEQ ID NO: 4623 - DNA, 188 bp, Artificial Sequence; identical to SEQ ID NO: 4622
  Synthetic polynucleotide

SEQ ID NO: 4624 - DNA, 190 bp, Artificial Sequence
  Synthetic polynucleotide
atcatctcaccttgcctcctgagtaaccgcagtttcaacctgcaggcgatgacgtcagagagacgatgacgtcagagtcgcgatgacgtcagaggaccgatgacgtcagagctacgatgacgtcagagactcgatgacgtcagagtgccgatgacgtcagaggtaggcgcgccatgcttcatcagactct

SEQ ID NO: 4625 - DNA, 190 bp, Artificial Sequence; identical to SEQ ID NO: 4624
  Synthetic polynucleotide

SEQ ID NO: 4626 - DNA, 156 bp, Artificial Sequence
  Synthetic polynucleotide
atcatctcaccttgcctcctgccgagtcagtctggttgcctgcaggtgtttacaagatgtttacatcgtgtttacagactgtttacactatgtttacaacttgtttacatgctgtttacagtatgtttacaggcgcgccatgcttcatcagactct

SEQ ID NO: 4627 - DNA, 156 bp, Artificial Sequence; identical to SEQ ID NO: 4626
  Synthetic polynucleotide

SEQ ID NO: 4628 - DNA, 185 bp, Artificial Sequence
  Synthetic polynucleotide
atcatctcaccttgcctcctggttgatccggtggtgaacctgcaggatccggcacgtggcctagaatccggcacgtggccttcgatccggcacgtggcctgacatccggcacgtggcctctaatccggcacgtggcctactatccggcacgtggccttgcggcgcgccatgcttcatcagactct

SEQ ID NO: 4629 - DNA, 185 bp, Artificial Sequence; identical to SEQ ID NO: 4628
  Synthetic polynucleotide

SEQ ID NO: 4630 - DNA, 196 bp, Artificial Sequence
  Synthetic polynucleotide
atcatctcaccttgcctcctgcgctctaaatttgggcacctgcaggaattcccagaaaaagaaattcccagaaaatcgaattcccagaaaagacaattcccagaaaactaaattcccagaaaaactaattcccagaaaatgcaattcccagaaaagtaaattcccagaaaaggcgcgccatgcttcatcagactct

SEQ ID NO: 4631 - DNA, 196 bp, Artificial Sequence; identical to SEQ ID NO: 4630
  Synthetic polynucleotide

SEQ ID NO: 4632 - DNA, 191 bp, Artificial Sequence
  Synthetic polynucleotide
atcatctcaccttgcctcctgtagtggctgtctatgtgcctgcaggtgaattcctagaaagcaagatgaattcctagaaagcatcgtgaattcctagaaagcagactgaattcctagaaagcactatgaattcctagaaagcaacttgaattcctagaaagcatgcggcgcgccatgcttcatcagactct

SEQ ID NO: 4633 - DNA, 191 bp, Artificial Sequence; identical to SEQ ID NO: 4632
  Synthetic polynucleotide

SEQ ID NO: 4634 - DNA, 188 bp, Artificial Sequence
  Synthetic polynucleotide
atcatctcaccttgcctcctgtttataataccaggagccctgcaggtgtaaacaaattagatgtaaacaaatttcgtgtaaacaaattgactgtaaacaaattctatgtaaacaaattacttgtaaacaaatttgctgtaaacaaattgtatgtaaacaaattggcgcgccatgcttcatcagactct

SEQ ID NO: 4635 - DNA, 188 bp, Artificial Sequence; identical to SEQ ID NO: 4634
  Synthetic polynucleotide

SEQ ID NO: 4636 - DNA, 188 bp, Artificial Sequence
  Synthetic polynucleotide
atcatctcaccttgcctcctggaatgtgagtgagatcccctgcaggctgaccttgaacagactgaccttgaactcgctgaccttgaacgacctgaccttgaacctactgaccttgaacactctgaccttgaactgcctgaccttgaacgtactgaccttgaacggcgcgccatgcttcatcagactct

SEQ ID NO: 4637 - DNA, 188 bp, Artificial Sequence; identical to SEQ ID NO: 4636
  Synthetic polynucleotide

SEQ ID NO: 4638 - DNA, 191 bp, Artificial Sequence
  Synthetic polynucleotide
atcatctcaccttgcctcctgcgcacatccttatcgaacctgcaggactttggtttcgatcagagaactttggtttcgatcagtcgactttggtttcgatcaggacactttggtttcgatcagctaactttggtttcgatcagactactttggtttcgatcagtgcggcgcgccatgcttcatcagactct

SEQ ID NO: 4639 - DNA, 191 bp, Artificial Sequence; identical to SEQ ID NO: 4638
  Synthetic polynucleotide

SEQ ID NO: 4640 - DNA, 180 bp, Artificial Sequence
  Synthetic polynucleotide
atcatctcaccttgcctcctgcaccatattcccgtgagcctgcaggcggacacaatcagacggacacaatctcgcggacacaatcgaccggacacaatcctacggacacaatcactcggacacaatctgccggacacaatcgtacggacacaatcggcgcgccatgcttcatcagactct

SEQ ID NO: 4641 - DNA, 180 bp, Artificial Sequence; identical to SEQ ID NO: 4640
  Synthetic polynucleotide

SEQ ID NO: 4642 - DNA, 197 bp, Artificial Sequence
  Synthetic polynucleotide
atcatctcaccttgcctcctgtatacgacgacgtctcccctgcaggttgctatttttagcaagattgctatttttagcatcgttgctatttttagcagacttgctatttttagcactattgctatttttagcaactttgctatttttagcatgcttgctatttttagcagtaggcgcgccatgcttcatcagactct

SEQ ID NO: 4643 - DNA, 197 bp, Artificial Sequence; identical to SEQ ID NO: 4642
  Synthetic polynucleotide

SEQ ID NO: 4644 - DNA, 191 bp, Artificial Sequence
  Synthetic polynucleotide
atcatctcaccttgcctcctgacaaccactttctcaagcctgcagggggtacaccgtgttcccagagggtacaccgtgttccctcggggtacaccgtgttcccgacgggtacaccgtgttcccctagggtacaccgtgttcccactgggtacaccgtgttccctgcggcgcgccatgcttcatcagactct

SEQ ID NO: 4645 - DNA, 191 bp, Artificial Sequence; identical to SEQ ID NO: 4644
  Synthetic polynucleotide

SEQ ID NO: 4646 - DNA, 197 bp, Artificial Sequence
  Synthetic polynucleotide
atcatctcaccttgcctcctgactgcacttggtactgccctgcaggcattgcctcagggcaagacattgcctcagggcatcgcattgcctcagggcagaccattgcctcagggcactacattgcctcagggcaactcattgcctcagggcatgccattgcctcagggcagtaggcgcgccatgcttcatcagactct

SEQ ID NO: 4647 - DNA, 197 bp, Artificial Sequence; identical to SEQ ID NO: 4646
  Synthetic polynucleotide

SEQ ID NO: 4648 - DNA, 180 bp, Artificial Sequence
  Synthetic polynucleotide
atcatctcaccttgcctcctgctttgccgtagcaggaccctgcaggaagccataaaaagaaagccataaaatcgaagccataaaagacaagccataaaactaaagccataaaaactaagccataaaatgcaagccataaaagtaaagccataaaaggcgcgccatgcttcatcagactct

SEQ ID NO: 4649 - DNA, 180 bp, Artificial Sequence; identical to SEQ ID NO: 4648
  Synthetic polynucleotide

SEQ ID NO: 4650 - DNA, 180 bp, Artificial Sequence
  Synthetic polynucleotide
atcatctcaccttgcctcctggatgcaaagtcggccgtcctgcaggtttttacgaccagatttttacgacctcgtttttacgaccgactttttacgaccctatttttacgaccacttttttacgacctgctttttacgaccgtatttttacgaccggcgcgccatgcttcatcagactct

SEQ ID NO: 4651 - DNA, 180 bp, Artificial Sequence; identical to SEQ ID NO: 4650
  Synthetic polynucleotide

SEQ ID NO: 4652 - DNA, 190 bp, Artificial Sequence
  Synthetic polynucleotide
atcatctcaccttgcctcctgggagagttcctgaatcgcctgcaggaaccgttaaccgttagaaaccgttaaccgtttcgaaccgttaaccgttgacaaccgttaaccgttctaaaccgttaaccgttactaaccgttaaccgtttgcaaccgttaaccgttgtaggcgcgccatgcttcatcagactct

SEQ ID NO: 4653 - DNA, 190 bp, Artificial Sequence; identical to SEQ ID NO: 4652
  Synthetic polynucleotide

SEQ ID NO: 4654 - DNA, 180 bp, Artificial Sequence
  Synthetic polynucleotide
atcatctcaccttgcctcctgagccggtcaaggatatacctgcaggccagcgcccgcagaccagcgcccgctcgccagcgcccgcgacccagcgcccgcctaccagcgcccgcactccagcgcccgctgcccagcgcccgcgtaccagcgcccgcggcgcgccatgcttcatcagactct

SEQ ID NO: 4655 - DNA, 180 bp, Artificial Sequence; identical to SEQ ID NO: 4654
  Synthetic polynucleotide

SEQ ID NO: 4656 - DNA, 190 bp, Artificial Sequence
  Synthetic polynucleotide
atcatctcaccttgcctcctgttctttaagctactgagcctgcaggatttcctgtttgccagaatttcctgtttgcctcgatttcctgtttgccgacatttcctgtttgccctaatttcctgtttgccactatttcctgtttgcctgcatttcctgtttgccgtaggcgcgccatgcttcatcagactct

SEQ ID NO: 4657 - DNA, 190 bp, Artificial Sequence; identical to SEQ ID NO: 4656
  Synthetic polynucleotide

SEQ ID NO: 4658 - DNA, 197 bp, Artificial Sequence
  Synthetic polynucleotide
atcatctcaccttgcctcctgttacagtgtatgacttgcctgcaggtgaaatatttatttaagatgaaatatttatttatcgtgaaatatttatttagactgaaatatttatttactatgaaatatttatttaacttgaaatatttatttatgctgaaatatttatttagtaggcgcgccatgcttcatcagactct

SEQ ID NO: 4659 - DNA, 197 bp, Artificial Sequence; identical to SEQ ID NO: 4658
  Synthetic polynucleotide

SEQ ID NO: 4660 - DNA, 197 bp, Artificial Sequence
  Synthetic polynucleotide
atcatctcaccttgcctcctgattcgagaccgggcagtcctgcaggttcgaacggttcgaaagattcgaacggttcgaatcgttcgaacggttcgaagacttcgaacggttcgaactattcgaacggttcgaaactttcgaacggttcgaatgcttcgaacggttcgaagtaggcgcgccatgcttcatcagactct

SEQ ID NO: 4661 - DNA, 197 bp, Artificial Sequence; identical to SEQ ID NO: 4660
  Synthetic polynucleotide

SEQ ID NO: 4662 - DNA, 156 bp, Artificial Sequence
  Synthetic polynucleotide
atcatctcaccttgcctcctgttgacgtacatcctgtacctgcaggtttcgcaaagatttcgcaatcgtttcgcaagactttcgcaactatttcgcaaacttttcgcaatgctttcgcaagtatttcgcaaggcgcgccatgcttcatcagactct

SEQ ID NO: 4663 - DNA, 156 bp, Artificial Sequence; identical to SEQ ID NO: 4662
  Synthetic polynucleotide

SEQ ID NO: 4664 - DNA, 190 bp, Artificial Sequence
  Synthetic polynucleotide
atcatctcaccttgcctcctgccgtctcacgattcaagcctgcagggaccacccacgacgagagaccacccacgacgtcggaccacccacgacggacgaccacccacgacgctagaccacccacgacgactgaccacccacgacgtgcgaccacccacgacggtaggcgcgccatgcttcatcagactct

SEQ ID NO: 4665 - DNA, 190 bp, Artificial Sequence; identical to SEQ ID NO: 4664
  Synthetic polynucleotide

SEQ ID NO: 4666 - DNA, 196 bp, Artificial Sequence
  Synthetic polynucleotide
atcatctcaccttgcctcctgttatcatgcagtagtgccctgcaggtgtttatgtttacagatgtttatgtttactcgtgtttatgtttacgactgtttatgtttacctatgtttatgtttacacttgtttatgtttactgctgtttatgtttacgtatgtttatgtttacggcgcgccatgcttcatcagactct

SEQ ID NO: 4667 - DNA, 196 bp, Artificial Sequence; identical to SEQ ID NO: 4666
  Synthetic polynucleotide

SEQ ID NO: 4668 - DNA, 172 bp, Artificial Sequence
  Synthetic polynucleotide
atcatctcaccttgcctcctgtgcatactatccgatctcctgcaggacctggtggcagaacctggtggctcgacctggtggcgacacctggtggcctaacctggtggcactacctggtggctgcacctggtggcgtaacctggtggcggcgcgccatgcttcatcagactct

SEQ ID NO: 4669 - DNA, 172 bp, Artificial Sequence; identical to SEQ ID NO: 4668
  Synthetic polynucleotide

SEQ ID NO: 4670 - DNA, 172 bp, Artificial Sequence
  Synthetic polynucleotide
atcatctcaccttgcctcctgtacataaggcatccgagcctgcagggttaattaccagagttaattacctcggttaattaccgacgttaattaccctagttaattaccactgttaattacctgcgttaattaccgtagttaattaccggcgcgccatgcttcatcagactct

SEQ ID NO: 4671 - DNA, 172 bp, Artificial Sequence; identical to SEQ ID NO: 4670
  Synthetic polynucleotide

SEQ ID NO: 4672 - DNA, 190 bp, Artificial Sequence
  Synthetic polynucleotide
atcatctcaccttgcctcctgatcgttgtccgacgtcacctgcaggtaattgaccaattaagataattgaccaattatcgtaattgaccaattagactaattgaccaattactataattgaccaattaacttaattgaccaattatgctaattgaccaattagtaggcgcgccatgcttcatcagactct

SEQ ID NO: 4673 - DNA, 190 bp, Artificial Sequence; identical to SEQ ID NO: 4672
  Synthetic polynucleotide

SEQ ID NO: 4674 - DNA, 148 bp, Artificial Sequence
  Synthetic polynucleotide
atcatctcaccttgcctcctgtcccacaccagcatgcacctgcaggtacgtaaagatacgtaatcgtacgtaagactacgtaactatacgtaaacttacgtaatgctacgtaagtatacgtaaggcgcgccatgcttcatcagactct

SEQ ID NO: 4675 - DNA, 148 bp, Artificial Sequence; identical to SEQ ID NO: 4674
  Synthetic polynucleotide

SEQ ID NO: 4676 - DNA, 156 bp, Artificial Sequence
  Synthetic polynucleotide
atcatctcaccttgcctcctgtggatcagcacctgggacctgcaggtcacgtgtagatcacgtgttcgtcacgtgtgactcacgtgtctatcacgtgtacttcacgtgttgctcacgtgtgtatcacgtgtggcgcgccatgcttcatcagactct

SEQ ID NO: 4677 - DNA, 156 bp, Artificial Sequence; identical to SEQ ID NO: 4676
  Synthetic polynucleotide

SEQ ID NO: 4678 - DNA, 185 bp, Artificial Sequence
  Synthetic polynucleotide
atcatctcaccttgcctcctgcacatccggtgagttcgcctgcagggttgtcacgtgcccgcagagttgtcacgtgcccgctcggttgtcacgtgcccgcgacgttgtcacgtgcccgcctagttgtcacgtgcccgcactgttgtcacgtgcccgctgcggcgcgccatgcttcatcagactct

SEQ ID NO: 4679 - DNA, 185 bp, Artificial Sequence; identical to SEQ ID NO: 4678
  Synthetic polynucleotide

SEQ ID NO: 4680 - DNA, 156 bp, Artificial Sequence
  Synthetic polynucleotide
atcatctcaccttgcctcctgtagctgatacggtcgttcctgcaggggattaatagaggattaattcgggattaatgacggattaatctaggattaatactggattaattgcggattaatgtaggattaatggcgcgccatgcttcatcagactct

SEQ ID NO: 4681 - DNA, 156 bp, Artificial Sequence; identical to SEQ ID NO: 4680
  Synthetic polynucleotide

SEQ ID NO: 4682 - DNA, 191 bp, Artificial Sequence
  Synthetic polynucleotide
atcatctcaccttgcctcctgctcagtagtgggcgcatcctgcaggaaacaatgtcattgtttagaaaacaatgtcattgttttcgaaacaatgtcattgtttgacaaacaatgtcattgtttctaaaacaatgtcattgtttactaaacaatgtcattgttttgcggcgcgccatgcttcatcagactct

SEQ ID NO: 4683 - DNA, 191 bp, Artificial Sequence; identical to SEQ ID NO: 4682
  Synthetic polynucleotide

SEQ ID NO: 4684 - DNA, 185 bp, Artificial Sequence
  Synthetic polynucleotide
atcatctcaccttgcctcctgatgggattatacgcttacctgcagggcccccaggcggagggagagcccccaggcggagggtcggcccccaggcggaggggacgcccccaggcggagggctagcccccaggcggagggactgcccccaggcggagggtgcggcgcgccatgcttcatcagactct

SEQ ID NO: 4685 - DNA, 185 bp, Artificial Sequence; identical to SEQ ID NO: 4684
  Synthetic polynucleotide

SEQ ID NO: 4686 - DNA, 164 bp, Artificial Sequence
  Synthetic polynucleotide
atcatctcaccttgcctcctgcgtcatcatagacagaacctgcaggcctgctggtagacctgctggttcgcctgctggtgaccctgctggtctacctgctggtactcctgctggttgccctgctggtgtacctgctggtggcgcgccatgcttcatcagactct

SEQ ID NO: 4687 - DNA, 164 bp, Artificial Sequence; identical to SEQ ID NO: 4686
  Synthetic polynucleotide

SEQ ID NO: 4688 - DNA, 180 bp, Artificial Sequence
  Synthetic polynucleotide
atcatctcaccttgcctcctggcgaataagttgatggtcctgcaggtgtttgtttttagatgtttgttttttcgtgtttgtttttgactgtttgtttttctatgtttgtttttacttgtttgttttttgctgtttgtttttgtatgtttgtttttggcgcgccatgcttcatcagactct

SEQ ID NO: 4689 - DNA, 180 bp, Artificial Sequence; identical to SEQ ID NO: 4688
  Synthetic polynucleotide

SEQ ID NO: 4690 - DNA, 200 bp, Artificial Sequence
  Synthetic polynucleotide
atcatctcaccttgcctcctggctacgtttgtttagcgcctgcaggtcacacctaaaaggtgtgaagatcacacctaaaaggtgtgatcgtcacacctaaaaggtgtgagactcacacctaaaaggtgtgactatcacacctaaaaggtgtgaacttcacacctaaaaggtgtgaggcgcgccatgcttcatcagactct

SEQ ID NO: 4691 - DNA, 200 bp, Artificial Sequence; identical to SEQ ID NO: 4690
  Synthetic polynucleotide

SEQ ID NO: 4692 - DNA, 172 bp, Artificial Sequence
  Synthetic polynucleotide
atcatctcaccttgcctcctgaccgctagtaagtgactcctgcaggaacacctgctagaaacacctgcttcgaacacctgctgacaacacctgctctaaacacctgctactaacacctgcttgcaacacctgctgtaaacacctgctggcgcgccatgcttcatcagactct

SEQ ID NO: 4693 - DNA, 172 bp, Artificial Sequence; identical to SEQ ID NO: 4692
  Synthetic polynucleotide

SEQ ID NO: 4694 - DNA, 196 bp, Artificial Sequence
  Synthetic polynucleotide
atcatctcaccttgcctcctgtgaagggttgataccatcctgcaggccgcccccaggccagaccgcccccaggcctcgccgcccccaggccgacccgcccccaggccctaccgcccccaggccactccgcccccaggcctgcccgcccccaggccgtaccgcccccaggccggcgcgccatgcttcatcagactct

SEQ ID NO: 4695 - DNA, 196 bp, Artificial Sequence; identical to SEQ ID NO: 4694
  Synthetic polynucleotide

SEQ ID NO: 4696 - DNA, 197 bp, Artificial Sequence
  Synthetic polynucleotide
atcatctcaccttgcctcctgtggttagtgggtgcagccctgcaggatagtctgataagggggtagaatagtctgataagggggttcgatagtctgataagggggtgacatagtctgataagggggtctaatagtctgataagggggtactatagtctgataagggggttgcggcgcgccatgcttcatcagactct

SEQ ID NO: 4697 - DNA, 197 bp, Artificial Sequence; identical to SEQ ID NO: 4696
  Synthetic polynucleotide

SEQ ID NO: 4698 - DNA, 156 bp, Artificial Sequence
  Synthetic polynucleotide
atcatctcaccttgcctcctgactcttgtcccgtgctgcctgcaggggattaacagaggattaactcgggattaacgacggattaacctaggattaacactggattaactgcggattaacgtaggattaacggcgcgccatgcttcatcagactct

SEQ ID NO: 4699 - DNA, 156 bp, Artificial Sequence; identical to SEQ ID NO: 4698
  Synthetic polynucleotide

SEQ ID NO: 4700 - DNA, 140 bp, Artificial Sequence
  Synthetic polynucleotide
atcatctcaccttgcctcctgataacaccaatcgtagccctgcaggcttccgagacttccgtcgcttccggaccttccgctacttccgactcttccgtgccttccggtacttccgggcgcgccatgcttcatcagactct

SEQ ID NO: 4701 - DNA, 140 bp, Artificial Sequence; identical to SEQ ID NO: 4700
  Synthetic polynucleotide

SEQ ID NO: 4702 - DNA, 196 bp, Artificial Sequence
  Synthetic polynucleotide
atcatctcaccttgcctcctggttccggcagatcctagcctgcaggtaattggcaattaagataattggcaattatcgtaattggcaattagactaattggcaattactataattggcaattaacttaattggcaattatgctaattggcaattagtataattggcaattaggcgcgccatgcttcatcagactct

SEQ ID NO: 4703 - DNA, 196 bp, Artificial Sequence; identical to SEQ ID NO: 4702
  Synthetic polynucleotide

SEQ ID NO: 4704 - DNA, 188 bp, Artificial Sequence
  Synthetic polynucleotide
atcatctcaccttgcctcctgaaactaaatcgcggtcacctgcagggagaacaaagcgagagagaacaaagcgtcggagaacaaagcggacgagaacaaagcgctagagaacaaagcgactgagaacaaagcgtgcgagaacaaagcggtagagaacaaagcgggcgcgccatgcttcatcagactct

SEQ ID NO: 4705 - DNA, 188 bp, Artificial Sequence; identical to SEQ ID NO: 4704
  Synthetic polynucleotide

SEQ ID NO: 4706 - DNA, 164 bp, Artificial Sequence
  Synthetic polynucleotide
atcatctcaccttgcctcctgtatcgcttcagcgtccgcctgcaggtgggcgtggagatgggcgtggtcgtgggcgtgggactgggcgtggctatgggcgtggacttgggcgtggtgctgggcgtgggtatgggcgtggggcgcgccatgcttcatcagactct

SEQ ID NO: 4707 - DNA, 164 bp, Artificial Sequence; identical to SEQ ID NO: 4706
  Synthetic polynucleotide

SEQ ID NO: 4708 - DNA, 188 bp, Artificial Sequence
  Synthetic polynucleotide
atcatctcaccttgcctcctgagtataggtccctccagcctgcaggccatatatgggcagaccatatatgggctcgccatatatgggcgacccatatatgggcctaccatatatgggcactccatatatgggctgcccatatatgggcgtaccatatatgggcggcgcgccatgcttcatcagactct

SEQ ID NO: 4709 - DNA, 188 bp, Artificial Sequence; identical to SEQ ID NO: 4708
  Synthetic polynucleotide

SEQ ID NO: 4710 - DNA, 185 bp, Artificial Sequence
  Synthetic polynucleotide
atcatctcaccttgcctcctgcggtaatgagcccttagcctgcaggtaagccacttgaaattagataagccacttgaaatttcgtaagccacttgaaattgactaagccacttgaaattctataagccacttgaaattacttaagccacttgaaatttgcggcgcgccatgcttcatcagactct

SEQ ID NO: 4711 - DNA, 185 bp, Artificial Sequence; identical to SEQ ID NO: 4710
  Synthetic polynucleotide

SEQ ID NO: 4712 - DNA, 156 bp, Artificial Sequence
  Synthetic polynucleotide
atcatctcaccttgcctcctgtttccggaataagacatcctgcaggcccaaaatagacccaaaattcgcccaaaatgaccccaaaatctacccaaaatactcccaaaattgccccaaaatgtacccaaaatggcgcgccatgcttcatcagactct

SEQ ID NO: 4713 - DNA, 156 bp, Artificial Sequence; identical to SEQ ID NO: 4712
  Synthetic polynucleotide

SEQ ID NO: 4714 - DNA, 197 bp, Artificial Sequence
  Synthetic polynucleotide
atcatctcaccttgcctcctgtctttaccatcatgcagcctgcagggtgaccttatgaggtcacagagtgaccttatgaggtcactcggtgaccttatgaggtcacgacgtgaccttatgaggtcacctagtgaccttatgaggtcacactgtgaccttatgaggtcactgcggcgcgccatgcttcatcagactct

SEQ ID NO: 4715 - DNA, 197 bp, Artificial Sequence; identical to SEQ ID NO: 4714
  Synthetic polynucleotide

SEQ ID NO: 4716 - DNA, 180 bp, Artificial Sequence
  Synthetic polynucleotide
atcatctcaccttgcctcctgtgtctcgtgatctactgcctgcaggagtaattacttagaagtaattactttcgagtaattacttgacagtaattacttctaagtaattacttactagtaattactttgcagtaattacttgtaagtaattacttggcgcgccatgcttcatcagactct

SEQ ID NO: 4717 - DNA, 180 bp, Artificial Sequence; identical to SEQ ID NO: 4716
  Synthetic polynucleotide

SEQ ID NO: 4718 - DNA, 156 bp, Artificial Sequence
  Synthetic polynucleotide
atcatctcaccttgcctcctgtggtatggcatcgtactcctgcaggtttaattgagatttaattgtcgtttaattggactttaattgctatttaattgacttttaattgtgctttaattggtatttaattgggcgcgccatgcttcatcagactct

SEQ ID NO: 4719 - DNA, 156 bp, Artificial Sequence; identical to SEQ ID NO: 4718
  Synthetic polynucleotide

SEQ ID NO: 4720 - DNA, 186 bp, Artificial Sequence
  Synthetic polynucleotide
atcatctcaccttgcctcctgtcgccatccactggtctcctgcaggcaagtgtcacgtgttacttgagacaagtgtcacgtgttacttgtcgcaagtgtcacgtgttacttggaccaagtgtcacgtgttacttgctacaagtgtcacgtgttacttgactggcgcgccatgcttcatcagactct

SEQ ID NO: 4721 - DNA, 186 bp, Artificial Sequence; identical to SEQ ID NO: 4720
  Synthetic polynucleotide

SEQ ID NO: 4722 - DNA, 180 bp, Artificial Sequence
  Synthetic polynucleotide
atcatctcaccttgcctcctgggtcaggaacattatggcctgcagggcgcctgcgcaagagcgcctgcgcatcggcgcctgcgcagacgcgcctgcgcactagcgcctgcgcaactgcgcctgcgcatgcgcgcctgcgcagtagcgcctgcgcaggcgcgccatgcttcatcagactct

SEQ ID NO: 4723 - DNA, 180 bp, Artificial Sequence; identical to SEQ ID NO: 4722
  Synthetic polynucleotide

SEQ ID NO: 4724 - DNA, 196 bp, Artificial Sequence
  Synthetic polynucleotide
atcatctcaccttgcctcctggtcagcttaaccacaggcctgcagggaatgagtcagcaagagaatgagtcagcatcggaatgagtcagcagacgaatgagtcagcactagaatgagtcagcaactgaatgagtcagcatgcgaatgagtcagcagtagaatgagtcagcaggcgcgccatgcttcatcagactct

SEQ ID NO: 4725 - DNA, 196 bp, Artificial Sequence; identical to SEQ ID NO: 4724
  Synthetic polynucleotide

SEQ ID NO: 4726 - DNA, 172 bp, Artificial Sequence
  Synthetic polynucleotide
atcatctcaccttgcctcctgggagtcgcttccttatccctgcaggtcgcctcaggagatcgcctcaggtcgtcgcctcagggactcgcctcaggctatcgcctcaggacttcgcctcaggtgctcgcctcagggtatcgcctcaggggcgcgccatgcttcatcagactct

SEQ ID NO: 4727 - DNA, 172 bp, Artificial Sequence; identical to SEQ ID NO: 4726
  Synthetic polynucleotide

SEQ ID NO: 4728 - DNA, 172 bp, Artificial Sequence
  Synthetic polynucleotide
atcatctcaccttgcctcctgtcagagcgttaattccgcctgcagggctaattgctagagctaattgcttcggctaattgctgacgctaattgctctagctaattgctactgctaattgcttgcgctaattgctgtagctaattgctggcgcgccatgcttcatcagactct

SEQ ID NO: 4729 - DNA, 172 bp, Artificial Sequence; identical to SEQ ID NO: 4728
  Synthetic polynucleotide

SEQ ID NO: 4730 - DNA, 156 bp, Artificial Sequence
  Synthetic polynucleotide
atcatctcaccttgcctcctggagcgcacacctactagcctgcaggtttaattaagatttaattatcgtttaattagactttaattactatttaattaacttttaattatgctttaattagtatttaattaggcgcgccatgcttcatcagactct

SEQ ID NO: 4731 - DNA, 156 bp, Artificial Sequence; identical to SEQ ID NO: 4730
  Synthetic polynucleotide

SEQ ID NO: 4732 - DNA, 180 bp, Artificial Sequence
  Synthetic polynucleotide
atcatctcaccttgcctcctgcgagcgcacggatttctcctgcaggtgacccacataagatgacccacatatcgtgacccacatagactgacccacatactatgacccacataacttgacccacatatgctgacccacatagtatgacccacataggcgcgccatgcttcatcagactct

SEQ ID NO: 4733 - DNA, 180 bp, Artificial Sequence; identical to SEQ ID NO: 4732
  Synthetic polynucleotide

SEQ ID NO: 4734 - DNA, 172 bp, Artificial Sequence
  Synthetic polynucleotide
atcatctcaccttgcctcctgattgataacgggcatttcctgcagggttaattactagagttaattacttcggttaattactgacgttaattactctagttaattactactgttaattacttgcgttaattactgtagttaattactggcgcgccatgcttcatcagactct

SEQ ID NO: 4735 - DNA, 172 bp, Artificial Sequence; identical to SEQ ID NO: 4734
  Synthetic polynucleotide

SEQ ID NO: 4736 - DNA, 156 bp, Artificial Sequence
  Synthetic polynucleotide
atcatctcaccttgcctcctgaaggacgccagttgggacctgcaggtcacgtgaagatcacgtgatcgtcacgtgagactcacgtgactatcacgtgaacttcacgtgatgctcacgtgagtatcacgtgaggcgcgccatgcttcatcagactct

SEQ ID NO: 4737 - DNA, 156 bp, Artificial Sequence; identical to SEQ ID NO: 4736
  Synthetic polynucleotide

SEQ ID NO: 4738 - DNA, 172 bp, Artificial Sequence
  Synthetic polynucleotide
atcatctcaccttgcctcctgtatccaccgcagcagaccctgcagggccacgtgcgagagccacgtgcgtcggccacgtgcggacgccacgtgcgctagccacgtgcgactgccacgtgcgtgcgccacgtgcggtagccacgtgcgggcgcgccatgcttcatcagactct

SEQ ID NO: 4739 - DNA, 172 bp, Artificial Sequence; identical to SEQ ID NO: 4738
  Synthetic polynucleotide

SEQ ID NO: 4740 - DNA, 156 bp, Artificial Sequence
  Synthetic polynucleotide
atcatctcaccttgcctcctgggtcaataagagcatgtcctgcaggtcacgtgcagatcacgtgctcgtcacgtgcgactcacgtgcctatcacgtgcacttcacgtgctgctcacgtgcgtatcacgtgcggcgcgccatgcttcatcagactct

SEQ ID NO: 4741 - DNA, 156 bp, Artificial Sequence; identical to SEQ ID NO: 4740
  Synthetic polynucleotide

SEQ ID NO: 4742 - DNA, 188 bp, Artificial Sequence
  Synthetic polynucleotide
atcatctcaccttgcctcctgagatttgtactgcgtaacctgcaggcgccccctggtgagacgccccctggtgtcgcgccccctggtggaccgccccctggtgctacgccccctggtgactcgccccctggtgtgccgccccctggtggtacgccccctggtgggcgcgccatgcttcatcagactct

SEQ ID NO: 4743 - DNA, 188 bp, Artificial Sequence; identical to SEQ ID NO: 4742
  Synthetic polynucleotide

SEQ ID NO: 4744 - DNA, 197 bp, Artificial Sequence
  Synthetic polynucleotide
atcatctcaccttgcctcctgaacgctcgcaatttgatcctgcaggtccgctccgggttttagatccgctccgggtttttcgtccgctccgggttttgactccgctccgggttttctatccgctccgggttttacttccgctccgggtttttgctccgctccgggttttgtaggcgcgccatgcttcatcagactct

SEQ ID NO: 4745 - DNA, 197 bp, Artificial Sequence; identical to SEQ ID NO: 4744
  Synthetic polynucleotide

SEQ ID NO: 4746 - DNA, 172 bp, Artificial Sequence
  Synthetic polynucleotide
atcatctcaccttgcctcctgtgactcggaaggagaagcctgcaggagaggaagtgagaagaggaagtgtcgagaggaagtggacagaggaagtgctaagaggaagtgactagaggaagtgtgcagaggaagtggtaagaggaagtgggcgcgccatgcttcatcagactct

SEQ ID NO: 4747 - DNA, 172 bp, Artificial Sequence; identical to SEQ ID NO: 4746
  Synthetic polynucleotide

SEQ ID NO: 4748 - DNA, 185 bp, Artificial Sequence
  Synthetic polynucleotide
atcatctcaccttgcctcctggaagaggcgaaacacctcctgcaggggaacaggatgttcttagaggaacaggatgttctttcgggaacaggatgttcttgacggaacaggatgttcttctaggaacaggatgttcttactggaacaggatgttctttgcggcgcgccatgcttcatcagactct

SEQ ID NO: 4749 - DNA, 185 bp, Artificial Sequence; identical to SEQ ID NO: 4748
  Synthetic polynucleotide

SEQ ID NO: 4750 - DNA, 197 bp, Artificial Sequence
  Synthetic polynucleotide
atcatctcaccttgcctcctgagtaattaaacactcggcctgcagggaccgtttaacggttagagaccgtttaacggtttcggaccgtttaacggttgacgaccgtttaacggttctagaccgtttaacggttactgaccgtttaacggtttgcgaccgtttaacggttgtaggcgcgccatgcttcatcagactct

SEQ ID NO: 4751 - DNA, 197 bp, Artificial Sequence; identical to SEQ ID NO: 4750
  Synthetic polynucleotide

SEQ ID NO: 4752 - DNA, 172 bp, Artificial Sequence
  Synthetic polynucleotide
atcatctcaccttgcctcctggggtccaaccctgaaagcctgcagggttaattaacagagttaattaactcggttaattaacgacgttaattaacctagttaattaacactgttaattaactgcgttaattaacgtagttaattaacggcgcgccatgcttcatcagactct

SEQ ID NO: 4753 - DNA, 172 bp, Artificial Sequence; identical to SEQ ID NO: 4752
  Synthetic polynucleotide

SEQ ID NO: 4754 - DNA, 191 bp, Artificial Sequence
  Synthetic polynucleotide
atcatctcaccttgcctcctggaaatgaaccatacgcacctgcagggaccatataaggcaactagagaccatataaggcaacttcggaccatataaggcaactgacgaccatataaggcaactctagaccatataaggcaactactgaccatataaggcaacttgcggcgcgccatgcttcatcagactct

SEQ ID NO: 4755 - DNA, 191 bp, Artificial Sequence; identical to SEQ ID NO: 4754
  Synthetic polynucleotide

SEQ ID NO: 4756 - DNA, 164 bp, Artificial Sequence
  Synthetic polynucleotide
atcatctcaccttgcctcctgtacacgcatttgctctacctgcaggacacctgttagaacacctgtttcgacacctgttgacacacctgttctaacacctgttactacacctgtttgcacacctgttgtaacacctgttggcgcgccatgcttcatcagactct

SEQ ID NO: 4757 - DNA, 164 bp, Artificial Sequence; identical to SEQ ID NO: 4756
  Synthetic polynucleotide

SEQ ID NO: 4758 - DNA, 172 bp, Artificial Sequence
  Synthetic polynucleotide
atcatctcaccttgcctcctgttgcgatgccatttcgtcctgcaggagcgtgaccgagaagcgtgaccgtcgagcgtgaccggacagcgtgaccgctaagcgtgaccgactagcgtgaccgtgcagcgtgaccggtaagcgtgaccgggcgcgccatgcttcatcagactct

SEQ ID NO: 4759 - DNA, 172 bp, Artificial Sequence; identical to SEQ ID NO: 4758
  Synthetic polynucleotide

SEQ ID NO: 4760 - DNA, 172 bp, Artificial Sequence
  Synthetic polynucleotide
atcatctcaccttgcctcctgatgacaacggcattatccctgcaggtacttccggtagatacttccggttcgtacttccggtgactacttccggtctatacttccggtacttacttccggttgctacttccggtgtatacttccggtggcgcgccatgcttcatcagactct

SEQ ID NO: 4761 - DNA, 172 bp, Artificial Sequence; identical to SEQ ID NO: 4760
  Synthetic polynucleotide

SEQ ID NO: 4762 - DNA, 180 bp, Artificial Sequence
  Synthetic polynucleotide
atcatctcaccttgcctcctggtgttgagctgtaggttcctgcaggatgtttattttagaatgtttatttttcgatgtttattttgacatgtttattttctaatgtttattttactatgtttatttttgcatgtttattttgtaatgtttattttggcgcgccatgcttcatcagactct

SEQ ID NO: 4763 - DNA, 180 bp, Artificial Sequence; identical to SEQ ID NO: 4762
  Synthetic polynucleotide

SEQ ID NO: 4764 - DNA, 172 bp, Artificial Sequence
  Synthetic polynucleotide
atcatctcaccttgcctcctgcgtatcgccagtctgagcctgcaggattacgtaacagaattacgtaactcgattacgtaacgacattacgtaacctaattacgtaacactattacgtaactgcattacgtaacgtaattacgtaacggcgcgccatgcttcatcagactct

SEQ ID NO: 4765 - DNA, 172 bp, Artificial Sequence; identical to SEQ ID NO: 4764
  Synthetic polynucleotide

SEQ ID NO: 4766 - DNA, 140 bp, Artificial Sequence
  Synthetic polynucleotide
atcatctcaccttgcctcctgacctcaggaactgatgccctgcaggctttgtagactttgttcgctttgtgacctttgtctactttgtactctttgttgcctttgtgtactttgtggcgcgccatgcttcatcagactct

SEQ ID NO: 4767 - DNA, 140 bp, Artificial Sequence; identical to SEQ ID NO: 4766
  Synthetic polynucleotide

SEQ ID NO: 4768 - DNA, 156 bp, Artificial Sequence
  Synthetic polynucleotide
atcatctcaccttgcctcctgctgttgggctttcgaggcctgcaggtataaataagatataaatatcgtataaatagactataaatactatataaataacttataaatatgctataaatagtatataaataggcgcgccatgcttcatcagactct

SEQ ID NO: 4769 - DNA, 156 bp, Artificial Sequence; identical to SEQ ID NO: 4768
  Synthetic polynucleotide

SEQ ID NO: 4770 - DNA, 180 bp, Artificial Sequence
  Synthetic polynucleotide
atcatctcaccttgcctcctgatctgttcggttatagccctgcaggtgcctcaggctagatgcctcaggcttcgtgcctcaggctgactgcctcaggctctatgcctcaggctacttgcctcaggcttgctgcctcaggctgtatgcctcaggctggcgcgccatgcttcatcagactct

SEQ ID NO: 4771 - DNA, 180 bp, Artificial Sequence; identical to SEQ ID NO: 4770
  Synthetic polynucleotide

SEQ ID NO: 4772 - DNA, 200 bp, Artificial Sequence
  Synthetic polynucleotide
atcatctcaccttgcctcctggcttgttgcgcttctcccctgcaggttgccttatttggccatggagattgccttatttggccatggtcgttgccttatttggccatgggacttgccttatttggccatggctattgccttatttggccatggactttgccttatttggccatggggcgcgccatgcttcatcagactct

SEQ ID NO: 4773 - DNA, 200 bp, Artificial Sequence; identical to SEQ ID NO: 4772
  Synthetic polynucleotide

SEQ ID NO: 4774 - DNA, 197 bp, Artificial Sequence
  Synthetic polynucleotide
atcatctcaccttgcctcctgaccgccctactacatgccctgcaggttttcagtgtgtgcaagattttcagtgtgtgcatcgttttcagtgtgtgcagacttttcagtgtgtgcactattttcagtgtgtgcaactttttcagtgtgtgcatgcttttcagtgtgtgcagtaggcgcgccatgcttcatcagactct

SEQ ID NO: 4775 - DNA, 197 bp, Artificial Sequence; identical to SEQ ID NO: 4774
  Synthetic polynucleotide

SEQ ID NO: 4776 - DNA, 164 bp, Artificial Sequence
  Synthetic polynucleotide
atcatctcaccttgcctcctgatcaaattaacgccacacctgcaggaaccggttaagaaaccggttatcgaaccggttagacaaccggttactaaaccggttaactaaccggttatgcaaccggttagtaaaccggttaggcgcgccatgcttcatcagactct

SEQ ID NO: 4777 - DNA, 164 bp, Artificial Sequence; identical to SEQ ID NO: 4776
  Synthetic polynucleotide

SEQ ID NO: 4778 - DNA, 180 bp, Artificial Sequence
  Synthetic polynucleotide
atcatctcaccttgcctcctgattggtttaagcaaccgcctgcaggagccaatcagcagaagccaatcagctcgagccaatcagcgacagccaatcagcctaagccaatcagcactagccaatcagctgcagccaatcagcgtaagccaatcagcggcgcgccatgcttcatcagactct

SEQ ID NO: 4779 - DNA, 180 bp, Artificial Sequence; identical to SEQ ID NO: 4778
  Synthetic polynucleotide

SEQ ID NO: 4780 - DNA, 140 bp, Artificial Sequence
  Synthetic polynucleotide
atcatctcaccttgcctcctgcatagcagatccagcttcctgcaggctttgaagactttgatcgctttgagacctttgactactttgaactctttgatgcctttgagtactttgaggcgcgccatgcttcatcagactct

SEQ ID NO: 4781 - DNA, 140 bp, Artificial Sequence; identical to SEQ ID NO: 4780
  Synthetic polynucleotide

SEQ ID NO: 4782 - DNA, 188 bp, Artificial Sequence
  Synthetic polynucleotide
atcatctcaccttgcctcctgtacgggtcgcgctgattcctgcaggtgccacgtggcaagatgccacgtggcatcgtgccacgtggcagactgccacgtggcactatgccacgtggcaacttgccacgtggcatgctgccacgtggcagtatgccacgtggcaggcgcgccatgcttcatcagactct

SEQ ID NO: 4783 - DNA, 188 bp, Artificial Sequence; identical to SEQ ID NO: 4782
  Synthetic polynucleotide

SEQ ID NO: 4784 - DNA, 164 bp, Artificial Sequence
  Synthetic polynucleotide
atcatctcaccttgcctcctgggctaagtggttatgtccctgcaggacacctgtcagaacacctgtctcgacacctgtcgacacacctgtcctaacacctgtcactacacctgtctgcacacctgtcgtaacacctgtcggcgcgccatgcttcatcagactct

SEQ ID NO: 4785 - DNA, 164 bp, Artificial Sequence; identical to SEQ ID NO: 4784
  Synthetic polynucleotide

SEQ ID NO: 4786 - DNA, 156 bp, Artificial Sequence
  Synthetic polynucleotide
atcatctcaccttgcctcctggctggaacttagttcgacctgcaggcttccggtagacttccggttcgcttccggtgaccttccggtctacttccggtactcttccggttgccttccggtgtacttccggtggcgcgccatgcttcatcagactct

SEQ ID NO: 4787 - DNA, 156 bp, Artificial Sequence; identical to SEQ ID NO: 4786
  Synthetic polynucleotide

SEQ ID NO: 4788 - DNA, 190 bp, Artificial Sequence
  Synthetic polynucleotide
atcatctcaccttgcctcctgtattcgaaccgcattctcctgcaggcacatgcgggtattagacacatgcgggtatttcgcacatgcgggtattgaccacatgcgggtattctacacatgcgggtattactcacatgcgggtatttgccacatgcgggtattgtaggcgcgccatgcttcatcagactct

SEQ ID NO: 4789 - DNA, 190 bp, Artificial Sequence; identical to SEQ ID NO: 4788
  Synthetic polynucleotide

SEQ ID NO: 4790 - DNA, 156 bp, Artificial Sequence
  Synthetic polynucleotide
atcatctcaccttgcctcctgtgattgtcacagtgagacctgcagggatacattagagatacatttcggatacattgacgatacattctagatacattactgatacatttgcgatacattgtagatacattggcgcgccatgcttcatcagactct

SEQ ID NO: 4791 - DNA, 156 bp, Artificial Sequence; identical to SEQ ID NO: 4790
  Synthetic polynucleotide

SEQ ID NO: 4792 - DNA, 172 bp, Artificial Sequence
  Synthetic polynucleotide
atcatctcaccttgcctcctgccgcatgtgacgttgaacctgcaggaacacgtgttagaaacacgtgtttcgaacacgtgttgacaacacgtgttctaaacacgtgttactaacacgtgtttgcaacacgtgttgtaaacacgtgttggcgcgccatgcttcatcagactct

SEQ ID NO: 4793 - DNA, 172 bp, Artificial Sequence; identical to SEQ ID NO: 4792
  Synthetic polynucleotide

SEQ ID NO: 4794 - DNA, 190 bp, Artificial Sequence
  Synthetic polynucleotide
atcatctcaccttgcctcctgtgtcgcggataaggagccctgcaggttattagtacataaagattattagtacataatcgttattagtacataagacttattagtacataactattattagtacataaactttattagtacataatgcttattagtacataagtaggcgcgccatgcttcatcagactct

SEQ ID NO: 4795 - DNA, 190 bp, Artificial Sequence; identical to SEQ ID NO: 4794
  Synthetic polynucleotide

SEQ ID NO: 4796 - DNA, 180 bp, Artificial Sequence
  Synthetic polynucleotide
atcatctcaccttgcctcctgacctgagtgggatcaagcctgcaggtaatttatgcaagataatttatgcatcgtaatttatgcagactaatttatgcactataatttatgcaacttaatttatgcatgctaatttatgcagtataatttatgcaggcgcgccatgcttcatcagactct

SEQ ID NO: 4797 - DNA, 180 bp, Artificial Sequence; identical to SEQ ID NO: 4796
  Synthetic polynucleotide

SEQ ID NO: 4798 - DNA, 183 bp, Artificial Sequence
  Synthetic polynucleotide
atcatctcaccttgcctcctggaaggcttccgctgacacctgcaggcggggcattctgggaattgtagtccagacggggcattctgggaattgtagtcctcgcggggcattctgggaattgtagtccgaccggggcattctgggaattgtagtccctaggcgcgccatgcttcatcagactct

SEQ ID NO: 4799 - DNA, 183 bp, Artificial Sequence; identical to SEQ ID NO: 4798
  Synthetic polynucleotide

SEQ ID NO: 4800 - DNA, 172 bp, Artificial Sequence
  Synthetic polynucleotide
atcatctcaccttgcctcctgtcggtagtcacatggagcctgcaggcgaggtcagtagacgaggtcagttcgcgaggtcagtgaccgaggtcagtctacgaggtcagtactcgaggtcagttgccgaggtcagtgtacgaggtcagtggcgcgccatgcttcatcagactct

SEQ ID NO: 4801 - DNA, 172 bp, Artificial Sequence; identical to SEQ ID NO: 4800
  Synthetic polynucleotide

SEQ ID NO: 4802 - DNA, 172 bp, Artificial Sequence
  Synthetic polynucleotide
atcatctcaccttgcctcctgcctctatacaccactaccctgcagggccaccaggtagagccaccaggttcggccaccaggtgacgccaccaggtctagccaccaggtactgccaccaggttgcgccaccaggtgtagccaccaggtggcgcgccatgcttcatcagactct

SEQ ID NO: 4803 - DNA, 172 bp, Artificial Sequence; identical to SEQ ID NO: 4802
  Synthetic polynucleotide

SEQ ID NO: 4804 - DNA, 196 bp, Artificial Sequence
  Synthetic polynucleotide
atcatctcaccttgcctcctgcatcctcatagtgttagcctgcaggtgcccacgtggtgagatgcccacgtggtgtcgtgcccacgtggtggactgcccacgtggtgctatgcccacgtggtgacttgcccacgtggtgtgctgcccacgtggtggtatgcccacgtggtgggcgcgccatgcttcatcagactct

SEQ ID NO: 4805 - DNA, 196 bp, Artificial Sequence; identical to SEQ ID NO: 4804
  Synthetic polynucleotide

SEQ ID NO: 4806 - DNA, 188 bp, Artificial Sequence
  Synthetic polynucleotide
atcatctcaccttgcctcctgggtagagatagttagtgcctgcaggtttggcgggaaaagatttggcgggaaatcgtttggcgggaaagactttggcgggaaactatttggcgggaaaacttttggcgggaaatgctttggcgggaaagtatttggcgggaaaggcgcgccatgcttcatcagactct

SEQ ID NO: 4807 - DNA, 188 bp, Artificial Sequence; identical to SEQ ID NO: 4806
  Synthetic polynucleotide

SEQ ID NO: 4808 - DNA, 172 bp, Artificial Sequence
  Synthetic polynucleotide
atcatctcaccttgcctcctgtgtgatgaaatcacggacctgcaggcacctgctccagacacctgctcctcgcacctgctccgaccacctgctccctacacctgctccactcacctgctcctgccacctgctccgtacacctgctccggcgcgccatgcttcatcagactct

SEQ ID NO: 4809 - DNA, 172 bp, Artificial Sequence; identical to SEQ ID NO: 4808
  Synthetic polynucleotide

SEQ ID NO: 4810 - DNA, 148 bp, Artificial Sequence
  Synthetic polynucleotide
atcatctcaccttgcctcctgtccgcgtacgcattaggcctgcaggagaacagagaagaacagtcgagaacaggacagaacagctaagaacagactagaacagtgcagaacaggtaagaacagggcgcgccatgcttcatcagactct

SEQ ID NO: 4811 - DNA, 148 bp, Artificial Sequence; identical to SEQ ID NO: 4810
  Synthetic polynucleotide

SEQ ID NO: 4812 - DNA, 188 bp, Artificial Sequence
  Synthetic polynucleotide
atcatctcaccttgcctcctgatgtacctttgaggttccctgcaggaattgcgtcactagaaattgcgtcacttcgaattgcgtcactgacaattgcgtcactctaaattgcgtcactactaattgcgtcacttgcaattgcgtcactgtaaattgcgtcactggcgcgccatgcttcatcagactct

SEQ ID NO: 4813 - DNA, 188 bp, Artificial Sequence; identical to SEQ ID NO: 4812
  Synthetic polynucleotide

SEQ ID NO: 4814 - DNA, 191 bp, Artificial Sequence
  Synthetic polynucleotide
atcatctcaccttgcctcctgtaggatacggtcatcttcctgcaggaatagggtatcaattatagaaatagggtatcaattattcgaatagggtatcaattatgacaatagggtatcaattatctaaatagggtatcaattatactaatagggtatcaattattgcggcgcgccatgcttcatcagactct

SEQ ID NO: 4815 - DNA, 191 bp, Artificial Sequence; identical to SEQ ID NO: 4814
  Synthetic polynucleotide

SEQ ID NO: 4816 - DNA, 172 bp, Artificial Sequence
  Synthetic polynucleotide
atcatctcaccttgcctcctgcctctaagcctttaacgcctgcagggcccgggggcagagcccgggggctcggcccgggggcgacgcccgggggcctagcccgggggcactgcccgggggctgcgcccgggggcgtagcccgggggcggcgcgccatgcttcatcagactct

SEQ ID NO: 4817 - DNA, 172 bp, Artificial Sequence; identical to SEQ ID NO: 4816
  Synthetic polynucleotide

SEQ ID NO: 4818 - DNA, 172 bp, Artificial Sequence
  Synthetic polynucleotide
atcatctcaccttgcctcctggcaattccgtaatatctcctgcaggattacgtaatagaattacgtaattcgattacgtaatgacattacgtaatctaattacgtaatactattacgtaattgcattacgtaatgtaattacgtaatggcgcgccatgcttcatcagactct

SEQ ID NO: 4819 - DNA, 172 bp, Artificial Sequence; identical to SEQ ID NO: 4818
  Synthetic polynucleotide

SEQ ID NO: 4820 - DNA, 197 bp, Artificial Sequence
  Synthetic polynucleotide
atcatctcaccttgcctcctgggcgatttgcccatgcacctgcaggatttttggggggcttagaatttttggggggctttcgatttttggggggcttgacatttttggggggcttctaatttttggggggcttactatttttggggggctttgcatttttggggggcttgtaggcgcgccatgcttcatcagactct

SEQ ID NO: 4821 - DNA, 197 bp, Artificial Sequence; identical to SEQ ID NO: 4820
  Synthetic polynucleotide

SEQ ID NO: 4822 - DNA, 191 bp, Artificial Sequence
  Synthetic polynucleotide
atcatctcaccttgcctcctgttctttgagaagaatgccctgcaggggcgctctccgtggtgctgaaagaggcgctctccgtggtgctgaatcgggcgctctccgtggtgctgaagacggcgctctccgtggtgctgaactaggcgctctccgtggtgctgaaactggcgcgccatgcttcatcagactct

SEQ ID NO: 4823 - DNA, 191 bp, Artificial Sequence; identical to SEQ ID NO: 4822
  Synthetic polynucleotide

SEQ ID NO: 4824 - DNA, 188 bp, Artificial Sequence
  Synthetic polynucleotide
atcatctcaccttgcctcctgccctaatagagtcccggcctgcaggtgggaaatccccagatgggaaatcccctcgtgggaaatccccgactgggaaatccccctatgggaaatccccacttgggaaatcccctgctgggaaatccccgtatgggaaatccccggcgcgccatgcttcatcagactct

SEQ ID NO: 4825 - DNA, 188 bp, Artificial Sequence; identical to SEQ ID NO: 4824
  Synthetic polynucleotide

SEQ ID NO: 4826 - DNA, 172 bp, Artificial Sequence
  Synthetic polynucleotide
atcatctcaccttgcctcctgatactaagcctataagccctgcaggtactaattagagatactaattagtcgtactaattaggactactaattagctatactaattagacttactaattagtgctactaattaggtatactaattagggcgcgccatgcttcatcagactct

SEQ ID NO: 4827 - DNA, 172 bp, Artificial Sequence; identical to SEQ ID NO: 4826
  Synthetic polynucleotide

SEQ ID NO: 4828 - DNA, 191 bp, Artificial Sequence
  Synthetic polynucleotide
atcatctcaccttgcctcctgcaccatcacgctctgagcctgcaggtccaactaattagctcaagatccaactaattagctcatcgtccaactaattagctcagactccaactaattagctcactatccaactaattagctcaacttccaactaattagctcatgcggcgcgccatgcttcatcagactct

SEQ ID NO: 4829 - DNA, 191 bp, Artificial Sequence; identical to SEQ ID NO: 4828
  Synthetic polynucleotide

SEQ ID NO: 4830 - DNA, 191 bp, Artificial Sequence
  Synthetic polynucleotide
atcatctcaccttgcctcctgacgcgagaattacgtgacctgcaggaatcgttaatccctttaagaaatcgttaatccctttatcgaatcgttaatccctttagacaatcgttaatccctttactaaatcgttaatccctttaactaatcgttaatccctttatgcggcgcgccatgcttcatcagactct

SEQ ID NO: 4831 - DNA, 191 bp, Artificial Sequence; identical to SEQ ID NO: 4830
  Synthetic polynucleotide

SEQ ID NO: 4832 - DNA, 185 bp, Artificial Sequence
  Synthetic polynucleotide
atcatctcaccttgcctcctgcggttagggcctaaacgcctgcaggactatgccaacctaccagaactatgccaacctacctcgactatgccaacctaccgacactatgccaacctaccctaactatgccaacctaccactactatgccaacctacctgcggcgcgccatgcttcatcagactct

SEQ ID NO: 4833 - DNA, 185 bp, Artificial Sequence; identical to SEQ ID NO: 4832
  Synthetic polynucleotide

SEQ ID NO: 4834 - DNA, 164 bp, Artificial Sequence
  Synthetic polynucleotide
atcatctcaccttgcctcctgcaacccaggattgtctacctgcagggaccccccaagagaccccccatcggaccccccagacgaccccccactagaccccccaactgaccccccatgcgaccccccagtagaccccccaggcgcgccatgcttcatcagactct

SEQ ID NO: 4835 - DNA, 164 bp, Artificial Sequence; identical to SEQ ID NO: 4834
  Synthetic polynucleotide

SEQ ID NO: 4836 - DNA, 197 bp, Artificial Sequence
  Synthetic polynucleotide
atcatctcaccttgcctcctgtaggtcatactgggctccctgcaggcgcggccacgtgaccagacgcggccacgtgacctcgcgcggccacgtgaccgaccgcggccacgtgaccctacgcggccacgtgaccactcgcggccacgtgacctgccgcggccacgtgaccgtaggcgcgccatgcttcatcagactct

SEQ ID NO: 4837 - DNA, 197 bp, Artificial Sequence; identical to SEQ ID NO: 4836
  Synthetic polynucleotide

SEQ ID NO: 4838 - DNA, 188 bp, Artificial Sequence
  Synthetic polynucleotide
atcatctcaccttgcctcctgtcagcggctaaacgtagcctgcagggcacaggtgcagagagcacaggtgcagtcggcacaggtgcaggacgcacaggtgcagctagcacaggtgcagactgcacaggtgcagtgcgcacaggtgcaggtagcacaggtgcagggcgcgccatgcttcatcagactct

SEQ ID NO: 4839 - DNA, 188 bp, Artificial Sequence; identical to SEQ ID NO: 4838
  Synthetic polynucleotide

SEQ ID NO: 4840 - DNA, 172 bp, Artificial Sequence
  Synthetic polynucleotide
atcatctcaccttgcctcctgatattcaggaatttgcgcctgcagggctaattggtagagctaattggttcggctaattggtgacgctaattggtctagctaattggtactgctaattggttgcgctaattggtgtagctaattggtggcgcgccatgcttcatcagactct

SEQ ID NO: 4841 - DNA, 172 bp, Artificial Sequence; identical to SEQ ID NO: 4840
  Synthetic polynucleotide

SEQ ID NO: 4842 - DNA, 197 bp, Artificial Sequence
  Synthetic polynucleotide
atcatctcaccttgcctcctgctacaatagacgggaagcctgcaggggtcaacaggtggttagaggtcaacaggtggtttcgggtcaacaggtggttgacggtcaacaggtggttctaggtcaacaggtggttactggtcaacaggtggtttgcggtcaacaggtggttgtaggcgcgccatgcttcatcagactct

SEQ ID NO: 4843 - DNA, 197 bp, Artificial Sequence; identical to SEQ ID NO: 4842
  Synthetic polynucleotide

SEQ ID NO: 4844 - DNA, 188 bp, Artificial Sequence
  Synthetic polynucleotide
atcatctcaccttgcctcctgtaggacaccattaaccccctgcagggcgcatgcgcagagagcgcatgcgcagtcggcgcatgcgcaggacgcgcatgcgcagctagcgcatgcgcagactgcgcatgcgcagtgcgcgcatgcgcaggtagcgcatgcgcagggcgcgccatgcttcatcagactct

SEQ ID NO: 4845 - DNA, 188 bp, Artificial Sequence; identical to SEQ ID NO: 4844
  Synthetic polynucleotide

SEQ ID NO: 4846 - DNA, 197 bp, Artificial Sequence
  Synthetic polynucleotide
atcatctcaccttgcctcctgggacaatcgacgattaccctgcaggggcgcagctggtgccagaggcgcagctggtgcctcgggcgcagctggtgccgacggcgcagctggtgccctaggcgcagctggtgccactggcgcagctggtgcctgcggcgcagctggtgccgtaggcgcgccatgcttcatcagactct

SEQ ID NO: 4847 - DNA, 197 bp, Artificial Sequence; identical to SEQ ID NO: 4846
  Synthetic polynucleotide

SEQ ID NO: 4848 - DNA, 140 bp, Artificial Sequence
  Synthetic polynucleotide
atcatctcaccttgcctcctgtcagcgaaacacacaggcctgcaggataacaagaataacatcgataacagacataacactaataacaactataacatgcataacagtaataacaggcgcgccatgcttcatcagactct

SEQ ID NO: 4849 - DNA, 140 bp, Artificial Sequence; identical to SEQ ID NO: 4848
  Synthetic polynucleotide

SEQ ID NO: 4850 - DNA, 190 bp, Artificial Sequence
  Synthetic polynucleotide
atcatctcaccttgcctcctgaaccagtcgtagacttccctgcaggcaccagggggcagcagacaccagggggcagctcgcaccagggggcagcgaccaccagggggcagcctacaccagggggcagcactcaccagggggcagctgccaccagggggcagcgtaggcgcgccatgcttcatcagactct

SEQ ID NO: 4851 - DNA, 190 bp, Artificial Sequence; identical to SEQ ID NO: 4850
  Synthetic polynucleotide

SEQ ID NO: 4852 - DNA, 172 bp, Artificial Sequence
  Synthetic polynucleotide
atcatctcaccttgcctcctggcggagaacctctaagccctgcagggctaattggcagagctaattggctcggctaattggcgacgctaattggcctagctaattggcactgctaattggctgcgctaattggcgtagctaattggcggcgcgccatgcttcatcagactct

SEQ ID NO: 4853 - DNA, 172 bp, Artificial Sequence; identical to SEQ ID NO: 4852
  Synthetic polynucleotide

SEQ ID NO: 4854 - DNA, 172 bp, Artificial Sequence
  Synthetic polynucleotide
atcatctcaccttgcctcctgttccttgatggactgtacctgcagggctaattgggagagctaattgggtcggctaattggggacgctaattgggctagctaattgggactgctaattgggtgcgctaattggggtagctaattgggggcgcgccatgcttcatcagactct

SEQ ID NO: 4855 - DNA, 172 bp, Artificial Sequence; identical to SEQ ID NO: 4854
  Synthetic polynucleotide

SEQ ID NO: 4856 - DNA, 148 bp, Artificial Sequence
  Synthetic polynucleotide
atcatctcaccttgcctcctgcctagcggacttactggcctgcaggcaagcttagacaagctttcgcaagcttgaccaagcttctacaagcttactcaagctttgccaagcttgtacaagcttggcgcgccatgcttcatcagactct

SEQ ID NO: 4857 - DNA, 148 bp, Artificial Sequence; identical to SEQ ID NO: 4856
  Synthetic polynucleotide

SEQ ID NO: 4858 - DNA, 172 bp, Artificial Sequence
  Synthetic polynucleotide
atcatctcaccttgcctcctgtgtttatggcccactaccctgcaggaaatcccctcagaaaatcccctctcgaaatcccctcgacaaatcccctcctaaaatcccctcactaaatcccctctgcaaatcccctcgtaaaatcccctcggcgcgccatgcttcatcagactct

SEQ ID NO: 4859 - DNA, 172 bp, Artificial Sequence; identical to SEQ ID NO: 4858
  Synthetic polynucleotide

SEQ ID NO: 4860 - DNA, 164 bp, Artificial Sequence
  Synthetic polynucleotide
atcatctcaccttgcctcctgcgaggactctaggaatgcctgcagggggggccctagagggggcccttcggggggccctgacgggggccctctagggggccctactgggggcccttgcgggggccctgtagggggccctggcgcgccatgcttcatcagactct

SEQ ID NO: 4861 - DNA, 164 bp, Artificial Sequence; identical to SEQ ID NO: 4860
  Synthetic polynucleotide

SEQ ID NO: 4862 - DNA, 172 bp, Artificial Sequence
  Synthetic polynucleotide
atcatctcaccttgcctcctgctgttgtagagagaattcctgcaggacctgtcaatagaacctgtcaattcgacctgtcaatgacacctgtcaatctaacctgtcaatactacctgtcaattgcacctgtcaatgtaacctgtcaatggcgcgccatgcttcatcagactct

SEQ ID NO: 4863 - DNA, 172 bp, Artificial Sequence; identical to SEQ ID NO: 4862
  Synthetic polynucleotide

SEQ ID NO: 4864 - DNA, 172 bp, Artificial Sequence
  Synthetic polynucleotide
atcatctcaccttgcctcctgccttagtgattaccgatcctgcagggccacgtggcagagccacgtggctcggccacgtggcgacgccacgtggcctagccacgtggcactgccacgtggctgcgccacgtggcgtagccacgtggcggcgcgccatgcttcatcagactct

SEQ ID NO: 4865 - DNA, 172 bp, Artificial Sequence; identical to SEQ ID NO: 4864
  Synthetic polynucleotide

SEQ ID NO: 4866 - DNA, 164 bp, Artificial Sequence
  Synthetic polynucleotide
atcatctcaccttgcctcctgcttcagtacttcacagtcctgcaggtttcaagtgagatttcaagtgtcgtttcaagtggactttcaagtgctatttcaagtgacttttcaagtgtgctttcaagtggtatttcaagtgggcgcgccatgcttcatcagactct

SEQ ID NO: 4867 - DNA, 164 bp, Artificial Sequence; identical to SEQ ID NO: 4866
  Synthetic polynucleotide

SEQ ID NO: 4868 - DNA, 164 bp, Artificial Sequence
  Synthetic polynucleotide
atcatctcaccttgcctcctgcagctgaccgcttagctcctgcaggaaattcctgagaaaattcctgtcgaaattcctggacaaattcctgctaaaattcctgactaaattcctgtgcaaattcctggtaaaattcctgggcgcgccatgcttcatcagactct

SEQ ID NO: 4869 - DNA, 164 bp, Artificial Sequence; identical to SEQ ID NO: 4868
  Synthetic polynucleotide

SEQ ID NO: 4870 - DNA, 172 bp, Artificial Sequence
  Synthetic polynucleotide
atcatctcaccttgcctcctgattaacgtgcgcttcaccctgcaggtatgcaaattagatatgcaaatttcgtatgcaaattgactatgcaaattctatatgcaaattacttatgcaaatttgctatgcaaattgtatatgcaaattggcgcgccatgcttcatcagactct

SEQ ID NO: 4871 - DNA, 172 bp, Artificial Sequence; identical to SEQ ID NO: 4870
  Synthetic polynucleotide

SEQ ID NO: 4872 - DNA, 196 bp, Artificial Sequence
  Synthetic polynucleotide
atcatctcaccttgcctcctgattatggcaggtcagctcctgcaggctgacctacttttagactgacctactttttcgctgacctacttttgacctgacctacttttctactgacctacttttactctgacctactttttgcctgacctacttttgtactgacctacttttggcgcgccatgcttcatcagactct

SEQ ID NO: 4873 - DNA, 196 bp, Artificial Sequence; identical to SEQ ID NO: 4872
  Synthetic polynucleotide

SEQ ID NO: 4874 - DNA, 197 bp, Artificial Sequence
  Synthetic polynucleotide
atcatctcaccttgcctcctgcagtcgcggctttactccctgcaggaaaataatcgatataagaaaaataatcgatatatcgaaaataatcgatatagacaaaataatcgatatactaaaaataatcgatataactaaaataatcgatatatgcaaaataatcgatatagtaggcgcgccatgcttcatcagactct

SEQ ID NO: 4875 - DNA, 197 bp, Artificial Sequence; identical to SEQ ID NO: 4874
  Synthetic polynucleotide

SEQ ID NO: 4876 - DNA, 191 bp, Artificial Sequence
  Synthetic polynucleotide
atcatctcaccttgcctcctgctatgcgcaaatccgtccctgcaggtgacctctgttgaccttagatgacctctgttgacctttcgtgacctctgttgaccttgactgacctctgttgaccttctatgacctctgttgaccttacttgacctctgttgacctttgcggcgcgccatgcttcatcagactct

SEQ ID NO: 4877 - DNA, 191 bp, Artificial Sequence; identical to SEQ ID NO: 4876
  Synthetic polynucleotide

SEQ ID NO: 4878 - DNA, 180 bp, Artificial Sequence
  Synthetic polynucleotide
atcatctcaccttgcctcctgatagggcgaacggcgtacctgcagggtgacaggtggagagtgacaggtggtcggtgacaggtgggacgtgacaggtggctagtgacaggtggactgtgacaggtggtgcgtgacaggtgggtagtgacaggtggggcgcgccatgcttcatcagactct

SEQ ID NO: 4879 - DNA, 180 bp, Artificial Sequence; identical to SEQ ID NO: 4878
  Synthetic polynucleotide

SEQ ID NO: 4880 - DNA, 196 bp, Artificial Sequence
  Synthetic polynucleotide
atcatctcaccttgcctcctgactgattcgttgacaagcctgcaggagaacagtctgtaagaagaacagtctgtatcgagaacagtctgtagacagaacagtctgtactaagaacagtctgtaactagaacagtctgtatgcagaacagtctgtagtaagaacagtctgtaggcgcgccatgcttcatcagactct

SEQ ID NO: 4881 - DNA, 196 bp, Artificial Sequence; identical to SEQ ID NO: 4880
  Synthetic polynucleotide

SEQ ID NO: 4882 - DNA, 156 bp, Artificial Sequence
  Synthetic polynucleotide
atcatctcaccttgcctcctgatatctcctgggtttaacctgcaggtgaactctagatgaactcttcgtgaactctgactgaactctctatgaactctacttgaactcttgctgaactctgtatgaactctggcgcgccatgcttcatcagactct

SEQ ID NO: 4883 - DNA, 156 bp, Artificial Sequence; identical to SEQ ID NO: 4882
  Synthetic polynucleotide

SEQ ID NO: 4884 - DNA, 172 bp, Artificial Sequence
  Synthetic polynucleotide
atcatctcaccttgcctcctgtaacggattacacgtgccctgcaggtatgcaaatcagatatgcaaatctcgtatgcaaatcgactatgcaaatcctatatgcaaatcacttatgcaaatctgctatgcaaatcgtatatgcaaatcggcgcgccatgcttcatcagactct

SEQ ID NO: 4885 - DNA, 172 bp, Artificial Sequence; identical to SEQ ID NO: 4884
  Synthetic polynucleotide

SEQ ID NO: 4886 - DNA, 190 bp, Artificial Sequence
  Synthetic polynucleotide
atcatctcaccttgcctcctggggtacgagctctgtatcctgcaggtttattgattttttagatttattgatttttttcgtttattgattttttgactttattgattttttctatttattgattttttacttttattgatttttttgctttattgattttttgtaggcgcgccatgcttcatcagactct

SEQ ID NO: 4887 - DNA, 190 bp, Artificial Sequence; identical to SEQ ID NO: 4886
  Synthetic polynucleotide

SEQ ID NO: 4888 - DNA, 185 bp, Artificial Sequence
  Synthetic polynucleotide
atcatctcaccttgcctcctggcagggcatttatgcaccctgcaggccattgttatgcaaatagaccattgttatgcaaattcgccattgttatgcaaatgacccattgttatgcaaatctaccattgttatgcaaatactccattgttatgcaaattgcggcgcgccatgcttcatcagactct

SEQ ID NO: 4889 - DNA, 185 bp, Artificial Sequence; identical to SEQ ID NO: 4888
  Synthetic polynucleotide

SEQ ID NO: 4890 - DNA, 191 bp, Artificial Sequence
  Synthetic polynucleotide
atcatctcaccttgcctcctgaggttgtcaagctgatacctgcagggatacctaattagcgcgagagatacctaattagcgcgtcggatacctaattagcgcggacgatacctaattagcgcgctagatacctaattagcgcgactgatacctaattagcgcgtgcggcgcgccatgcttcatcagactct

SEQ ID NO: 4891 - DNA, 191 bp, Artificial Sequence; identical to SEQ ID NO: 4890
  Synthetic polynucleotide

SEQ ID NO: 4892 - DNA, 180 bp, Artificial Sequence
  Synthetic polynucleotide
atcatctcaccttgcctcctggtacacacatacacgtacctgcaggggccacgtgctagaggccacgtgcttcgggccacgtgctgacggccacgtgctctaggccacgtgctactggccacgtgcttgcggccacgtgctgtaggccacgtgctggcgcgccatgcttcatcagactct

SEQ ID NO: 4893 - DNA, 180 bp, Artificial Sequence; identical to SEQ ID NO: 4892
  Synthetic polynucleotide

SEQ ID NO: 4894 - DNA, 172 bp, Artificial Sequence
  Synthetic polynucleotide
atcatctcaccttgcctcctgaataacgcgtgagggctcctgcaggtatgcaaataagatatgcaaatatcgtatgcaaatagactatgcaaatactatatgcaaataacttatgcaaatatgctatgcaaatagtatatgcaaataggcgcgccatgcttcatcagactct

SEQ ID NO: 4895 - DNA, 172 bp, Artificial Sequence; identical to SEQ ID NO: 4894
  Synthetic polynucleotide

SEQ ID NO: 4896 - DNA, 164 bp, Artificial Sequence
  Synthetic polynucleotide
atcatctcaccttgcctcctggggttatgcttcccagacctgcaggttgacctttagattgaccttttcgttgacctttgacttgacctttctattgacctttactttgaccttttgcttgacctttgtattgacctttggcgcgccatgcttcatcagactct

SEQ ID NO: 4897 - DNA, 164 bp, Artificial Sequence; identical to SEQ ID NO: 4896
  Synthetic polynucleotide

SEQ ID NO: 4898 - DNA, 197 bp, Artificial Sequence
  Synthetic polynucleotide
atcatctcaccttgcctcctgtccattcgtgtgaattgcctgcaggggtgcgggggcggggagaggtgcgggggcggggtcgggtgcgggggcgggggacggtgcgggggcggggctaggtgcgggggcggggactggtgcgggggcggggtgcggtgcgggggcgggggtaggcgcgccatgcttcatcagactct

SEQ ID NO: 4899 - DNA, 197 bp, Artificial Sequence; identical to SEQ ID NO: 4898
  Synthetic polynucleotide

SEQ ID NO: 4900 - DNA, 172 bp, Artificial Sequence
  Synthetic polynucleotide
atcatctcaccttgcctcctggtaagcgcgaagcaagccctgcaggggggggccccagaggggggcccctcgggggggccccgacggggggccccctaggggggccccactggggggcccctgcggggggccccgtaggggggccccggcgcgccatgcttcatcagactct

SEQ ID NO: 4901 - DNA, 172 bp, Artificial Sequence; identical to SEQ ID NO: 4900
  Synthetic polynucleotide

SEQ ID NO: 4902 - DNA, 172 bp, Artificial Sequence
  Synthetic polynucleotide
atcatctcaccttgcctcctgccgaagcatttcacattcctgcaggattgacctctagaattgacctcttcgattgacctctgacattgacctctctaattgacctctactattgacctcttgcattgacctctgtaattgacctctggcgcgccatgcttcatcagactct

SEQ ID NO: 4903 - DNA, 172 bp, Artificial Sequence; identical to SEQ ID NO: 4902
  Synthetic polynucleotide

SEQ ID NO: 4904 - DNA, 148 bp, Artificial Sequence
  Synthetic polynucleotide
atcatctcaccttgcctcctgaactcagccagactgttcctgcaggaaagtcaagaaaagtcatcgaaagtcagacaaagtcactaaaagtcaactaaagtcatgcaaagtcagtaaaagtcaggcgcgccatgcttcatcagactct

SEQ ID NO: 4905 - DNA, 148 bp, Artificial Sequence; identical to SEQ ID NO: 4904
  Synthetic polynucleotide

SEQ ID NO: 4906 - DNA, 188 bp, Artificial Sequence
  Synthetic polynucleotide
atcatctcaccttgcctcctgtatatggcggcatagttcctgcagggttaaatattaaagagttaaatattaatcggttaaatattaagacgttaaatattaactagttaaatattaaactgttaaatattaatgcgttaaatattaagtagttaaatattaaggcgcgccatgcttcatcagactct

SEQ ID NO: 4907 - DNA, 188 bp, Artificial Sequence; identical to SEQ ID NO: 4906
  Synthetic polynucleotide

SEQ ID NO: 4908 - DNA, 191 bp, Artificial Sequence
  Synthetic polynucleotide
atcatctcaccttgcctcctgctatatgattacgaacgcctgcaggtaaactaattagctgagagataaactaattagctgagtcgtaaactaattagctgaggactaaactaattagctgagctataaactaattagctgagacttaaactaattagctgagtgcggcgcgccatgcttcatcagactct

SEQ ID NO: 4909 - DNA, 191 bp, Artificial Sequence; identical to SEQ ID NO: 4908
  Synthetic polynucleotide

SEQ ID NO: 4910 - DNA, 197 bp, Artificial Sequence
  Synthetic polynucleotide
atcatctcaccttgcctcctgctctggtatcgaagacacctgcaggggtttttttttttttagaggttttttttttttttcgggtttttttttttttgacggtttttttttttttctaggtttttttttttttactggttttttttttttttgcggtttttttttttttgtaggcgcgccatgcttcatcagactct

SEQ ID NO: 4911 - DNA, 197 bp, Artificial Sequence; identical to SEQ ID NO: 4910
  Synthetic polynucleotide

SEQ ID NO: 4912 - DNA, 156 bp, Artificial Sequence
  Synthetic polynucleotide
atcatctcaccttgcctcctgaacagaccgccagaatacctgcaggtgaactccagatgaactcctcgtgaactccgactgaactccctatgaactccacttgaactcctgctgaactccgtatgaactccggcgcgccatgcttcatcagactct

SEQ ID NO: 4913 - DNA, 156 bp, Artificial Sequence; identical to SEQ ID NO: 4912
  Synthetic polynucleotide

SEQ ID NO: 4914 - DNA, 172 bp, Artificial Sequence
  Synthetic polynucleotide
atcatctcaccttgcctcctggctactctccgcaaagacctgcagggttaaacggtagagttaaacggttcggttaaacggtgacgttaaacggtctagttaaacggtactgttaaacggttgcgttaaacggtgtagttaaacggtggcgcgccatgcttcatcagactct

SEQ ID NO: 4915 - DNA, 172 bp, Artificial Sequence; identical to SEQ ID NO: 4914
  Synthetic polynucleotide

SEQ ID NO: 4916 - DNA, 191 bp, Artificial Sequence
  Synthetic polynucleotide
atcatctcaccttgcctcctgaatggccgtcaagcatgcctgcaggaaaaagtaaacaaacccagaaaaaagtaaacaaaccctcgaaaaagtaaacaaacccgacaaaaagtaaacaaacccctaaaaaagtaaacaaacccactaaaaagtaaacaaaccctgcggcgcgccatgcttcatcagactct

SEQ ID NO: 4917 - DNA, 191 bp, Artificial Sequence; identical to SEQ ID NO: 4916
  Synthetic polynucleotide

SEQ ID NO: 4918 - DNA, 197 bp, Artificial Sequence
  Synthetic polynucleotide
atcatctcaccttgcctcctgccgtcactgttatagagcctgcaggaggggtcagaggtcaagaaggggtcagaggtcatcgaggggtcagaggtcagacaggggtcagaggtcactaaggggtcagaggtcaactaggggtcagaggtcatgcaggggtcagaggtcagtaggcgcgccatgcttcatcagactct

SEQ ID NO: 4919 - DNA, 197 bp, Artificial Sequence; identical to SEQ ID NO: 4918
  Synthetic polynucleotide

SEQ ID NO: 4920 - DNA, 197 bp, Artificial Sequence
  Synthetic polynucleotide
atcatctcaccttgcctcctggtggcacccaacaacttcctgcaggccgcatagcaacggaagaccgcatagcaacggatcgccgcatagcaacggagacccgcatagcaacggactaccgcatagcaacggaactccgcatagcaacggatgcccgcatagcaacggagtaggcgcgccatgcttcatcagactct

SEQ ID NO: 4921 - DNA, 197 bp, Artificial Sequence; identical to SEQ ID NO: 4920
  Synthetic polynucleotide

SEQ ID NO: 4922 - DNA, 191 bp, Artificial Sequence
  Synthetic polynucleotide
atcatctcaccttgcctcctgacgtcgtatcgcaatttcctgcaggctgggggacccactgctagactgggggacccactgcttcgctgggggacccactgctgacctgggggacccactgctctactgggggacccactgctactctgggggacccactgcttgcggcgcgccatgcttcatcagactct

SEQ ID NO: 4923 - DNA, 191 bp, Artificial Sequence; identical to SEQ ID NO: 4922
  Synthetic polynucleotide

SEQ ID NO: 4924 - DNA, 197 bp, Artificial Sequence
  Synthetic polynucleotide
atcatctcaccttgcctcctgattcgcgtgatagcgcacctgcaggctcaagttcaagttcaccagactcaagttcaagttcacctcgctcaagttcaagttcaccgacctcaagttcaagttcaccctactcaagttcaagttcaccactctcaagttcaagttcacctgcggcgcgccatgcttcatcagactct

SEQ ID NO: 4925 - DNA, 197 bp, Artificial Sequence; identical to SEQ ID NO: 4924
  Synthetic polynucleotide

SEQ ID NO: 4926 - DNA, 148 bp, Artificial Sequence
  Synthetic polynucleotide
atcatctcaccttgcctcctgcagaccgccactgtgaacctgcaggtacgtcaagatacgtcatcgtacgtcagactacgtcactatacgtcaacttacgtcatgctacgtcagtatacgtcaggcgcgccatgcttcatcagactct

SEQ ID NO: 4927 - DNA, 148 bp, Artificial Sequence; identical to SEQ ID NO: 4926
  Synthetic polynucleotide

SEQ ID NO: 4928 - DNA, 172 bp, Artificial Sequence
  Synthetic polynucleotide
atcatctcaccttgcctcctgtttcgcctgcaatcagacctgcaggccaaggtcacagaccaaggtcactcgccaaggtcacgacccaaggtcacctaccaaggtcacactccaaggtcactgcccaaggtcacgtaccaaggtcacggcgcgccatgcttcatcagactct

SEQ ID NO: 4929 - DNA, 172 bp, Artificial Sequence; identical to SEQ ID NO: 4928
  Synthetic polynucleotide

SEQ ID NO: 4930 - DNA, 200 bp, Artificial Sequence
  Synthetic polynucleotide
atcatctcaccttgcctcctgcctcggttatccagagacctgcaggatcaatatgcaaatttcggagaatcaatatgcaaatttcggtcgatcaatatgcaaatttcgggacatcaatatgcaaatttcggctaatcaatatgcaaatttcggactatcaatatgcaaatttcggggcgcgccatgcttcatcagactct

SEQ ID NO: 4931 - DNA, 200 bp, Artificial Sequence; identical to SEQ ID NO: 4930
  Synthetic polynucleotide

SEQ ID NO: 4932 - DNA, 172 bp, Artificial Sequence
  Synthetic polynucleotide
atcatctcaccttgcctcctgactgttagtttcgttcacctgcaggtcaacctgcaagatcaacctgcatcgtcaacctgcagactcaacctgcactatcaacctgcaacttcaacctgcatgctcaacctgcagtatcaacctgcaggcgcgccatgcttcatcagactct

SEQ ID NO: 4933 - DNA, 172 bp, Artificial Sequence; identical to SEQ ID NO: 4932
  Synthetic polynucleotide

SEQ ID NO: 4934 - DNA, 156 bp, Artificial Sequence
  Synthetic polynucleotide
atcatctcaccttgcctcctgggaaactatgctggccgcctgcaggatttgaatagaatttgaattcgatttgaatgacatttgaatctaatttgaatactatttgaattgcatttgaatgtaatttgaatggcgcgccatgcttcatcagactct

SEQ ID NO: 4935 - DNA, 156 bp, Artificial Sequence; identical to SEQ ID NO: 4934
  Synthetic polynucleotide

SEQ ID NO: 4936 - DNA, 188 bp, Artificial Sequence
  Synthetic polynucleotide
atcatctcaccttgcctcctgtgacaagtacagggtgccctgcaggtccaaacgagatagatccaaacgagattcgtccaaacgagatgactccaaacgagatctatccaaacgagatacttccaaacgagattgctccaaacgagatgtatccaaacgagatggcgcgccatgcttcatcagactct

SEQ ID NO: 4937 - DNA, 188 bp, Artificial Sequence; identical to SEQ ID NO: 4936
  Synthetic polynucleotide

SEQ ID NO: 4938 - DNA, 156 bp, Artificial Sequence
  Synthetic polynucleotide
atcatctcaccttgcctcctggtaacttgtagatgaagcctgcaggattttgggagaattttgggtcgattttggggacattttgggctaattttgggactattttgggtgcattttggggtaattttgggggcgcgccatgcttcatcagactct

SEQ ID NO: 4939 - DNA, 156 bp, Artificial Sequence; identical to SEQ ID NO: 4938
  Synthetic polynucleotide

SEQ ID NO: 4940 - DNA, 197 bp, Artificial Sequence
  Synthetic polynucleotide
atcatctcaccttgcctcctgatcggtctcaatctagtcctgcaggcagtttcagtttctcagacagtttcagtttctctcgcagtttcagtttctcgaccagtttcagtttctcctacagtttcagtttctcactcagtttcagtttctctgccagtttcagtttctcgtaggcgcgccatgcttcatcagactct

SEQ ID NO: 4941 - DNA, 197 bp, Artificial Sequence; identical to SEQ ID NO: 4940
  Synthetic polynucleotide

SEQ ID NO: 4942 - DNA, 196 bp, Artificial Sequence
  Synthetic polynucleotide
atcatctcaccttgcctcctgagagtaaaggatgcaaccctgcaggtgctgactcattcagatgctgactcattctcgtgctgactcattcgactgctgactcattcctatgctgactcattcacttgctgactcattctgctgctgactcattcgtatgctgactcattcggcgcgccatgcttcatcagactct

SEQ ID NO: 4943 - DNA, 196 bp, Artificial Sequence; identical to SEQ ID NO: 4942
  Synthetic polynucleotide

SEQ ID NO: 4944 - DNA, 164 bp, Artificial Sequence
  Synthetic polynucleotide
atcatctcaccttgcctcctggaccgggtaattccacgcctgcaggtaattagcgagataattagcgtcgtaattagcggactaattagcgctataattagcgacttaattagcgtgctaattagcggtataattagcgggcgcgccatgcttcatcagactct

SEQ ID NO: 4945 - DNA, 164 bp, Artificial Sequence; identical to SEQ ID NO: 4944
  Synthetic polynucleotide

SEQ ID NO: 4946 - DNA, 172 bp, Artificial Sequence
  Synthetic polynucleotide
atcatctcaccttgcctcctgtttcaatactatctcgccctgcaggatcacgcgatagaatcacgcgattcgatcacgcgatgacatcacgcgatctaatcacgcgatactatcacgcgattgcatcacgcgatgtaatcacgcgatggcgcgccatgcttcatcagactct

SEQ ID NO: 4947 - DNA, 172 bp, Artificial Sequence; identical to SEQ ID NO: 4946
  Synthetic polynucleotide

SEQ ID NO: 4948 - DNA, 172 bp, Artificial Sequence
  Synthetic polynucleotide
atcatctcaccttgcctcctggacacgaagcatataaccctgcaggtttgtttacaagatttgtttacatcgtttgtttacagactttgtttacactatttgtttacaacttttgtttacatgctttgtttacagtatttgtttacaggcgcgccatgcttcatcagactct

SEQ ID NO: 4949 - DNA, 172 bp, Artificial Sequence; identical to SEQ ID NO: 4948
  Synthetic polynucleotide

SEQ ID NO: 4950 - DNA, 190 bp, Artificial Sequence
  Synthetic polynucleotide
atcatctcaccttgcctcctgcattgacctattgggctcctgcaggcattaattattcatagacattaattattcattcgcattaattattcatgaccattaattattcatctacattaattattcatactcattaattattcattgccattaattattcatgtaggcgcgccatgcttcatcagactct

SEQ ID NO: 4951 - DNA, 190 bp, Artificial Sequence; identical to SEQ ID NO: 4950
  Synthetic polynucleotide

SEQ ID NO: 4952 - DNA, 172 bp, Artificial Sequence
  Synthetic polynucleotide
atcatctcaccttgcctcctgggacaataatgcaagatcctgcaggccaatcagaaagaccaatcagaatcgccaatcagaagacccaatcagaactaccaatcagaaactccaatcagaatgcccaatcagaagtaccaatcagaaggcgcgccatgcttcatcagactct

SEQ ID NO: 4953 - DNA, 172 bp, Artificial Sequence; identical to SEQ ID NO: 4952
  Synthetic polynucleotide

SEQ ID NO: 4954 - DNA, 172 bp, Artificial Sequence
  Synthetic polynucleotide
atcatctcaccttgcctcctgattgtgttgttgatgtgcctgcaggccaattaccgagaccaattaccgtcgccaattaccggacccaattaccgctaccaattaccgactccaattaccgtgcccaattaccggtaccaattaccgggcgcgccatgcttcatcagactct

SEQ ID NO: 4955 - DNA, 172 bp, Artificial Sequence; identical to SEQ ID NO: 4954
  Synthetic polynucleotide

SEQ ID NO: 4956 - DNA, 185 bp, Artificial Sequence
  Synthetic polynucleotide
atcatctcaccttgcctcctgcttggtagatccaaatccctgcaggaacactgcaattgttcagaaacactgcaattgttctcgaacactgcaattgttcgacaacactgcaattgttcctaaacactgcaattgttcactaacactgcaattgttctgcggcgcgccatgcttcatcagactct

SEQ ID NO: 4957 - DNA, 185 bp, Artificial Sequence; identical to SEQ ID NO: 4956
  Synthetic polynucleotide

SEQ ID NO: 4958 - DNA, 185 bp, Artificial Sequence
  Synthetic polynucleotide
atcatctcaccttgcctcctggcctcattaacaccgagcctgcaggaaaaatccggatgtacagaaaaaatccggatgtactcgaaaaatccggatgtacgacaaaaatccggatgtacctaaaaaatccggatgtacactaaaaatccggatgtactgcggcgcgccatgcttcatcagactct

SEQ ID NO: 4959 - DNA, 185 bp, Artificial Sequence; identical to SEQ ID NO: 4958
  Synthetic polynucleotide

SEQ ID NO: 4960 - DNA, 179 bp, Artificial Sequence
  Synthetic polynucleotide
atcatctcaccttgcctcctgcgaaaccaggttaaggtcctgcaggattaaatgacacgtcatctttctgagaattaaatgacacgtcatctttctgtcgattaaatgacacgtcatctttctggacattaaatgacacgtcatctttctgctaggcgcgccatgcttcatcagactct

SEQ ID NO: 4961 - DNA, 179 bp, Artificial Sequence; identical to SEQ ID NO: 4960
  Synthetic polynucleotide

SEQ ID NO: 4962 - DNA, 197 bp, Artificial Sequence
  Synthetic polynucleotide
atcatctcaccttgcctcctgctcggatgtgcgtccatcctgcaggcccaacggcggttgggggagacccaacggcggttgggggtcgcccaacggcggttggggggaccccaacggcggttgggggctacccaacggcggttgggggactcccaacggcggttgggggtgcggcgcgccatgcttcatcagactct

SEQ ID NO: 4963 - DNA, 197 bp, Artificial Sequence; identical to SEQ ID NO: 4962
  Synthetic polynucleotide

SEQ ID NO: 4964 - DNA, 156 bp, Artificial Sequence
  Synthetic polynucleotide
atcatctcaccttgcctcctggtatcgctccagctcgtcctgcaggagataagaagaagataagatcgagataagagacagataagactaagataagaactagataagatgcagataagagtaagataagaggcgcgccatgcttcatcagactct

SEQ ID NO: 4965 - DNA, 156 bp, Artificial Sequence; identical to SEQ ID NO: 4964
  Synthetic polynucleotide

SEQ ID NO: 4966 - DNA, 156 bp, Artificial Sequence
  Synthetic polynucleotide
atcatctcaccttgcctcctgacctgttaagctcatagcctgcaggagataaggagaagataaggtcgagataagggacagataaggctaagataaggactagataaggtgcagataagggtaagataaggggcgcgccatgcttcatcagactct

SEQ ID NO: 4967 - DNA, 156 bp, Artificial Sequence; identical to SEQ ID NO: 4966
  Synthetic polynucleotide

SEQ ID NO: 4968 - DNA, 156 bp, Artificial Sequence
  Synthetic polynucleotide
atcatctcaccttgcctcctgcggtctcgaccctacttcctgcaggagagggcgagaagagggcgtcgagagggcggacagagggcgctaagagggcgactagagggcgtgcagagggcggtaagagggcgggcgcgccatgcttcatcagactct

SEQ ID NO: 4969 - DNA, 156 bp, Artificial Sequence; identical to SEQ ID NO: 4968
  Synthetic polynucleotide

SEQ ID NO: 4970 - DNA, 164 bp, Artificial Sequence
  Synthetic polynucleotide
atcatctcaccttgcctcctgttccgctggattagtatcctgcaggaacatcaaaagaaacatcaaatcgaacatcaaagacaacatcaaactaaacatcaaaactaacatcaaatgcaacatcaaagtaaacatcaaaggcgcgccatgcttcatcagactct

SEQ ID NO: 4971 - DNA, 164 bp, Artificial Sequence; identical to SEQ ID NO: 4970
  Synthetic polynucleotide

SEQ ID NO: 4972 - DNA, 191 bp, Artificial Sequence
  Synthetic polynucleotide
atcatctcaccttgcctcctgattaagcgcaagggtcacctgcaggattatttaattaattacagaattatttaattaattactcgattatttaattaattacgacattatttaattaattacctaattatttaattaattacactattatttaattaattactgcggcgcgccatgcttcatcagactct

SEQ ID NO: 4973 - DNA, 191 bp, Artificial Sequence; identical to SEQ ID NO: 4972
  Synthetic polynucleotide

SEQ ID NO: 4974 - DNA, 156 bp, Artificial Sequence
  Synthetic polynucleotide
atcatctcaccttgcctcctgtacttagagggttggtacctgcagggggtgtggagagggtgtggtcggggtgtgggacgggtgtggctagggtgtggactgggtgtggtgcgggtgtgggtagggtgtggggcgcgccatgcttcatcagactct

SEQ ID NO: 4975 - DNA, 156 bp, Artificial Sequence; identical to SEQ ID NO: 4974
  Synthetic polynucleotide

SEQ ID NO: 4976 - DNA, 190 bp, Artificial Sequence
  Synthetic polynucleotide
atcatctcaccttgcctcctggccgtgcattgtaggttcctgcaggttcacgcatgagttagattcacgcatgagtttcgttcacgcatgagttgacttcacgcatgagttctattcacgcatgagttactttcacgcatgagtttgcttcacgcatgagttgtaggcgcgccatgcttcatcagactct

SEQ ID NO: 4977 - DNA, 190 bp, Artificial Sequence; identical to SEQ ID NO: 4976
  Synthetic polynucleotide

SEQ ID NO: 4978 - DNA, 191 bp, Artificial Sequence
  Synthetic polynucleotide
atcatctcaccttgcctcctgcagttgccactgcccaacctgcaggtcaattgacccctgaagagatcaattgacccctgaagtcgtcaattgacccctgaaggactcaattgacccctgaagctatcaattgacccctgaagacttcaattgacccctgaagtgcggcgcgccatgcttcatcagactct

SEQ ID NO: 4979 - DNA, 191 bp, Artificial Sequence; identical to SEQ ID NO: 4978
  Synthetic polynucleotide

SEQ ID NO: 4980 - DNA, 197 bp, Artificial Sequence
  Synthetic polynucleotide
atcatctcaccttgcctcctgtgtctccaacatatccgcctgcaggtggactttggactctagatggactttggactcttcgtggactttggactctgactggactttggactctctatggactttggactctacttggactttggactcttgctggactttggactctgtaggcgcgccatgcttcatcagactct

SEQ ID NO: 4981 - DNA, 197 bp, Artificial Sequence; identical to SEQ ID NO: 4980
  Synthetic polynucleotide

SEQ ID NO: 4982 - DNA, 196 bp, Artificial Sequence
  Synthetic polynucleotide
atcatctcaccttgcctcctgcagttgggaaagtaccacctgcaggagttacgtaattgagaagttacgtaattgtcgagttacgtaattggacagttacgtaattgctaagttacgtaattgactagttacgtaattgtgcagttacgtaattggtaagttacgtaattgggcgcgccatgcttcatcagactct

SEQ ID NO: 4983 - DNA, 196 bp, Artificial Sequence; identical to SEQ ID NO: 4982
  Synthetic polynucleotide

SEQ ID NO: 4984 - DNA, 196 bp, Artificial Sequence
  Synthetic polynucleotide
atcatctcaccttgcctcctgaactgaagaatcggttccctgcaggtgtgtgagtcatcagatgtgtgagtcatctcgtgtgtgagtcatcgactgtgtgagtcatcctatgtgtgagtcatcacttgtgtgagtcatctgctgtgtgagtcatcgtatgtgtgagtcatcggcgcgccatgcttcatcagactct

SEQ ID NO: 4985 - DNA, 196 bp, Artificial Sequence; identical to SEQ ID NO: 4984
  Synthetic polynucleotide

SEQ ID NO: 4986 - DNA, 191 bp, Artificial Sequence
  Synthetic polynucleotide
atcatctcaccttgcctcctgcgccggaaatgctcaaccctgcagggggtacaccgtgtacctagagggtacaccgtgtaccttcggggtacaccgtgtacctgacgggtacaccgtgtacctctagggtacaccgtgtacctactgggtacaccgtgtaccttgcggcgcgccatgcttcatcagactct

SEQ ID NO: 4987 - DNA, 191 bp, Artificial Sequence; identical to SEQ ID NO: 4986
  Synthetic polynucleotide

SEQ ID NO: 4988 - DNA, 172 bp, Artificial Sequence
  Synthetic polynucleotide
atcatctcaccttgcctcctgcgcaaatgcaaaccatccctgcaggaaaccgcaaaagaaaaccgcaaatcgaaaccgcaaagacaaaccgcaaactaaaaccgcaaaactaaaccgcaaatgcaaaccgcaaagtaaaaccgcaaaggcgcgccatgcttcatcagactct

SEQ ID NO: 4989 - DNA, 172 bp, Artificial Sequence; identical to SEQ ID NO: 4988
  Synthetic polynucleotide

SEQ ID NO: 4990 - DNA, 164 bp, Artificial Sequence
  Synthetic polynucleotide
atcatctcaccttgcctcctgacatcatgatcaaaccacctgcaggctcattgtcagactcattgtctcgctcattgtcgacctcattgtcctactcattgtcactctcattgtctgcctcattgtcgtactcattgtcggcgcgccatgcttcatcagactct

SEQ ID NO: 4991 - DNA, 164 bp, Artificial Sequence; identical to SEQ ID NO: 4990
  Synthetic polynucleotide

SEQ ID NO: 4992 - DNA, 156 bp, Artificial Sequence
  Synthetic polynucleotide
atcatctcaccttgcctcctggcacgagcaagcattgccctgcaggattgttttagaattgtttttcgattgttttgacattgttttctaattgttttactattgtttttgcattgttttgtaattgttttggcgcgccatgcttcatcagactct

SEQ ID NO: 4993 - DNA, 156 bp, Artificial Sequence; identical to SEQ ID NO: 4992
  Synthetic polynucleotide

SEQ ID NO: 4994 - DNA, 172 bp, Artificial Sequence
  Synthetic polynucleotide
atcatctcaccttgcctcctggccgacctgtaagcagacctgcaggtgcaggtgtgagatgcaggtgtgtcgtgcaggtgtggactgcaggtgtgctatgcaggtgtgacttgcaggtgtgtgctgcaggtgtggtatgcaggtgtgggcgcgccatgcttcatcagactct

SEQ ID NO: 4995 - DNA, 172 bp, Artificial Sequence; identical to SEQ ID NO: 4994
  Synthetic polynucleotide

SEQ ID NO: 4996 - DNA, 180 bp, Artificial Sequence
  Synthetic polynucleotide
atcatctcaccttgcctcctgtgttgtgccttggatagcctgcagggttttacgagcagagttttacgagctcggttttacgagcgacgttttacgagcctagttttacgagcactgttttacgagctgcgttttacgagcgtagttttacgagcggcgcgccatgcttcatcagactct

SEQ ID NO: 4997 - DNA, 180 bp, Artificial Sequence; identical to SEQ ID NO: 4996
  Synthetic polynucleotide

SEQ ID NO: 4998 - DNA, 197 bp, Artificial Sequence
  Synthetic polynucleotide
atcatctcaccttgcctcctgtatcgctctttattgagcctgcaggggttaataattaccaagaggttaataattaccatcgggttaataattaccagacggttaataattaccactaggttaataattaccaactggttaataattaccatgcggttaataattaccagtaggcgcgccatgcttcatcagactct

SEQ ID NO: 4999 - DNA, 197 bp, Artificial Sequence; identical to SEQ ID NO: 4998
  Synthetic polynucleotide

SEQ ID NO: 5000 - DNA, 180 bp, Artificial Sequence
  Synthetic polynucleotide
atcatctcaccttgcctcctgatggttagttgggcagacctgcaggaaagcgtcgttagaaaagcgtcgtttcgaaagcgtcgttgacaaagcgtcgttctaaaagcgtcgttactaaagcgtcgtttgcaaagcgtcgttgtaaaagcgtcgttggcgcgccatgcttcatcagactct

SEQ ID NO: 5001 - DNA, 180 bp, Artificial Sequence; identical to SEQ ID NO: 5000
  Synthetic polynucleotide

SEQ ID NO: 5002 - DNA, 196 bp, Artificial Sequence
  Synthetic polynucleotide
atcatctcaccttgcctcctgactattgcgcacgcttccctgcaggggggattgcatttagaggggattgcattttcgggggattgcatttgacggggattgcatttctaggggattgcatttactggggattgcattttgcggggattgcatttgtaggggattgcatttggcgcgccatgcttcatcagactct

SEQ ID NO: 5003 - DNA, 196 bp, Artificial Sequence; identical to SEQ ID NO: 5002
  Synthetic polynucleotide

SEQ ID NO: 5004 - DNA, 197 bp, Artificial Sequence
  Synthetic polynucleotide
atcatctcaccttgcctcctggctatcccgatacgtagcctgcaggcagtattgcgtgagtagacagtattgcgtgagttcgcagtattgcgtgagtgaccagtattgcgtgagtctacagtattgcgtgagtactcagtattgcgtgagttgccagtattgcgtgagtgtaggcgcgccatgcttcatcagactct

SEQ ID NO: 5005 - DNA, 197 bp, Artificial Sequence; identical to SEQ ID NO: 5004
  Synthetic polynucleotide

SEQ ID NO: 5006 - DNA, 191 bp, Artificial Sequence
  Synthetic polynucleotide
atcatctcaccttgcctcctgtcctcactattggatatcctgcaggcggatgacctttgacccctgaagacggatgacctttgacccctgatcgcggatgacctttgacccctgagaccggatgacctttgacccctgactacggatgacctttgacccctgaactggcgcgccatgcttcatcagactct

SEQ ID NO: 5007 - DNA, 191 bp, Artificial Sequence; identical to SEQ ID NO: 5006
  Synthetic polynucleotide

SEQ ID NO: 5008 - DNA, 191 bp, Artificial Sequence
  Synthetic polynucleotide
atcatctcaccttgcctcctgtccttctccggttaccgcctgcaggtgacgtgccaggcgaaaagatgacgtgccaggcgaaatcgtgacgtgccaggcgaaagactgacgtgccaggcgaaactatgacgtgccaggcgaaaacttgacgtgccaggcgaaatgcggcgcgccatgcttcatcagactct

SEQ ID NO: 5009 - DNA, 191 bp, Artificial Sequence; identical to SEQ ID NO: 5008
  Synthetic polynucleotide

SEQ ID NO: 5010 - DNA, 188 bp, Artificial Sequence
  Synthetic polynucleotide
atcatctcaccttgcctcctggcaataacagaagatgtcctgcaggggacaggtgttgagaggacaggtgttgtcgggacaggtgttggacggacaggtgttgctaggacaggtgttgactggacaggtgttgtgcggacaggtgttggtaggacaggtgttgggcgcgccatgcttcatcagactct

SEQ ID NO: 5011 - DNA, 188 bp, Artificial Sequence; identical to SEQ ID NO: 5010
  Synthetic polynucleotide

SEQ ID NO: 5012 - DNA, 164 bp, Artificial Sequence
  Synthetic polynucleotide
atcatctcaccttgcctcctgcctcttatagagaaccacctgcaggcagataaggagacagataaggtcgcagataagggaccagataaggctacagataaggactcagataaggtgccagataagggtacagataaggggcgcgccatgcttcatcagactct

SEQ ID NO: 5013 - DNA, 164 bp, Artificial Sequence; identical to SEQ ID NO: 5012
  Synthetic polynucleotide

SEQ ID NO: 5014 - DNA, 196 bp, Artificial Sequence
  Synthetic polynucleotide
atcatctcaccttgcctcctgggagaatcactgaaagacctgcaggtagggccccctctagatagggccccctcttcgtagggccccctctgactagggccccctctctatagggccccctctacttagggccccctcttgctagggccccctctgtatagggccccctctggcgcgccatgcttcatcagactct

SEQ ID NO: 5015 - DNA, 196 bp, Artificial Sequence; identical to SEQ ID NO: 5014
  Synthetic polynucleotide

SEQ ID NO: 5016 - DNA, 164 bp, Artificial Sequence
  Synthetic polynucleotide
atcatctcaccttgcctcctggttagccaaggtgtatgcctgcaggcacacctggagacacacctggtcgcacacctgggaccacacctggctacacacctggactcacacctggtgccacacctgggtacacacctggggcgcgccatgcttcatcagactct

SEQ ID NO: 5017 - DNA, 164 bp, Artificial Sequence; identical to SEQ ID NO: 5016
  Synthetic polynucleotide

SEQ ID NO: 5018 - DNA, 164 bp, Artificial Sequence
  Synthetic polynucleotide
atcatctcaccttgcctcctgctccatcacagctcgcacctgcaggttcaagtggagattcaagtggtcgttcaagtgggacttcaagtggctattcaagtggactttcaagtggtgcttcaagtgggtattcaagtggggcgcgccatgcttcatcagactct

SEQ ID NO: 5019 - DNA, 164 bp, Artificial Sequence; identical to SEQ ID NO: 5018
  Synthetic polynucleotide

SEQ ID NO: 5020 - DNA, 197 bp, Artificial Sequence
  Synthetic polynucleotide
atcatctcaccttgcctcctggacgaaagcctcctactcctgcaggagtcacttcctgctaagaagtcacttcctgctatcgagtcacttcctgctagacagtcacttcctgctactaagtcacttcctgctaactagtcacttcctgctatgcagtcacttcctgctagtaggcgcgccatgcttcatcagactct

SEQ ID NO: 5021 - DNA, 197 bp, Artificial Sequence; identical to SEQ ID NO: 5020
  Synthetic polynucleotide

SEQ ID NO: 5022 - DNA, 200 bp, Artificial Sequence
  Synthetic polynucleotide
atcatctcaccttgcctcctggtgcgcatttccctagacctgcagggggttgtcacgcgatccccagagggttgtcacgcgatcccctcggggttgtcacgcgatccccgacgggttgtcacgcgatccccctagggttgtcacgcgatccccactgggttgtcacgcgatccccggcgcgccatgcttcatcagactct

SEQ ID NO: 5023 - DNA, 200 bp, Artificial Sequence; identical to SEQ ID NO: 5022
  Synthetic polynucleotide

SEQ ID NO: 5024 - DNA, 185 bp, Artificial Sequence
  Synthetic polynucleotide
atcatctcaccttgcctcctgtgtctgacccatatgctcctgcaggcaaattcctcgaaagaagacaaattcctcgaaagatcgcaaattcctcgaaagagaccaaattcctcgaaagactacaaattcctcgaaagaactcaaattcctcgaaagatgcggcgcgccatgcttcatcagactct

SEQ ID NO: 5025 - DNA, 185 bp, Artificial Sequence; identical to SEQ ID NO: 5024
  Synthetic polynucleotide

SEQ ID NO: 5026 - DNA, 180 bp, Artificial Sequence
  Synthetic polynucleotide
atcatctcaccttgcctcctggccgagatcagtcagtacctgcaggctttcactttcagactttcactttctcgctttcactttcgacctttcactttcctactttcactttcactctttcactttctgcctttcactttcgtactttcactttcggcgcgccatgcttcatcagactct

SEQ ID NO: 5027 - DNA, 180 bp, Artificial Sequence; identical to SEQ ID NO: 5026
  Synthetic polynucleotide

SEQ ID NO: 5028 - DNA, 191 bp, Artificial Sequence
  Synthetic polynucleotide
atcatctcaccttgcctcctggagtttggccttactaccctgcagggataattaatcccttccagagataattaatcccttcctcggataattaatcccttccgacgataattaatcccttccctagataattaatcccttccactgataattaatcccttcctgcggcgcgccatgcttcatcagactct

SEQ ID NO: 5029 - DNA, 191 bp, Artificial Sequence; identical to SEQ ID NO: 5028
  Synthetic polynucleotide

SEQ ID NO: 5030 - DNA, 172 bp, Artificial Sequence
  Synthetic polynucleotide
atcatctcaccttgcctcctgcgacggtctgcatacaacctgcaggagccaatcagagaagccaatcagtcgagccaatcaggacagccaatcagctaagccaatcagactagccaatcagtgcagccaatcaggtaagccaatcagggcgcgccatgcttcatcagactct

SEQ ID NO: 5031 - DNA, 172 bp, Artificial Sequence; identical to SEQ ID NO: 5030
  Synthetic polynucleotide

SEQ ID NO: 5032 - DNA, 197 bp, Artificial Sequence
  Synthetic polynucleotide
atcatctcaccttgcctcctgatatctggacgcagagacctgcaggcccccccgggggggtagacccccccgggggggttcgcccccccgggggggtgaccccccccgggggggtctacccccccgggggggtactcccccccgggggggttgccccccccgggggggtgtaggcgcgccatgcttcatcagactct

SEQ ID NO: 5033 - DNA, 197 bp, Artificial Sequence; identical to SEQ ID NO: 5032
  Synthetic polynucleotide

SEQ ID NO: 5034 - DNA, 196 bp, Artificial Sequence
  Synthetic polynucleotide
atcatctcaccttgcctcctgaggcgcgttgcgatatgcctgcaggtatgtcgcgatagagatatgtcgcgatagtcgtatgtcgcgataggactatgtcgcgatagctatatgtcgcgatagacttatgtcgcgatagtgctatgtcgcgataggtatatgtcgcgatagggcgcgccatgcttcatcagactct

SEQ ID NO: 5035 - DNA, 196 bp, Artificial Sequence; identical to SEQ ID NO: 5034
  Synthetic polynucleotide

SEQ ID NO: 5036 - DNA, 197 bp, Artificial Sequence
  Synthetic polynucleotide
atcatctcaccttgcctcctgagacgtagcctgtctcccctgcaggtttggcttcttgccaagaagatttggcttcttgccaagatcgtttggcttcttgccaagagactttggcttcttgccaagactatttggcttcttgccaagaacttttggcttcttgccaagatgcggcgcgccatgcttcatcagactct

SEQ ID NO: 5037 - DNA, 197 bp, Artificial Sequence; identical to SEQ ID NO: 5036
  Synthetic polynucleotide

SEQ ID NO: 5038 - DNA, 180 bp, Artificial Sequence
  Synthetic polynucleotide
atcatctcaccttgcctcctgtccgaggctcgtttggacctgcaggggtcccgcgagagaggtcccgcgagtcgggtcccgcgaggacggtcccgcgagctaggtcccgcgagactggtcccgcgagtgcggtcccgcgaggtaggtcccgcgagggcgcgccatgcttcatcagactct

SEQ ID NO: 5039 - DNA, 180 bp, Artificial Sequence; identical to SEQ ID NO: 5038
  Synthetic polynucleotide

SEQ ID NO: 5040 - DNA, 172 bp, Artificial Sequence
  Synthetic polynucleotide
atcatctcaccttgcctcctggggaatagttccgaggacctgcaggcaaatatttgagacaaatatttgtcgcaaatatttggaccaaatatttgctacaaatatttgactcaaatatttgtgccaaatatttggtacaaatatttgggcgcgccatgcttcatcagactct

SEQ ID NO: 5041 - DNA, 172 bp, Artificial Sequence; identical to SEQ ID NO: 5040
  Synthetic polynucleotide

SEQ ID NO: 5042 - DNA, 164 bp, Artificial Sequence
  Synthetic polynucleotide
atcatctcaccttgcctcctgtatcatcgcgccacgaccctgcaggctgactcatagactgactcattcgctgactcatgacctgactcatctactgactcatactctgactcattgcctgactcatgtactgactcatggcgcgccatgcttcatcagactct

SEQ ID NO: 5043 - DNA, 164 bp, Artificial Sequence; identical to SEQ ID NO: 5042
  Synthetic polynucleotide

SEQ ID NO: 5044 - DNA, 190 bp, Artificial Sequence
  Synthetic polynucleotide
atcatctcaccttgcctcctgtgctatgatgttccgcccctgcaggtaacttcctcttaaagataacttcctcttaatcgtaacttcctcttaagactaacttcctcttaactataacttcctcttaaacttaacttcctcttaatgctaacttcctcttaagtaggcgcgccatgcttcatcagactct

SEQ ID NO: 5045 - DNA, 190 bp, Artificial Sequence; identical to SEQ ID NO: 5044
  Synthetic polynucleotide

SEQ ID NO: 5046 - DNA, 190 bp, Artificial Sequence
  Synthetic polynucleotide
atcatctcaccttgcctcctggcgaacaggataacggccctgcaggcatttacataaacaagacatttacataaacatcgcatttacataaacagaccatttacataaacactacatttacataaacaactcatttacataaacatgccatttacataaacagtaggcgcgccatgcttcatcagactct

SEQ ID NO: 5047 - DNA, 190 bp, Artificial Sequence; identical to SEQ ID NO: 5046
  Synthetic polynucleotide

SEQ ID NO: 5048 - DNA, 196 bp, Artificial Sequence
  Synthetic polynucleotide
atcatctcaccttgcctcctgtcgtagcgaacgtggagcctgcaggtggactttggcctagatggactttggccttcgtggactttggcctgactggactttggcctctatggactttggcctacttggactttggccttgctggactttggcctgtatggactttggcctggcgcgccatgcttcatcagactct

SEQ ID NO: 5049 - DNA, 196 bp, Artificial Sequence; identical to SEQ ID NO: 5048
  Synthetic polynucleotide

SEQ ID NO: 5050 - DNA, 156 bp, Artificial Sequence
  Synthetic polynucleotide
atcatctcaccttgcctcctgagtccacagcgggtagacctgcaggtgacgtcaagatgacgtcatcgtgacgtcagactgacgtcactatgacgtcaacttgacgtcatgctgacgtcagtatgacgtcaggcgcgccatgcttcatcagactct

SEQ ID NO: 5051 - DNA, 156 bp, Artificial Sequence; identical to SEQ ID NO: 5050
  Synthetic polynucleotide

SEQ ID NO: 5052 - DNA, 156 bp, Artificial Sequence
  Synthetic polynucleotide
atcatctcaccttgcctcctgggtgaattattaacgagcctgcaggaaataacaagaaaataacatcgaaataacagacaaataacactaaaataacaactaaataacatgcaaataacagtaaaataacaggcgcgccatgcttcatcagactct

SEQ ID NO: 5053 - DNA, 156 bp, Artificial Sequence; identical to SEQ ID NO: 5052
  Synthetic polynucleotide

SEQ ID NO: 5054 - DNA, 185 bp, Artificial Sequence
  Synthetic polynucleotide
atcatctcaccttgcctcctgtaaatacaggcgaattccctgcaggaacaaccaattaattcagaaacaaccaattaattctcgaacaaccaattaattcgacaacaaccaattaattcctaaacaaccaattaattcactaacaaccaattaattctgcggcgcgccatgcttcatcagactct

SEQ ID NO: 5055 - DNA, 185 bp, Artificial Sequence; identical to SEQ ID NO: 5054
  Synthetic polynucleotide

SEQ ID NO: 5056 - DNA, 172 bp, Artificial Sequence
  Synthetic polynucleotide
atcatctcaccttgcctcctgccgtgtgtctatgcagacctgcaggaccgtttaacagaaccgtttaactcgaccgtttaacgacaccgtttaacctaaccgtttaacactaccgtttaactgcaccgtttaacgtaaccgtttaacggcgcgccatgcttcatcagactct

SEQ ID NO: 5057 - DNA, 172 bp, Artificial Sequence; identical to SEQ ID NO: 5056
  Synthetic polynucleotide

SEQ ID NO: 5058 - DNA, 190 bp, Artificial Sequence
  Synthetic polynucleotide
atcatctcaccttgcctcctgccgctcttgctgcatgtcctgcagggtgccgtgtgcaaaagagtgccgtgtgcaaatcggtgccgtgtgcaaagacgtgccgtgtgcaaactagtgccgtgtgcaaaactgtgccgtgtgcaaatgcgtgccgtgtgcaaagtaggcgcgccatgcttcatcagactct

SEQ ID NO: 5059 - DNA, 190 bp, Artificial Sequence; identical to SEQ ID NO: 5058
  Synthetic polynucleotide

SEQ ID NO: 5060 - DNA, 196 bp, Artificial Sequence
  Synthetic polynucleotide
atcatctcaccttgcctcctgacgtccctcattagttgcctgcagggaggatgagtcacagagaggatgagtcactcggaggatgagtcacgacgaggatgagtcacctagaggatgagtcacactgaggatgagtcactgcgaggatgagtcacgtagaggatgagtcacggcgcgccatgcttcatcagactct

SEQ ID NO: 5061 - DNA, 196 bp, Artificial Sequence; identical to SEQ ID NO: 5060
  Synthetic polynucleotide

SEQ ID NO: 5062 - DNA, 191 bp, Artificial Sequence
  Synthetic polynucleotide
atcatctcaccttgcctcctgacttgtatctgatgccacctgcagggggactacaactcccagcaggagagggactacaactcccagcaggtcggggactacaactcccagcagggacgggactacaactcccagcaggctagggactacaactcccagcaggactggcgcgccatgcttcatcagactct

SEQ ID NO: 5063 - DNA, 191 bp, Artificial Sequence; identical to SEQ ID NO: 5062
  Synthetic polynucleotide

SEQ ID NO: 5064 - DNA, 191 bp, Artificial Sequence
  Synthetic polynucleotide
atcatctcaccttgcctcctgaacttgccggaagattgcctgcaggtgcactaattagtgcacagatgcactaattagtgcactcgtgcactaattagtgcacgactgcactaattagtgcacctatgcactaattagtgcacacttgcactaattagtgcactgcggcgcgccatgcttcatcagactct

SEQ ID NO: 5065 - DNA, 191 bp, Artificial Sequence; identical to SEQ ID NO: 5064
  Synthetic polynucleotide

SEQ ID NO: 5066 - DNA, 148 bp, Artificial Sequence
  Synthetic polynucleotide
atcatctcaccttgcctcctgtctatccgtgactcagccctgcaggatgaaccagaatgaacctcgatgaaccgacatgaaccctaatgaaccactatgaacctgcatgaaccgtaatgaaccggcgcgccatgcttcatcagactct

SEQ ID NO: 5067 - DNA, 148 bp, Artificial Sequence; identical to SEQ ID NO: 5066
  Synthetic polynucleotide

SEQ ID NO: 5068 - DNA, 180 bp, Artificial Sequence
  Synthetic polynucleotide
atcatctcaccttgcctcctgggttatatccttgtatgcctgcaggaccggaaatccagaaccggaaatcctcgaccggaaatccgacaccggaaatccctaaccggaaatccactaccggaaatcctgcaccggaaatccgtaaccggaaatccggcgcgccatgcttcatcagactct

SEQ ID NO: 5069 - DNA, 180 bp, Artificial Sequence; identical to SEQ ID NO: 5068
  Synthetic polynucleotide

SEQ ID NO: 5070 - DNA, 197 bp, Artificial Sequence
  Synthetic polynucleotide
atcatctcaccttgcctcctgggcggaccttgtgaatacctgcaggagtgccacctagtggagaagtgccacctagtggtcgagtgccacctagtgggacagtgccacctagtggctaagtgccacctagtggactagtgccacctagtggtgcagtgccacctagtgggtaggcgcgccatgcttcatcagactct

SEQ ID NO: 5071 - DNA, 197 bp, Artificial Sequence; identical to SEQ ID NO: 5070
  Synthetic polynucleotide

SEQ ID NO: 5072 - DNA, 197 bp, Artificial Sequence
  Synthetic polynucleotide
atcatctcaccttgcctcctgggcctattagatagtatcctgcaggaaccgttaaacggtcagaaaccgttaaacggtctcgaaccgttaaacggtcgacaaccgttaaacggtcctaaaccgttaaacggtcactaaccgttaaacggtctgcaaccgttaaacggtcgtaggcgcgccatgcttcatcagactct

SEQ ID NO: 5073 - DNA, 197 bp, Artificial Sequence; identical to SEQ ID NO: 5072
  Synthetic polynucleotide

SEQ ID NO: 5074 - DNA, 196 bp, Artificial Sequence
  Synthetic polynucleotide
atcatctcaccttgcctcctgttgcgagaggcttcaatcctgcaggtgaccttgaacttagatgaccttgaactttcgtgaccttgaacttgactgaccttgaacttctatgaccttgaacttacttgaccttgaactttgctgaccttgaacttgtatgaccttgaacttggcgcgccatgcttcatcagactct

SEQ ID NO: 5075 - DNA, 196 bp, Artificial Sequence; identical to SEQ ID NO: 5074
  Synthetic polynucleotide

SEQ ID NO: 5076 - DNA, 148 bp, Artificial Sequence
  Synthetic polynucleotide
atcatctcaccttgcctcctgcgtcaacgatcgatcaccctgcaggggaaattagaggaaatttcgggaaattgacggaaattctaggaaattactggaaatttgcggaaattgtaggaaattggcgcgccatgcttcatcagactct

SEQ ID NO: 5077 - DNA, 148 bp, Artificial Sequence; identical to SEQ ID NO: 5076
  Synthetic polynucleotide

SEQ ID NO: 5078 - DNA, 190 bp, Artificial Sequence
  Synthetic polynucleotide
atcatctcaccttgcctcctgacatttcccattgtcaacctgcaggccataaaactgtcaagaccataaaactgtcatcgccataaaactgtcagacccataaaactgtcactaccataaaactgtcaactccataaaactgtcatgcccataaaactgtcagtaggcgcgccatgcttcatcagactct

SEQ ID NO: 5079 - DNA, 190 bp, Artificial Sequence; identical to SEQ ID NO: 5078
  Synthetic polynucleotide

SEQ ID NO: 5080 - DNA, 196 bp, Artificial Sequence
  Synthetic polynucleotide
atcatctcaccttgcctcctggcattcctcgatgcaagcctgcaggaaatgcaatccccagaaaatgcaatcccctcgaaatgcaatccccgacaaatgcaatccccctaaaatgcaatccccactaaatgcaatcccctgcaaatgcaatccccgtaaaatgcaatccccggcgcgccatgcttcatcagactct

SEQ ID NO: 5081 - DNA, 196 bp, Artificial Sequence; identical to SEQ ID NO: 5080
  Synthetic polynucleotide

SEQ ID NO: 5082 - DNA, 180 bp, Artificial Sequence
  Synthetic polynucleotide
atcatctcaccttgcctcctgcggtcagtccattattccctgcaggggccacgtggtagaggccacgtggttcgggccacgtggtgacggccacgtggtctaggccacgtggtactggccacgtggttgcggccacgtggtgtaggccacgtggtggcgcgccatgcttcatcagactct

SEQ ID NO: 5083 - DNA, 180 bp, Artificial Sequence; identical to SEQ ID NO: 5082
  Synthetic polynucleotide

SEQ ID NO: 5084 - DNA, 191 bp, Artificial Sequence
  Synthetic polynucleotide
atcatctcaccttgcctcctgcggagagttgctgagtccctgcaggggtcccgcccccttctcagaggtcccgcccccttctctcgggtcccgcccccttctcgacggtcccgcccccttctcctaggtcccgcccccttctcactggtcccgcccccttctctgcggcgcgccatgcttcatcagactct

SEQ ID NO: 5085 - DNA, 191 bp, Artificial Sequence; identical to SEQ ID NO: 5084
  Synthetic polynucleotide

SEQ ID NO: 5086 - DNA, 140 bp, Artificial Sequence
  Synthetic polynucleotide
atcatctcaccttgcctcctgctttaggtatggagtcgcctgcaggcaattaagacaattatcgcaattagaccaattactacaattaactcaattatgccaattagtacaattaggcgcgccatgcttcatcagactct

SEQ ID NO: 5087 - DNA, 140 bp, Artificial Sequence; identical to SEQ ID NO: 5086
  Synthetic polynucleotide

SEQ ID NO: 5088 - DNA, 172 bp, Artificial Sequence
  Synthetic polynucleotide
atcatctcaccttgcctcctgacttctgtttcgaggtccctgcagggcggattaggagagcggattaggtcggcggattagggacgcggattaggctagcggattaggactgcggattaggtgcgcggattagggtagcggattaggggcgcgccatgcttcatcagactct

SEQ ID NO: 5089 - DNA, 172 bp, Artificial Sequence; identical to SEQ ID NO: 5088
  Synthetic polynucleotide

SEQ ID NO: 5090 - DNA, 164 bp, Artificial Sequence
  Synthetic polynucleotide
atcatctcaccttgcctcctgcagtgccttgcaagccacctgcaggttatcgattagattatcgatttcgttatcgattgacttatcgattctattatcgattactttatcgatttgcttatcgattgtattatcgattggcgcgccatgcttcatcagactct

SEQ ID NO: 5091 - DNA, 164 bp, Artificial Sequence; identical to SEQ ID NO: 5090
  Synthetic polynucleotide

SEQ ID NO: 5092 - DNA, 164 bp, Artificial Sequence
  Synthetic polynucleotide
atcatctcaccttgcctcctgctgtttcttcaagcctgcctgcaggttaattaccagattaattacctcgttaattaccgacttaattaccctattaattaccactttaattacctgcttaattaccgtattaattaccggcgcgccatgcttcatcagactct

SEQ ID NO: 5093 - DNA, 164 bp, Artificial Sequence; identical to SEQ ID NO: 5092
  Synthetic polynucleotide

SEQ ID NO: 5094 - DNA, 172 bp, Artificial Sequence
  Synthetic polynucleotide
atcatctcaccttgcctcctgtgacgcttgcgttacagcctgcaggccacgtgatcagaccacgtgatctcgccacgtgatcgacccacgtgatcctaccacgtgatcactccacgtgatctgcccacgtgatcgtaccacgtgatcggcgcgccatgcttcatcagactct

SEQ ID NO: 5095 - DNA, 172 bp, Artificial Sequence; identical to SEQ ID NO: 5094
  Synthetic polynucleotide

SEQ ID NO: 5096 - DNA, 172 bp, Artificial Sequence
  Synthetic polynucleotide
atcatctcaccttgcctcctgagtaggtttctttacgccctgcaggaccggaagtaagaaccggaagtatcgaccggaagtagacaccggaagtactaaccggaagtaactaccggaagtatgcaccggaagtagtaaccggaagtaggcgcgccatgcttcatcagactct

SEQ ID NO: 5097 - DNA, 172 bp, Artificial Sequence; identical to SEQ ID NO: 5096
  Synthetic polynucleotide

SEQ ID NO: 5098 - DNA, 191 bp, Artificial Sequence
  Synthetic polynucleotide
atcatctcaccttgcctcctgcagtactgatgagagttcctgcaggccgctcccagcggctgcagaccgctcccagcggctgctcgccgctcccagcggctgcgacccgctcccagcggctgcctaccgctcccagcggctgcactccgctcccagcggctgctgcggcgcgccatgcttcatcagactct

SEQ ID NO: 5099 - DNA, 191 bp, Artificial Sequence; identical to SEQ ID NO: 5098
  Synthetic polynucleotide

SEQ ID NO: 5100 - DNA, 172 bp, Artificial Sequence
  Synthetic polynucleotide
atcatctcaccttgcctcctgtcttaacgatgtactcacctgcaggacagataaggagaacagataaggtcgacagataagggacacagataaggctaacagataaggactacagataaggtgcacagataagggtaacagataaggggcgcgccatgcttcatcagactct

SEQ ID NO: 5101 - DNA, 172 bp, Artificial Sequence; identical to SEQ ID NO: 5100
  Synthetic polynucleotide

SEQ ID NO: 5102 - DNA, 191 bp, Artificial Sequence
  Synthetic polynucleotide
atcatctcaccttgcctcctgtaaagagtgcaagtcgtcctgcagggggaacattgtgttcccagagggaacattgtgttccctcggggaacattgtgttcccgacgggaacattgtgttcccctagggaacattgtgttcccactgggaacattgtgttccctgcggcgcgccatgcttcatcagactct

SEQ ID NO: 5103 - DNA, 191 bp, Artificial Sequence; identical to SEQ ID NO: 5102
  Synthetic polynucleotide

SEQ ID NO: 5104 - DNA, 196 bp, Artificial Sequence
  Synthetic polynucleotide
atcatctcaccttgcctcctgaagcgttggttctagcccctgcaggggaaccggaagtgagaggaaccggaagtgtcgggaaccggaagtggacggaaccggaagtgctaggaaccggaagtgactggaaccggaagtgtgcggaaccggaagtggtaggaaccggaagtgggcgcgccatgcttcatcagactct

SEQ ID NO: 5105 - DNA, 196 bp, Artificial Sequence; identical to SEQ ID NO: 5104
  Synthetic polynucleotide

SEQ ID NO: 5106 - DNA, 190 bp, Artificial Sequence
  Synthetic polynucleotide
atcatctcaccttgcctcctgctatacttactttgccccctgcaggaaagttttattgccagaaaagttttattgcctcgaaagttttattgccgacaaagttttattgccctaaaagttttattgccactaaagttttattgcctgcaaagttttattgccgtaggcgcgccatgcttcatcagactct

SEQ ID NO: 5107 - DNA, 190 bp, Artificial Sequence; identical to SEQ ID NO: 5106
  Synthetic polynucleotide

SEQ ID NO: 5108 - DNA, 180 bp, Artificial Sequence
  Synthetic polynucleotide
atcatctcaccttgcctcctgcttaatgcgtgagttagcctgcaggggccacgtggcagaggccacgtggctcgggccacgtggcgacggccacgtggcctaggccacgtggcactggccacgtggctgcggccacgtggcgtaggccacgtggcggcgcgccatgcttcatcagactct

SEQ ID NO: 5109 - DNA, 180 bp, Artificial Sequence; identical to SEQ ID NO: 5108
  Synthetic polynucleotide

SEQ ID NO: 5110 - DNA, 185 bp, Artificial Sequence
  Synthetic polynucleotide
atcatctcaccttgcctcctgctccaataggaaactagcctgcaggttgagttaattaacctagattgagttaattaaccttcgttgagttaattaacctgacttgagttaattaacctctattgagttaattaacctactttgagttaattaaccttgcggcgcgccatgcttcatcagactct

SEQ ID NO: 5111 - DNA, 185 bp, Artificial Sequence; identical to SEQ ID NO: 5110
  Synthetic polynucleotide

SEQ ID NO: 5112 - DNA, 172 bp, Artificial Sequence
  Synthetic polynucleotide
atcatctcaccttgcctcctgtgtagcttacactgagtcctgcaggaccggaagtgagaaccggaagtgtcgaccggaagtggacaccggaagtgctaaccggaagtgactaccggaagtgtgcaccggaagtggtaaccggaagtgggcgcgccatgcttcatcagactct

SEQ ID NO: 5113 - DNA, 172 bp, Artificial Sequence; identical to SEQ ID NO: 5112
  Synthetic polynucleotide

SEQ ID NO: 5114 - DNA, 156 bp, Artificial Sequence
  Synthetic polynucleotide
atcatctcaccttgcctcctgtaagttgcctgctagggcctgcaggggcaattaagaggcaattatcgggcaattagacggcaattactaggcaattaactggcaattatgcggcaattagtaggcaattaggcgcgccatgcttcatcagactct

SEQ ID NO: 5115 - DNA, 156 bp, Artificial Sequence; identical to SEQ ID NO: 5114
  Synthetic polynucleotide

SEQ ID NO: 5116 - DNA, 172 bp, Artificial Sequence
  Synthetic polynucleotide
atcatctcaccttgcctcctgacatggcgcgatctctccctgcaggacagataagaagaacagataagatcgacagataagagacacagataagactaacagataagaactacagataagatgcacagataagagtaacagataagaggcgcgccatgcttcatcagactct

SEQ ID NO: 5117 - DNA, 172 bp, Artificial Sequence; identical to SEQ ID NO: 5116
  Synthetic polynucleotide

SEQ ID NO: 5118 - DNA, 191 bp, Artificial Sequence
  Synthetic polynucleotide
atcatctcaccttgcctcctgcgctatttacagtacggcctgcaggtgtcgtgaccccttaatagatgtcgtgaccccttaattcgtgtcgtgaccccttaatgactgtcgtgaccccttaatctatgtcgtgaccccttaatacttgtcgtgaccccttaattgcggcgcgccatgcttcatcagactct

SEQ ID NO: 5119 - DNA, 191 bp, Artificial Sequence; identical to SEQ ID NO: 5118
  Synthetic polynucleotide

SEQ ID NO: 5120 - DNA, 200 bp, Artificial Sequence
  Synthetic polynucleotide
atcatctcaccttgcctcctgtgtctacaaggttaagtcctgcaggagtttcgatatgagtcatcagaagtttcgatatgagtcatctcgagtttcgatatgagtcatcgacagtttcgatatgagtcatcctaagtttcgatatgagtcatcactagtttcgatatgagtcatcggcgcgccatgcttcatcagactct

SEQ ID NO: 5121 - DNA, 200 bp, Artificial Sequence; identical to SEQ ID NO: 5120
  Synthetic polynucleotide

SEQ ID NO: 5122 - DNA, 191 bp, Artificial Sequence
  Synthetic polynucleotide
atcatctcaccttgcctcctgagagatgtcgtcgtatccctgcagggggtcacttcaggtcagagagggtcacttcaggtcagtcggggtcacttcaggtcaggacgggtcacttcaggtcagctagggtcacttcaggtcagactgggtcacttcaggtcagtgcggcgcgccatgcttcatcagactct

SEQ ID NO: 5123 - DNA, 191 bp, Artificial Sequence; identical to SEQ ID NO: 5122
  Synthetic polynucleotide

SEQ ID NO: 5124 - DNA, 197 bp, Artificial Sequence
  Synthetic polynucleotide
atcatctcaccttgcctcctgcataaggatatcgcactcctgcaggtttggaaatccccttagatttggaaatcccctttcgtttggaaatccccttgactttggaaatccccttctatttggaaatccccttacttttggaaatcccctttgctttggaaatccccttgtaggcgcgccatgcttcatcagactct

SEQ ID NO: 5125 - DNA, 197 bp, Artificial Sequence; identical to SEQ ID NO: 5124
  Synthetic polynucleotide

SEQ ID NO: 5126 - DNA, 172 bp, Artificial Sequence
  Synthetic polynucleotide
atcatctcaccttgcctcctgtctaacattgccggagccctgcaggcctcaggcgaagacctcaggcgatcgcctcaggcgagaccctcaggcgactacctcaggcgaactcctcaggcgatgccctcaggcgagtacctcaggcgaggcgcgccatgcttcatcagactct

SEQ ID NO: 5127 - DNA, 172 bp, Artificial Sequence; identical to SEQ ID NO: 5126
  Synthetic polynucleotide

SEQ ID NO: 5128 - DNA, 188 bp, Artificial Sequence
  Synthetic polynucleotide
atcatctcaccttgcctcctgcgctaggaaacctcattcctgcagggagcacgtggttagagagcacgtggtttcggagcacgtggttgacgagcacgtggttctagagcacgtggttactgagcacgtggtttgcgagcacgtggttgtagagcacgtggttggcgcgccatgcttcatcagactct

SEQ ID NO: 5129 - DNA, 188 bp, Artificial Sequence; identical to SEQ ID NO: 5128
  Synthetic polynucleotide

SEQ ID NO: 5130 - DNA, 191 bp, Artificial Sequence
  Synthetic polynucleotide
atcatctcaccttgcctcctgtcctagctacaagttcacctgcaggatctaagttatctcttaagaatctaagttatctcttatcgatctaagttatctcttagacatctaagttatctcttactaatctaagttatctcttaactatctaagttatctcttatgcggcgcgccatgcttcatcagactct

SEQ ID NO: 5131 - DNA, 191 bp, Artificial Sequence; identical to SEQ ID NO: 5130
  Synthetic polynucleotide

SEQ ID NO: 5132 - DNA, 197 bp, Artificial Sequence
  Synthetic polynucleotide
atcatctcaccttgcctcctggaatccctaggacaagccctgcaggccaactttcgatttcctaagaccaactttcgatttcctatcgccaactttcgatttcctagacccaactttcgatttcctactaccaactttcgatttcctaactccaactttcgatttcctatgcggcgcgccatgcttcatcagactct

SEQ ID NO: 5133 - DNA, 197 bp, Artificial Sequence; identical to SEQ ID NO: 5132
  Synthetic polynucleotide

SEQ ID NO: 5134 - DNA, 164 bp, Artificial Sequence
  Synthetic polynucleotide
atcatctcaccttgcctcctgaatcaacccacccgttccctgcaggaccagctgcagaaccagctgctcgaccagctgcgacaccagctgcctaaccagctgcactaccagctgctgcaccagctgcgtaaccagctgcggcgcgccatgcttcatcagactct

SEQ ID NO: 5135 - DNA, 164 bp, Artificial Sequence; identical to SEQ ID NO: 5134
  Synthetic polynucleotide

SEQ ID NO: 5136 - DNA, 191 bp, Artificial Sequence
  Synthetic polynucleotide
atcatctcaccttgcctcctggtctagtactttggtcccctgcaggaaggtcaccagaggtcaagaaaggtcaccagaggtcatcgaaggtcaccagaggtcagacaaggtcaccagaggtcactaaaggtcaccagaggtcaactaaggtcaccagaggtcatgcggcgcgccatgcttcatcagactct

SEQ ID NO: 5137 - DNA, 191 bp, Artificial Sequence; identical to SEQ ID NO: 5136
  Synthetic polynucleotide

SEQ ID NO: 5138 - DNA, 197 bp, Artificial Sequence
  Synthetic polynucleotide
atcatctcaccttgcctcctgcggatctctgttgcaagcctgcaggttaattagcgctaattagagattaattagcgctaattagtcgttaattagcgctaattaggacttaattagcgctaattagctattaattagcgctaattagactttaattagcgctaattagtgcggcgcgccatgcttcatcagactct

SEQ ID NO: 5139 - DNA, 197 bp, Artificial Sequence; identical to SEQ ID NO: 5138
  Synthetic polynucleotide

SEQ ID NO: 5140 - DNA, 164 bp, Artificial Sequence
  Synthetic polynucleotide
atcatctcaccttgcctcctgtaccttcatcacttcaacctgcaggtgggtggtcagatgggtggtctcgtgggtggtcgactgggtggtcctatgggtggtcacttgggtggtctgctgggtggtcgtatgggtggtcggcgcgccatgcttcatcagactct

SEQ ID NO: 5141 - DNA, 164 bp, Artificial Sequence; identical to SEQ ID NO: 5140
  Synthetic polynucleotide

SEQ ID NO: 5142 - DNA, 196 bp, Artificial Sequence
  Synthetic polynucleotide
atcatctcaccttgcctcctgttattgaagggccgtggcctgcaggtgcataaattatgagatgcataaattatgtcgtgcataaattatggactgcataaattatgctatgcataaattatgacttgcataaattatgtgctgcataaattatggtatgcataaattatgggcgcgccatgcttcatcagactct

SEQ ID NO: 5143 - DNA, 196 bp, Artificial Sequence; identical to SEQ ID NO: 5142
  Synthetic polynucleotide

SEQ ID NO: 5144 - DNA, 156 bp, Artificial Sequence
  Synthetic polynucleotide
atcatctcaccttgcctcctgtatccgtgtatgggagccctgcaggtgacgtacagatgacgtactcgtgacgtacgactgacgtacctatgacgtacacttgacgtactgctgacgtacgtatgacgtacggcgcgccatgcttcatcagactct

SEQ ID NO: 5145 - DNA, 156 bp, Artificial Sequence; identical to SEQ ID NO: 5144
  Synthetic polynucleotide

SEQ ID NO: 5146 - DNA, 191 bp, Artificial Sequence
  Synthetic polynucleotide
atcatctcaccttgcctcctgggattattatctagccccctgcaggaatgactgcaattcattagaaatgactgcaattcatttcgaatgactgcaattcattgacaatgactgcaattcattctaaatgactgcaattcattactaatgactgcaattcatttgcggcgcgccatgcttcatcagactct

SEQ ID NO: 5147 - DNA, 191 bp, Artificial Sequence; identical to SEQ ID NO: 5146
  Synthetic polynucleotide

SEQ ID NO: 5148 - DNA, 172 bp, Artificial Sequence
  Synthetic polynucleotide
atcatctcaccttgcctcctgagagtgcggcgttatcgcctgcaggtgctaccgttagatgctaccgtttcgtgctaccgttgactgctaccgttctatgctaccgttacttgctaccgtttgctgctaccgttgtatgctaccgttggcgcgccatgcttcatcagactct

SEQ ID NO: 5149 - DNA, 172 bp, Artificial Sequence; identical to SEQ ID NO: 5148
  Synthetic polynucleotide

SEQ ID NO: 5150 - DNA, 190 bp, Artificial Sequence
  Synthetic polynucleotide
atcatctcaccttgcctcctgagatgatcggtctgggtcctgcaggccatataaggcaaaagaccatataaggcaaatcgccatataaggcaaagacccatataaggcaaactaccatataaggcaaaactccatataaggcaaatgcccatataaggcaaagtaggcgcgccatgcttcatcagactct

SEQ ID NO: 5151 - DNA, 190 bp, Artificial Sequence; identical to SEQ ID NO: 5150
  Synthetic polynucleotide

SEQ ID NO: 5152 - DNA, 172 bp, Artificial Sequence
  Synthetic polynucleotide
atcatctcaccttgcctcctgcttcgcataacccttatcctgcaggccacagcaggagaccacagcaggtcgccacagcagggacccacagcaggctaccacagcaggactccacagcaggtgcccacagcagggtaccacagcaggggcgcgccatgcttcatcagactct

SEQ ID NO: 5153 - DNA, 172 bp, Artificial Sequence; identical to SEQ ID NO: 5152
  Synthetic polynucleotide

SEQ ID NO: 5154 - DNA, 197 bp, Artificial Sequence
  Synthetic polynucleotide
atcatctcaccttgcctcctgaggtgtctatccaactgcctgcaggaaagaggaagtgaaaagaaaagaggaagtgaaatcgaaagaggaagtgaaagacaaagaggaagtgaaactaaaagaggaagtgaaaactaaagaggaagtgaaatgcaaagaggaagtgaaagtaggcgcgccatgcttcatcagactct

SEQ ID NO: 5155 - DNA, 197 bp, Artificial Sequence; identical to SEQ ID NO: 5154
  Synthetic polynucleotide

SEQ ID NO: 5156 - DNA, 188 bp, Artificial Sequence
  Synthetic polynucleotide
atcatctcaccttgcctcctgatgtctgatgctcaagtcctgcagggaaatccccagcagagaaatccccagctcggaaatccccagcgacgaaatccccagcctagaaatccccagcactgaaatccccagctgcgaaatccccagcgtagaaatccccagcggcgcgccatgcttcatcagactct

SEQ ID NO: 5157 - DNA, 188 bp, Artificial Sequence; identical to SEQ ID NO: 5156
  Synthetic polynucleotide

SEQ ID NO: 5158 - DNA, 196 bp, Artificial Sequence
  Synthetic polynucleotide
atcatctcaccttgcctcctggacacacgttcgttgggcctgcaggttacttccgggttagattacttccgggtttcgttacttccgggttgacttacttccgggttctattacttccgggttactttacttccgggtttgcttacttccgggttgtattacttccgggttggcgcgccatgcttcatcagactct

SEQ ID NO: 5159 - DNA, 196 bp, Artificial Sequence; identical to SEQ ID NO: 5158
  Synthetic polynucleotide

SEQ ID NO: 5160 - DNA, 156 bp, Artificial Sequence
  Synthetic polynucleotide
atcatctcaccttgcctcctgtcctggtcacgttagtgcctgcaggccacacccagaccacaccctcgccacacccgacccacacccctaccacacccactccacaccctgcccacacccgtaccacacccggcgcgccatgcttcatcagactct

SEQ ID NO: 5161 - DNA, 156 bp, Artificial Sequence; identical to SEQ ID NO: 5160
  Synthetic polynucleotide

SEQ ID NO: 5162 - DNA, 180 bp, Artificial Sequence
  Synthetic polynucleotide
atcatctcaccttgcctcctgcaccgccaaagagaatccctgcaggacaggtgttttagaacaggtgtttttcgacaggtgttttgacacaggtgttttctaacaggtgttttactacaggtgtttttgcacaggtgttttgtaacaggtgttttggcgcgccatgcttcatcagactct

SEQ ID NO: 5163 - DNA, 180 bp, Artificial Sequence; identical to SEQ ID NO: 5162
  Synthetic polynucleotide

SEQ ID NO: 5164 - DNA, 185 bp, Artificial Sequence
  Synthetic polynucleotide
atcatctcaccttgcctcctgacctcataagatcctgtcctgcaggttttagaacaattgaaagattttagaacaattgaatcgttttagaacaattgaagacttttagaacaattgaactattttagaacaattgaaactttttagaacaattgaatgcggcgcgccatgcttcatcagactct

SEQ ID NO: 5165 - DNA, 185 bp, Artificial Sequence; identical to SEQ ID NO: 5164
  Synthetic polynucleotide

SEQ ID NO: 5166 - DNA, 156 bp, Artificial Sequence
  Synthetic polynucleotide
atcatctcaccttgcctcctgcctcatgtgttaggcgtcctgcagggacttcctagagacttccttcggacttcctgacgacttcctctagacttcctactgacttccttgcgacttcctgtagacttcctggcgcgccatgcttcatcagactct

SEQ ID NO: 5167 - DNA, 156 bp, Artificial Sequence; identical to SEQ ID NO: 5166
  Synthetic polynucleotide

SEQ ID NO: 5168 - DNA, 164 bp, Artificial Sequence
  Synthetic polynucleotide
atcatctcaccttgcctcctgataatcaccgacacacccctgcaggtctcccaaaagatctcccaaatcgtctcccaaagactctcccaaactatctcccaaaacttctcccaaatgctctcccaaagtatctcccaaaggcgcgccatgcttcatcagactct

SEQ ID NO: 5169 - DNA, 164 bp, Artificial Sequence; identical to SEQ ID NO: 5168
  Synthetic polynucleotide

SEQ ID NO: 5170 - DNA, 191 bp, Artificial Sequence
  Synthetic polynucleotide
atcatctcaccttgcctcctgctcaggtccattaagctcctgcaggagcgctaattggtcttcagaagcgctaattggtcttctcgagcgctaattggtcttcgacagcgctaattggtcttcctaagcgctaattggtcttcactagcgctaattggtcttctgcggcgcgccatgcttcatcagactct

SEQ ID NO: 5171 - DNA, 191 bp, Artificial Sequence; identical to SEQ ID NO: 5170
  Synthetic polynucleotide

SEQ ID NO: 5172 - DNA, 172 bp, Artificial Sequence
  Synthetic polynucleotide
atcatctcaccttgcctcctgatatcagttaccacgagcctgcaggaattaattaaagaaattaattaatcgaattaattaagacaattaattaactaaattaattaaactaattaattaatgcaattaattaagtaaattaattaaggcgcgccatgcttcatcagactct

SEQ ID NO: 5173 - DNA, 172 bp, Artificial Sequence; identical to SEQ ID NO: 5172
  Synthetic polynucleotide

SEQ ID NO: 5174 - DNA, 196 bp, Artificial Sequence
  Synthetic polynucleotide
atcatctcaccttgcctcctgactctaccctaacggtccctgcaggtaattgccaattaagataattgccaattatcgtaattgccaattagactaattgccaattactataattgccaattaacttaattgccaattatgctaattgccaattagtataattgccaattaggcgcgccatgcttcatcagactct

SEQ ID NO: 5175 - DNA, 196 bp, Artificial Sequence; identical to SEQ ID NO: 5174
  Synthetic polynucleotide

SEQ ID NO: 5176 - DNA, 188 bp, Artificial Sequence
  Synthetic polynucleotide
atcatctcaccttgcctcctgttgtgcgggtgaccctacctgcaggggcagacaggctagaggcagacaggcttcgggcagacaggctgacggcagacaggctctaggcagacaggctactggcagacaggcttgcggcagacaggctgtaggcagacaggctggcgcgccatgcttcatcagactct

SEQ ID NO: 5177 - DNA, 188 bp, Artificial Sequence; identical to SEQ ID NO: 5176
  Synthetic polynucleotide

SEQ ID NO: 5178 - DNA, 172 bp, Artificial Sequence
  Synthetic polynucleotide
atcatctcaccttgcctcctgagctaccggccaaatggcctgcaggaattaattagagaaattaattagtcgaattaattaggacaattaattagctaaattaattagactaattaattagtgcaattaattaggtaaattaattagggcgcgccatgcttcatcagactct

SEQ ID NO: 5179 - DNA, 172 bp, Artificial Sequence; identical to SEQ ID NO: 5178
  Synthetic polynucleotide

SEQ ID NO: 5180 - DNA, 172 bp, Artificial Sequence
  Synthetic polynucleotide
atcatctcaccttgcctcctgagatagcgcagccatgtcctgcaggatcatgtaatagaatcatgtaattcgatcatgtaatgacatcatgtaatctaatcatgtaatactatcatgtaattgcatcatgtaatgtaatcatgtaatggcgcgccatgcttcatcagactct

SEQ ID NO: 5181 - DNA, 172 bp, Artificial Sequence; identical to SEQ ID NO: 5180
  Synthetic polynucleotide

SEQ ID NO: 5182 - DNA, 180 bp, Artificial Sequence
  Synthetic polynucleotide
atcatctcaccttgcctcctgcattctcgaggcagtgccctgcagggccgccattatagagccgccattattcggccgccattatgacgccgccattatctagccgccattatactgccgccattattgcgccgccattatgtagccgccattatggcgcgccatgcttcatcagactct

SEQ ID NO: 5183 - DNA, 180 bp, Artificial Sequence; identical to SEQ ID NO: 5182
  Synthetic polynucleotide

SEQ ID NO: 5184 - DNA, 183 bp, Artificial Sequence
  Synthetic polynucleotide
atcatctcaccttgcctcctggtgcttcacaatcaacccctgcaggatttcacacctaggtgtcactatgtagaatttcacacctaggtgtcactatgttcgatttcacacctaggtgtcactatgtgacatttcacacctaggtgtcactatgtctaggcgcgccatgcttcatcagactct

SEQ ID NO: 5185 - DNA, 183 bp, Artificial Sequence; identical to SEQ ID NO: 5184
  Synthetic polynucleotide

SEQ ID NO: 5186 - DNA, 180 bp, Artificial Sequence
  Synthetic polynucleotide
atcatctcaccttgcctcctgtaatggacgtcgaccgtcctgcaggaccatctgccgagaaccatctgccgtcgaccatctgccggacaccatctgccgctaaccatctgccgactaccatctgccgtgcaccatctgccggtaaccatctgccgggcgcgccatgcttcatcagactct

SEQ ID NO: 5187 - DNA, 180 bp, Artificial Sequence; identical to SEQ ID NO: 5186
  Synthetic polynucleotide

SEQ ID NO: 5188 - DNA, 191 bp, Artificial Sequence
  Synthetic polynucleotide
atcatctcaccttgcctcctgcaagtatcactcacgcacctgcaggaatccctttgatctatcagaaatccctttgatctatctcgaatccctttgatctatcgacaatccctttgatctatcctaaatccctttgatctatcactaatccctttgatctatctgcggcgcgccatgcttcatcagactct

SEQ ID NO: 5189 - DNA, 191 bp, Artificial Sequence; identical to SEQ ID NO: 5188
  Synthetic polynucleotide

SEQ ID NO: 5190 - DNA, 132 bp, Artificial Sequence
  Synthetic polynucleotide
atcatctcaccttgcctcctgaagcctgtggttgaccacctgcaggggataagaggatatcgggatagacggatactaggataactggatatgcggatagtaggataggcgcgccatgcttcatcagactct

SEQ ID NO: 5191 - DNA, 132 bp, Artificial Sequence; identical to SEQ ID NO: 5190
  Synthetic polynucleotide

SEQ ID NO: 5192 - DNA, 172 bp, Artificial Sequence
  Synthetic polynucleotide
atcatctcaccttgcctcctggatacaggttgttgagccctgcagggttaattagaagagttaattagatcggttaattagagacgttaattagactagttaattagaactgttaattagatgcgttaattagagtagttaattagaggcgcgccatgcttcatcagactct

SEQ ID NO: 5193 - DNA, 172 bp, Artificial Sequence; identical to SEQ ID NO: 5192
  Synthetic polynucleotide

SEQ ID NO: 5194 - DNA, 164 bp, Artificial Sequence
  Synthetic polynucleotide
atcatctcaccttgcctcctggcattcggccttagcagcctgcaggtgacctttgagatgacctttgtcgtgacctttggactgacctttgctatgacctttgacttgacctttgtgctgacctttggtatgacctttgggcgcgccatgcttcatcagactct

SEQ ID NO: 5195 - DNA, 164 bp, Artificial Sequence; identical to SEQ ID NO: 5194
  Synthetic polynucleotide

SEQ ID NO: 5196 - DNA, 185 bp, Artificial Sequence
  Synthetic polynucleotide
atcatctcaccttgcctcctgcactgtcgtattctgtacctgcaggcgttgccatggcaacgagacgttgccatggcaacgtcgcgttgccatggcaacggaccgttgccatggcaacgctacgttgccatggcaacgactcgttgccatggcaacgtgcggcgcgccatgcttcatcagactct

SEQ ID NO: 5197 - DNA, 185 bp, Artificial Sequence; identical to SEQ ID NO: 5196
  Synthetic polynucleotide

SEQ ID NO: 5198 - DNA, 186 bp, Artificial Sequence
  Synthetic polynucleotide
atcatctcaccttgcctcctgaatgaacagcgagacaccctgcaggaatggaaaattattttccctagaaatggaaaattattttcccttcgaatggaaaattattttccctgacaatggaaaattattttccctctaaatggaaaattattttccctactggcgcgccatgcttcatcagactct

SEQ ID NO: 5199 - DNA, 186 bp, Artificial Sequence; identical to SEQ ID NO: 5198
  Synthetic polynucleotide

SEQ ID NO: 5200 - DNA, 172 bp, Artificial Sequence
  Synthetic polynucleotide
atcatctcaccttgcctcctggggcgtctttaacctcacctgcagggttaattagcagagttaattagctcggttaattagcgacgttaattagcctagttaattagcactgttaattagctgcgttaattagcgtagttaattagcggcgcgccatgcttcatcagactct

SEQ ID NO: 5201 - DNA, 172 bp, Artificial Sequence; identical to SEQ ID NO: 5200
  Synthetic polynucleotide

SEQ ID NO: 5202 - DNA, 185 bp, Artificial Sequence
  Synthetic polynucleotide
atcatctcaccttgcctcctgctatttgttccgtcctacctgcaggatacgcccacgcatttagaatacgcccacgcattttcgatacgcccacgcatttgacatacgcccacgcatttctaatacgcccacgcatttactatacgcccacgcattttgcggcgcgccatgcttcatcagactct

SEQ ID NO: 5203 - DNA, 185 bp, Artificial Sequence; identical to SEQ ID NO: 5202
  Synthetic polynucleotide

SEQ ID NO: 5204 - DNA, 196 bp, Artificial Sequence
  Synthetic polynucleotide
atcatctcaccttgcctcctggtcggaagatcaagaaccctgcaggtgacctttggcctagatgacctttggccttcgtgacctttggcctgactgacctttggcctctatgacctttggcctacttgacctttggccttgctgacctttggcctgtatgacctttggcctggcgcgccatgcttcatcagactct

SEQ ID NO: 5205 - DNA, 196 bp, Artificial Sequence; identical to SEQ ID NO: 5204
  Synthetic polynucleotide

SEQ ID NO: 5206 - DNA, 164 bp, Artificial Sequence
  Synthetic polynucleotide
atcatctcaccttgcctcctgtcgtatccaaggctgcgcctgcaggggataatccagaggataatcctcgggataatccgacggataatccctaggataatccactggataatcctgcggataatccgtaggataatccggcgcgccatgcttcatcagactct

SEQ ID NO: 5207 - DNA, 164 bp, Artificial Sequence; identical to SEQ ID NO: 5206
  Synthetic polynucleotide

SEQ ID NO: 5208 - DNA, 164 bp, Artificial Sequence
  Synthetic polynucleotide
atcatctcaccttgcctcctggggtccgcaagtacttccctgcagggagatagggagagagatagggtcggagataggggacgagatagggctagagatagggactgagatagggtgcgagataggggtagagatagggggcgcgccatgcttcatcagactct

SEQ ID NO: 5209 - DNA, 164 bp, Artificial Sequence; identical to SEQ ID NO: 5208
  Synthetic polynucleotide

SEQ ID NO: 5210 - DNA, 164 bp, Artificial Sequence
  Synthetic polynucleotide
atcatctcaccttgcctcctgagaaaccagtatttgtgcctgcaggtgtggcctaagatgtggcctatcgtgtggcctagactgtggcctactatgtggcctaacttgtggcctatgctgtggcctagtatgtggcctaggcgcgccatgcttcatcagactct

SEQ ID NO: 5211 - DNA, 164 bp, Artificial Sequence; identical to SEQ ID NO: 5210
  Synthetic polynucleotide

SEQ ID NO: 5212 - DNA, 156 bp, Artificial Sequence
  Synthetic polynucleotide
atcatctcaccttgcctcctgtcaccgaacacgcaactcctgcaggtttattaaagatttattaatcgtttattaagactttattaactatttattaaacttttattaatgctttattaagtatttattaaggcgcgccatgcttcatcagactct

SEQ ID NO: 5213 - DNA, 156 bp, Artificial Sequence; identical to SEQ ID NO: 5212
  Synthetic polynucleotide

SEQ ID NO: 5214 - DNA, 185 bp, Artificial Sequence
  Synthetic polynucleotide
atcatctcaccttgcctcctgcaataaatgttcaggcgcctgcagggaagtaattaattactagagaagtaattaattacttcggaagtaattaattactgacgaagtaattaattactctagaagtaattaattactactgaagtaattaattacttgcggcgcgccatgcttcatcagactct

SEQ ID NO: 5215 - DNA, 185 bp, Artificial Sequence; identical to SEQ ID NO: 5214
  Synthetic polynucleotide

SEQ ID NO: 5216 - DNA, 185 bp, Artificial Sequence
  Synthetic polynucleotide
atcatctcaccttgcctcctgtcccgaattcgagagtgcctgcagggcctgaactggccagaagagcctgaactggccagatcggcctgaactggccagagacgcctgaactggccagactagcctgaactggccagaactgcctgaactggccagatgcggcgcgccatgcttcatcagactct

SEQ ID NO: 5217 - DNA, 185 bp, Artificial Sequence; identical to SEQ ID NO: 5216
  Synthetic polynucleotide

SEQ ID NO: 5218 - DNA, 185 bp, Artificial Sequence
  Synthetic polynucleotide
atcatctcaccttgcctcctgcgagtggcaaggagtctcctgcaggacgactaattaggagtagaacgactaattaggagttcgacgactaattaggagtgacacgactaattaggagtctaacgactaattaggagtactacgactaattaggagttgcggcgcgccatgcttcatcagactct

SEQ ID NO: 5219 - DNA, 185 bp, Artificial Sequence; identical to SEQ ID NO: 5218
  Synthetic polynucleotide

SEQ ID NO: 5220 - DNA, 185 bp, Artificial Sequence
  Synthetic polynucleotide
atcatctcaccttgcctcctgagcctccatccttaccccctgcaggcgttgccatggcaaccagacgttgccatggcaacctcgcgttgccatggcaaccgaccgttgccatggcaaccctacgttgccatggcaaccactcgttgccatggcaacctgcggcgcgccatgcttcatcagactct

SEQ ID NO: 5221 - DNA, 185 bp, Artificial Sequence; identical to SEQ ID NO: 5220
  Synthetic polynucleotide

SEQ ID NO: 5222 - DNA, 188 bp, Artificial Sequence
  Synthetic polynucleotide
atcatctcaccttgcctcctgatactatgggacgtatccctgcagggcccatatatggagagcccatatatggtcggcccatatatgggacgcccatatatggctagcccatatatggactgcccatatatggtgcgcccatatatgggtagcccatatatggggcgcgccatgcttcatcagactct

SEQ ID NO: 5223 - DNA, 188 bp, Artificial Sequence; identical to SEQ ID NO: 5222
  Synthetic polynucleotide

SEQ ID NO: 5224 - DNA, 156 bp, Artificial Sequence
  Synthetic polynucleotide
atcatctcaccttgcctcctgcattgatatttggaacgcctgcaggtgacgtggagatgacgtggtcgtgacgtgggactgacgtggctatgacgtggacttgacgtggtgctgacgtgggtatgacgtggggcgcgccatgcttcatcagactct

SEQ ID NO: 5225 - DNA, 156 bp, Artificial Sequence; identical to SEQ ID NO: 5224
  Synthetic polynucleotide

SEQ ID NO: 5226 - DNA, 164 bp, Artificial Sequence
  Synthetic polynucleotide
atcatctcaccttgcctcctggagacatccgtgaaatgcctgcaggattgttttgagaattgttttgtcgattgttttggacattgttttgctaattgttttgactattgttttgtgcattgttttggtaattgttttgggcgcgccatgcttcatcagactct

SEQ ID NO: 5227 - DNA, 164 bp, Artificial Sequence; identical to SEQ ID NO: 5226
  Synthetic polynucleotide

SEQ ID NO: 5228 - DNA, 180 bp, Artificial Sequence
  Synthetic polynucleotide
atcatctcaccttgcctcctgtctgatccgtcagcggacctgcaggcatgcgggtacagacatgcgggtactcgcatgcgggtacgaccatgcgggtacctacatgcgggtacactcatgcgggtactgccatgcgggtacgtacatgcgggtacggcgcgccatgcttcatcagactct

SEQ ID NO: 5229 - DNA, 180 bp, Artificial Sequence; identical to SEQ ID NO: 5228
  Synthetic polynucleotide

SEQ ID NO: 5230 - DNA, 164 bp, Artificial Sequence
  Synthetic polynucleotide
atcatctcaccttgcctcctgaagggctctgtgtctgacctgcaggaacatatggagaaacatatggtcgaacatatgggacaacatatggctaaacatatggactaacatatggtgcaacatatgggtaaacatatggggcgcgccatgcttcatcagactct

SEQ ID NO: 5231 - DNA, 164 bp, Artificial Sequence; identical to SEQ ID NO: 5230
  Synthetic polynucleotide

SEQ ID NO: 5232 - DNA, 172 bp, Artificial Sequence
  Synthetic polynucleotide
atcatctcaccttgcctcctgtagcgcatgggtgctcacctgcaggtgttatctgcagatgttatctgctcgtgttatctgcgactgttatctgcctatgttatctgcacttgttatctgctgctgttatctgcgtatgttatctgcggcgcgccatgcttcatcagactct

SEQ ID NO: 5233 - DNA, 172 bp, Artificial Sequence; identical to SEQ ID NO: 5232
  Synthetic polynucleotide

SEQ ID NO: 5234 - DNA, 191 bp, Artificial Sequence
  Synthetic polynucleotide
atcatctcaccttgcctcctgctagatcgttagctgtccctgcaggtaaatacatgtaaaattagataaatacatgtaaaatttcgtaaatacatgtaaaattgactaaatacatgtaaaattctataaatacatgtaaaattacttaaatacatgtaaaatttgcggcgcgccatgcttcatcagactct

SEQ ID NO: 5235 - DNA, 191 bp, Artificial Sequence; identical to SEQ ID NO: 5234
  Synthetic polynucleotide

SEQ ID NO: 5236 - DNA, 180 bp, Artificial Sequence
  Synthetic polynucleotide
atcatctcaccttgcctcctgtatcagttccgcgaacccctgcaggcaaaggtcagaagacaaaggtcagatcgcaaaggtcagagaccaaaggtcagactacaaaggtcagaactcaaaggtcagatgccaaaggtcagagtacaaaggtcagaggcgcgccatgcttcatcagactct

SEQ ID NO: 5237 - DNA, 180 bp, Artificial Sequence; identical to SEQ ID NO: 5236
  Synthetic polynucleotide

SEQ ID NO: 5238 - DNA, 164 bp, Artificial Sequence
  Synthetic polynucleotide
atcatctcaccttgcctcctgtacgaattagcgagtctcctgcaggattgttttcagaattgttttctcgattgttttcgacattgttttcctaattgttttcactattgttttctgcattgttttcgtaattgttttcggcgcgccatgcttcatcagactct

SEQ ID NO: 5239 - DNA, 164 bp, Artificial Sequence; identical to SEQ ID NO: 5238
  Synthetic polynucleotide

SEQ ID NO: 5240 - DNA, 200 bp, Artificial Sequence
  Synthetic polynucleotide
atcatctcaccttgcctcctgagaaattccagtgccatcctgcagggaacccattgttcttttccagagaacccattgttcttttcctcggaacccattgttcttttccgacgaacccattgttcttttccctagaacccattgttcttttccactgaacccattgttcttttccggcgcgccatgcttcatcagactct

SEQ ID NO: 5241 - DNA, 200 bp, Artificial Sequence; identical to SEQ ID NO: 5240
  Synthetic polynucleotide

SEQ ID NO: 5242 - DNA, 197 bp, Artificial Sequence
  Synthetic polynucleotide
atcatctcaccttgcctcctggccttaacgaaggtttccctgcaggataaaggcgcgcgatagaataaaggcgcgcgattcgataaaggcgcgcgatgacataaaggcgcgcgatctaataaaggcgcgcgatactataaaggcgcgcgattgcataaaggcgcgcgatgtaggcgcgccatgcttcatcagactct

SEQ ID NO: 5243 - DNA, 197 bp, Artificial Sequence; identical to SEQ ID NO: 5242
  Synthetic polynucleotide

SEQ ID NO: 5244 - DNA, 191 bp, Artificial Sequence
  Synthetic polynucleotide
atcatctcaccttgcctcctgagagcactcagagcagtcctgcaggtgattattgatgggtgaagatgattattgatgggtgatcgtgattattgatgggtgagactgattattgatgggtgactatgattattgatgggtgaacttgattattgatgggtgatgcggcgcgccatgcttcatcagactct

SEQ ID NO: 5245 - DNA, 191 bp, Artificial Sequence; identical to SEQ ID NO: 5244
  Synthetic polynucleotide

SEQ ID NO: 5246 - DNA, 195 bp, Artificial Sequence
  Synthetic polynucleotide
atcatctcaccttgcctcctgtgatttcttaaaggacgcctgcaggggggcggctacgcatcattgcgcctcgaagaggggcggctacgcatcattgcgcctcgatcgggggcggctacgcatcattgcgcctcgagacggggcggctacgcatcattgcgcctcgactaggcgcgccatgcttcatcagactct

SEQ ID NO: 5247 - DNA, 195 bp, Artificial Sequence; identical to SEQ ID NO: 5246
  Synthetic polynucleotide

SEQ ID NO: 5248 - DNA, 164 bp, Artificial Sequence
  Synthetic polynucleotide
atcatctcaccttgcctcctgcctaaacggaccgggtacctgcaggattgcgtaaagaattgcgtaatcgattgcgtaagacattgcgtaactaattgcgtaaactattgcgtaatgcattgcgtaagtaattgcgtaaggcgcgccatgcttcatcagactct

SEQ ID NO: 5249 - DNA, 164 bp, Artificial Sequence; identical to SEQ ID NO: 5248
  Synthetic polynucleotide

SEQ ID NO: 5250 - DNA, 190 bp, Artificial Sequence
  Synthetic polynucleotide
atcatctcaccttgcctcctggcttgcctgtggtcagtcctgcaggcattgtaatgcaaaagacattgtaatgcaaatcgcattgtaatgcaaagaccattgtaatgcaaactacattgtaatgcaaaactcattgtaatgcaaatgccattgtaatgcaaagtaggcgcgccatgcttcatcagactct

SEQ ID NO: 5251 - DNA, 190 bp, Artificial Sequence; identical to SEQ ID NO: 5250
  Synthetic polynucleotide

SEQ ID NO: 5252 - DNA, 164 bp, Artificial Sequence
  Synthetic polynucleotide
atcatctcaccttgcctcctgttgattctcttcgcacgcctgcaggattgttttaagaattgttttatcgattgttttagacattgttttactaattgttttaactattgttttatgcattgttttagtaattgttttaggcgcgccatgcttcatcagactct

SEQ ID NO: 5253 - DNA, 164 bp, Artificial Sequence; identical to SEQ ID NO: 5252
  Synthetic polynucleotide

SEQ ID NO: 5254 - DNA, 188 bp, Artificial Sequence
  Synthetic polynucleotide
atcatctcaccttgcctcctgcacatcgaaagtcgagacctgcaggatgaatatgcaaagaatgaatatgcaatcgatgaatatgcaagacatgaatatgcaactaatgaatatgcaaactatgaatatgcaatgcatgaatatgcaagtaatgaatatgcaaggcgcgccatgcttcatcagactct

SEQ ID NO: 5255 - DNA, 188 bp, Artificial Sequence; identical to SEQ ID NO: 5254
  Synthetic polynucleotide

SEQ ID NO: 5256 - DNA, 172 bp, Artificial Sequence
  Synthetic polynucleotide
atcatctcaccttgcctcctgcagcaatacaaccaagacctgcaggcgccatgtttagacgccatgttttcgcgccatgtttgaccgccatgtttctacgccatgtttactcgccatgttttgccgccatgtttgtacgccatgtttggcgcgccatgcttcatcagactct

SEQ ID NO: 5257 - DNA, 172 bp, Artificial Sequence; identical to SEQ ID NO: 5256
  Synthetic polynucleotide

SEQ ID NO: 5258 - DNA, 180 bp, Artificial Sequence
  Synthetic polynucleotide
atcatctcaccttgcctcctgggcgacgaaactggatacctgcaggagcaattaaaaagaagcaattaaaatcgagcaattaaaagacagcaattaaaactaagcaattaaaaactagcaattaaaatgcagcaattaaaagtaagcaattaaaaggcgcgccatgcttcatcagactct

SEQ ID NO: 5259 - DNA, 180 bp, Artificial Sequence; identical to SEQ ID NO: 5258
  Synthetic polynucleotide

SEQ ID NO: 5260 - DNA, 191 bp, Artificial Sequence
  Synthetic polynucleotide
atcatctcaccttgcctcctgtgttacggatgatcgcccctgcaggcgaagtaattaattttcagacgaagtaattaattttctcgcgaagtaattaattttcgaccgaagtaattaattttcctacgaagtaattaattttcactcgaagtaattaattttctgcggcgcgccatgcttcatcagactct

SEQ ID NO: 5261 - DNA, 191 bp, Artificial Sequence; identical to SEQ ID NO: 5260
  Synthetic polynucleotide

SEQ ID NO: 5262 - DNA, 197 bp, Artificial Sequence
  Synthetic polynucleotide
atcatctcaccttgcctcctggccgcacttccagtatccctgcaggtgtccgtggtgctgaagatgtccgtggtgctgatcgtgtccgtggtgctgagactgtccgtggtgctgactatgtccgtggtgctgaacttgtccgtggtgctgatgctgtccgtggtgctgagtaggcgcgccatgcttcatcagactct

SEQ ID NO: 5263 - DNA, 197 bp, Artificial Sequence; identical to SEQ ID NO: 5262
  Synthetic polynucleotide

SEQ ID NO: 5264 - DNA, 185 bp, Artificial Sequence
  Synthetic polynucleotide
atcatctcaccttgcctcctggacttcaagatagttctcctgcaggggtgtgatatcacaccagaggtgtgatatcacacctcgggtgtgatatcacaccgacggtgtgatatcacaccctaggtgtgatatcacaccactggtgtgatatcacacctgcggcgcgccatgcttcatcagactct

SEQ ID NO: 5265 - DNA, 185 bp, Artificial Sequence; identical to SEQ ID NO: 5264
  Synthetic polynucleotide

SEQ ID NO: 5266 - DNA, 164 bp, Artificial Sequence
  Synthetic polynucleotide
atcatctcaccttgcctcctgatttaccgtgtgttctccctgcagggccaattaaagagccaattaatcggccaattaagacgccaattaactagccaattaaactgccaattaatgcgccaattaagtagccaattaaggcgcgccatgcttcatcagactct

SEQ ID NO: 5267 - DNA, 164 bp, Artificial Sequence; identical to SEQ ID NO: 5266
  Synthetic polynucleotide

SEQ ID NO: 5268 - DNA, 172 bp, Artificial Sequence
  Synthetic polynucleotide
atcatctcaccttgcctcctgtgtattgcgtgaccgtgcctgcagggttaattagtagagttaattagttcggttaattagtgacgttaattagtctagttaattagtactgttaattagttgcgttaattagtgtagttaattagtggcgcgccatgcttcatcagactct

SEQ ID NO: 5269 - DNA, 172 bp, Artificial Sequence; identical to SEQ ID NO: 5268
  Synthetic polynucleotide

SEQ ID NO: 5270 - DNA, 191 bp, Artificial Sequence
  Synthetic polynucleotide
atcatctcaccttgcctcctgacccagaatgtctggctcctgcagggggaacattatgtacccagagggaacattatgtaccctcggggaacattatgtacccgacgggaacattatgtacccctagggaacattatgtacccactgggaacattatgtaccctgcggcgcgccatgcttcatcagactct

SEQ ID NO: 5271 - DNA, 191 bp, Artificial Sequence; identical to SEQ ID NO: 5270
  Synthetic polynucleotide

SEQ ID NO: 5272 - DNA, 188 bp, Artificial Sequence
  Synthetic polynucleotide
atcatctcaccttgcctcctgtattaggtgatacgacgcctgcagggtccctggggacagagtccctggggactcggtccctggggacgacgtccctggggacctagtccctggggacactgtccctggggactgcgtccctggggacgtagtccctggggacggcgcgccatgcttcatcagactct

SEQ ID NO: 5273 - DNA, 188 bp, Artificial Sequence; identical to SEQ ID NO: 5272
  Synthetic polynucleotide

SEQ ID NO: 5274 - DNA, 197 bp, Artificial Sequence
  Synthetic polynucleotide
atcatctcaccttgcctcctgatacgatagcgtcattacctgcaggaccagccaatcagagagaaccagccaatcagagtcgaccagccaatcagaggacaccagccaatcagagctaaccagccaatcagagactaccagccaatcagagtgcaccagccaatcagaggtaggcgcgccatgcttcatcagactct

SEQ ID NO: 5275 - DNA, 197 bp, Artificial Sequence; identical to SEQ ID NO: 5274
  Synthetic polynucleotide

SEQ ID NO: 5276 - DNA, 172 bp, Artificial Sequence
  Synthetic polynucleotide
atcatctcaccttgcctcctgctatcgaaagaggttcgcctgcagggggcgttgccagagggcgttgcctcggggcgttgccgacgggcgttgccctagggcgttgccactgggcgttgcctgcgggcgttgccgtagggcgttgccggcgcgccatgcttcatcagactct

SEQ ID NO: 5277 - DNA, 172 bp, Artificial Sequence; identical to SEQ ID NO: 5276
  Synthetic polynucleotide

SEQ ID NO: 5278 - DNA, 172 bp, Artificial Sequence
  Synthetic polynucleotide
atcatctcaccttgcctcctgcctctggctcaacccatcctgcagggcagataaggagagcagataaggtcggcagataagggacgcagataaggctagcagataaggactgcagataaggtgcgcagataagggtagcagataaggggcgcgccatgcttcatcagactct

SEQ ID NO: 5279 - DNA, 172 bp, Artificial Sequence; identical to SEQ ID NO: 5278
  Synthetic polynucleotide

SEQ ID NO: 5280 - DNA, 156 bp, Artificial Sequence
  Synthetic polynucleotide
atcatctcaccttgcctcctggcggaagactttcaaaccctgcagggcgcctttagagcgccttttcggcgcctttgacgcgcctttctagcgcctttactgcgccttttgcgcgcctttgtagcgcctttggcgcgccatgcttcatcagactct

SEQ ID NO: 5281 - DNA, 156 bp, Artificial Sequence; identical to SEQ ID NO: 5280
  Synthetic polynucleotide

SEQ ID NO: 5282 - DNA, 197 bp, Artificial Sequence
  Synthetic polynucleotide
atcatctcaccttgcctcctggtagtaaagcccttatacctgcaggcgttgctaggcaaccagacgttgctaggcaacctcgcgttgctaggcaaccgaccgttgctaggcaaccctacgttgctaggcaaccactcgttgctaggcaacctgccgttgctaggcaaccgtaggcgcgccatgcttcatcagactct

SEQ ID NO: 5283 - DNA, 197 bp, Artificial Sequence; identical to SEQ ID NO: 5282
  Synthetic polynucleotide

SEQ ID NO: 5284 - DNA, 197 bp, Artificial Sequence
  Synthetic polynucleotide
atcatctcaccttgcctcctgaacccaccgtagtggtacctgcaggtcactttcactttctagatcactttcactttcttcgtcactttcactttctgactcactttcactttctctatcactttcactttctacttcactttcactttcttgctcactttcactttctgtaggcgcgccatgcttcatcagactct

SEQ ID NO: 5285 - DNA, 197 bp, Artificial Sequence; identical to SEQ ID NO: 5284
  Synthetic polynucleotide

SEQ ID NO: 5286 - DNA, 185 bp, Artificial Sequence
  Synthetic polynucleotide
atcatctcaccttgcctcctgattccgatttgagccgacctgcaggaatttcaagtggcttaagaaatttcaagtggcttatcgaatttcaagtggcttagacaatttcaagtggcttactaaatttcaagtggcttaactaatttcaagtggcttatgcggcgcgccatgcttcatcagactct

SEQ ID NO: 5287 - DNA, 185 bp, Artificial Sequence; identical to SEQ ID NO: 5286
  Synthetic polynucleotide

SEQ ID NO: 5288 - DNA, 156 bp, Artificial Sequence
  Synthetic polynucleotide
atcatctcaccttgcctcctgcgtcttctgctcacatccctgcaggacgtaataagaacgtaatatcgacgtaatagacacgtaatactaacgtaataactacgtaatatgcacgtaatagtaacgtaataggcgcgccatgcttcatcagactct

SEQ ID NO: 5289 - DNA, 156 bp, Artificial Sequence; identical to SEQ ID NO: 5288
  Synthetic polynucleotide

SEQ ID NO: 5290 - DNA, 196 bp, Artificial Sequence
  Synthetic polynucleotide
atcatctcaccttgcctcctgaggtagagttagagatccctgcaggtttttgaaatgagagatttttgaaatgagtcgtttttgaaatgaggactttttgaaatgagctatttttgaaatgagacttttttgaaatgagtgctttttgaaatgaggtatttttgaaatgagggcgcgccatgcttcatcagactct

SEQ ID NO: 5291 - DNA, 196 bp, Artificial Sequence; identical to SEQ ID NO: 5290
  Synthetic polynucleotide

SEQ ID NO: 5292 - DNA, 196 bp, Artificial Sequence
  Synthetic polynucleotide
atcatctcaccttgcctcctgcttcaagggttgtggcgcctgcaggggccgtgatttcgagaggccgtgatttcgtcgggccgtgatttcggacggccgtgatttcgctaggccgtgatttcgactggccgtgatttcgtgcggccgtgatttcggtaggccgtgatttcgggcgcgccatgcttcatcagactct

SEQ ID NO: 5293 - DNA, 196 bp, Artificial Sequence; identical to SEQ ID NO: 5292
  Synthetic polynucleotide

SEQ ID NO: 5294 - DNA, 185 bp, Artificial Sequence
  Synthetic polynucleotide
atcatctcaccttgcctcctgggctttcgccaccataacctgcaggattcactaattactttagaattcactaattacttttcgattcactaattactttgacattcactaattactttctaattcactaattactttactattcactaattacttttgcggcgcgccatgcttcatcagactct

SEQ ID NO: 5295 - DNA, 185 bp, Artificial Sequence; identical to SEQ ID NO: 5294
  Synthetic polynucleotide

SEQ ID NO: 5296 - DNA, 180 bp, Artificial Sequence
  Synthetic polynucleotide
atcatctcaccttgcctcctggacgactggttggtgagcctgcaggtccacttaactagatccacttaacttcgtccacttaactgactccacttaactctatccacttaactacttccacttaacttgctccacttaactgtatccacttaactggcgcgccatgcttcatcagactct

SEQ ID NO: 5297 - DNA, 180 bp, Artificial Sequence; identical to SEQ ID NO: 5296
  Synthetic polynucleotide

SEQ ID NO: 5298 - DNA, 191 bp, Artificial Sequence
  Synthetic polynucleotide
atcatctcaccttgcctcctggtttagtcttggctgcgcctgcagggataattaattactttgagagataattaattactttgtcggataattaattactttggacgataattaattactttgctagataattaattactttgactgataattaattactttgtgcggcgcgccatgcttcatcagactct

SEQ ID NO: 5299 - DNA, 191 bp, Artificial Sequence; identical to SEQ ID NO: 5298
  Synthetic polynucleotide

SEQ ID NO: 5300 - DNA, 197 bp, Artificial Sequence
  Synthetic polynucleotide
atcatctcaccttgcctcctgtctcctgttctcacccacctgcaggcgttgctaggcaacgagacgttgctaggcaacgtcgcgttgctaggcaacggaccgttgctaggcaacgctacgttgctaggcaacgactcgttgctaggcaacgtgccgttgctaggcaacggtaggcgcgccatgcttcatcagactct

SEQ ID NO: 5301 - DNA, 197 bp, Artificial Sequence; identical to SEQ ID NO: 5300
  Synthetic polynucleotide

SEQ ID NO: 5302 - DNA, 190 bp, Artificial Sequence
  Synthetic polynucleotide
atcatctcaccttgcctcctgaggcacttgacccagaccctgcaggtgtaaatattgacaagatgtaaatattgacatcgtgtaaatattgacagactgtaaatattgacactatgtaaatattgacaacttgtaaatattgacatgctgtaaatattgacagtaggcgcgccatgcttcatcagactct

SEQ ID NO: 5303 - DNA, 190 bp, Artificial Sequence; identical to SEQ ID NO: 5302
  Synthetic polynucleotide

SEQ ID NO: 5304 - DNA, 191 bp, Artificial Sequence
  Synthetic polynucleotide
atcatctcaccttgcctcctgacgacaaagagtagtttcctgcagggtcacgtcaccgccgcgcgccagagtcacgtcaccgccgcgcgcctcggtcacgtcaccgccgcgcgccgacgtcacgtcaccgccgcgcgccctagtcacgtcaccgccgcgcgccactggcgcgccatgcttcatcagactct

SEQ ID NO: 5305 - DNA, 191 bp, Artificial Sequence; identical to SEQ ID NO: 5304
  Synthetic polynucleotide

SEQ ID NO: 5306 - DNA, 180 bp, Artificial Sequence
  Synthetic polynucleotide
atcatctcaccttgcctcctgcctcttggatgcctgttcctgcaggagaacaatgggagaagaacaatgggtcgagaacaatggggacagaacaatgggctaagaacaatgggactagaacaatgggtgcagaacaatggggtaagaacaatgggggcgcgccatgcttcatcagactct

SEQ ID NO: 5307 - DNA, 180 bp, Artificial Sequence; identical to SEQ ID NO: 5306
  Synthetic polynucleotide

SEQ ID NO: 5308 - DNA, 191 bp, Artificial Sequence
  Synthetic polynucleotide
atcatctcaccttgcctcctgggcagggctgagaattgcctgcaggattctttaattgcttgtagaattctttaattgcttgttcgattctttaattgcttgtgacattctttaattgcttgtctaattctttaattgcttgtactattctttaattgcttgttgcggcgcgccatgcttcatcagactct

SEQ ID NO: 5309 - DNA, 191 bp, Artificial Sequence; identical to SEQ ID NO: 5308
  Synthetic polynucleotide

SEQ ID NO: 5310 - DNA, 190 bp, Artificial Sequence
  Synthetic polynucleotide
atcatctcaccttgcctcctgatcagcaagatgctagtcctgcaggatcaaaggagccgaagaatcaaaggagccgatcgatcaaaggagccgagacatcaaaggagccgactaatcaaaggagccgaactatcaaaggagccgatgcatcaaaggagccgagtaggcgcgccatgcttcatcagactct

SEQ ID NO: 5311 - DNA, 190 bp, Artificial Sequence; identical to SEQ ID NO: 5310
  Synthetic polynucleotide

SEQ ID NO: 5312 - DNA, 197 bp, Artificial Sequence
  Synthetic polynucleotide
atcatctcaccttgcctcctggccacaaacacatcttccctgcagggaaggaagcggaagaagagaaggaagcggaagatcggaaggaagcggaagagacgaaggaagcggaagactagaaggaagcggaagaactgaaggaagcggaagatgcgaaggaagcggaagagtaggcgcgccatgcttcatcagactct

SEQ ID NO: 5313 - DNA, 197 bp, Artificial Sequence; identical to SEQ ID NO: 5312
  Synthetic polynucleotide

SEQ ID NO: 5314 - DNA, 164 bp, Artificial Sequence
  Synthetic polynucleotide
atcatctcaccttgcctcctggtgtgtcataccttatccctgcaggccattgttcagaccattgttctcgccattgttcgacccattgttcctaccattgttcactccattgttctgcccattgttcgtaccattgttcggcgcgccatgcttcatcagactct

SEQ ID NO: 5315 - DNA, 164 bp, Artificial Sequence; identical to SEQ ID NO: 5314
  Synthetic polynucleotide

SEQ ID NO: 5316 - DNA, 172 bp, Artificial Sequence
  Synthetic polynucleotide
atcatctcaccttgcctcctgaacagcgctccttaaagcctgcaggtttgacttttagatttgactttttcgtttgacttttgactttgacttttctatttgacttttacttttgactttttgctttgacttttgtatttgacttttggcgcgccatgcttcatcagactct

SEQ ID NO: 5317 - DNA, 172 bp, Artificial Sequence; identical to SEQ ID NO: 5316
  Synthetic polynucleotide

SEQ ID NO: 5318 - DNA, 148 bp, Artificial Sequence
  Synthetic polynucleotide
atcatctcaccttgcctcctggggtggttgagtaagaacctgcaggtgactcaagatgactcatcgtgactcagactgactcactatgactcaacttgactcatgctgactcagtatgactcaggcgcgccatgcttcatcagactct

SEQ ID NO: 5319 - DNA, 148 bp, Artificial Sequence; identical to SEQ ID NO: 5318
  Synthetic polynucleotide

SEQ ID NO: 5320 - DNA, 196 bp, Artificial Sequence
  Synthetic polynucleotide
atcatctcaccttgcctcctgcggtcgccttcataatgcctgcaggaaattgttacattagaaaattgttacatttcgaaattgttacattgacaaattgttacattctaaaattgttacattactaaattgttacatttgcaaattgttacattgtaaaattgttacattggcgcgccatgcttcatcagactct

SEQ ID NO: 5321 - DNA, 196 bp, Artificial Sequence; identical to SEQ ID NO: 5320
  Synthetic polynucleotide

SEQ ID NO: 5322 - DNA, 197 bp, Artificial Sequence
  Synthetic polynucleotide
atcatctcaccttgcctcctgttaggagcctgtgtgtccctgcaggccatcaatcaatttaagaccatcaatcaatttatcgccatcaatcaatttagacccatcaatcaatttactaccatcaatcaatttaactccatcaatcaatttatgcccatcaatcaatttagtaggcgcgccatgcttcatcagactct

SEQ ID NO: 5323 - DNA, 197 bp, Artificial Sequence; identical to SEQ ID NO: 5322
  Synthetic polynucleotide

SEQ ID NO: 5324 - DNA, 190 bp, Artificial Sequence
  Synthetic polynucleotide
atcatctcaccttgcctcctgggccttgtgagaatagacctgcaggtccagatgtttcgcagatccagatgtttcgctcgtccagatgtttcgcgactccagatgtttcgcctatccagatgtttcgcacttccagatgtttcgctgctccagatgtttcgcgtaggcgcgccatgcttcatcagactct

SEQ ID NO: 5325 - DNA, 190 bp, Artificial Sequence; identical to SEQ ID NO: 5324
  Synthetic polynucleotide

SEQ ID NO: 5326 - DNA, 196 bp, Artificial Sequence
  Synthetic polynucleotide
atcatctcaccttgcctcctggccgcatttgggttcaacctgcaggcaagatggcggccagacaagatggcggcctcgcaagatggcggccgaccaagatggcggccctacaagatggcggccactcaagatggcggcctgccaagatggcggccgtacaagatggcggccggcgcgccatgcttcatcagactct

SEQ ID NO: 5327 - DNA, 196 bp, Artificial Sequence; identical to SEQ ID NO: 5326
  Synthetic polynucleotide

SEQ ID NO: 5328 - DNA, 197 bp, Artificial Sequence
  Synthetic polynucleotide
atcatctcaccttgcctcctgcgatgtgataccgtcagcctgcaggcattgaccttttgacctcagacattgaccttttgacctctcgcattgaccttttgacctcgaccattgaccttttgacctcctacattgaccttttgacctcactcattgaccttttgacctctgcggcgcgccatgcttcatcagactct

SEQ ID NO: 5329 - DNA, 197 bp, Artificial Sequence; identical to SEQ ID NO: 5328
  Synthetic polynucleotide

SEQ ID NO: 5330 - DNA, 188 bp, Artificial Sequence
  Synthetic polynucleotide
atcatctcaccttgcctcctgcctgttgctactcaatccctgcaggggccaaagtccaagaggccaaagtccatcgggccaaagtccagacggccaaagtccactaggccaaagtccaactggccaaagtccatgcggccaaagtccagtaggccaaagtccaggcgcgccatgcttcatcagactct

SEQ ID NO: 5331 - DNA, 188 bp, Artificial Sequence; identical to SEQ ID NO: 5330
  Synthetic polynucleotide

SEQ ID NO: 5332 - DNA, 197 bp, Artificial Sequence
  Synthetic polynucleotide
atcatctcaccttgcctcctgttccgtatgtgtatcatcctgcaggcccgttgcctagcaactgagacccgttgcctagcaactgtcgcccgttgcctagcaactggaccccgttgcctagcaactgctacccgttgcctagcaactgactcccgttgcctagcaactgtgcggcgcgccatgcttcatcagactct

SEQ ID NO: 5333 - DNA, 197 bp, Artificial Sequence; identical to SEQ ID NO: 5332
  Synthetic polynucleotide

SEQ ID NO: 5334 - DNA, 197 bp, Artificial Sequence
  Synthetic polynucleotide
atcatctcaccttgcctcctgttctaagtccgattagccctgcagggatgacatcatctttagagatgacatcatcttttcggatgacatcatctttgacgatgacatcatctttctagatgacatcatctttactgatgacatcatcttttgcgatgacatcatctttgtaggcgcgccatgcttcatcagactct

SEQ ID NO: 5335 - DNA, 197 bp, Artificial Sequence; identical to SEQ ID NO: 5334
  Synthetic polynucleotide

SEQ ID NO: 5336 - DNA, 180 bp, Artificial Sequence
  Synthetic polynucleotide
atcatctcaccttgcctcctgagaagggctcctaggtgcctgcaggaccatggacagagaaccatggacagtcgaccatggacaggacaccatggacagctaaccatggacagactaccatggacagtgcaccatggacaggtaaccatggacagggcgcgccatgcttcatcagactct

SEQ ID NO: 5337 - DNA, 180 bp, Artificial Sequence; identical to SEQ ID NO: 5336
  Synthetic polynucleotide

SEQ ID NO: 5338 - DNA, 156 bp, Artificial Sequence
  Synthetic polynucleotide
atcatctcaccttgcctcctgcctgacacaccgtgttgcctgcaggtcacgcgaagatcacgcgatcgtcacgcgagactcacgcgactatcacgcgaacttcacgcgatgctcacgcgagtatcacgcgaggcgcgccatgcttcatcagactct

SEQ ID NO: 5339 - DNA, 156 bp, Artificial Sequence; identical to SEQ ID NO: 5338
  Synthetic polynucleotide

SEQ ID NO: 5340 - DNA, 191 bp, Artificial Sequence
  Synthetic polynucleotide
atcatctcaccttgcctcctgatatatcatcagagtgccctgcaggggtgattaattaatgggagaggtgattaattaatgggtcgggtgattaattaatggggacggtgattaattaatgggctaggtgattaattaatgggactggtgattaattaatgggtgcggcgcgccatgcttcatcagactct

SEQ ID NO: 5341 - DNA, 191 bp, Artificial Sequence; identical to SEQ ID NO: 5340
  Synthetic polynucleotide

SEQ ID NO: 5342 - DNA, 197 bp, Artificial Sequence
  Synthetic polynucleotide
atcatctcaccttgcctcctgtgctctccgtgtcgagacctgcagggtcgccatggcaaccagagtcgccatggcaacctcggtcgccatggcaaccgacgtcgccatggcaaccctagtcgccatggcaaccactgtcgccatggcaacctgcgtcgccatggcaaccgtaggcgcgccatgcttcatcagactct

SEQ ID NO: 5343 - DNA, 197 bp, Artificial Sequence; identical to SEQ ID NO: 5342
  Synthetic polynucleotide

SEQ ID NO: 5344 - DNA, 180 bp, Artificial Sequence
  Synthetic polynucleotide
atcatctcaccttgcctcctgttgccgacatgctagttcctgcagggaataattaccagagaataattacctcggaataattaccgacgaataattaccctagaataattaccactgaataattacctgcgaataattaccgtagaataattaccggcgcgccatgcttcatcagactct

SEQ ID NO: 5345 - DNA, 180 bp, Artificial Sequence; identical to SEQ ID NO: 5344
  Synthetic polynucleotide

SEQ ID NO: 5346 - DNA, 180 bp, Artificial Sequence
  Synthetic polynucleotide
atcatctcaccttgcctcctggggcaatattagtggtccctgcaggcgcaggtgtgcagacgcaggtgtgctcgcgcaggtgtgcgaccgcaggtgtgcctacgcaggtgtgcactcgcaggtgtgctgccgcaggtgtgcgtacgcaggtgtgcggcgcgccatgcttcatcagactct

SEQ ID NO: 5347 - DNA, 180 bp, Artificial Sequence; identical to SEQ ID NO: 5346
  Synthetic polynucleotide

SEQ ID NO: 5348 - DNA, 197 bp, Artificial Sequence
  Synthetic polynucleotide
atcatctcaccttgcctcctgctggccatgttgtctttcctgcaggccagccacacccaccagaccagccacacccacctcgccagccacacccaccgacccagccacacccaccctaccagccacacccaccactccagccacacccacctgcccagccacacccaccgtaggcgcgccatgcttcatcagactct

SEQ ID NO: 5349 - DNA, 197 bp, Artificial Sequence; identical to SEQ ID NO: 5348
  Synthetic polynucleotide

SEQ ID NO: 5350 - DNA, 164 bp, Artificial Sequence
  Synthetic polynucleotide
atcatctcaccttgcctcctgttattggatggtccacgcctgcaggatgcgtgggagaatgcgtgggtcgatgcgtggggacatgcgtgggctaatgcgtgggactatgcgtgggtgcatgcgtggggtaatgcgtgggggcgcgccatgcttcatcagactct

SEQ ID NO: 5351 - DNA, 164 bp, Artificial Sequence; identical to SEQ ID NO: 5350
  Synthetic polynucleotide

SEQ ID NO: 5352 - DNA, 180 bp, Artificial Sequence
  Synthetic polynucleotide
atcatctcaccttgcctcctgtccaatttcaatagtcgcctgcaggcccacgtgataagacccacgtgatatcgcccacgtgatagaccccacgtgatactacccacgtgataactcccacgtgatatgccccacgtgatagtacccacgtgataggcgcgccatgcttcatcagactct

SEQ ID NO: 5353 - DNA, 180 bp, Artificial Sequence; identical to SEQ ID NO: 5352
  Synthetic polynucleotide

SEQ ID NO: 5354 - DNA, 190 bp, Artificial Sequence
  Synthetic polynucleotide
atcatctcaccttgcctcctgcgaacgtgccttgtaatcctgcaggaggatgatgcaatcagaaggatgatgcaatctcgaggatgatgcaatcgacaggatgatgcaatcctaaggatgatgcaatcactaggatgatgcaatctgcaggatgatgcaatcgtaggcgcgccatgcttcatcagactct

SEQ ID NO: 5355 - DNA, 190 bp, Artificial Sequence; identical to SEQ ID NO: 5354
  Synthetic polynucleotide

SEQ ID NO: 5356 - DNA, 196 bp, Artificial Sequence
  Synthetic polynucleotide
atcatctcaccttgcctcctgagcggctgtttactaatcctgcagggtatgcaaatgagagagtatgcaaatgagtcggtatgcaaatgaggacgtatgcaaatgagctagtatgcaaatgagactgtatgcaaatgagtgcgtatgcaaatgaggtagtatgcaaatgagggcgcgccatgcttcatcagactct

SEQ ID NO: 5357 - DNA, 196 bp, Artificial Sequence; identical to SEQ ID NO: 5356
  Synthetic polynucleotide

SEQ ID NO: 5358 - DNA, 190 bp, Artificial Sequence
  Synthetic polynucleotide
atcatctcaccttgcctcctgtatgtgctggctgactgcctgcagggcgctgacgtaaccagagcgctgacgtaacctcggcgctgacgtaaccgacgcgctgacgtaaccctagcgctgacgtaaccactgcgctgacgtaacctgcgcgctgacgtaaccgtaggcgcgccatgcttcatcagactct

SEQ ID NO: 5359 - DNA, 190 bp, Artificial Sequence; identical to SEQ ID NO: 5358
  Synthetic polynucleotide

SEQ ID NO: 5360 - DNA, 197 bp, Artificial Sequence
  Synthetic polynucleotide
atcatctcaccttgcctcctgtccgtgttccactccgtcctgcaggttggcacggtgccaaagattggcacggtgccaatcgttggcacggtgccaagacttggcacggtgccaactattggcacggtgccaaactttggcacggtgccaatgcttggcacggtgccaagtaggcgcgccatgcttcatcagactct

SEQ ID NO: 5361 - DNA, 197 bp, Artificial Sequence; identical to SEQ ID NO: 5360
  Synthetic polynucleotide

SEQ ID NO: 5362 - DNA, 197 bp, Artificial Sequence
  Synthetic polynucleotide
atcatctcaccttgcctcctgggcttcgatagagatgtcctgcaggaaaatgtatcaaattagaaaaatgtatcaaatttcgaaaatgtatcaaattgacaaaatgtatcaaattctaaaaatgtatcaaattactaaaatgtatcaaatttgcaaaatgtatcaaattgtaggcgcgccatgcttcatcagactct

SEQ ID NO: 5363 - DNA, 197 bp, Artificial Sequence; identical to SEQ ID NO: 5362
  Synthetic polynucleotide

SEQ ID NO: 5364 - DNA, 156 bp, Artificial Sequence
  Synthetic polynucleotide
atcatctcaccttgcctcctgtggacgatggtcactctcctgcaggaagaaatgagaaagaaatgtcgaagaaatggacaagaaatgctaaagaaatgactaagaaatgtgcaagaaatggtaaagaaatgggcgcgccatgcttcatcagactct

SEQ ID NO: 5365 - DNA, 156 bp, Artificial Sequence; identical to SEQ ID NO: 5364
  Synthetic polynucleotide

SEQ ID NO: 5366 - DNA, 164 bp, Artificial Sequence
  Synthetic polynucleotide
atcatctcaccttgcctcctgcgcgcacactaaattcgcctgcaggattgttctcagaattgttctctcgattgttctcgacattgttctcctaattgttctcactattgttctctgcattgttctcgtaattgttctcggcgcgccatgcttcatcagactct

SEQ ID NO: 5367 - DNA, 164 bp, Artificial Sequence; identical to SEQ ID NO: 5366
  Synthetic polynucleotide

SEQ ID NO: 5368 - DNA, 197 bp, Artificial Sequence
  Synthetic polynucleotide
atcatctcaccttgcctcctggagactcaattaggcgccctgcaggatgctaaaaatagaaagaatgctaaaaatagaatcgatgctaaaaatagaagacatgctaaaaatagaactaatgctaaaaatagaaactatgctaaaaatagaatgcatgctaaaaatagaagtaggcgcgccatgcttcatcagactct

SEQ ID NO: 5369 - DNA, 197 bp, Artificial Sequence; identical to SEQ ID NO: 5368
  Synthetic polynucleotide

SEQ ID NO: 5370 - DNA, 164 bp, Artificial Sequence
  Synthetic polynucleotide
atcatctcaccttgcctcctgcaagtaaatccgttcggcctgcaggattaattagagaattaattagtcgattaattaggacattaattagctaattaattagactattaattagtgcattaattaggtaattaattagggcgcgccatgcttcatcagactct

SEQ ID NO: 5371 - DNA, 164 bp, Artificial Sequence; identical to SEQ ID NO: 5370
  Synthetic polynucleotide

SEQ ID NO: 5372 - DNA, 180 bp, Artificial Sequence
  Synthetic polynucleotide
atcatctcaccttgcctcctgagcttagacacatccaacctgcaggagcaattaacaagaagcaattaacatcgagcaattaacagacagcaattaacactaagcaattaacaactagcaattaacatgcagcaattaacagtaagcaattaacaggcgcgccatgcttcatcagactct

SEQ ID NO: 5373 - DNA, 180 bp, Artificial Sequence; identical to SEQ ID NO: 5372
  Synthetic polynucleotide

SEQ ID NO: 5374 - DNA, 156 bp, Artificial Sequence
  Synthetic polynucleotide
atcatctcaccttgcctcctgccggcatctaagcagagcctgcaggaagaaatcagaaagaaatctcgaagaaatcgacaagaaatcctaaagaaatcactaagaaatctgcaagaaatcgtaaagaaatcggcgcgccatgcttcatcagactct

SEQ ID NO: 5375 - DNA, 156 bp, Artificial Sequence; identical to SEQ ID NO: 5374
  Synthetic polynucleotide

SEQ ID NO: 5376 - DNA, 164 bp, Artificial Sequence
  Synthetic polynucleotide
atcatctcaccttgcctcctgctatatctctcgagaaccctgcaggattaattacagaattaattactcgattaattacgacattaattacctaattaattacactattaattactgcattaattacgtaattaattacggcgcgccatgcttcatcagactct

SEQ ID NO: 5377 - DNA, 164 bp, Artificial Sequence; identical to SEQ ID NO: 5376
  Synthetic polynucleotide

SEQ ID NO: 5378 - DNA, 191 bp, Artificial Sequence
  Synthetic polynucleotide
atcatctcaccttgcctcctgtgttcttcggcactcgacctgcaggggaaggggggggcagggagaggaaggggggggcagggtcgggaaggggggggcaggggacggaaggggggggcagggctaggaaggggggggcagggactggaaggggggggcagggtgcggcgcgccatgcttcatcagactct

SEQ ID NO: 5379 - DNA, 191 bp, Artificial Sequence; identical to SEQ ID NO: 5378
  Synthetic polynucleotide

SEQ ID NO: 5380 - DNA, 172 bp, Artificial Sequence
  Synthetic polynucleotide
atcatctcaccttgcctcctgtatcatagagtcccttccctgcaggaccatggacaagaaccatggacatcgaccatggacagacaccatggacactaaccatggacaactaccatggacatgcaccatggacagtaaccatggacaggcgcgccatgcttcatcagactct

SEQ ID NO: 5381 - DNA, 172 bp, Artificial Sequence; identical to SEQ ID NO: 5380
  Synthetic polynucleotide

SEQ ID NO: 5382 - DNA, 185 bp, Artificial Sequence
  Synthetic polynucleotide
atcatctcaccttgcctcctgtagagcggaccctgcaacctgcaggaaagtaaacaaaaattagaaaagtaaacaaaaatttcgaaagtaaacaaaaattgacaaagtaaacaaaaattctaaaagtaaacaaaaattactaaagtaaacaaaaatttgcggcgcgccatgcttcatcagactct

SEQ ID NO: 5383 - DNA, 185 bp, Artificial Sequence; identical to SEQ ID NO: 5382
  Synthetic polynucleotide

SEQ ID NO: 5384 - DNA, 156 bp, Artificial Sequence
  Synthetic polynucleotide
atcatctcaccttgcctcctggcccaccaatcttatctcctgcaggacacctgcagaacacctgctcgacacctgcgacacacctgcctaacacctgcactacacctgctgcacacctgcgtaacacctgcggcgcgccatgcttcatcagactct

SEQ ID NO: 5385 - DNA, 156 bp, Artificial Sequence; identical to SEQ ID NO: 5384
  Synthetic polynucleotide

SEQ ID NO: 5386 - DNA, 190 bp, Artificial Sequence
  Synthetic polynucleotide
atcatctcaccttgcctcctgccggatcagtacaccatcctgcaggtttgcattacaatgagatttgcattacaatgtcgtttgcattacaatggactttgcattacaatgctatttgcattacaatgacttttgcattacaatgtgctttgcattacaatggtaggcgcgccatgcttcatcagactct

SEQ ID NO: 5387 - DNA, 190 bp, Artificial Sequence; identical to SEQ ID NO: 5386
  Synthetic polynucleotide

SEQ ID NO: 5388 - DNA, 180 bp, Artificial Sequence
  Synthetic polynucleotide
atcatctcaccttgcctcctgcagttgatctctggacacctgcaggcaccggaagtaagacaccggaagtatcgcaccggaagtagaccaccggaagtactacaccggaagtaactcaccggaagtatgccaccggaagtagtacaccggaagtaggcgcgccatgcttcatcagactct

SEQ ID NO: 5389 - DNA, 180 bp, Artificial Sequence; identical to SEQ ID NO: 5388
  Synthetic polynucleotide

SEQ ID NO: 5390 - DNA, 156 bp, Artificial Sequence
  Synthetic polynucleotide
atcatctcaccttgcctcctgcggcatcctattaagtccctgcaggaacggaagagaaacggaagtcgaacggaaggacaacggaagctaaacggaagactaacggaagtgcaacggaaggtaaacggaagggcgcgccatgcttcatcagactct

SEQ ID NO: 5391 - DNA, 156 bp, Artificial Sequence; identical to SEQ ID NO: 5390
  Synthetic polynucleotide

SEQ ID NO: 5392 - DNA, 172 bp, Artificial Sequence
  Synthetic polynucleotide
atcatctcaccttgcctcctggcggagaatacggactgcctgcagggccacgtgacagagccacgtgactcggccacgtgacgacgccacgtgacctagccacgtgacactgccacgtgactgcgccacgtgacgtagccacgtgacggcgcgccatgcttcatcagactct

SEQ ID NO: 5393 - DNA, 172 bp, Artificial Sequence; identical to SEQ ID NO: 5392
  Synthetic polynucleotide

SEQ ID NO: 5394 - DNA, 156 bp, Artificial Sequence
  Synthetic polynucleotide
atcatctcaccttgcctcctgtttgtggttgtgtgaatcctgcaggacacctggagaacacctggtcgacacctgggacacacctggctaacacctggactacacctggtgcacacctgggtaacacctggggcgcgccatgcttcatcagactct

SEQ ID NO: 5395 - DNA, 156 bp, Artificial Sequence; identical to SEQ ID NO: 5394
  Synthetic polynucleotide

SEQ ID NO: 5396 - DNA, 185 bp, Artificial Sequence
  Synthetic polynucleotide
atcatctcaccttgcctcctgtttgaccacgcattgcccctgcaggggattgacaggtctttagaggattgacaggtcttttcgggattgacaggtctttgacggattgacaggtctttctaggattgacaggtctttactggattgacaggtcttttgcggcgcgccatgcttcatcagactct

SEQ ID NO: 5397 - DNA, 185 bp, Artificial Sequence; identical to SEQ ID NO: 5396
  Synthetic polynucleotide

SEQ ID NO: 5398 - DNA, 191 bp, Artificial Sequence
  Synthetic polynucleotide
atcatctcaccttgcctcctgcggtcaaataccaagaccctgcagggacttaattaattaatcagagacttaattaattaatctcggacttaattaattaatcgacgacttaattaattaatcctagacttaattaattaatcactgacttaattaattaatctgcggcgcgccatgcttcatcagactct

SEQ ID NO: 5399 - DNA, 191 bp, Artificial Sequence; identical to SEQ ID NO: 5398
  Synthetic polynucleotide

SEQ ID NO: 5400 - DNA, 191 bp, Artificial Sequence
  Synthetic polynucleotide
atcatctcaccttgcctcctgcttccctgtcaggcaaccctgcaggatgatgacgtgtcctatagaatgatgacgtgtcctattcgatgatgacgtgtcctatgacatgatgacgtgtcctatctaatgatgacgtgtcctatactatgatgacgtgtcctattgcggcgcgccatgcttcatcagactct

SEQ ID NO: 5401 - DNA, 191 bp, Artificial Sequence; identical to SEQ ID NO: 5400
  Synthetic polynucleotide

SEQ ID NO: 5402 - DNA, 172 bp, Artificial Sequence
  Synthetic polynucleotide
atcatctcaccttgcctcctgtcgcaaggacatgaccccctgcaggggaagtgaaaagaggaagtgaaatcgggaagtgaaagacggaagtgaaactaggaagtgaaaactggaagtgaaatgcggaagtgaaagtaggaagtgaaaggcgcgccatgcttcatcagactct

SEQ ID NO: 5403 - DNA, 172 bp, Artificial Sequence; identical to SEQ ID NO: 5402
  Synthetic polynucleotide

SEQ ID NO: 5404 - DNA, 197 bp, Artificial Sequence
  Synthetic polynucleotide
atcatctcaccttgcctcctgcaagcagtcagcctatccctgcaggccttccttccttccttccagaccttccttccttccttcctcgccttccttccttccttccgacccttccttccttccttccctaccttccttccttccttccactccttccttccttccttcctgcggcgcgccatgcttcatcagactct

SEQ ID NO: 5405 - DNA, 197 bp, Artificial Sequence; identical to SEQ ID NO: 5404
  Synthetic polynucleotide

SEQ ID NO: 5406 - DNA, 172 bp, Artificial Sequence
  Synthetic polynucleotide
atcatctcaccttgcctcctgataacattacgggtactcctgcaggcacttccggcagacacttccggctcgcacttccggcgaccacttccggcctacacttccggcactcacttccggctgccacttccggcgtacacttccggcggcgcgccatgcttcatcagactct

SEQ ID NO: 5407 - DNA, 172 bp, Artificial Sequence; identical to SEQ ID NO: 5406
  Synthetic polynucleotide

SEQ ID NO: 5408 - DNA, 191 bp, Artificial Sequence
  Synthetic polynucleotide
atcatctcaccttgcctcctgtttataagcataccgcgcctgcagggggaaacggaaaccgaaactgagagggaaacggaaaccgaaactgtcggggaaacggaaaccgaaactggacgggaaacggaaaccgaaactgctagggaaacggaaaccgaaactgactggcgcgccatgcttcatcagactct

SEQ ID NO: 5409 - DNA, 191 bp, Artificial Sequence; identical to SEQ ID NO: 5408
  Synthetic polynucleotide

SEQ ID NO: 5410 - DNA, 156 bp, Artificial Sequence
  Synthetic polynucleotide
atcatctcaccttgcctcctggtgggtggagttatacacctgcagggtgacctcagagtgacctctcggtgacctcgacgtgacctcctagtgacctcactgtgacctctgcgtgacctcgtagtgacctcggcgcgccatgcttcatcagactct

SEQ ID NO: 5411 - DNA, 156 bp, Artificial Sequence; identical to SEQ ID NO: 5410
  Synthetic polynucleotide

SEQ ID NO: 5412 - DNA, 172 bp, Artificial Sequence
  Synthetic polynucleotide
atcatctcaccttgcctcctgtgataagaagacagtagcctgcaggaatttgcataagaaatttgcatatcgaatttgcatagacaatttgcatactaaatttgcataactaatttgcatatgcaatttgcatagtaaatttgcataggcgcgccatgcttcatcagactct

SEQ ID NO: 5413 - DNA, 172 bp, Artificial Sequence; identical to SEQ ID NO: 5412
  Synthetic polynucleotide

SEQ ID NO: 5414 - DNA, 156 bp, Artificial Sequence
  Synthetic polynucleotide
atcatctcaccttgcctcctggtaacgttaaaggtctgcctgcagggctattttagagctatttttcggctattttgacgctattttctagctattttactgctatttttgcgctattttgtagctattttggcgcgccatgcttcatcagactct

SEQ ID NO: 5415 - DNA, 156 bp, Artificial Sequence; identical to SEQ ID NO: 5414
  Synthetic polynucleotide

SEQ ID NO: 5416 - DNA, 179 bp, Artificial Sequence
  Synthetic polynucleotide
atcatctcaccttgcctcctggctctgtctgaggtgagcctgcagggggcaacaaatccctgcgccccgtagagggcaacaaatccctgcgccccgttcggggcaacaaatccctgcgccccgtgacgggcaacaaatccctgcgccccgtctaggcgcgccatgcttcatcagactct

SEQ ID NO: 5417 - DNA, 179 bp, Artificial Sequence; identical to SEQ ID NO: 5416
  Synthetic polynucleotide

SEQ ID NO: 5418 - DNA, 164 bp, Artificial Sequence
  Synthetic polynucleotide
atcatctcaccttgcctcctgtccgtaagaggcttgtccctgcaggaactgatgaagaaactgatgatcgaactgatgagacaactgatgactaaactgatgaactaactgatgatgcaactgatgagtaaactgatgaggcgcgccatgcttcatcagactct

SEQ ID NO: 5419 - DNA, 164 bp, Artificial Sequence; identical to SEQ ID NO: 5418
  Synthetic polynucleotide

SEQ ID NO: 5420 - DNA, 172 bp, Artificial Sequence
  Synthetic polynucleotide
atcatctcaccttgcctcctgatggacccacttaacatcctgcaggaacacctgtgagaaacacctgtgtcgaacacctgtggacaacacctgtgctaaacacctgtgactaacacctgtgtgcaacacctgtggtaaacacctgtgggcgcgccatgcttcatcagactct

SEQ ID NO: 5421 - DNA, 172 bp, Artificial Sequence; identical to SEQ ID NO: 5420
  Synthetic polynucleotide

SEQ ID NO: 5422 - DNA, 190 bp, Artificial Sequence
  Synthetic polynucleotide
atcatctcaccttgcctcctgttcattctatacgtggtcctgcaggctctgacgtcacccagactctgacgtcaccctcgctctgacgtcacccgacctctgacgtcacccctactctgacgtcacccactctctgacgtcaccctgcctctgacgtcacccgtaggcgcgccatgcttcatcagactct

SEQ ID NO: 5423 - DNA, 190 bp, Artificial Sequence; identical to SEQ ID NO: 5422
  Synthetic polynucleotide

SEQ ID NO: 5424 - DNA, 156 bp, Artificial Sequence
  Synthetic polynucleotide
atcatctcaccttgcctcctggtgaatggcagagacctcctgcaggcaggtcaaagacaggtcaatcgcaggtcaagaccaggtcaactacaggtcaaactcaggtcaatgccaggtcaagtacaggtcaaggcgcgccatgcttcatcagactct

SEQ ID NO: 5425 - DNA, 156 bp, Artificial Sequence; identical to SEQ ID NO: 5424
  Synthetic polynucleotide

SEQ ID NO: 5426 - DNA, 148 bp, Artificial Sequence
  Synthetic polynucleotide
atcatctcaccttgcctcctgctataggcatacactcacctgcagggccaacgagagccaacgtcggccaacggacgccaacgctagccaacgactgccaacgtgcgccaacggtagccaacgggcgcgccatgcttcatcagactct

SEQ ID NO: 5427 - DNA, 148 bp, Artificial Sequence; identical to SEQ ID NO: 5426
  Synthetic polynucleotide

SEQ ID NO: 5428 - DNA, 172 bp, Artificial Sequence
  Synthetic polynucleotide
atcatctcaccttgcctcctgcatcgacacaactaacgcctgcaggtttaattggtagatttaattggttcgtttaattggtgactttaattggtctatttaattggtacttttaattggttgctttaattggtgtatttaattggtggcgcgccatgcttcatcagactct

SEQ ID NO: 5429 - DNA, 172 bp, Artificial Sequence; identical to SEQ ID NO: 5428
  Synthetic polynucleotide

SEQ ID NO: 5430 - DNA, 188 bp, Artificial Sequence
  Synthetic polynucleotide
atcatctcaccttgcctcctgcggatccgaattcgtcgcctgcaggagtttcattttcagaagtttcattttctcgagtttcattttcgacagtttcattttcctaagtttcattttcactagtttcattttctgcagtttcattttcgtaagtttcattttcggcgcgccatgcttcatcagactct

SEQ ID NO: 5431 - DNA, 188 bp, Artificial Sequence; identical to SEQ ID NO: 5430
  Synthetic polynucleotide

SEQ ID NO: 5432 - DNA, 190 bp, Artificial Sequence
  Synthetic polynucleotide
atcatctcaccttgcctcctggtagctccgtgtaggttcctgcaggcttcgtggggggtcagacttcgtggggggtctcgcttcgtggggggtcgaccttcgtggggggtcctacttcgtggggggtcactcttcgtggggggtctgccttcgtggggggtcgtaggcgcgccatgcttcatcagactct

SEQ ID NO: 5433 - DNA, 190 bp, Artificial Sequence; identical to SEQ ID NO: 5432
  Synthetic polynucleotide

SEQ ID NO: 5434 - DNA, 172 bp, Artificial Sequence
  Synthetic polynucleotide
atcatctcaccttgcctcctgatctctcgaatgtatgacctgcaggaatggaaaatagaaatggaaaattcgaatggaaaatgacaatggaaaatctaaatggaaaatactaatggaaaattgcaatggaaaatgtaaatggaaaatggcgcgccatgcttcatcagactct

SEQ ID NO: 5435 - DNA, 172 bp, Artificial Sequence; identical to SEQ ID NO: 5434
  Synthetic polynucleotide

SEQ ID NO: 5436 - DNA, 156 bp, Artificial Sequence
  Synthetic polynucleotide
atcatctcaccttgcctcctgtatagctcattcgtatgcctgcaggaatcgataagaaatcgatatcgaatcgatagacaatcgatactaaatcgataactaatcgatatgcaatcgatagtaaatcgataggcgcgccatgcttcatcagactct

SEQ ID NO: 5437 - DNA, 156 bp, Artificial Sequence; identical to SEQ ID NO: 5436
  Synthetic polynucleotide

SEQ ID NO: 5438 - DNA, 188 bp, Artificial Sequence
  Synthetic polynucleotide
atcatctcaccttgcctcctggtgataggatccctgttcctgcaggtttgtttacttaagatttgtttacttatcgtttgtttacttagactttgtttacttactatttgtttacttaacttttgtttacttatgctttgtttacttagtatttgtttacttaggcgcgccatgcttcatcagactct

SEQ ID NO: 5439 - DNA, 188 bp, Artificial Sequence; identical to SEQ ID NO: 5438
  Synthetic polynucleotide

SEQ ID NO: 5440 - DNA, 172 bp, Artificial Sequence
  Synthetic polynucleotide
atcatctcaccttgcctcctgggatcgtataatcatcacctgcaggcgtgacccctagacgtgaccccttcgcgtgacccctgaccgtgacccctctacgtgacccctactcgtgaccccttgccgtgacccctgtacgtgacccctggcgcgccatgcttcatcagactct

SEQ ID NO: 5441 - DNA, 172 bp, Artificial Sequence; identical to SEQ ID NO: 5440
  Synthetic polynucleotide

SEQ ID NO: 5442 - DNA, 190 bp, Artificial Sequence
  Synthetic polynucleotide
atcatctcaccttgcctcctgatagtaccaaccgtttgcctgcagggtcgccataaacgcagagtcgccataaacgctcggtcgccataaacgcgacgtcgccataaacgcctagtcgccataaacgcactgtcgccataaacgctgcgtcgccataaacgcgtaggcgcgccatgcttcatcagactct

SEQ ID NO: 5443 - DNA, 190 bp, Artificial Sequence; identical to SEQ ID NO: 5442
  Synthetic polynucleotide

SEQ ID NO: 5444 - DNA, 188 bp, Artificial Sequence
  Synthetic polynucleotide
atcatctcaccttgcctcctgaagcttgggtaataagccctgcaggcaatgttattgtagacaatgttattgttcgcaatgttattgtgaccaatgttattgtctacaatgttattgtactcaatgttattgttgccaatgttattgtgtacaatgttattgtggcgcgccatgcttcatcagactct

SEQ ID NO: 5445 - DNA, 188 bp, Artificial Sequence; identical to SEQ ID NO: 5444
  Synthetic polynucleotide

SEQ ID NO: 5446 - DNA, 185 bp, Artificial Sequence
  Synthetic polynucleotide
atcatctcaccttgcctcctgagtctcccgttcttacacctgcagggctctgattggctgatagagctctgattggctgattcggctctgattggctgatgacgctctgattggctgatctagctctgattggctgatactgctctgattggctgattgcggcgcgccatgcttcatcagactct

SEQ ID NO: 5447 - DNA, 185 bp, Artificial Sequence; identical to SEQ ID NO: 5446
  Synthetic polynucleotide

SEQ ID NO: 5448 - DNA, 188 bp, Artificial Sequence
  Synthetic polynucleotide
atcatctcaccttgcctcctggctgtctagagcggcaacctgcaggggggatttcccaagaggggatttcccatcgggggatttcccagacggggatttcccactaggggatttcccaactggggatttcccatgcggggatttcccagtaggggatttcccaggcgcgccatgcttcatcagactct

SEQ ID NO: 5449 - DNA, 188 bp, Artificial Sequence; identical to SEQ ID NO: 5448
  Synthetic polynucleotide

SEQ ID NO: 5450 - DNA, 197 bp, Artificial Sequence
  Synthetic polynucleotide
atcatctcaccttgcctcctgatagtttcggttagtctcctgcaggaaagatcaaagggttagaaaagatcaaagggtttcgaaagatcaaagggttgacaaagatcaaagggttctaaaagatcaaagggttactaaagatcaaagggtttgcaaagatcaaagggttgtaggcgcgccatgcttcatcagactct

SEQ ID NO: 5451 - DNA, 197 bp, Artificial Sequence; identical to SEQ ID NO: 5450
  Synthetic polynucleotide

SEQ ID NO: 5452 - DNA, 191 bp, Artificial Sequence
  Synthetic polynucleotide
atcatctcaccttgcctcctgcctcaccgttcgaatctcctgcaggctggcaagttgccaaggagactggcaagttgccaaggtcgctggcaagttgccaagggacctggcaagttgccaaggctactggcaagttgccaaggactctggcaagttgccaaggtgcggcgcgccatgcttcatcagactct

SEQ ID NO: 5453 - DNA, 191 bp, Artificial Sequence; identical to SEQ ID NO: 5452
  Synthetic polynucleotide

SEQ ID NO: 5454 - DNA, 191 bp, Artificial Sequence
  Synthetic polynucleotide
atcatctcaccttgcctcctgatatgtcgaccttcagtcctgcaggaattttcacaccttttaagaaattttcacaccttttatcgaattttcacaccttttagacaattttcacaccttttactaaattttcacaccttttaactaattttcacaccttttatgcggcgcgccatgcttcatcagactct

SEQ ID NO: 5455 - DNA, 191 bp, Artificial Sequence; identical to SEQ ID NO: 5454
  Synthetic polynucleotide

SEQ ID NO: 5456 - DNA, 156 bp, Artificial Sequence
  Synthetic polynucleotide
atcatctcaccttgcctcctgtatcttaccgagggaaccctgcaggttgagtcaagattgagtcatcgttgagtcagacttgagtcactattgagtcaactttgagtcatgcttgagtcagtattgagtcaggcgcgccatgcttcatcagactct

SEQ ID NO: 5457 - DNA, 156 bp, Artificial Sequence; identical to SEQ ID NO: 5456
  Synthetic polynucleotide

SEQ ID NO: 5458 - DNA, 172 bp, Artificial Sequence
  Synthetic polynucleotide
atcatctcaccttgcctcctgatactgggaccctaagacctgcaggctcttccggtagactcttccggttcgctcttccggtgacctcttccggtctactcttccggtactctcttccggttgcctcttccggtgtactcttccggtggcgcgccatgcttcatcagactct

SEQ ID NO: 5459 - DNA, 172 bp, Artificial Sequence; identical to SEQ ID NO: 5458
  Synthetic polynucleotide

SEQ ID NO: 5460 - DNA, 191 bp, Artificial Sequence
  Synthetic polynucleotide
atcatctcaccttgcctcctgtaccaggccatacagcgcctgcagggggggcatcaggaggggagagggggcatcaggaggggtcggggggcatcaggagggggacgggggcatcaggaggggctagggggcatcaggaggggactgggggcatcaggaggggtgcggcgcgccatgcttcatcagactct

SEQ ID NO: 5461 - DNA, 191 bp, Artificial Sequence; identical to SEQ ID NO: 5460
  Synthetic polynucleotide

SEQ ID NO: 5462 - DNA, 197 bp, Artificial Sequence
  Synthetic polynucleotide
atcatctcaccttgcctcctgaaggactttgtcatcggcctgcaggatgaatgttattcatagaatgaatgttattcattcgatgaatgttattcatgacatgaatgttattcatctaatgaatgttattcatactatgaatgttattcattgcatgaatgttattcatgtaggcgcgccatgcttcatcagactct

SEQ ID NO: 5463 - DNA, 197 bp, Artificial Sequence; identical to SEQ ID NO: 5462
  Synthetic polynucleotide

SEQ ID NO: 5464 - DNA, 156 bp, Artificial Sequence
  Synthetic polynucleotide
atcatctcaccttgcctcctgacaggctagtggctagacctgcaggcttatctcagacttatctctcgcttatctcgaccttatctcctacttatctcactcttatctctgccttatctcgtacttatctcggcgcgccatgcttcatcagactct

SEQ ID NO: 5465 - DNA, 156 bp, Artificial Sequence; identical to SEQ ID NO: 5464
  Synthetic polynucleotide

SEQ ID NO: 5466 - DNA, 188 bp, Artificial Sequence
  Synthetic polynucleotide
atcatctcaccttgcctcctgagtcgttcgtttgagatcctgcaggggaaaaaatcggagaggaaaaaatcggtcgggaaaaaatcgggacggaaaaaatcggctaggaaaaaatcggactggaaaaaatcggtgcggaaaaaatcgggtaggaaaaaatcggggcgcgccatgcttcatcagactct

SEQ ID NO: 5467 - DNA, 188 bp, Artificial Sequence; identical to SEQ ID NO: 5466
  Synthetic polynucleotide

SEQ ID NO: 5468 - DNA, 188 bp, Artificial Sequence
  Synthetic polynucleotide
atcatctcaccttgcctcctgaatgtagttagctcttgcctgcaggtttggcgcgaaaagatttggcgcgaaatcgtttggcgcgaaagactttggcgcgaaactatttggcgcgaaaacttttggcgcgaaatgctttggcgcgaaagtatttggcgcgaaaggcgcgccatgcttcatcagactct

SEQ ID NO: 5469 - DNA, 188 bp, Artificial Sequence; identical to SEQ ID NO: 5468
  Synthetic polynucleotide

SEQ ID NO: 5470 - DNA, 197 bp, Artificial Sequence
  Synthetic polynucleotide
atcatctcaccttgcctcctgcacaacggtggagaacccctgcaggttgttggcggggtcaagattgttggcggggtcatcgttgttggcggggtcagacttgttggcggggtcactattgttggcggggtcaactttgttggcggggtcatgcttgttggcggggtcagtaggcgcgccatgcttcatcagactct

SEQ ID NO: 5471 - DNA, 197 bp, Artificial Sequence; identical to SEQ ID NO: 5470
  Synthetic polynucleotide

SEQ ID NO: 5472 - DNA, 197 bp, Artificial Sequence
  Synthetic polynucleotide
atcatctcaccttgcctcctgtcttagtcgtaaccacacctgcagggttaatccgattaacagagttaatccgattaactcggttaatccgattaacgacgttaatccgattaacctagttaatccgattaacactgttaatccgattaactgcgttaatccgattaacgtaggcgcgccatgcttcatcagactct

SEQ ID NO: 5473 - DNA, 197 bp, Artificial Sequence; identical to SEQ ID NO: 5472
  Synthetic polynucleotide

SEQ ID NO: 5474 - DNA, 197 bp, Artificial Sequence
  Synthetic polynucleotide
atcatctcaccttgcctcctgctagatcagtgttgatacctgcaggaacaatggtagtgttagaaacaatggtagtgtttcgaacaatggtagtgttgacaacaatggtagtgttctaaacaatggtagtgttactaacaatggtagtgtttgcaacaatggtagtgttgtaggcgcgccatgcttcatcagactct

SEQ ID NO: 5475 - DNA, 197 bp, Artificial Sequence; identical to SEQ ID NO: 5474
  Synthetic polynucleotide

SEQ ID NO: 5476 - DNA, 197 bp, Artificial Sequence
  Synthetic polynucleotide
atcatctcaccttgcctcctgtcagcgccagagacctacctgcaggagtgcgtgggcgtagagaagtgcgtgggcgtagtcgagtgcgtgggcgtaggacagtgcgtgggcgtagctaagtgcgtgggcgtagactagtgcgtgggcgtagtgcagtgcgtgggcgtaggtaggcgcgccatgcttcatcagactct

SEQ ID NO: 5477 - DNA, 197 bp, Artificial Sequence; identical to SEQ ID NO: 5476
  Synthetic polynucleotide

SEQ ID NO: 5478 - DNA, 195 bp, Artificial Sequence
  Synthetic polynucleotide
atcatctcaccttgcctcctgcaccgtatcttcctcaacctgcaggtgtatggtcacgcttcaggtatctgtttagatgtatggtcacgcttcaggtatctgttttcgtgtatggtcacgcttcaggtatctgtttgactgtatggtcacgcttcaggtatctgtttctaggcgcgccatgcttcatcagactct

SEQ ID NO: 5479 - DNA, 195 bp, Artificial Sequence; identical to SEQ ID NO: 5478
  Synthetic polynucleotide

SEQ ID NO: 5480 - DNA, 164 bp, Artificial Sequence
  Synthetic polynucleotide
atcatctcaccttgcctcctgagcttgtaacacagcggcctgcaggaaggacaggagaaaggacaggtcgaaggacagggacaaggacaggctaaaggacaggactaaggacaggtgcaaggacagggtaaaggacaggggcgcgccatgcttcatcagactct

SEQ ID NO: 5481 - DNA, 164 bp, Artificial Sequence; identical to SEQ ID NO: 5480
  Synthetic polynucleotide

SEQ ID NO: 5482 - DNA, 156 bp, Artificial Sequence
  Synthetic polynucleotide
atcatctcaccttgcctcctgagaacgtagtcctgccccctgcaggaaccgaaaagaaaccgaaatcgaaccgaaagacaaccgaaactaaaccgaaaactaaccgaaatgcaaccgaaagtaaaccgaaaggcgcgccatgcttcatcagactct

SEQ ID NO: 5483 - DNA, 156 bp, Artificial Sequence; identical to SEQ ID NO: 5482
  Synthetic polynucleotide

SEQ ID NO: 5484 - DNA, 156 bp, Artificial Sequence
  Synthetic polynucleotide
atcatctcaccttgcctcctgtatcttctcaatacggccctgcagggtgaccttagagtgacctttcggtgaccttgacgtgaccttctagtgaccttactgtgacctttgcgtgaccttgtagtgaccttggcgcgccatgcttcatcagactct

SEQ ID NO: 5485 - DNA, 156 bp, Artificial Sequence; identical to SEQ ID NO: 5484
  Synthetic polynucleotide

SEQ ID NO: 5486 - DNA, 188 bp, Artificial Sequence
  Synthetic polynucleotide
atcatctcaccttgcctcctggctggctgtgatcgcaacctgcaggtatgcaaattagagatatgcaaattagtcgtatgcaaattaggactatgcaaattagctatatgcaaattagacttatgcaaattagtgctatgcaaattaggtatatgcaaattagggcgcgccatgcttcatcagactct

SEQ ID NO: 5487 - DNA, 188 bp, Artificial Sequence; identical to SEQ ID NO: 5486
  Synthetic polynucleotide

SEQ ID NO: 5488 - DNA, 191 bp, Artificial Sequence
  Synthetic polynucleotide
atcatctcaccttgcctcctgccggcaatatgtacttgcctgcaggtttattatgcatattttagatttattatgcatatttttcgtttattatgcatattttgactttattatgcatattttctatttattatgcatattttacttttattatgcatatttttgcggcgcgccatgcttcatcagactct

SEQ ID NO: 5489 - DNA, 191 bp, Artificial Sequence; identical to SEQ ID NO: 5488
  Synthetic polynucleotide

SEQ ID NO: 5490 - DNA, 180 bp, Artificial Sequence
  Synthetic polynucleotide
atcatctcaccttgcctcctgactttctttggcgccgccctgcaggtaatggcggacagataatggcggactcgtaatggcggacgactaatggcggacctataatggcggacacttaatggcggactgctaatggcggacgtataatggcggacggcgcgccatgcttcatcagactct

SEQ ID NO: 5491 - DNA, 180 bp, Artificial Sequence; identical to SEQ ID NO: 5490
  Synthetic polynucleotide

SEQ ID NO: 5492 - DNA, 183 bp, Artificial Sequence
  Synthetic polynucleotide
atcatctcaccttgcctcctgaacaaaccagccctaaacctgcaggtgccatcagaggtgtgagaagcgacagatgccatcagaggtgtgagaagcgactcgtgccatcagaggtgtgagaagcgacgactgccatcagaggtgtgagaagcgacctaggcgcgccatgcttcatcagactct

SEQ ID NO: 5493 - DNA, 183 bp, Artificial Sequence; identical to SEQ ID NO: 5492
  Synthetic polynucleotide

SEQ ID NO: 5494 - DNA, 180 bp, Artificial Sequence
  Synthetic polynucleotide
atcatctcaccttgcctcctggatggcatcctggctgtcctgcaggctaatcctcttagactaatcctctttcgctaatcctcttgacctaatcctcttctactaatcctcttactctaatcctctttgcctaatcctcttgtactaatcctcttggcgcgccatgcttcatcagactct

SEQ ID NO: 5495 - DNA, 180 bp, Artificial Sequence; identical to SEQ ID NO: 5494
  Synthetic polynucleotide

SEQ ID NO: 5496 - DNA, 188 bp, Artificial Sequence
  Synthetic polynucleotide
atcatctcaccttgcctcctggaaaggtacgggtggctcctgcaggaatttgtttacaagaaatttgtttacatcgaatttgtttacagacaatttgtttacactaaatttgtttacaactaatttgtttacatgcaatttgtttacagtaaatttgtttacaggcgcgccatgcttcatcagactct

SEQ ID NO: 5497 - DNA, 188 bp, Artificial Sequence; identical to SEQ ID NO: 5496
  Synthetic polynucleotide

SEQ ID NO: 5498 - DNA, 156 bp, Artificial Sequence
  Synthetic polynucleotide
atcatctcaccttgcctcctgtcgtccatggcatagctcctgcaggcttatctgagacttatctgtcgcttatctggaccttatctgctacttatctgactcttatctgtgccttatctggtacttatctgggcgcgccatgcttcatcagactct

SEQ ID NO: 5499 - DNA, 156 bp, Artificial Sequence; identical to SEQ ID NO: 5498
  Synthetic polynucleotide

SEQ ID NO: 5500 - DNA, 156 bp, Artificial Sequence
  Synthetic polynucleotide
atcatctcaccttgcctcctgttgaagactttggacaccctgcagggagataagagagagataagtcggagataaggacgagataagctagagataagactgagataagtgcgagataaggtagagataagggcgcgccatgcttcatcagactct

SEQ ID NO: 5501 - DNA, 156 bp, Artificial Sequence; identical to SEQ ID NO: 5500
  Synthetic polynucleotide

SEQ ID NO: 5502 - DNA, 164 bp, Artificial Sequence
  Synthetic polynucleotide
atcatctcaccttgcctcctgtacgaaacgtagtcgtgcctgcaggatcataaaaagaatcataaaatcgatcataaaagacatcataaaactaatcataaaaactatcataaaatgcatcataaaagtaatcataaaaggcgcgccatgcttcatcagactct

SEQ ID NO: 5503 - DNA, 164 bp, Artificial Sequence; identical to SEQ ID NO: 5502
  Synthetic polynucleotide

SEQ ID NO: 5504 - DNA, 180 bp, Artificial Sequence
  Synthetic polynucleotide
atcatctcaccttgcctcctgatcagatctctcgtaggcctgcaggttatcttgtctagattatcttgtcttcgttatcttgtctgacttatcttgtctctattatcttgtctactttatcttgtcttgcttatcttgtctgtattatcttgtctggcgcgccatgcttcatcagactct

SEQ ID NO: 5505 - DNA, 180 bp, Artificial Sequence; identical to SEQ ID NO: 5504
  Synthetic polynucleotide

SEQ ID NO: 5506 - DNA, 164 bp, Artificial Sequence
  Synthetic polynucleotide
atcatctcaccttgcctcctgtactaagatcagcgtgacctgcaggcctcacctgagacctcacctgtcgcctcacctggaccctcacctgctacctcacctgactcctcacctgtgccctcacctggtacctcacctgggcgcgccatgcttcatcagactct

SEQ ID NO: 5507 - DNA, 164 bp, Artificial Sequence; identical to SEQ ID NO: 5506
  Synthetic polynucleotide

SEQ ID NO: 5508 - DNA, 164 bp, Artificial Sequence
  Synthetic polynucleotide
atcatctcaccttgcctcctggtgtgctaaatagtgttcctgcaggtggcgtcacagatggcgtcactcgtggcgtcacgactggcgtcacctatggcgtcacacttggcgtcactgctggcgtcacgtatggcgtcacggcgcgccatgcttcatcagactct

SEQ ID NO: 5509 - DNA, 164 bp, Artificial Sequence; identical to SEQ ID NO: 5508
  Synthetic polynucleotide

SEQ ID NO: 5510 - DNA, 197 bp, Artificial Sequence
  Synthetic polynucleotide
atcatctcaccttgcctcctgtaaaccgaatcatgatgcctgcaggaccgcctcaggcggtagaaccgcctcaggcggttcgaccgcctcaggcggtgacaccgcctcaggcggtctaaccgcctcaggcggtactaccgcctcaggcggttgcaccgcctcaggcggtgtaggcgcgccatgcttcatcagactct

SEQ ID NO: 5511 - DNA, 197 bp, Artificial Sequence; identical to SEQ ID NO: 5510
  Synthetic polynucleotide

SEQ ID NO: 5512 - DNA, 191 bp, Artificial Sequence
  Synthetic polynucleotide
atcatctcaccttgcctcctggcgcccggtgagtatttcctgcaggggaggggattaatttatagaggaggggattaatttattcgggaggggattaatttatgacggaggggattaatttatctaggaggggattaatttatactggaggggattaatttattgcggcgcgccatgcttcatcagactct

SEQ ID NO: 5513 - DNA, 191 bp, Artificial Sequence; identical to SEQ ID NO: 5512
  Synthetic polynucleotide

SEQ ID NO: 5514 - DNA, 185 bp, Artificial Sequence
  Synthetic polynucleotide
atcatctcaccttgcctcctgaaaccgccgcctataaacctgcaggtaattagcgctaattaagataattagcgctaattatcgtaattagcgctaattagactaattagcgctaattactataattagcgctaattaacttaattagcgctaattatgcggcgcgccatgcttcatcagactct

SEQ ID NO: 5515 - DNA, 185 bp, Artificial Sequence; identical to SEQ ID NO: 5514
  Synthetic polynucleotide

SEQ ID NO: 5516 - DNA, 191 bp, Artificial Sequence
  Synthetic polynucleotide
atcatctcaccttgcctcctgtgtcctctcaacgctgacctgcaggaaggtcacggtgacctgagaaaggtcacggtgacctgtcgaaggtcacggtgacctggacaaggtcacggtgacctgctaaaggtcacggtgacctgactaaggtcacggtgacctgtgcggcgcgccatgcttcatcagactct

SEQ ID NO: 5517 - DNA, 191 bp, Artificial Sequence; identical to SEQ ID NO: 5516
  Synthetic polynucleotide

SEQ ID NO: 5518 - DNA, 164 bp, Artificial Sequence
  Synthetic polynucleotide
atcatctcaccttgcctcctgggacctgcccagatcaacctgcaggttttatgatagattttatgattcgttttatgatgacttttatgatctattttatgatactttttatgattgcttttatgatgtattttatgatggcgcgccatgcttcatcagactct

SEQ ID NO: 5519 - DNA, 164 bp, Artificial Sequence; identical to SEQ ID NO: 5518
  Synthetic polynucleotide

SEQ ID NO: 5520 - DNA, 197 bp, Artificial Sequence
  Synthetic polynucleotide
atcatctcaccttgcctcctggggataaggcagaacagcctgcaggagctaaaaatagcatagaagctaaaaatagcattcgagctaaaaatagcatgacagctaaaaatagcatctaagctaaaaatagcatactagctaaaaatagcattgcagctaaaaatagcatgtaggcgcgccatgcttcatcagactct

SEQ ID NO: 5521 - DNA, 197 bp, Artificial Sequence; identical to SEQ ID NO: 5520
  Synthetic polynucleotide

SEQ ID NO: 5522 - DNA, 164 bp, Artificial Sequence
  Synthetic polynucleotide
atcatctcaccttgcctcctgttctcacagttagggaccctgcaggggtttggctagaggtttggcttcgggtttggctgacggtttggctctaggtttggctactggtttggcttgcggtttggctgtaggtttggctggcgcgccatgcttcatcagactct

SEQ ID NO: 5523 - DNA, 164 bp, Artificial Sequence; identical to SEQ ID NO: 5522
  Synthetic polynucleotide

SEQ ID NO: 5524 - DNA, 191 bp, Artificial Sequence
  Synthetic polynucleotide
atcatctcaccttgcctcctgtaatttcggacttcaaccctgcaggtaaagggattaacgattagataaagggattaacgatttcgtaaagggattaacgattgactaaagggattaacgattctataaagggattaacgattacttaaagggattaacgatttgcggcgcgccatgcttcatcagactct

SEQ ID NO: 5525 - DNA, 191 bp, Artificial Sequence; identical to SEQ ID NO: 5524
  Synthetic polynucleotide

SEQ ID NO: 5526 - DNA, 172 bp, Artificial Sequence
  Synthetic polynucleotide
atcatctcaccttgcctcctgtccctggctttgcctaccctgcaggtgacctgaccagatgacctgacctcgtgacctgaccgactgacctgaccctatgacctgaccacttgacctgacctgctgacctgaccgtatgacctgaccggcgcgccatgcttcatcagactct

SEQ ID NO: 5527 - DNA, 172 bp, Artificial Sequence; identical to SEQ ID NO: 5526
  Synthetic polynucleotide

SEQ ID NO: 5528 - DNA, 186 bp, Artificial Sequence
  Synthetic polynucleotide
atcatctcaccttgcctcctggcaaagccagggaaatgcctgcaggtcagcaccacggacagcaccagatcagcaccacggacagcacctcgtcagcaccacggacagcaccgactcagcaccacggacagcaccctatcagcaccacggacagcaccactggcgcgccatgcttcatcagactct

SEQ ID NO: 5529 - DNA, 186 bp, Artificial Sequence; identical to SEQ ID NO: 5528
  Synthetic polynucleotide

SEQ ID NO: 5530 - DNA, 172 bp, Artificial Sequence
  Synthetic polynucleotide
atcatctcaccttgcctcctgcttcaagatagggcgaccctgcaggtatgactcatagatatgactcattcgtatgactcatgactatgactcatctatatgactcatacttatgactcattgctatgactcatgtatatgactcatggcgcgccatgcttcatcagactct

SEQ ID NO: 5531 - DNA, 172 bp, Artificial Sequence; identical to SEQ ID NO: 5530
  Synthetic polynucleotide

SEQ ID NO: 5532 - DNA, 197 bp, Artificial Sequence
  Synthetic polynucleotide
atcatctcaccttgcctcctgttggtaagacccaccggcctgcaggggtcacgtggccgcgagaggtcacgtggccgcgtcgggtcacgtggccgcggacggtcacgtggccgcgctaggtcacgtggccgcgactggtcacgtggccgcgtgcggtcacgtggccgcggtaggcgcgccatgcttcatcagactct

SEQ ID NO: 5533 - DNA, 197 bp, Artificial Sequence; identical to SEQ ID NO: 5532
  Synthetic polynucleotide

SEQ ID NO: 5534 - DNA, 148 bp, Artificial Sequence
  Synthetic polynucleotide
atcatctcaccttgcctcctgatggaagtatctttgcacctgcaggctccgggagactccgggtcgctccggggacctccgggctactccgggactctccgggtgcctccggggtactccgggggcgcgccatgcttcatcagactct

SEQ ID NO: 5535 - DNA, 148 bp, Artificial Sequence; identical to SEQ ID NO: 5534
  Synthetic polynucleotide

SEQ ID NO: 5536 - DNA, 191 bp, Artificial Sequence
  Synthetic polynucleotide
atcatctcaccttgcctcctgcaaggctacggctgtgtcctgcaggacctttgtttacatttaagaacctttgtttacatttatcgacctttgtttacatttagacacctttgtttacatttactaacctttgtttacatttaactacctttgtttacatttatgcggcgcgccatgcttcatcagactct

SEQ ID NO: 5537 - DNA, 191 bp, Artificial Sequence; identical to SEQ ID NO: 5536
  Synthetic polynucleotide

SEQ ID NO: 5538 - DNA, 197 bp, Artificial Sequence
  Synthetic polynucleotide
atcatctcaccttgcctcctgttccagacgctcagctccctgcaggggttaatgattaccaagaggttaatgattaccatcgggttaatgattaccagacggttaatgattaccactaggttaatgattaccaactggttaatgattaccatgcggttaatgattaccagtaggcgcgccatgcttcatcagactct

SEQ ID NO: 5539 - DNA, 197 bp, Artificial Sequence; identical to SEQ ID NO: 5538
  Synthetic polynucleotide

SEQ ID NO: 5540 - DNA, 197 bp, Artificial Sequence
  Synthetic polynucleotide
atcatctcaccttgcctcctgacgaaaccggagtctcacctgcagggacatgcccgggcatgttagagacatgcccgggcatgtttcggacatgcccgggcatgttgacgacatgcccgggcatgttctagacatgcccgggcatgttactgacatgcccgggcatgtttgcggcgcgccatgcttcatcagactct

SEQ ID NO: 5541 - DNA, 197 bp, Artificial Sequence; identical to SEQ ID NO: 5540
  Synthetic polynucleotide

SEQ ID NO: 5542 - DNA, 191 bp, Artificial Sequence
  Synthetic polynucleotide
atcatctcaccttgcctcctgaatcttgttgcctggtccctgcagggagcgttaattaatgtaagagagcgttaattaatgtatcggagcgttaattaatgtagacgagcgttaattaatgtactagagcgttaattaatgtaactgagcgttaattaatgtatgcggcgcgccatgcttcatcagactct

SEQ ID NO: 5543 - DNA, 191 bp, Artificial Sequence; identical to SEQ ID NO: 5542
  Synthetic polynucleotide

SEQ ID NO: 5544 - DNA, 196 bp, Artificial Sequence
  Synthetic polynucleotide
atcatctcaccttgcctcctgttcagacttctctcgggcctgcagggtgatttatggccagagtgatttatggcctcggtgatttatggccgacgtgatttatggccctagtgatttatggccactgtgatttatggcctgcgtgatttatggccgtagtgatttatggccggcgcgccatgcttcatcagactct

SEQ ID NO: 5545 - DNA, 196 bp, Artificial Sequence; identical to SEQ ID NO: 5544
  Synthetic polynucleotide

SEQ ID NO: 5546 - DNA, 156 bp, Artificial Sequence
  Synthetic polynucleotide
atcatctcaccttgcctcctgaagtgaagtctacccagcctgcagggcacctgcagagcacctgctcggcacctgcgacgcacctgcctagcacctgcactgcacctgctgcgcacctgcgtagcacctgcggcgcgccatgcttcatcagactct

SEQ ID NO: 5547 - DNA, 156 bp, Artificial Sequence; identical to SEQ ID NO: 5546
  Synthetic polynucleotide

SEQ ID NO: 5548 - DNA, 172 bp, Artificial Sequence
  Synthetic polynucleotide
atcatctcaccttgcctcctggttaaggaagtagaagacctgcaggttgacaccttagattgacacctttcgttgacaccttgacttgacaccttctattgacaccttactttgacacctttgcttgacaccttgtattgacaccttggcgcgccatgcttcatcagactct

SEQ ID NO: 5549 - DNA, 172 bp, Artificial Sequence; identical to SEQ ID NO: 5548
  Synthetic polynucleotide

SEQ ID NO: 5550 - DNA, 190 bp, Artificial Sequence
  Synthetic polynucleotide
atcatctcaccttgcctcctgacgacacgtgttggttccctgcaggctctgacgtcatcgagactctgacgtcatcgtcgctctgacgtcatcggacctctgacgtcatcgctactctgacgtcatcgactctctgacgtcatcgtgcctctgacgtcatcggtaggcgcgccatgcttcatcagactct

SEQ ID NO: 5551 - DNA, 190 bp, Artificial Sequence; identical to SEQ ID NO: 5550
  Synthetic polynucleotide

SEQ ID NO: 5552 - DNA, 190 bp, Artificial Sequence
  Synthetic polynucleotide
atcatctcaccttgcctcctgttggcttgtaagtatgccctgcaggcaaacgtaaacaatagacaaacgtaaacaattcgcaaacgtaaacaatgaccaaacgtaaacaatctacaaacgtaaacaatactcaaacgtaaacaattgccaaacgtaaacaatgtaggcgcgccatgcttcatcagactct

SEQ ID NO: 5553 - DNA, 190 bp, Artificial Sequence; identical to SEQ ID NO: 5552
  Synthetic polynucleotide

SEQ ID NO: 5554 - DNA, 156 bp, Artificial Sequence
  Synthetic polynucleotide
atcatctcaccttgcctcctgtgtttgcggcagaacatcctgcaggccgcacctagaccgcaccttcgccgcacctgacccgcacctctaccgcacctactccgcaccttgcccgcacctgtaccgcacctggcgcgccatgcttcatcagactct

SEQ ID NO: 5555 - DNA, 156 bp, Artificial Sequence; identical to SEQ ID NO: 5554
  Synthetic polynucleotide

SEQ ID NO: 5556 - DNA, 197 bp, Artificial Sequence
  Synthetic polynucleotide
atcatctcaccttgcctcctgtgtattgtaaagagggccctgcaggaagttcaaggtcagcagaaagttcaaggtcagctcgaagttcaaggtcagcgacaagttcaaggtcagcctaaagttcaaggtcagcactaagttcaaggtcagctgcaagttcaaggtcagcgtaggcgcgccatgcttcatcagactct

SEQ ID NO: 5557 - DNA, 197 bp, Artificial Sequence; identical to SEQ ID NO: 5556
  Synthetic polynucleotide

SEQ ID NO: 5558 - DNA, 197 bp, Artificial Sequence
  Synthetic polynucleotide
atcatctcaccttgcctcctgtggaacctatatcagtacctgcaggtaattggtttttaattgcagataattggtttttaattgctcgtaattggtttttaattgcgactaattggtttttaattgcctataattggtttttaattgcacttaattggtttttaattgctgcggcgcgccatgcttcatcagactct

SEQ ID NO: 5559 - DNA, 197 bp, Artificial Sequence; identical to SEQ ID NO: 5558
  Synthetic polynucleotide

SEQ ID NO: 5560 - DNA, 164 bp, Artificial Sequence
  Synthetic polynucleotide
atcatctcaccttgcctcctgaaccacataggacggctcctgcaggttttatgagagattttatgagtcgttttatgaggacttttatgagctattttatgagactttttatgagtgcttttatgaggtattttatgagggcgcgccatgcttcatcagactct

SEQ ID NO: 5561 - DNA, 164 bp, Artificial Sequence; identical to SEQ ID NO: 5560
  Synthetic polynucleotide

SEQ ID NO: 5562 - DNA, 172 bp, Artificial Sequence
  Synthetic polynucleotide
atcatctcaccttgcctcctgcgggtccattagcataacctgcaggaaggggaagtagaaaggggaagttcgaaggggaagtgacaaggggaagtctaaaggggaagtactaaggggaagttgcaaggggaagtgtaaaggggaagtggcgcgccatgcttcatcagactct

SEQ ID NO: 5563 - DNA, 172 bp, Artificial Sequence; identical to SEQ ID NO: 5562
  Synthetic polynucleotide

SEQ ID NO: 5564 - DNA, 164 bp, Artificial Sequence
  Synthetic polynucleotide
atcatctcaccttgcctcctggtctacgctccctatttcctgcaggtttcccacgagatttcccacgtcgtttcccacggactttcccacgctatttcccacgacttttcccacgtgctttcccacggtatttcccacgggcgcgccatgcttcatcagactct

SEQ ID NO: 5565 - DNA, 164 bp, Artificial Sequence; identical to SEQ ID NO: 5564
  Synthetic polynucleotide

SEQ ID NO: 5566 - DNA, 190 bp, Artificial Sequence
  Synthetic polynucleotide
atcatctcaccttgcctcctgttagtggcgtaccgggtcctgcaggctaatcatcattaaagactaatcatcattaatcgctaatcatcattaagacctaatcatcattaactactaatcatcattaaactctaatcatcattaatgcctaatcatcattaagtaggcgcgccatgcttcatcagactct

SEQ ID NO: 5567 - DNA, 190 bp, Artificial Sequence; identical to SEQ ID NO: 5566
  Synthetic polynucleotide

SEQ ID NO: 5568 - DNA, 188 bp, Artificial Sequence
  Synthetic polynucleotide
atcatctcaccttgcctcctggagggttaaggaagaaccctgcaggtaccacgtgtcaagataccacgtgtcatcgtaccacgtgtcagactaccacgtgtcactataccacgtgtcaacttaccacgtgtcatgctaccacgtgtcagtataccacgtgtcaggcgcgccatgcttcatcagactct

SEQ ID NO: 5569 - DNA, 188 bp, Artificial Sequence; identical to SEQ ID NO: 5568
  Synthetic polynucleotide

SEQ ID NO: 5570 - DNA, 180 bp, Artificial Sequence
  Synthetic polynucleotide
atcatctcaccttgcctcctggttaggtgagcgttgtacctgcaggttttaattggtagattttaattggttcgttttaattggtgacttttaattggtctattttaattggtactttttaattggttgcttttaattggtgtattttaattggtggcgcgccatgcttcatcagactct

SEQ ID NO: 5571 - DNA, 180 bp, Artificial Sequence; identical to SEQ ID NO: 5570
  Synthetic polynucleotide

SEQ ID NO: 5572 - DNA, 172 bp, Artificial Sequence
  Synthetic polynucleotide
atcatctcaccttgcctcctgcagagatccaatactaccctgcaggtgtttgctttagatgtttgcttttcgtgtttgctttgactgtttgctttctatgtttgctttacttgtttgcttttgctgtttgctttgtatgtttgctttggcgcgccatgcttcatcagactct

SEQ ID NO: 5573 - DNA, 172 bp, Artificial Sequence; identical to SEQ ID NO: 5572
  Synthetic polynucleotide

SEQ ID NO: 5574 - DNA, 172 bp, Artificial Sequence
  Synthetic polynucleotide
atcatctcaccttgcctcctgcgacggatcttcttacccctgcaggcacttccggtagacacttccggttcgcacttccggtgaccacttccggtctacacttccggtactcacttccggttgccacttccggtgtacacttccggtggcgcgccatgcttcatcagactct

SEQ ID NO: 5575 - DNA, 172 bp, Artificial Sequence; identical to SEQ ID NO: 5574
  Synthetic polynucleotide

SEQ ID NO: 5576 - DNA, 172 bp, Artificial Sequence
  Synthetic polynucleotide
atcatctcaccttgcctcctgaggatctgatgcagcctcctgcaggaaggtgtcaaagaaaggtgtcaatcgaaggtgtcaagacaaggtgtcaactaaaggtgtcaaactaaggtgtcaatgcaaggtgtcaagtaaaggtgtcaaggcgcgccatgcttcatcagactct

SEQ ID NO: 5577 - DNA, 172 bp, Artificial Sequence; identical to SEQ ID NO: 5576
  Synthetic polynucleotide

SEQ ID NO: 5578 - DNA, 156 bp, Artificial Sequence
  Synthetic polynucleotide
atcatctcaccttgcctcctggatcagcataacgctcgcctgcaggtataaacaagatataaacatcgtataaacagactataaacactatataaacaacttataaacatgctataaacagtatataaacaggcgcgccatgcttcatcagactct

SEQ ID NO: 5579 - DNA, 156 bp, Artificial Sequence; identical to SEQ ID NO: 5578
  Synthetic polynucleotide

SEQ ID NO: 5580 - DNA, 172 bp, Artificial Sequence
  Synthetic polynucleotide
atcatctcaccttgcctcctgaggatcctacattgtcacctgcaggttgacacctcagattgacacctctcgttgacacctcgacttgacacctcctattgacacctcactttgacacctctgcttgacacctcgtattgacacctcggcgcgccatgcttcatcagactct

SEQ ID NO: 5581 - DNA, 172 bp, Artificial Sequence; identical to SEQ ID NO: 5580
  Synthetic polynucleotide

SEQ ID NO: 5582 - DNA, 172 bp, Artificial Sequence
  Synthetic polynucleotide
atcatctcaccttgcctcctgagcttagtatccattggcctgcaggaccgtttagcagaaccgtttagctcgaccgtttagcgacaccgtttagcctaaccgtttagcactaccgtttagctgcaccgtttagcgtaaccgtttagcggcgcgccatgcttcatcagactct

SEQ ID NO: 5583 - DNA, 172 bp, Artificial Sequence; identical to SEQ ID NO: 5582
  Synthetic polynucleotide

SEQ ID NO: 5584 - DNA, 180 bp, Artificial Sequence
  Synthetic polynucleotide
atcatctcaccttgcctcctgacgaagacagcaggagacctgcaggtgattaaattaagatgattaaattatcgtgattaaattagactgattaaattactatgattaaattaacttgattaaattatgctgattaaattagtatgattaaattaggcgcgccatgcttcatcagactct

SEQ ID NO: 5585 - DNA, 180 bp, Artificial Sequence; identical to SEQ ID NO: 5584
  Synthetic polynucleotide

SEQ ID NO: 5586 - DNA, 191 bp, Artificial Sequence
  Synthetic polynucleotide
atcatctcaccttgcctcctgagtccgacgatatgaggcctgcaggtttcacttcctctttttagatttcacttcctcttttttcgtttcacttcctctttttgactttcacttcctctttttctatttcacttcctctttttacttttcacttcctcttttttgcggcgcgccatgcttcatcagactct

SEQ ID NO: 5587 - DNA, 191 bp, Artificial Sequence; identical to SEQ ID NO: 5586
  Synthetic polynucleotide

SEQ ID NO: 5588 - DNA, 180 bp, Artificial Sequence
  Synthetic polynucleotide
atcatctcaccttgcctcctgagcgccgttcttagaatcctgcaggggaccacccagagaggaccacccagtcgggaccacccaggacggaccacccagctaggaccacccagactggaccacccagtgcggaccacccaggtaggaccacccagggcgcgccatgcttcatcagactct

SEQ ID NO: 5589 - DNA, 180 bp, Artificial Sequence; identical to SEQ ID NO: 5588
  Synthetic polynucleotide

SEQ ID NO: 5590 - DNA, 191 bp, Artificial Sequence
  Synthetic polynucleotide
atcatctcaccttgcctcctgttatcgctgtaggcctgcctgcagggagtattatgggatggaagagagtattatgggatggatcggagtattatgggatggagacgagtattatgggatggactagagtattatgggatggaactgagtattatgggatggatgcggcgcgccatgcttcatcagactct

SEQ ID NO: 5591 - DNA, 191 bp, Artificial Sequence; identical to SEQ ID NO: 5590
  Synthetic polynucleotide

SEQ ID NO: 5592 - DNA, 156 bp, Artificial Sequence
  Synthetic polynucleotide
atcatctcaccttgcctcctgtacgagattgggtttgacctgcaggctgataagagactgataagtcgctgataaggacctgataagctactgataagactctgataagtgcctgataaggtactgataagggcgcgccatgcttcatcagactct

SEQ ID NO: 5593 - DNA, 156 bp, Artificial Sequence; identical to SEQ ID NO: 5592
  Synthetic polynucleotide

SEQ ID NO: 5594 - DNA, 185 bp, Artificial Sequence
  Synthetic polynucleotide
atcatctcaccttgcctcctggcaactattggagaattcctgcaggtatcttatcttatcttagatatcttatcttatctttcgtatcttatcttatcttgactatcttatcttatcttctatatcttatcttatcttacttatcttatcttatctttgcggcgcgccatgcttcatcagactct

SEQ ID NO: 5595 - DNA, 185 bp, Artificial Sequence; identical to SEQ ID NO: 5594
  Synthetic polynucleotide

SEQ ID NO: 5596 - DNA, 191 bp, Artificial Sequence
  Synthetic polynucleotide
atcatctcaccttgcctcctgtcgccacattgtttctgcctgcaggtatcaatgttattgataagatatcaatgttattgatatcgtatcaatgttattgatagactatcaatgttattgatactatatcaatgttattgataacttatcaatgttattgatatgcggcgcgccatgcttcatcagactct

SEQ ID NO: 5597 - DNA, 191 bp, Artificial Sequence; identical to SEQ ID NO: 5596
  Synthetic polynucleotide

SEQ ID NO: 5598 - DNA, 180 bp, Artificial Sequence
  Synthetic polynucleotide
atcatctcaccttgcctcctgctagtcagtcgggcatgcctgcaggacagctgctgcagaacagctgctgctcgacagctgctgcgacacagctgctgcctaacagctgctgcactacagctgctgctgcacagctgctgcgtaacagctgctgcggcgcgccatgcttcatcagactct

SEQ ID NO: 5599 - DNA, 180 bp, Artificial Sequence; identical to SEQ ID NO: 5598
  Synthetic polynucleotide

SEQ ID NO: 5600 - DNA, 180 bp, Artificial Sequence
  Synthetic polynucleotide
atcatctcaccttgcctcctgagctaacacccaagtttcctgcaggttgaccttgaaagattgaccttgaatcgttgaccttgaagacttgaccttgaactattgaccttgaaactttgaccttgaatgcttgaccttgaagtattgaccttgaaggcgcgccatgcttcatcagactct

SEQ ID NO: 5601 - DNA, 180 bp, Artificial Sequence; identical to SEQ ID NO: 5600
  Synthetic polynucleotide

SEQ ID NO: 5602 - DNA, 191 bp, Artificial Sequence
  Synthetic polynucleotide
atcatctcaccttgcctcctgtgtgggtgtcgtccagacctgcaggttttactttcactttcactttagattttactttcactttcacttttcgttttactttcactttcactttgacttttactttcactttcactttctattttactttcactttcactttactggcgcgccatgcttcatcagactct

SEQ ID NO: 5603 - DNA, 191 bp, Artificial Sequence; identical to SEQ ID NO: 5602
  Synthetic polynucleotide

SEQ ID NO: 5604 - DNA, 172 bp, Artificial Sequence
  Synthetic polynucleotide
atcatctcaccttgcctcctgagaacgtatagggaagccctgcaggcacgcacgcaagacacgcacgcatcgcacgcacgcagaccacgcacgcactacacgcacgcaactcacgcacgcatgccacgcacgcagtacacgcacgcaggcgcgccatgcttcatcagactct

SEQ ID NO: 5605 - DNA, 172 bp, Artificial Sequence; identical to SEQ ID NO: 5604
  Synthetic polynucleotide

SEQ ID NO: 5606 - DNA, 156 bp, Artificial Sequence
  Synthetic polynucleotide
atcatctcaccttgcctcctggaacaatcggagaagtccctgcaggaccacaaaagaaccacaaatcgaccacaaagacaccacaaactaaccacaaaactaccacaaatgcaccacaaagtaaccacaaaggcgcgccatgcttcatcagactct

SEQ ID NO: 5607 - DNA, 156 bp, Artificial Sequence; identical to SEQ ID NO: 5606
  Synthetic polynucleotide

SEQ ID NO: 5608 - DNA, 188 bp, Artificial Sequence
  Synthetic polynucleotide
atcatctcaccttgcctcctgcgtcgatcgaaaggtttcctgcaggaaattgacctcaagaaaattgacctcatcgaaattgacctcagacaaattgacctcactaaaattgacctcaactaaattgacctcatgcaaattgacctcagtaaaattgacctcaggcgcgccatgcttcatcagactct

SEQ ID NO: 5609 - DNA, 188 bp, Artificial Sequence; identical to SEQ ID NO: 5608
  Synthetic polynucleotide

SEQ ID NO: 5610 - DNA, 172 bp, Artificial Sequence
  Synthetic polynucleotide
atcatctcaccttgcctcctggaggaaagtactccttccctgcaggataatgcataagaataatgcatatcgataatgcatagacataatgcatactaataatgcataactataatgcatatgcataatgcatagtaataatgcataggcgcgccatgcttcatcagactct

SEQ ID NO: 5611 - DNA, 172 bp, Artificial Sequence; identical to SEQ ID NO: 5610
  Synthetic polynucleotide

SEQ ID NO: 5612 - DNA, 186 bp, Artificial Sequence
  Synthetic polynucleotide
atcatctcaccttgcctcctgtccctacgcgttcatcacctgcaggccccggccccgcccccccccagaccccggccccgccccccccctcgccccggccccgcccccccccgacccccggccccgcccccccccctaccccggccccgcccccccccactggcgcgccatgcttcatcagactct

SEQ ID NO: 5613 - DNA, 186 bp, Artificial Sequence; identical to SEQ ID NO: 5612
  Synthetic polynucleotide

SEQ ID NO: 5614 - DNA, 190 bp, Artificial Sequence
  Synthetic polynucleotide
atcatctcaccttgcctcctgagaatcacaccaaagtacctgcagggattgcatcatcctagagattgcatcatccttcggattgcatcatcctgacgattgcatcatcctctagattgcatcatcctactgattgcatcatccttgcgattgcatcatcctgtaggcgcgccatgcttcatcagactct

SEQ ID NO: 5615 - DNA, 190 bp, Artificial Sequence; identical to SEQ ID NO: 5614
  Synthetic polynucleotide

SEQ ID NO: 5616 - DNA, 188 bp, Artificial Sequence
  Synthetic polynucleotide
atcatctcaccttgcctcctgtgcacggaagtcgctcacctgcaggtaatgacacgtcagataatgacacgtctcgtaatgacacgtcgactaatgacacgtcctataatgacacgtcacttaatgacacgtctgctaatgacacgtcgtataatgacacgtcggcgcgccatgcttcatcagactct

SEQ ID NO: 5617 - DNA, 188 bp, Artificial Sequence; identical to SEQ ID NO: 5616
  Synthetic polynucleotide

SEQ ID NO: 5618 - DNA, 196 bp, Artificial Sequence
  Synthetic polynucleotide
atcatctcaccttgcctcctgtctcgatcgaataaagacctgcaggggtcaaagttcatagaggtcaaagttcattcgggtcaaagttcatgacggtcaaagttcatctaggtcaaagttcatactggtcaaagttcattgcggtcaaagttcatgtaggtcaaagttcatggcgcgccatgcttcatcagactct

SEQ ID NO: 5619 - DNA, 196 bp, Artificial Sequence; identical to SEQ ID NO: 5618
  Synthetic polynucleotide

SEQ ID NO: 5620 - DNA, 197 bp, Artificial Sequence
  Synthetic polynucleotide
atcatctcaccttgcctcctggagtcacttatctccatcctgcaggcaggcgccgccgccgagacaggcgccgccgccgtcgcaggcgccgccgccggaccaggcgccgccgccgctacaggcgccgccgccgactcaggcgccgccgccgtgccaggcgccgccgccggtaggcgcgccatgcttcatcagactct

SEQ ID NO: 5621 - DNA, 197 bp, Artificial Sequence; identical to SEQ ID NO: 5620
  Synthetic polynucleotide

SEQ ID NO: 5622 - DNA, 200 bp, Artificial Sequence
  Synthetic polynucleotide
atcatctcaccttgcctcctgcatagcgtcttcctgtacctgcaggctggtgggggcagataaggagactggtgggggcagataaggtcgctggtgggggcagataagggacctggtgggggcagataaggctactggtgggggcagataaggactctggtgggggcagataaggggcgcgccatgcttcatcagactct

SEQ ID NO: 5623 - DNA, 200 bp, Artificial Sequence; identical to SEQ ID NO: 5622
  Synthetic polynucleotide

SEQ ID NO: 5624 - DNA, 156 bp, Artificial Sequence
  Synthetic polynucleotide
atcatctcaccttgcctcctgagcacgtacgtattcctcctgcagggggagcacagagggagcactcggggagcacgacgggagcacctagggagcacactgggagcactgcgggagcacgtagggagcacggcgcgccatgcttcatcagactct

SEQ ID NO: 5625 - DNA, 156 bp, Artificial Sequence; identical to SEQ ID NO: 5624
  Synthetic polynucleotide

SEQ ID NO: 5626 - DNA, 156 bp, Artificial Sequence
  Synthetic polynucleotide
atcatctcaccttgcctcctggcagctaagtcgatctgcctgcaggaaaggggcagaaaaggggctcgaaaggggcgacaaaggggcctaaaaggggcactaaaggggctgcaaaggggcgtaaaaggggcggcgcgccatgcttcatcagactct

SEQ ID NO: 5627 - DNA, 156 bp, Artificial Sequence; identical to SEQ ID NO: 5626
  Synthetic polynucleotide

SEQ ID NO: 5628 - DNA, 156 bp, Artificial Sequence
  Synthetic polynucleotide
atcatctcaccttgcctcctggcgatagctggtagtcacctgcaggataattatagaataattattcgataattatgacataattatctaataattatactataattattgcataattatgtaataattatggcgcgccatgcttcatcagactct

SEQ ID NO: 5629 - DNA, 156 bp, Artificial Sequence; identical to SEQ ID NO: 5628
  Synthetic polynucleotide

SEQ ID NO: 5630 - DNA, 190 bp, Artificial Sequence
  Synthetic polynucleotide
atcatctcaccttgcctcctgagcgttagtgaatccaccctgcagggctgccatctagtgagagctgccatctagtgtcggctgccatctagtggacgctgccatctagtgctagctgccatctagtgactgctgccatctagtgtgcgctgccatctagtggtaggcgcgccatgcttcatcagactct

SEQ ID NO: 5631 - DNA, 190 bp, Artificial Sequence; identical to SEQ ID NO: 5630
  Synthetic polynucleotide

SEQ ID NO: 5632 - DNA, 188 bp, Artificial Sequence
  Synthetic polynucleotide
atcatctcaccttgcctcctgtactgcggctgtcgaaacctgcaggttgaatattcatagattgaatattcattcgttgaatattcatgacttgaatattcatctattgaatattcatactttgaatattcattgcttgaatattcatgtattgaatattcatggcgcgccatgcttcatcagactct

SEQ ID NO: 5633 - DNA, 188 bp, Artificial Sequence; identical to SEQ ID NO: 5632
  Synthetic polynucleotide

SEQ ID NO: 5634 - DNA, 191 bp, Artificial Sequence
  Synthetic polynucleotide
atcatctcaccttgcctcctggtacgggttcagtcaggcctgcagggaacaattgcagtgttcagagaacaattgcagtgttctcggaacaattgcagtgttcgacgaacaattgcagtgttcctagaacaattgcagtgttcactgaacaattgcagtgttctgcggcgcgccatgcttcatcagactct

SEQ ID NO: 5635 - DNA, 191 bp, Artificial Sequence; identical to SEQ ID NO: 5634
  Synthetic polynucleotide

SEQ ID NO: 5636 - DNA, 188 bp, Artificial Sequence
  Synthetic polynucleotide
atcatctcaccttgcctcctggcatgtttacatgcgagcctgcaggaaaaagaggaagagaaaaaagaggaagtcgaaaaagaggaaggacaaaaagaggaagctaaaaaagaggaagactaaaaagaggaagtgcaaaaagaggaaggtaaaaaagaggaagggcgcgccatgcttcatcagactct

SEQ ID NO: 5637 - DNA, 188 bp, Artificial Sequence; identical to SEQ ID NO: 5636
  Synthetic polynucleotide

SEQ ID NO: 5638 - DNA, 197 bp, Artificial Sequence
  Synthetic polynucleotide
atcatctcaccttgcctcctgtctttacgtaatggactcctgcaggtaaataaatatttcaagataaataaatatttcatcgtaaataaatatttcagactaaataaatatttcactataaataaatatttcaacttaaataaatatttcatgctaaataaatatttcagtaggcgcgccatgcttcatcagactct

SEQ ID NO: 5639 - DNA, 197 bp, Artificial Sequence; identical to SEQ ID NO: 5638
  Synthetic polynucleotide

SEQ ID NO: 5640 - DNA, 172 bp, Artificial Sequence
  Synthetic polynucleotide
atcatctcaccttgcctcctgagttgcgtcgatcggttcctgcaggttcccggaaaagattcccggaaatcgttcccggaaagacttcccggaaactattcccggaaaactttcccggaaatgcttcccggaaagtattcccggaaaggcgcgccatgcttcatcagactct

SEQ ID NO: 5641 - DNA, 172 bp, Artificial Sequence; identical to SEQ ID NO: 5640
  Synthetic polynucleotide

SEQ ID NO: 5642 - DNA, 164 bp, Artificial Sequence
  Synthetic polynucleotide
atcatctcaccttgcctcctgctctgggttaaagctgacctgcaggagctgtcaaagaagctgtcaatcgagctgtcaagacagctgtcaactaagctgtcaaactagctgtcaatgcagctgtcaagtaagctgtcaaggcgcgccatgcttcatcagactct

SEQ ID NO: 5643 - DNA, 164 bp, Artificial Sequence; identical to SEQ ID NO: 5642
  Synthetic polynucleotide

SEQ ID NO: 5644 - DNA, 196 bp, Artificial Sequence
  Synthetic polynucleotide
atcatctcaccttgcctcctgttgaccgtcgcgagtctcctgcaggaaacccggaagtaagaaaacccggaagtatcgaaacccggaagtagacaaacccggaagtactaaaacccggaagtaactaaacccggaagtatgcaaacccggaagtagtaaaacccggaagtaggcgcgccatgcttcatcagactct

SEQ ID NO: 5645 - DNA, 196 bp, Artificial Sequence; identical to SEQ ID NO: 5644
  Synthetic polynucleotide

SEQ ID NO: 5646 - DNA, 197 bp, Artificial Sequence
  Synthetic polynucleotide
atcatctcaccttgcctcctgactctgaggacgcttgacctgcaggagcatgactcatcgtagaagcatgactcatcgttcgagcatgactcatcgtgacagcatgactcatcgtctaagcatgactcatcgtactagcatgactcatcgttgcagcatgactcatcgtgtaggcgcgccatgcttcatcagactct

SEQ ID NO: 5647 - DNA, 197 bp, Artificial Sequence; identical to SEQ ID NO: 5646
  Synthetic polynucleotide

SEQ ID NO: 5648 - DNA, 164 bp, Artificial Sequence
  Synthetic polynucleotide
atcatctcaccttgcctcctgacttagattgagagtaccctgcaggacagttacaagaacagttacatcgacagttacagacacagttacactaacagttacaactacagttacatgcacagttacagtaacagttacaggcgcgccatgcttcatcagactct

SEQ ID NO: 5649 - DNA, 164 bp, Artificial Sequence; identical to SEQ ID NO: 5648
  Synthetic polynucleotide

SEQ ID NO: 5650 - DNA, 172 bp, Artificial Sequence
  Synthetic polynucleotide
atcatctcaccttgcctcctgcatcgatccggctctaccctgcaggaaggggcgggagaaaggggcgggtcgaaggggcggggacaaggggcgggctaaaggggcgggactaaggggcgggtgcaaggggcggggtaaaggggcgggggcgcgccatgcttcatcagactct

SEQ ID NO: 5651 - DNA, 172 bp, Artificial Sequence; identical to SEQ ID NO: 5650
  Synthetic polynucleotide

SEQ ID NO: 5652 - DNA, 164 bp, Artificial Sequence
  Synthetic polynucleotide
atcatctcaccttgcctcctgtcgttgaactggctgtgcctgcaggttgacctctagattgacctcttcgttgacctctgacttgacctctctattgacctctactttgacctcttgcttgacctctgtattgacctctggcgcgccatgcttcatcagactct

SEQ ID NO: 5653 - DNA, 164 bp, Artificial Sequence; identical to SEQ ID NO: 5652
  Synthetic polynucleotide

SEQ ID NO: 5654 - DNA, 164 bp, Artificial Sequence
  Synthetic polynucleotide
atcatctcaccttgcctcctgtgcgtggttctacgacacctgcaggctaattggtagactaattggttcgctaattggtgacctaattggtctactaattggtactctaattggttgcctaattggtgtactaattggtggcgcgccatgcttcatcagactct

SEQ ID NO: 5655 - DNA, 164 bp, Artificial Sequence; identical to SEQ ID NO: 5654
  Synthetic polynucleotide

SEQ ID NO: 5656 - DNA, 196 bp, Artificial Sequence
  Synthetic polynucleotide
atcatctcaccttgcctcctgacaagcgtctctatttccctgcaggcgctgccctctgcagacgctgccctctgctcgcgctgccctctgcgaccgctgccctctgcctacgctgccctctgcactcgctgccctctgctgccgctgccctctgcgtacgctgccctctgcggcgcgccatgcttcatcagactct

SEQ ID NO: 5657 - DNA, 196 bp, Artificial Sequence; identical to SEQ ID NO: 5656
  Synthetic polynucleotide

SEQ ID NO: 5658 - DNA, 197 bp, Artificial Sequence
  Synthetic polynucleotide
atcatctcaccttgcctcctgccaccactccatgctaacctgcaggcatttcccggaaatgagacatttcccggaaatgtcgcatttcccggaaatggaccatttcccggaaatgctacatttcccggaaatgactcatttcccggaaatgtgccatttcccggaaatggtaggcgcgccatgcttcatcagactct

SEQ ID NO: 5659 - DNA, 197 bp, Artificial Sequence; identical to SEQ ID NO: 5658
  Synthetic polynucleotide

SEQ ID NO: 5660 - DNA, 197 bp, Artificial Sequence
  Synthetic polynucleotide
atcatctcaccttgcctcctgtacaagaggccgtcccacctgcaggagggtcaaaaggtcaagaagggtcaaaaggtcatcgagggtcaaaaggtcagacagggtcaaaaggtcactaagggtcaaaaggtcaactagggtcaaaaggtcatgcagggtcaaaaggtcagtaggcgcgccatgcttcatcagactct

SEQ ID NO: 5661 - DNA, 197 bp, Artificial Sequence; identical to SEQ ID NO: 5660
  Synthetic polynucleotide

SEQ ID NO: 5662 - DNA, 191 bp, Artificial Sequence
  Synthetic polynucleotide
atcatctcaccttgcctcctggaagtttaagtagtgtgcctgcaggtgtttacacttgtttatagatgtttacacttgtttattcgtgtttacacttgtttatgactgtttacacttgtttatctatgtttacacttgtttatacttgtttacacttgtttattgcggcgcgccatgcttcatcagactct

SEQ ID NO: 5663 - DNA, 191 bp, Artificial Sequence; identical to SEQ ID NO: 5662
  Synthetic polynucleotide

SEQ ID NO: 5664 - DNA, 172 bp, Artificial Sequence
  Synthetic polynucleotide
atcatctcaccttgcctcctggtacgctgggtaaaccacctgcaggtttcactttcagatttcactttctcgtttcactttcgactttcactttcctatttcactttcacttttcactttctgctttcactttcgtatttcactttcggcgcgccatgcttcatcagactct

SEQ ID NO: 5665 - DNA, 172 bp, Artificial Sequence; identical to SEQ ID NO: 5664
  Synthetic polynucleotide

SEQ ID NO: 5666 - DNA, 197 bp, Artificial Sequence
  Synthetic polynucleotide
atcatctcaccttgcctcctgagcagagcccttacaagcctgcaggatgagtcatccctttagaatgagtcatcccttttcgatgagtcatccctttgacatgagtcatccctttctaatgagtcatccctttactatgagtcatcccttttgcatgagtcatccctttgtaggcgcgccatgcttcatcagactct

SEQ ID NO: 5667 - DNA, 197 bp, Artificial Sequence; identical to SEQ ID NO: 5666
  Synthetic polynucleotide

SEQ ID NO: 5668 - DNA, 140 bp, Artificial Sequence
  Synthetic polynucleotide
atcatctcaccttgcctcctggtgatgaatgttctgctcctgcaggcggaagagacggaagtcgcggaaggaccggaagctacggaagactcggaagtgccggaaggtacggaagggcgcgccatgcttcatcagactct

SEQ ID NO: 5669 - DNA, 140 bp, Artificial Sequence; identical to SEQ ID NO: 5668
  Synthetic polynucleotide

SEQ ID NO: 5670 - DNA, 172 bp, Artificial Sequence
  Synthetic polynucleotide
atcatctcaccttgcctcctgaagggccttgatagtggcctgcaggtttgtttatgagatttgtttatgtcgtttgtttatggactttgtttatgctatttgtttatgacttttgtttatgtgctttgtttatggtatttgtttatgggcgcgccatgcttcatcagactct

SEQ ID NO: 5671 - DNA, 172 bp, Artificial Sequence; identical to SEQ ID NO: 5670
  Synthetic polynucleotide

SEQ ID NO: 5672 - DNA, 190 bp, Artificial Sequence
  Synthetic polynucleotide
atcatctcaccttgcctcctgagacgcgaatggttcgtcctgcaggccaccagggggcgcagaccaccagggggcgctcgccaccagggggcgcgacccaccagggggcgcctaccaccagggggcgcactccaccagggggcgctgcccaccagggggcgcgtaggcgcgccatgcttcatcagactct

SEQ ID NO: 5673 - DNA, 190 bp, Artificial Sequence; identical to SEQ ID NO: 5672
  Synthetic polynucleotide

SEQ ID NO: 5674 - DNA, 185 bp, Artificial Sequence
  Synthetic polynucleotide
atcatctcaccttgcctcctgacctctttgcctagactcctgcaggtgaactcaatgaactcagatgaactcaatgaactctcgtgaactcaatgaactcgactgaactcaatgaactcctatgaactcaatgaactcacttgaactcaatgaactctgcggcgcgccatgcttcatcagactct

SEQ ID NO: 5675 - DNA, 185 bp, Artificial Sequence; identical to SEQ ID NO: 5674
  Synthetic polynucleotide

SEQ ID NO: 5676 - DNA, 172 bp, Artificial Sequence
  Synthetic polynucleotide
atcatctcaccttgcctcctggattcactattaagctgcctgcaggtgggtggggcagatgggtggggctcgtgggtggggcgactgggtggggcctatgggtggggcacttgggtggggctgctgggtggggcgtatgggtggggcggcgcgccatgcttcatcagactct

SEQ ID NO: 5677 - DNA, 172 bp, Artificial Sequence; identical to SEQ ID NO: 5676
  Synthetic polynucleotide

SEQ ID NO: 5678 - DNA, 164 bp, Artificial Sequence
  Synthetic polynucleotide
atcatctcaccttgcctcctgtgttcaagactcctccccctgcaggtttgggttgagatttgggttgtcgtttgggttggactttgggttgctatttgggttgacttttgggttgtgctttgggttggtatttgggttgggcgcgccatgcttcatcagactct

SEQ ID NO: 5679 - DNA, 164 bp, Artificial Sequence; identical to SEQ ID NO: 5678
  Synthetic polynucleotide

SEQ ID NO: 5680 - DNA, 164 bp, Artificial Sequence
  Synthetic polynucleotide
atcatctcaccttgcctcctgtgcttgcggctcttggtcctgcaggacatctgtcagaacatctgtctcgacatctgtcgacacatctgtcctaacatctgtcactacatctgtctgcacatctgtcgtaacatctgtcggcgcgccatgcttcatcagactct

SEQ ID NO: 5681 - DNA, 164 bp, Artificial Sequence; identical to SEQ ID NO: 5680
  Synthetic polynucleotide

SEQ ID NO: 5682 - DNA, 191 bp, Artificial Sequence
  Synthetic polynucleotide
atcatctcaccttgcctcctgacatgaccggagccctacctgcaggtagtgccccctagtggccaaaagatagtgccccctagtggccaaatcgtagtgccccctagtggccaaagactagtgccccctagtggccaaactatagtgccccctagtggccaaaactggcgcgccatgcttcatcagactct

SEQ ID NO: 5683 - DNA, 191 bp, Artificial Sequence; identical to SEQ ID NO: 5682
  Synthetic polynucleotide

SEQ ID NO: 5684 - DNA, 140 bp, Artificial Sequence
  Synthetic polynucleotide
atcatctcaccttgcctcctgatcatggacgcacatttcctgcaggtaattaagataattatcgtaattagactaattactataattaacttaattatgctaattagtataattaggcgcgccatgcttcatcagactct

SEQ ID NO: 5685 - DNA, 140 bp, Artificial Sequence; identical to SEQ ID NO: 5684
  Synthetic polynucleotide

SEQ ID NO: 5686 - DNA, 190 bp, Artificial Sequence
  Synthetic polynucleotide
atcatctcaccttgcctcctgactttcgagggatagaacctgcagggttaatcattaaccagagttaatcattaacctcggttaatcattaaccgacgttaatcattaaccctagttaatcattaaccactgttaatcattaacctgcgttaatcattaaccgtaggcgcgccatgcttcatcagactct

SEQ ID NO: 5687 - DNA, 190 bp, Artificial Sequence; identical to SEQ ID NO: 5686
  Synthetic polynucleotide

SEQ ID NO: 5688 - DNA, 172 bp, Artificial Sequence
  Synthetic polynucleotide
atcatctcaccttgcctcctgaccacgaacaaggccgacctgcaggttgaccgttaagattgaccgttatcgttgaccgttagacttgaccgttactattgaccgttaactttgaccgttatgcttgaccgttagtattgaccgttaggcgcgccatgcttcatcagactct

SEQ ID NO: 5689 - DNA, 172 bp, Artificial Sequence; identical to SEQ ID NO: 5688
  Synthetic polynucleotide

SEQ ID NO: 5690 - DNA, 156 bp, Artificial Sequence
  Synthetic polynucleotide
atcatctcaccttgcctcctgagtttgaagcgtaccttcctgcaggattgttctagaattgttcttcgattgttctgacattgttctctaattgttctactattgttcttgcattgttctgtaattgttctggcgcgccatgcttcatcagactct

SEQ ID NO: 5691 - DNA, 156 bp, Artificial Sequence; identical to SEQ ID NO: 5690
  Synthetic polynucleotide

SEQ ID NO: 5692 - DNA, 172 bp, Artificial Sequence
  Synthetic polynucleotide
atcatctcaccttgcctcctgctgttaaacggtgggtccctgcagggaggtcatgcagagaggtcatgctcggaggtcatgcgacgaggtcatgcctagaggtcatgcactgaggtcatgctgcgaggtcatgcgtagaggtcatgcggcgcgccatgcttcatcagactct

SEQ ID NO: 5693 - DNA, 172 bp, Artificial Sequence; identical to SEQ ID NO: 5692
  Synthetic polynucleotide

SEQ ID NO: 5694 - DNA, 191 bp, Artificial Sequence
  Synthetic polynucleotide
atcatctcaccttgcctcctgagcgggtcacaaagtgtcctgcaggcgtcacgcatgactgcaagacgtcacgcatgactgcatcgcgtcacgcatgactgcagaccgtcacgcatgactgcactacgtcacgcatgactgcaactcgtcacgcatgactgcatgcggcgcgccatgcttcatcagactct

SEQ ID NO: 5695 - DNA, 191 bp, Artificial Sequence; identical to SEQ ID NO: 5694
  Synthetic polynucleotide

SEQ ID NO: 5696 - DNA, 191 bp, Artificial Sequence
  Synthetic polynucleotide
atcatctcaccttgcctcctggcggtactcagtatctccctgcagggccaccagatggcactaagagccaccagatggcactatcggccaccagatggcactagacgccaccagatggcactactagccaccagatggcactaactgccaccagatggcactatgcggcgcgccatgcttcatcagactct

SEQ ID NO: 5697 - DNA, 191 bp, Artificial Sequence; identical to SEQ ID NO: 5696
  Synthetic polynucleotide

SEQ ID NO: 5698 - DNA, 197 bp, Artificial Sequence
  Synthetic polynucleotide
atcatctcaccttgcctcctgtctgtgcctaaggcgaacctgcaggtttccataatggaaaagatttccataatggaaatcgtttccataatggaaagactttccataatggaaactatttccataatggaaaacttttccataatggaaatgctttccataatggaaagtaggcgcgccatgcttcatcagactct

SEQ ID NO: 5699 - DNA, 197 bp, Artificial Sequence; identical to SEQ ID NO: 5698
  Synthetic polynucleotide

SEQ ID NO: 5700 - DNA, 190 bp, Artificial Sequence
  Synthetic polynucleotide
atcatctcaccttgcctcctggtacctattgtacctagcctgcaggaaagatcaaaggaaagaaaagatcaaaggaatcgaaagatcaaaggaagacaaagatcaaaggaactaaaagatcaaaggaaactaaagatcaaaggaatgcaaagatcaaaggaagtaggcgcgccatgcttcatcagactct

SEQ ID NO: 5701 - DNA, 190 bp, Artificial Sequence; identical to SEQ ID NO: 5700
  Synthetic polynucleotide

SEQ ID NO: 5702 - DNA, 164 bp, Artificial Sequence
  Synthetic polynucleotide
atcatctcaccttgcctcctggttgggccaataacggccctgcaggatcagctggagaatcagctggtcgatcagctgggacatcagctggctaatcagctggactatcagctggtgcatcagctgggtaatcagctggggcgcgccatgcttcatcagactct

SEQ ID NO: 5703 - DNA, 164 bp, Artificial Sequence; identical to SEQ ID NO: 5702
  Synthetic polynucleotide

SEQ ID NO: 5704 - DNA, 172 bp, Artificial Sequence
  Synthetic polynucleotide
atcatctcaccttgcctcctgccactaattgtcagcctcctgcaggattaattaatagaattaattaattcgattaattaatgacattaattaatctaattaattaatactattaattaattgcattaattaatgtaattaattaatggcgcgccatgcttcatcagactct

SEQ ID NO: 5705 - DNA, 172 bp, Artificial Sequence; identical to SEQ ID NO: 5704
  Synthetic polynucleotide

SEQ ID NO: 5706 - DNA, 172 bp, Artificial Sequence
  Synthetic polynucleotide
atcatctcaccttgcctcctgatgaataaatgtcggaccctgcaggagcacttgagagaagcacttgagtcgagcacttgaggacagcacttgagctaagcacttgagactagcacttgagtgcagcacttgaggtaagcacttgagggcgcgccatgcttcatcagactct

SEQ ID NO: 5707 - DNA, 172 bp, Artificial Sequence; identical to SEQ ID NO: 5706
  Synthetic polynucleotide

SEQ ID NO: 5708 - DNA, 164 bp, Artificial Sequence
  Synthetic polynucleotide
atcatctcaccttgcctcctgacgaaattcactgccctcctgcaggaatttgtttagaaatttgttttcgaatttgtttgacaatttgtttctaaatttgtttactaatttgttttgcaatttgtttgtaaatttgtttggcgcgccatgcttcatcagactct

SEQ ID NO: 5709 - DNA, 164 bp, Artificial Sequence; identical to SEQ ID NO: 5708
  Synthetic polynucleotide

SEQ ID NO: 5710 - DNA, 172 bp, Artificial Sequence
  Synthetic polynucleotide
atcatctcaccttgcctcctggtcttgcaacgttaatgcctgcaggcggggggcccagacggggggccctcgcggggggcccgaccggggggcccctacggggggcccactcggggggccctgccggggggcccgtacggggggcccggcgcgccatgcttcatcagactct

SEQ ID NO: 5711 - DNA, 172 bp, Artificial Sequence; identical to SEQ ID NO: 5710
  Synthetic polynucleotide

SEQ ID NO: 5712 - DNA, 188 bp, Artificial Sequence
  Synthetic polynucleotide
atcatctcaccttgcctcctgcgcctgaaataggtagacctgcaggaatatgcaaattagaaatatgcaaatttcgaatatgcaaattgacaatatgcaaattctaaatatgcaaattactaatatgcaaatttgcaatatgcaaattgtaaatatgcaaattggcgcgccatgcttcatcagactct

SEQ ID NO: 5713 - DNA, 188 bp, Artificial Sequence; identical to SEQ ID NO: 5712
  Synthetic polynucleotide

SEQ ID NO: 5714 - DNA, 191 bp, Artificial Sequence
  Synthetic polynucleotide
atcatctcaccttgcctcctgttctcctcgttcccatgcctgcaggattaaggggtcacgacaagaattaaggggtcacgacatcgattaaggggtcacgacagacattaaggggtcacgacactaattaaggggtcacgacaactattaaggggtcacgacatgcggcgcgccatgcttcatcagactct

SEQ ID NO: 5715 - DNA, 191 bp, Artificial Sequence; identical to SEQ ID NO: 5714
  Synthetic polynucleotide

SEQ ID NO: 5716 - DNA, 180 bp, Artificial Sequence
  Synthetic polynucleotide
atcatctcaccttgcctcctgtcgcatctatgccctcgcctgcaggccacttccggcagaccacttccggctcgccacttccggcgacccacttccggcctaccacttccggcactccacttccggctgcccacttccggcgtaccacttccggcggcgcgccatgcttcatcagactct

SEQ ID NO: 5717 - DNA, 180 bp, Artificial Sequence; identical to SEQ ID NO: 5716
  Synthetic polynucleotide

SEQ ID NO: 5718 - DNA, 190 bp, Artificial Sequence
  Synthetic polynucleotide
atcatctcaccttgcctcctggtttcctcaccgcgaaacctgcaggcatgaatattcataagacatgaatattcatatcgcatgaatattcatagaccatgaatattcatactacatgaatattcataactcatgaatattcatatgccatgaatattcatagtaggcgcgccatgcttcatcagactct

SEQ ID NO: 5719 - DNA, 190 bp, Artificial Sequence; identical to SEQ ID NO: 5718
  Synthetic polynucleotide

SEQ ID NO: 5720 - DNA, 164 bp, Artificial Sequence
  Synthetic polynucleotide
atcatctcaccttgcctcctgatcttaattcactctcccctgcaggatcagctgaagaatcagctgatcgatcagctgagacatcagctgactaatcagctgaactatcagctgatgcatcagctgagtaatcagctgaggcgcgccatgcttcatcagactct

SEQ ID NO: 5721 - DNA, 164 bp, Artificial Sequence; identical to SEQ ID NO: 5720
  Synthetic polynucleotide

SEQ ID NO: 5722 - DNA, 197 bp, Artificial Sequence
  Synthetic polynucleotide
atcatctcaccttgcctcctgtaacgagcatagcccagcctgcaggatgaatgaaattcatagaatgaatgaaattcattcgatgaatgaaattcatgacatgaatgaaattcatctaatgaatgaaattcatactatgaatgaaattcattgcatgaatgaaattcatgtaggcgcgccatgcttcatcagactct

SEQ ID NO: 5723 - DNA, 197 bp, Artificial Sequence; identical to SEQ ID NO: 5722
  Synthetic polynucleotide

SEQ ID NO: 5724 - DNA, 197 bp, Artificial Sequence
  Synthetic polynucleotide
atcatctcaccttgcctcctgtctatcacaacgggtaccctgcaggcttatctgccccccccagagacttatctgccccccccagtcgcttatctgccccccccaggaccttatctgccccccccagctacttatctgccccccccagactcttatctgccccccccagtgcggcgcgccatgcttcatcagactct

SEQ ID NO: 5725 - DNA, 197 bp, Artificial Sequence; identical to SEQ ID NO: 5724
  Synthetic polynucleotide

SEQ ID NO: 5726 - DNA, 140 bp, Artificial Sequence
  Synthetic polynucleotide
atcatctcaccttgcctcctgtgaacgttacggtcgtccctgcaggtaattgagataattgtcgtaattggactaattgctataattgacttaattgtgctaattggtataattgggcgcgccatgcttcatcagactct

SEQ ID NO: 5727 - DNA, 140 bp, Artificial Sequence; identical to SEQ ID NO: 5726
  Synthetic polynucleotide

SEQ ID NO: 5728 - DNA, 197 bp, Artificial Sequence
  Synthetic polynucleotide
atcatctcaccttgcctcctggactggagtcgttccttcctgcaggtgctatttttggcatagatgctatttttggcattcgtgctatttttggcatgactgctatttttggcatctatgctatttttggcatacttgctatttttggcattgctgctatttttggcatgtaggcgcgccatgcttcatcagactct

SEQ ID NO: 5729 - DNA, 197 bp, Artificial Sequence; identical to SEQ ID NO: 5728
  Synthetic polynucleotide

SEQ ID NO: 5730 - DNA, 197 bp, Artificial Sequence
  Synthetic polynucleotide
atcatctcaccttgcctcctgagtcgcgagagatataccctgcaggcaaggtcacggtgacctgagacaaggtcacggtgacctgtcgcaaggtcacggtgacctggaccaaggtcacggtgacctgctacaaggtcacggtgacctgactcaaggtcacggtgacctgtgcggcgcgccatgcttcatcagactct

SEQ ID NO: 5731 - DNA, 197 bp, Artificial Sequence; identical to SEQ ID NO: 5730
  Synthetic polynucleotide

SEQ ID NO: 5732 - DNA, 164 bp, Artificial Sequence
  Synthetic polynucleotide
atcatctcaccttgcctcctgtccacctgcacagatggcctgcaggcgaccgttaagacgaccgttatcgcgaccgttagaccgaccgttactacgaccgttaactcgaccgttatgccgaccgttagtacgaccgttaggcgcgccatgcttcatcagactct

SEQ ID NO: 5733 - DNA, 164 bp, Artificial Sequence; identical to SEQ ID NO: 5732
  Synthetic polynucleotide

SEQ ID NO: 5734 - DNA, 188 bp, Artificial Sequence
  Synthetic polynucleotide
atcatctcaccttgcctcctgacattgacttgtcacctcctgcaggcaccagggggcgagacaccagggggcgtcgcaccagggggcggaccaccagggggcgctacaccagggggcgactcaccagggggcgtgccaccagggggcggtacaccagggggcgggcgcgccatgcttcatcagactct

SEQ ID NO: 5735 - DNA, 188 bp, Artificial Sequence; identical to SEQ ID NO: 5734
  Synthetic polynucleotide

SEQ ID NO: 5736 - DNA, 191 bp, Artificial Sequence
  Synthetic polynucleotide
atcatctcaccttgcctcctgtagtactatagagcaggcctgcaggtcgcattaattaatgcaagatcgcattaattaatgcatcgtcgcattaattaatgcagactcgcattaattaatgcactatcgcattaattaatgcaacttcgcattaattaatgcatgcggcgcgccatgcttcatcagactct

SEQ ID NO: 5737 - DNA, 191 bp, Artificial Sequence; identical to SEQ ID NO: 5736
  Synthetic polynucleotide

SEQ ID NO: 5738 - DNA, 190 bp, Artificial Sequence
  Synthetic polynucleotide
atcatctcaccttgcctcctgttacagtgttgccttatcctgcaggggccacgcccccttagaggccacgccccctttcgggccacgcccccttgacggccacgcccccttctaggccacgcccccttactggccacgccccctttgcggccacgcccccttgtaggcgcgccatgcttcatcagactct

SEQ ID NO: 5739 - DNA, 190 bp, Artificial Sequence; identical to SEQ ID NO: 5738
  Synthetic polynucleotide

SEQ ID NO: 5740 - DNA, 191 bp, Artificial Sequence
  Synthetic polynucleotide
atcatctcaccttgcctcctgagcaacgcactactcgccctgcaggttttattaattaatttgagattttattaattaatttgtcgttttattaattaatttggacttttattaattaatttgctattttattaattaatttgactttttattaattaatttgtgcggcgcgccatgcttcatcagactct

SEQ ID NO: 5741 - DNA, 191 bp, Artificial Sequence; identical to SEQ ID NO: 5740
  Synthetic polynucleotide

SEQ ID NO: 5742 - DNA, 180 bp, Artificial Sequence
  Synthetic polynucleotide
atcatctcaccttgcctcctggaggagagattcctatacctgcaggagataaggcctagaagataaggccttcgagataaggcctgacagataaggcctctaagataaggcctactagataaggccttgcagataaggcctgtaagataaggcctggcgcgccatgcttcatcagactct

SEQ ID NO: 5743 - DNA, 180 bp, Artificial Sequence; identical to SEQ ID NO: 5742
  Synthetic polynucleotide

SEQ ID NO: 5744 - DNA, 156 bp, Artificial Sequence
  Synthetic polynucleotide
atcatctcaccttgcctcctgccattgatgaagattctcctgcaggataattagagaataattagtcgataattaggacataattagctaataattagactataattagtgcataattaggtaataattagggcgcgccatgcttcatcagactct

SEQ ID NO: 5745 - DNA, 156 bp, Artificial Sequence; identical to SEQ ID NO: 5744
  Synthetic polynucleotide

SEQ ID NO: 5746 - DNA, 185 bp, Artificial Sequence
  Synthetic polynucleotide
atcatctcaccttgcctcctgctaatgacgaagtacgtcctgcaggtataactaattacttaagatataactaattacttatcgtataactaattacttagactataactaattacttactatataactaattacttaacttataactaattacttatgcggcgcgccatgcttcatcagactct

SEQ ID NO: 5747 - DNA, 185 bp, Artificial Sequence; identical to SEQ ID NO: 5746
  Synthetic polynucleotide

SEQ ID NO: 5748 - DNA, 185 bp, Artificial Sequence
  Synthetic polynucleotide
atcatctcaccttgcctcctgaccacagatttagctctcctgcaggctaggggcgcccccaaagactaggggcgcccccaatcgctaggggcgcccccaagacctaggggcgcccccaactactaggggcgcccccaaactctaggggcgcccccaatgcggcgcgccatgcttcatcagactct

SEQ ID NO: 5749 - DNA, 185 bp, Artificial Sequence; identical to SEQ ID NO: 5748
  Synthetic polynucleotide

SEQ ID NO: 5750 - DNA, 191 bp, Artificial Sequence
  Synthetic polynucleotide
atcatctcaccttgcctcctggtaacgaattctgagtgcctgcaggagtttttaattaatttgagaagtttttaattaatttgtcgagtttttaattaatttggacagtttttaattaatttgctaagtttttaattaatttgactagtttttaattaatttgtgcggcgcgccatgcttcatcagactct

SEQ ID NO: 5751 - DNA, 191 bp, Artificial Sequence; identical to SEQ ID NO: 5750
  Synthetic polynucleotide

SEQ ID NO: 5752 - DNA, 196 bp, Artificial Sequence
  Synthetic polynucleotide
atcatctcaccttgcctcctgcaatttaattgagcgcacctgcaggatgaactttgaccagaatgaactttgacctcgatgaactttgaccgacatgaactttgaccctaatgaactttgaccactatgaactttgacctgcatgaactttgaccgtaatgaactttgaccggcgcgccatgcttcatcagactct

SEQ ID NO: 5753 - DNA, 196 bp, Artificial Sequence; identical to SEQ ID NO: 5752
  Synthetic polynucleotide

SEQ ID NO: 5754 - DNA, 156 bp, Artificial Sequence
  Synthetic polynucleotide
atcatctcaccttgcctcctgtcgttacgcgttataagcctgcaggataattacagaataattactcgataattacgacataattacctaataattacactataattactgcataattacgtaataattacggcgcgccatgcttcatcagactct

SEQ ID NO: 5755 - DNA, 156 bp, Artificial Sequence; identical to SEQ ID NO: 5754
  Synthetic polynucleotide

SEQ ID NO: 5756 - DNA, 156 bp, Artificial Sequence
  Synthetic polynucleotide
atcatctcaccttgcctcctggagtaccaagtaacgggcctgcaggataattaaagaataattaatcgataattaagacataattaactaataattaaactataattaatgcataattaagtaataattaaggcgcgccatgcttcatcagactct

SEQ ID NO: 5757 - DNA, 156 bp, Artificial Sequence; identical to SEQ ID NO: 5756
  Synthetic polynucleotide

SEQ ID NO: 5758 - DNA, 188 bp, Artificial Sequence
  Synthetic polynucleotide
atcatctcaccttgcctcctgcgccgggtgttgaatcacctgcaggtgactcaaggggagatgactcaaggggtcgtgactcaagggggactgactcaaggggctatgactcaaggggacttgactcaaggggtgctgactcaagggggtatgactcaaggggggcgcgccatgcttcatcagactct

SEQ ID NO: 5759 - DNA, 188 bp, Artificial Sequence; identical to SEQ ID NO: 5758
  Synthetic polynucleotide

SEQ ID NO: 5760 - DNA, 172 bp, Artificial Sequence
  Synthetic polynucleotide
atcatctcaccttgcctcctgattcagtagggtagtgacctgcaggtcgatattgcagatcgatattgctcgtcgatattgcgactcgatattgcctatcgatattgcacttcgatattgctgctcgatattgcgtatcgatattgcggcgcgccatgcttcatcagactct

SEQ ID NO: 5761 - DNA, 172 bp, Artificial Sequence; identical to SEQ ID NO: 5760
  Synthetic polynucleotide

SEQ ID NO: 5762 - DNA, 172 bp, Artificial Sequence
  Synthetic polynucleotide
atcatctcaccttgcctcctggagagggaactctctaacctgcaggcgtgacctctagacgtgacctcttcgcgtgacctctgaccgtgacctctctacgtgacctctactcgtgacctcttgccgtgacctctgtacgtgacctctggcgcgccatgcttcatcagactct

SEQ ID NO: 5763 - DNA, 172 bp, Artificial Sequence; identical to SEQ ID NO: 5762
  Synthetic polynucleotide

SEQ ID NO: 5764 - DNA, 190 bp, Artificial Sequence
  Synthetic polynucleotide
atcatctcaccttgcctcctgtccggtcaattgaccggcctgcaggattttacggaaaatagaattttacggaaaattcgattttacggaaaatgacattttacggaaaatctaattttacggaaaatactattttacggaaaattgcattttacggaaaatgtaggcgcgccatgcttcatcagactct

SEQ ID NO: 5765 - DNA, 190 bp, Artificial Sequence; identical to SEQ ID NO: 5764
  Synthetic polynucleotide

SEQ ID NO: 5766 - DNA, 140 bp, Artificial Sequence
  Synthetic polynucleotide
atcatctcaccttgcctcctgccttgaaacagagctgccctgcaggtaactaagataactatcgtaactagactaactactataactaacttaactatgctaactagtataactaggcgcgccatgcttcatcagactct

SEQ ID NO: 5767 - DNA, 140 bp, Artificial Sequence; identical to SEQ ID NO: 5766
  Synthetic polynucleotide

SEQ ID NO: 5768 - DNA, 191 bp, Artificial Sequence
  Synthetic polynucleotide
atcatctcaccttgcctcctgcggatactctctctgcccctgcaggggcgctgtccatggtgctgaaagaggcgctgtccatggtgctgaatcgggcgctgtccatggtgctgaagacggcgctgtccatggtgctgaactaggcgctgtccatggtgctgaaactggcgcgccatgcttcatcagactct

SEQ ID NO: 5769 - DNA, 191 bp, Artificial Sequence; identical to SEQ ID NO: 5768
  Synthetic polynucleotide

SEQ ID NO: 5770 - DNA, 197 bp, Artificial Sequence
  Synthetic polynucleotide
atcatctcaccttgcctcctgtacctggaatcttcaagcctgcaggcctagcaacagatgaagacctagcaacagatgatcgcctagcaacagatgagaccctagcaacagatgactacctagcaacagatgaactcctagcaacagatgatgccctagcaacagatgagtaggcgcgccatgcttcatcagactct

SEQ ID NO: 5771 - DNA, 197 bp, Artificial Sequence; identical to SEQ ID NO: 5770
  Synthetic polynucleotide

SEQ ID NO: 5772 - DNA, 172 bp, Artificial Sequence
  Synthetic polynucleotide
atcatctcaccttgcctcctgtaccagtatagtcaatccctgcaggtgacatctggagatgacatctggtcgtgacatctgggactgacatctggctatgacatctggacttgacatctggtgctgacatctgggtatgacatctggggcgcgccatgcttcatcagactct

SEQ ID NO: 5773 - DNA, 172 bp, Artificial Sequence; identical to SEQ ID NO: 5772
  Synthetic polynucleotide

SEQ ID NO: 5774 - DNA, 180 bp, Artificial Sequence
  Synthetic polynucleotide
atcatctcaccttgcctcctgggactaaccgagcttgacctgcaggttcaggtgagaagattcaggtgagatcgttcaggtgagagacttcaggtgagactattcaggtgagaactttcaggtgagatgcttcaggtgagagtattcaggtgagaggcgcgccatgcttcatcagactct

SEQ ID NO: 5775 - DNA, 180 bp, Artificial Sequence; identical to SEQ ID NO: 5774
  Synthetic polynucleotide

SEQ ID NO: 5776 - DNA, 172 bp, Artificial Sequence
  Synthetic polynucleotide
atcatctcaccttgcctcctgagaaccaccggagtgttcctgcaggcgctgactcaagacgctgactcatcgcgctgactcagaccgctgactcactacgctgactcaactcgctgactcatgccgctgactcagtacgctgactcaggcgcgccatgcttcatcagactct

SEQ ID NO: 5777 - DNA, 172 bp, Artificial Sequence; identical to SEQ ID NO: 5776
  Synthetic polynucleotide

SEQ ID NO: 5778 - DNA, 190 bp, Artificial Sequence
  Synthetic polynucleotide
atcatctcaccttgcctcctgataacgagtagagcgttcctgcagggtccttatatggccagagtccttatatggcctcggtccttatatggccgacgtccttatatggccctagtccttatatggccactgtccttatatggcctgcgtccttatatggccgtaggcgcgccatgcttcatcagactct

SEQ ID NO: 5779 - DNA, 190 bp, Artificial Sequence; identical to SEQ ID NO: 5778
  Synthetic polynucleotide

SEQ ID NO: 5780 - DNA, 180 bp, Artificial Sequence
  Synthetic polynucleotide
atcatctcaccttgcctcctgaaagagcagacacgttacctgcaggttttaattgctagattttaattgcttcgttttaattgctgacttttaattgctctattttaattgctactttttaattgcttgcttttaattgctgtattttaattgctggcgcgccatgcttcatcagactct

SEQ ID NO: 5781 - DNA, 180 bp, Artificial Sequence; identical to SEQ ID NO: 5780
  Synthetic polynucleotide

SEQ ID NO: 5782 - DNA, 197 bp, Artificial Sequence
  Synthetic polynucleotide
atcatctcaccttgcctcctgctactgtcaatctcggacctgcaggctttgttatgcaaatagactttgttatgcaaattcgctttgttatgcaaatgacctttgttatgcaaatctactttgttatgcaaatactctttgttatgcaaattgcctttgttatgcaaatgtaggcgcgccatgcttcatcagactct

SEQ ID NO: 5783 - DNA, 197 bp, Artificial Sequence; identical to SEQ ID NO: 5782
  Synthetic polynucleotide

SEQ ID NO: 5784 - DNA, 200 bp, Artificial Sequence
  Synthetic polynucleotide
atcatctcaccttgcctcctgattaggattcagtagagcctgcaggaaatgctgactcagcacaaagaaaatgctgactcagcacaatcgaaatgctgactcagcacaagacaaatgctgactcagcacaactaaaatgctgactcagcacaaactaaatgctgactcagcacaaggcgcgccatgcttcatcagactct

SEQ ID NO: 5785 - DNA, 200 bp, Artificial Sequence; identical to SEQ ID NO: 5784
  Synthetic polynucleotide

SEQ ID NO: 5786 - DNA, 185 bp, Artificial Sequence
  Synthetic polynucleotide
atcatctcaccttgcctcctgagttacggcgcagtggacctgcaggaaggtcaaaaggtcaaagaaaggtcaaaaggtcaatcgaaggtcaaaaggtcaagacaaggtcaaaaggtcaactaaaggtcaaaaggtcaaactaaggtcaaaaggtcaatgcggcgcgccatgcttcatcagactct

SEQ ID NO: 5787 - DNA, 185 bp, Artificial Sequence; identical to SEQ ID NO: 5786
  Synthetic polynucleotide

SEQ ID NO: 5788 - DNA, 180 bp, Artificial Sequence
  Synthetic polynucleotide
atcatctcaccttgcctcctgccttcctaatgcatgcgcctgcaggctctgacgtcaagactctgacgtcatcgctctgacgtcagacctctgacgtcactactctgacgtcaactctctgacgtcatgcctctgacgtcagtactctgacgtcaggcgcgccatgcttcatcagactct

SEQ ID NO: 5789 - DNA, 180 bp, Artificial Sequence; identical to SEQ ID NO: 5788
  Synthetic polynucleotide

SEQ ID NO: 5790 - DNA, 156 bp, Artificial Sequence
  Synthetic polynucleotide
atcatctcaccttgcctcctgctagtcggtaggatgttcctgcaggagtaacggagaagtaacggtcgagtaacgggacagtaacggctaagtaacggactagtaacggtgcagtaacgggtaagtaacggggcgcgccatgcttcatcagactct

SEQ ID NO: 5791 - DNA, 156 bp, Artificial Sequence; identical to SEQ ID NO: 5790
  Synthetic polynucleotide

SEQ ID NO: 5792 - DNA, 190 bp, Artificial Sequence
  Synthetic polynucleotide
atcatctcaccttgcctcctggactaagcaggcgcttgcctgcaggtttgcacacggcacagatttgcacacggcactcgtttgcacacggcacgactttgcacacggcacctatttgcacacggcacacttttgcacacggcactgctttgcacacggcacgtaggcgcgccatgcttcatcagactct

SEQ ID NO: 5793 - DNA, 190 bp, Artificial Sequence; identical to SEQ ID NO: 5792
  Synthetic polynucleotide

SEQ ID NO: 5794 - DNA, 180 bp, Artificial Sequence
  Synthetic polynucleotide
atcatctcaccttgcctcctgagtcttatctcccggctcctgcaggaccccgcccccagaaccccgccccctcgaccccgcccccgacaccccgcccccctaaccccgcccccactaccccgccccctgcaccccgcccccgtaaccccgcccccggcgcgccatgcttcatcagactct

SEQ ID NO: 5795 - DNA, 180 bp, Artificial Sequence; identical to SEQ ID NO: 5794
  Synthetic polynucleotide

SEQ ID NO: 5796 - DNA, 197 bp, Artificial Sequence
  Synthetic polynucleotide
atcatctcaccttgcctcctgtcatgcctcttagtagccctgcaggaattttggcgccaaaatgagaaattttggcgccaaaatgtcgaattttggcgccaaaatggacaattttggcgccaaaatgctaaattttggcgccaaaatgactaattttggcgccaaaatgtgcggcgcgccatgcttcatcagactct

SEQ ID NO: 5797 - DNA, 197 bp, Artificial Sequence; identical to SEQ ID NO: 5796
  Synthetic polynucleotide

SEQ ID NO: 5798 - DNA, 196 bp, Artificial Sequence
  Synthetic polynucleotide
atcatctcaccttgcctcctgtagagccaattggagtccctgcaggcaaggttggttgcagacaaggttggttgctcgcaaggttggttgcgaccaaggttggttgcctacaaggttggttgcactcaaggttggttgctgccaaggttggttgcgtacaaggttggttgcggcgcgccatgcttcatcagactct

SEQ ID NO: 5799 - DNA, 196 bp, Artificial Sequence; identical to SEQ ID NO: 5798
  Synthetic polynucleotide

SEQ ID NO: 5800 - DNA, 188 bp, Artificial Sequence
  Synthetic polynucleotide
atcatctcaccttgcctcctgagccgcagggaccttatcctgcaggtgaggtcaatttagatgaggtcaattttcgtgaggtcaatttgactgaggtcaatttctatgaggtcaatttacttgaggtcaattttgctgaggtcaatttgtatgaggtcaatttggcgcgccatgcttcatcagactct

SEQ ID NO: 5801 - DNA, 188 bp, Artificial Sequence; identical to SEQ ID NO: 5800
  Synthetic polynucleotide

SEQ ID NO: 5802 - DNA, 190 bp, Artificial Sequence
  Synthetic polynucleotide
atcatctcaccttgcctcctgattctattcggaccggacctgcaggtggaggtaattaacagatggaggtaattaactcgtggaggtaattaacgactggaggtaattaacctatggaggtaattaacacttggaggtaattaactgctggaggtaattaacgtaggcgcgccatgcttcatcagactct

SEQ ID NO: 5803 - DNA, 190 bp, Artificial Sequence; identical to SEQ ID NO: 5802
  Synthetic polynucleotide

SEQ ID NO: 5804 - DNA, 188 bp, Artificial Sequence
  Synthetic polynucleotide
atcatctcaccttgcctcctgtgcatggtacacttacccctgcaggggcgtgggaggcagaggcgtgggaggctcgggcgtgggaggcgacggcgtgggaggcctaggcgtgggaggcactggcgtgggaggctgcggcgtgggaggcgtaggcgtgggaggcggcgcgccatgcttcatcagactct

SEQ ID NO: 5805 - DNA, 188 bp, Artificial Sequence; identical to SEQ ID NO: 5804
  Synthetic polynucleotide

SEQ ID NO: 5806 - DNA, 191 bp, Artificial Sequence
  Synthetic polynucleotide
atcatctcaccttgcctcctgtgaggcgcattatactacctgcaggtgccttaattaatgctcagatgccttaattaatgctctcgtgccttaattaatgctcgactgccttaattaatgctcctatgccttaattaatgctcacttgccttaattaatgctctgcggcgcgccatgcttcatcagactct

SEQ ID NO: 5807 - DNA, 191 bp, Artificial Sequence; identical to SEQ ID NO: 5806
  Synthetic polynucleotide

SEQ ID NO: 5808 - DNA, 172 bp, Artificial Sequence
  Synthetic polynucleotide
atcatctcaccttgcctcctgtcgatacgtgacgggagcctgcagggaggtgtcaaagagaggtgtcaatcggaggtgtcaagacgaggtgtcaactagaggtgtcaaactgaggtgtcaatgcgaggtgtcaagtagaggtgtcaaggcgcgccatgcttcatcagactct

SEQ ID NO: 5809 - DNA, 172 bp, Artificial Sequence; identical to SEQ ID NO: 5808
  Synthetic polynucleotide

SEQ ID NO: 5810 - DNA, 197 bp, Artificial Sequence
  Synthetic polynucleotide
atcatctcaccttgcctcctggataggagtagattcgtcctgcaggtatgtaaatattgacataagatatgtaaatattgacatatcgtatgtaaatattgacatagactatgtaaatattgacatactatatgtaaatattgacataacttatgtaaatattgacatatgcggcgcgccatgcttcatcagactct

SEQ ID NO: 5811 - DNA, 197 bp, Artificial Sequence; identical to SEQ ID NO: 5810
  Synthetic polynucleotide

SEQ ID NO: 5812 - DNA, 156 bp, Artificial Sequence
  Synthetic polynucleotide
atcatctcaccttgcctcctgaggatcaggagatattgcctgcagggatttcttagagatttctttcggatttcttgacgatttcttctagatttcttactgatttctttgcgatttcttgtagatttcttggcgcgccatgcttcatcagactct

SEQ ID NO: 5813 - DNA, 156 bp, Artificial Sequence; identical to SEQ ID NO: 5812
  Synthetic polynucleotide

SEQ ID NO: 5814 - DNA, 191 bp, Artificial Sequence
  Synthetic polynucleotide
atcatctcaccttgcctcctgcctcccgttacgccattcctgcaggaagacgctgtaaagcgaagaaagacgctgtaaagcgatcgaagacgctgtaaagcgagacaagacgctgtaaagcgactaaagacgctgtaaagcgaactaagacgctgtaaagcgatgcggcgcgccatgcttcatcagactct

SEQ ID NO: 5815 - DNA, 191 bp, Artificial Sequence; identical to SEQ ID NO: 5814
  Synthetic polynucleotide

SEQ ID NO: 5816 - DNA, 172 bp, Artificial Sequence
  Synthetic polynucleotide
atcatctcaccttgcctcctggaatgggcgcctttcaacctgcagggatttgcataagagatttgcatatcggatttgcatagacgatttgcatactagatttgcataactgatttgcatatgcgatttgcatagtagatttgcataggcgcgccatgcttcatcagactct

SEQ ID NO: 5817 - DNA, 172 bp, Artificial Sequence; identical to SEQ ID NO: 5816
  Synthetic polynucleotide

SEQ ID NO: 5818 - DNA, 180 bp, Artificial Sequence
  Synthetic polynucleotide
atcatctcaccttgcctcctggatacctaaagtcgcgtcctgcaggaggccttatctagaaggccttatcttcgaggccttatctgacaggccttatctctaaggccttatctactaggccttatcttgcaggccttatctgtaaggccttatctggcgcgccatgcttcatcagactct

SEQ ID NO: 5819 - DNA, 180 bp, Artificial Sequence; identical to SEQ ID NO: 5818
  Synthetic polynucleotide

SEQ ID NO: 5820 - DNA, 190 bp, Artificial Sequence
  Synthetic polynucleotide
atcatctcaccttgcctcctgtcgtagaagccgtggtccctgcaggggggcgggggcgggagaggggcgggggcgggtcgggggcgggggcggggacggggcgggggcgggctaggggcgggggcgggactggggcgggggcgggtgcggggcgggggcggggtaggcgcgccatgcttcatcagactct

SEQ ID NO: 5821 - DNA, 190 bp, Artificial Sequence; identical to SEQ ID NO: 5820
  Synthetic polynucleotide

SEQ ID NO: 5822 - DNA, 197 bp, Artificial Sequence
  Synthetic polynucleotide
atcatctcaccttgcctcctgccggttctggtactaagcctgcaggggttgcctagcaacgagaggttgcctagcaacgtcgggttgcctagcaacggacggttgcctagcaacgctaggttgcctagcaacgactggttgcctagcaacgtgcggttgcctagcaacggtaggcgcgccatgcttcatcagactct

SEQ ID NO: 5823 - DNA, 197 bp, Artificial Sequence; identical to SEQ ID NO: 5822
  Synthetic polynucleotide

SEQ ID NO: 5824 - DNA, 156 bp, Artificial Sequence
  Synthetic polynucleotide
atcatctcaccttgcctcctgtgagtatgtgtgataggcctgcaggactaattaagaactaattatcgactaattagacactaattactaactaattaactactaattatgcactaattagtaactaattaggcgcgccatgcttcatcagactct

SEQ ID NO: 5825 - DNA, 156 bp, Artificial Sequence; identical to SEQ ID NO: 5824
  Synthetic polynucleotide

SEQ ID NO: 5826 - DNA, 183 bp, Artificial Sequence
  Synthetic polynucleotide
atcatctcaccttgcctcctggaccaaccaaagtaggtcctgcaggccgccatcttggttaagggcagaggagaccgccatcttggttaagggcagaggtcgccgccatcttggttaagggcagagggacccgccatcttggttaagggcagaggctaggcgcgccatgcttcatcagactct

SEQ ID NO: 5827 - DNA, 183 bp, Artificial Sequence; identical to SEQ ID NO: 5826
  Synthetic polynucleotide

SEQ ID NO: 5828 - DNA, 180 bp, Artificial Sequence
  Synthetic polynucleotide
atcatctcaccttgcctcctgccatggacgatcaaagtcctgcaggacggacacaatagaacggacacaattcgacggacacaatgacacggacacaatctaacggacacaatactacggacacaattgcacggacacaatgtaacggacacaatggcgcgccatgcttcatcagactct

SEQ ID NO: 5829 - DNA, 180 bp, Artificial Sequence; identical to SEQ ID NO: 5828
  Synthetic polynucleotide

SEQ ID NO: 5830 - DNA, 188 bp, Artificial Sequence
  Synthetic polynucleotide
atcatctcaccttgcctcctgccttgcctctcgattaacctgcaggattgcccgccgcagaattgcccgccgctcgattgcccgccgcgacattgcccgccgcctaattgcccgccgcactattgcccgccgctgcattgcccgccgcgtaattgcccgccgcggcgcgccatgcttcatcagactct

SEQ ID NO: 5831 - DNA, 188 bp, Artificial Sequence; identical to SEQ ID NO: 5830
  Synthetic polynucleotide

SEQ ID NO: 5832 - DNA, 197 bp, Artificial Sequence
  Synthetic polynucleotide
atcatctcaccttgcctcctggtgcttctgaaagaaggcctgcaggctgagtcagcaatttagactgagtcagcaattttcgctgagtcagcaatttgacctgagtcagcaatttctactgagtcagcaatttactctgagtcagcaattttgcctgagtcagcaatttgtaggcgcgccatgcttcatcagactct

SEQ ID NO: 5833 - DNA, 197 bp, Artificial Sequence; identical to SEQ ID NO: 5832
  Synthetic polynucleotide

SEQ ID NO: 5834 - DNA, 191 bp, Artificial Sequence
  Synthetic polynucleotide
atcatctcaccttgcctcctgaccaagatgtccgtgtgcctgcagggatcaatgttattgattagagatcaatgttattgatttcggatcaatgttattgattgacgatcaatgttattgattctagatcaatgttattgattactgatcaatgttattgatttgcggcgcgccatgcttcatcagactct

SEQ ID NO: 5835 - DNA, 191 bp, Artificial Sequence; identical to SEQ ID NO: 5834
  Synthetic polynucleotide

SEQ ID NO: 5836 - DNA, 172 bp, Artificial Sequence
  Synthetic polynucleotide
atcatctcaccttgcctcctgactgctacccatgtcaacctgcaggttgcatcagcagattgcatcagctcgttgcatcagcgacttgcatcagcctattgcatcagcactttgcatcagctgcttgcatcagcgtattgcatcagcggcgcgccatgcttcatcagactct

SEQ ID NO: 5837 - DNA, 172 bp, Artificial Sequence; identical to SEQ ID NO: 5836
  Synthetic polynucleotide

SEQ ID NO: 5838 - DNA, 180 bp, Artificial Sequence
  Synthetic polynucleotide
atcatctcaccttgcctcctgagcgattggtcccgttgcctgcaggacttagtcactagaacttagtcacttcgacttagtcactgacacttagtcactctaacttagtcactactacttagtcacttgcacttagtcactgtaacttagtcactggcgcgccatgcttcatcagactct

SEQ ID NO: 5839 - DNA, 180 bp, Artificial Sequence; identical to SEQ ID NO: 5838
  Synthetic polynucleotide

SEQ ID NO: 5840 - DNA, 191 bp, Artificial Sequence
  Synthetic polynucleotide
atcatctcaccttgcctcctgtactacgctcctgtgctcctgcaggttagggtacgccaaagaagattagggtacgccaaagatcgttagggtacgccaaagagacttagggtacgccaaagactattagggtacgccaaagaactttagggtacgccaaagatgcggcgcgccatgcttcatcagactct

SEQ ID NO: 5841 - DNA, 191 bp, Artificial Sequence; identical to SEQ ID NO: 5840
  Synthetic polynucleotide

SEQ ID NO: 5842 - DNA, 191 bp, Artificial Sequence
  Synthetic polynucleotide
atcatctcaccttgcctcctgtgaccaccagcggtactcctgcaggtctttggcgtaccctaaagatctttggcgtaccctaatcgtctttggcgtaccctaagactctttggcgtaccctaactatctttggcgtaccctaaacttctttggcgtaccctaatgcggcgcgccatgcttcatcagactct

SEQ ID NO: 5843 - DNA, 191 bp, Artificial Sequence; identical to SEQ ID NO: 5842
  Synthetic polynucleotide

SEQ ID NO: 5844 - DNA, 148 bp, Artificial Sequence
  Synthetic polynucleotide
atcatctcaccttgcctcctgagaagtatagcgcgaaacctgcaggatcaaagagaatcaaagtcgatcaaaggacatcaaagctaatcaaagactatcaaagtgcatcaaaggtaatcaaagggcgcgccatgcttcatcagactct

SEQ ID NO: 5845 - DNA, 148 bp, Artificial Sequence; identical to SEQ ID NO: 5844
  Synthetic polynucleotide

SEQ ID NO: 5846 - DNA, 191 bp, Artificial Sequence
  Synthetic polynucleotide
atcatctcaccttgcctcctgattcgatgttcatggctcctgcaggtacaacaacctgttcttagatacaacaacctgttctttcgtacaacaacctgttcttgactacaacaacctgttcttctatacaacaacctgttcttacttacaacaacctgttctttgcggcgcgccatgcttcatcagactct

SEQ ID NO: 5847 - DNA, 191 bp, Artificial Sequence; identical to SEQ ID NO: 5846
  Synthetic polynucleotide

SEQ ID NO: 5848 - DNA, 156 bp, Artificial Sequence
  Synthetic polynucleotide
atcatctcaccttgcctcctggctagtatggtgtaagtcctgcaggataattggagaataattggtcgataattgggacataattggctaataattggactataattggtgcataattgggtaataattggggcgcgccatgcttcatcagactct

SEQ ID NO: 5849 - DNA, 156 bp, Artificial Sequence; identical to SEQ ID NO: 5848
  Synthetic polynucleotide

SEQ ID NO: 5850 - DNA, 172 bp, Artificial Sequence
  Synthetic polynucleotide
atcatctcaccttgcctcctgaggcgagtcaagtcctacctgcaggaattgggtcaagaaattgggtcatcgaattgggtcagacaattgggtcactaaattgggtcaactaattgggtcatgcaattgggtcagtaaattgggtcaggcgcgccatgcttcatcagactct

SEQ ID NO: 5851 - DNA, 172 bp, Artificial Sequence; identical to SEQ ID NO: 5850
  Synthetic polynucleotide

SEQ ID NO: 5852 - DNA, 196 bp, Artificial Sequence
  Synthetic polynucleotide
atcatctcaccttgcctcctgggaaatcgtatgtagggcctgcaggttgacctacttatagattgacctacttattcgttgacctacttatgacttgacctacttatctattgacctacttatactttgacctacttattgcttgacctacttatgtattgacctacttatggcgcgccatgcttcatcagactct

SEQ ID NO: 5853 - DNA, 196 bp, Artificial Sequence; identical to SEQ ID NO: 5852
  Synthetic polynucleotide

SEQ ID NO: 5854 - DNA, 180 bp, Artificial Sequence
  Synthetic polynucleotide
atcatctcaccttgcctcctggtggcgaggcaagaactcctgcagggccataaatcaagagccataaatcatcggccataaatcagacgccataaatcactagccataaatcaactgccataaatcatgcgccataaatcagtagccataaatcaggcgcgccatgcttcatcagactct

SEQ ID NO: 5855 - DNA, 180 bp, Artificial Sequence; identical to SEQ ID NO: 5854
  Synthetic polynucleotide

SEQ ID NO: 5856 - DNA, 140 bp, Artificial Sequence
  Synthetic polynucleotide
atcatctcaccttgcctcctgtaacgcctgcttatcatcctgcaggggggcaagaggggcatcgggggcagacggggcactaggggcaactggggcatgcggggcagtaggggcaggcgcgccatgcttcatcagactct

SEQ ID NO: 5857 - DNA, 140 bp, Artificial Sequence; identical to SEQ ID NO: 5856
  Synthetic polynucleotide

SEQ ID NO: 5858 - DNA, 185 bp, Artificial Sequence
  Synthetic polynucleotide
atcatctcaccttgcctcctggaattgcgccagatttacctgcagggggtccaaagtccaatagagggtccaaagtccaattcggggtccaaagtccaatgacgggtccaaagtccaatctagggtccaaagtccaatactgggtccaaagtccaattgcggcgcgccatgcttcatcagactct

SEQ ID NO: 5859 - DNA, 185 bp, Artificial Sequence; identical to SEQ ID NO: 5858
  Synthetic polynucleotide

SEQ ID NO: 5860 - DNA, 191 bp, Artificial Sequence
  Synthetic polynucleotide
atcatctcaccttgcctcctgtaatctaagcccgtccacctgcagggatcaatgttattgatgagagatcaatgttattgatgtcggatcaatgttattgatggacgatcaatgttattgatgctagatcaatgttattgatgactgatcaatgttattgatgtgcggcgcgccatgcttcatcagactct

SEQ ID NO: 5861 - DNA, 191 bp, Artificial Sequence; identical to SEQ ID NO: 5860
  Synthetic polynucleotide

SEQ ID NO: 5862 - DNA, 180 bp, Artificial Sequence
  Synthetic polynucleotide
atcatctcaccttgcctcctgctagcgcctaagacattcctgcaggcttcctggaagagacttcctggaagtcgcttcctggaaggaccttcctggaagctacttcctggaagactcttcctggaagtgccttcctggaaggtacttcctggaagggcgcgccatgcttcatcagactct

SEQ ID NO: 5863 - DNA, 180 bp, Artificial Sequence; identical to SEQ ID NO: 5862
  Synthetic polynucleotide

SEQ ID NO: 5864 - DNA, 156 bp, Artificial Sequence
  Synthetic polynucleotide
atcatctcaccttgcctcctgtatggactgtgctcgaccctgcaggataattgcagaataattgctcgataattgcgacataattgcctaataattgcactataattgctgcataattgcgtaataattgcggcgcgccatgcttcatcagactct

SEQ ID NO: 5865 - DNA, 156 bp, Artificial Sequence; identical to SEQ ID NO: 5864
  Synthetic polynucleotide

SEQ ID NO: 5866 - DNA, 172 bp, Artificial Sequence
  Synthetic polynucleotide
atcatctcaccttgcctcctgagcgtttaatgcggcgacctgcaggctgattggctagactgattggcttcgctgattggctgacctgattggctctactgattggctactctgattggcttgcctgattggctgtactgattggctggcgcgccatgcttcatcagactct

SEQ ID NO: 5867 - DNA, 172 bp, Artificial Sequence; identical to SEQ ID NO: 5866
  Synthetic polynucleotide

SEQ ID NO: 5868 - DNA, 197 bp, Artificial Sequence
  Synthetic polynucleotide
atcatctcaccttgcctcctgccaccacaacttcccagcctgcaggaaattccaggaaatcagaaaattccaggaaatctcgaaattccaggaaatcgacaaattccaggaaatcctaaaattccaggaaatcactaaattccaggaaatctgcaaattccaggaaatcgtaggcgcgccatgcttcatcagactct

SEQ ID NO: 5869 - DNA, 197 bp, Artificial Sequence; identical to SEQ ID NO: 5868
  Synthetic polynucleotide

SEQ ID NO: 5870 - DNA, 197 bp, Artificial Sequence
  Synthetic polynucleotide
atcatctcaccttgcctcctgatctgatggcatttgtgcctgcaggtatgtcaatatttacataagatatgtcaatatttacatatcgtatgtcaatatttacatagactatgtcaatatttacatactatatgtcaatatttacataacttatgtcaatatttacatatgcggcgcgccatgcttcatcagactct

SEQ ID NO: 5871 - DNA, 197 bp, Artificial Sequence; identical to SEQ ID NO: 5870
  Synthetic polynucleotide

SEQ ID NO: 5872 - DNA, 164 bp, Artificial Sequence
  Synthetic polynucleotide
atcatctcaccttgcctcctgcgctggatccattcatccctgcagggacagatgtagagacagatgttcggacagatgtgacgacagatgtctagacagatgtactgacagatgttgcgacagatgtgtagacagatgtggcgcgccatgcttcatcagactct

SEQ ID NO: 5873 - DNA, 164 bp, Artificial Sequence; identical to SEQ ID NO: 5872
  Synthetic polynucleotide

SEQ ID NO: 5874 - DNA, 172 bp, Artificial Sequence
  Synthetic polynucleotide
atcatctcaccttgcctcctgtaatctccagatggttgcctgcaggaggtcaccttagaaggtcacctttcgaggtcaccttgacaggtcaccttctaaggtcaccttactaggtcacctttgcaggtcaccttgtaaggtcaccttggcgcgccatgcttcatcagactct

SEQ ID NO: 5875 - DNA, 172 bp, Artificial Sequence; identical to SEQ ID NO: 5874
  Synthetic polynucleotide

SEQ ID NO: 5876 - DNA, 191 bp, Artificial Sequence
  Synthetic polynucleotide
atcatctcaccttgcctcctggcagtatggccacgatgcctgcaggaaacggttcaggaagttcatcagaaaacggttcaggaagttcatctcgaaacggttcaggaagttcatcgacaaacggttcaggaagttcatcctaaaacggttcaggaagttcatcactggcgcgccatgcttcatcagactct

SEQ ID NO: 5877 - DNA, 191 bp, Artificial Sequence; identical to SEQ ID NO: 5876
  Synthetic polynucleotide

SEQ ID NO: 5878 - DNA, 196 bp, Artificial Sequence
  Synthetic polynucleotide
atcatctcaccttgcctcctggatagggttgtgacagccctgcaggtaattaggtcgagagataattaggtcgagtcgtaattaggtcgaggactaattaggtcgagctataattaggtcgagacttaattaggtcgagtgctaattaggtcgaggtataattaggtcgagggcgcgccatgcttcatcagactct

SEQ ID NO: 5879 - DNA, 196 bp, Artificial Sequence; identical to SEQ ID NO: 5878
  Synthetic polynucleotide

SEQ ID NO: 5880 - DNA, 180 bp, Artificial Sequence
  Synthetic polynucleotide
atcatctcaccttgcctcctgcggctcaaaccttgtaccctgcagggctgattggctagagctgattggcttcggctgattggctgacgctgattggctctagctgattggctactgctgattggcttgcgctgattggctgtagctgattggctggcgcgccatgcttcatcagactct

SEQ ID NO: 5881 - DNA, 180 bp, Artificial Sequence; identical to SEQ ID NO: 5880
  Synthetic polynucleotide

SEQ ID NO: 5882 - DNA, 188 bp, Artificial Sequence
  Synthetic polynucleotide
atcatctcaccttgcctcctgacactagatgatttctccctgcaggggttacgtcaccagaggttacgtcacctcgggttacgtcaccgacggttacgtcaccctaggttacgtcaccactggttacgtcacctgcggttacgtcaccgtaggttacgtcaccggcgcgccatgcttcatcagactct

SEQ ID NO: 5883 - DNA, 188 bp, Artificial Sequence; identical to SEQ ID NO: 5882
  Synthetic polynucleotide

SEQ ID NO: 5884 - DNA, 172 bp, Artificial Sequence
  Synthetic polynucleotide
atcatctcaccttgcctcctgtatttggcaccaaccaccctgcaggcattaaaattagacattaaaatttcgcattaaaattgaccattaaaattctacattaaaattactcattaaaatttgccattaaaattgtacattaaaattggcgcgccatgcttcatcagactct

SEQ ID NO: 5885 - DNA, 172 bp, Artificial Sequence; identical to SEQ ID NO: 5884
  Synthetic polynucleotide

SEQ ID NO: 5886 - DNA, 197 bp, Artificial Sequence
  Synthetic polynucleotide
atcatctcaccttgcctcctgtggagctgaattgcagtcctgcaggtggttaataattaacagtagatggttaataattaacagttcgtggttaataattaacagtgactggttaataattaacagtctatggttaataattaacagtacttggttaataattaacagttgcggcgcgccatgcttcatcagactct

SEQ ID NO: 5887 - DNA, 197 bp, Artificial Sequence; identical to SEQ ID NO: 5886
  Synthetic polynucleotide

SEQ ID NO: 5888 - DNA, 172 bp, Artificial Sequence
  Synthetic polynucleotide
atcatctcaccttgcctcctgggtaactccaaatcgtccctgcagggcaggtgttcagagcaggtgttctcggcaggtgttcgacgcaggtgttcctagcaggtgttcactgcaggtgttctgcgcaggtgttcgtagcaggtgttcggcgcgccatgcttcatcagactct

SEQ ID NO: 5889 - DNA, 172 bp, Artificial Sequence; identical to SEQ ID NO: 5888
  Synthetic polynucleotide

SEQ ID NO: 5890 - DNA, 200 bp, Artificial Sequence
  Synthetic polynucleotide
atcatctcaccttgcctcctgtttgtaggtccacggctcctgcaggtagcgccccctggtggccaagatagcgccccctggtggccatcgtagcgccccctggtggccagactagcgccccctggtggccactatagcgccccctggtggccaacttagcgccccctggtggccaggcgcgccatgcttcatcagactct

SEQ ID NO: 5891 - DNA, 200 bp, Artificial Sequence; identical to SEQ ID NO: 5890
  Synthetic polynucleotide

SEQ ID NO: 5892 - DNA, 185 bp, Artificial Sequence
  Synthetic polynucleotide
atcatctcaccttgcctcctgactttagggataaactgcctgcaggaggccacgtgccggatagaaggccacgtgccggattcgaggccacgtgccggatgacaggccacgtgccggatctaaggccacgtgccggatactaggccacgtgccggattgcggcgcgccatgcttcatcagactct

SEQ ID NO: 5893 - DNA, 185 bp, Artificial Sequence; identical to SEQ ID NO: 5892
  Synthetic polynucleotide

SEQ ID NO: 5894 - DNA, 172 bp, Artificial Sequence
  Synthetic polynucleotide
atcatctcaccttgcctcctgttaaccctgaaccgcatcctgcaggtgtatcaattagatgtatcaatttcgtgtatcaattgactgtatcaattctatgtatcaattacttgtatcaatttgctgtatcaattgtatgtatcaattggcgcgccatgcttcatcagactct

SEQ ID NO: 5895 - DNA, 172 bp, Artificial Sequence; identical to SEQ ID NO: 5894
  Synthetic polynucleotide

SEQ ID NO: 5896 - DNA, 191 bp, Artificial Sequence
  Synthetic polynucleotide
atcatctcaccttgcctcctgtgggtggcagtgcaaagcctgcaggatccattaattaattgaagaatccattaattaattgatcgatccattaattaattgagacatccattaattaattgactaatccattaattaattgaactatccattaattaattgatgcggcgcgccatgcttcatcagactct

SEQ ID NO: 5897 - DNA, 191 bp, Artificial Sequence; identical to SEQ ID NO: 5896
  Synthetic polynucleotide

SEQ ID NO: 5898 - DNA, 196 bp, Artificial Sequence
  Synthetic polynucleotide
atcatctcaccttgcctcctgctcgtttgtaagcaaaccctgcaggattaaccctttctagaattaaccctttcttcgattaaccctttctgacattaaccctttctctaattaaccctttctactattaaccctttcttgcattaaccctttctgtaattaaccctttctggcgcgccatgcttcatcagactct

SEQ ID NO: 5899 - DNA, 196 bp, Artificial Sequence; identical to SEQ ID NO: 5898
  Synthetic polynucleotide

SEQ ID NO: 5900 - DNA, 196 bp, Artificial Sequence
  Synthetic polynucleotide
atcatctcaccttgcctcctgtaggatgccttctctatcctgcaggcatccagatgttcagacatccagatgttctcgcatccagatgttcgaccatccagatgttcctacatccagatgttcactcatccagatgttctgccatccagatgttcgtacatccagatgttcggcgcgccatgcttcatcagactct

SEQ ID NO: 5901 - DNA, 196 bp, Artificial Sequence; identical to SEQ ID NO: 5900
  Synthetic polynucleotide

SEQ ID NO: 5902 - DNA, 190 bp, Artificial Sequence
  Synthetic polynucleotide
atcatctcaccttgcctcctggctcgtataggtggtgacctgcagggggtgacgtcagagagagggtgacgtcagagtcggggtgacgtcagaggacgggtgacgtcagagctagggtgacgtcagagactgggtgacgtcagagtgcgggtgacgtcagaggtaggcgcgccatgcttcatcagactct

SEQ ID NO: 5903 - DNA, 190 bp, Artificial Sequence; identical to SEQ ID NO: 5902
  Synthetic polynucleotide

SEQ ID NO: 5904 - DNA, 172 bp, Artificial Sequence
  Synthetic polynucleotide
atcatctcaccttgcctcctggtctccgtggttgtcctcctgcaggccacgtgaccagaccacgtgacctcgccacgtgaccgacccacgtgaccctaccacgtgaccactccacgtgacctgcccacgtgaccgtaccacgtgaccggcgcgccatgcttcatcagactct

SEQ ID NO: 5905 - DNA, 172 bp, Artificial Sequence; identical to SEQ ID NO: 5904
  Synthetic polynucleotide

SEQ ID NO: 5906 - DNA, 180 bp, Artificial Sequence
  Synthetic polynucleotide
atcatctcaccttgcctcctgacaaacgggatggttgccctgcaggggcggcagggcagaggcggcagggctcgggcggcagggcgacggcggcagggcctaggcggcagggcactggcggcagggctgcggcggcagggcgtaggcggcagggcggcgcgccatgcttcatcagactct

SEQ ID NO: 5907 - DNA, 180 bp, Artificial Sequence; identical to SEQ ID NO: 5906
  Synthetic polynucleotide

SEQ ID NO: 5908 - DNA, 185 bp, Artificial Sequence
  Synthetic polynucleotide
atcatctcaccttgcctcctgcagaacacttcacagatcctgcaggggttgccatggcaacgagaggttgccatggcaacgtcgggttgccatggcaacggacggttgccatggcaacgctaggttgccatggcaacgactggttgccatggcaacgtgcggcgcgccatgcttcatcagactct

SEQ ID NO: 5909 - DNA, 185 bp, Artificial Sequence; identical to SEQ ID NO: 5908
  Synthetic polynucleotide

SEQ ID NO: 5910 - DNA, 164 bp, Artificial Sequence
  Synthetic polynucleotide
atcatctcaccttgcctcctgcgcggcctttagagtctcctgcaggcgtcacgctagacgtcacgcttcgcgtcacgctgaccgtcacgctctacgtcacgctactcgtcacgcttgccgtcacgctgtacgtcacgctggcgcgccatgcttcatcagactct

SEQ ID NO: 5911 - DNA, 164 bp, Artificial Sequence; identical to SEQ ID NO: 5910
  Synthetic polynucleotide

SEQ ID NO: 5912 - DNA, 196 bp, Artificial Sequence
  Synthetic polynucleotide
atcatctcaccttgcctcctgaaccctaccgaagtaatcctgcaggtgacagttttatgagatgacagttttatgtcgtgacagttttatggactgacagttttatgctatgacagttttatgacttgacagttttatgtgctgacagttttatggtatgacagttttatgggcgcgccatgcttcatcagactct

SEQ ID NO: 5913 - DNA, 196 bp, Artificial Sequence; identical to SEQ ID NO: 5912
  Synthetic polynucleotide

SEQ ID NO: 5914 - DNA, 197 bp, Artificial Sequence
  Synthetic polynucleotide
atcatctcaccttgcctcctgctcaatctgcatcgagtcctgcaggaagtatgagtcatcaagaaagtatgagtcatcatcgaagtatgagtcatcagacaagtatgagtcatcactaaagtatgagtcatcaactaagtatgagtcatcatgcaagtatgagtcatcagtaggcgcgccatgcttcatcagactct

SEQ ID NO: 5915 - DNA, 197 bp, Artificial Sequence; identical to SEQ ID NO: 5914
  Synthetic polynucleotide

SEQ ID NO: 5916 - DNA, 191 bp, Artificial Sequence
  Synthetic polynucleotide
atcatctcaccttgcctcctgagcattcctgggataaacctgcaggtaaagaacaatagataaagataaagaacaatagataatcgtaaagaacaatagataagactaaagaacaatagataactataaagaacaatagataaacttaaagaacaatagataatgcggcgcgccatgcttcatcagactct

SEQ ID NO: 5917 - DNA, 191 bp, Artificial Sequence; identical to SEQ ID NO: 5916
  Synthetic polynucleotide

SEQ ID NO: 5918 - DNA, 180 bp, Artificial Sequence
  Synthetic polynucleotide
atcatctcaccttgcctcctgaaacaccgctgcgacttcctgcaggacacccactctagaacacccactcttcgacacccactctgacacacccactctctaacacccactctactacacccactcttgcacacccactctgtaacacccactctggcgcgccatgcttcatcagactct

SEQ ID NO: 5919 - DNA, 180 bp, Artificial Sequence; identical to SEQ ID NO: 5918
  Synthetic polynucleotide

SEQ ID NO: 5920 - DNA, 196 bp, Artificial Sequence
  Synthetic polynucleotide
atcatctcaccttgcctcctgcggattgacacttcttgcctgcaggcataaaactgtcaagacataaaactgtcatcgcataaaactgtcagaccataaaactgtcactacataaaactgtcaactcataaaactgtcatgccataaaactgtcagtacataaaactgtcaggcgcgccatgcttcatcagactct

SEQ ID NO: 5921 - DNA, 196 bp, Artificial Sequence; identical to SEQ ID NO: 5920
  Synthetic polynucleotide

SEQ ID NO: 5922 - DNA, 156 bp, Artificial Sequence
  Synthetic polynucleotide
atcatctcaccttgcctcctgtccgtagagtctcggaccctgcagggggaaatcagagggaaatctcggggaaatcgacgggaaatcctagggaaatcactgggaaatctgcgggaaatcgtagggaaatcggcgcgccatgcttcatcagactct

SEQ ID NO: 5923 - DNA, 156 bp, Artificial Sequence; identical to SEQ ID NO: 5922
  Synthetic polynucleotide

SEQ ID NO: 5924 - DNA, 196 bp, Artificial Sequence
  Synthetic polynucleotide
atcatctcaccttgcctcctggagtccttcctactattcctgcaggggatgtttgtttaagaggatgtttgtttatcgggatgtttgtttagacggatgtttgtttactaggatgtttgtttaactggatgtttgtttatgcggatgtttgtttagtaggatgtttgtttaggcgcgccatgcttcatcagactct

SEQ ID NO: 5925 - DNA, 196 bp, Artificial Sequence; identical to SEQ ID NO: 5924
  Synthetic polynucleotide

SEQ ID NO: 5926 - DNA, 188 bp, Artificial Sequence
  Synthetic polynucleotide
atcatctcaccttgcctcctgattacccacaaggtggacctgcaggaaaccacttaaaagaaaaccacttaaatcgaaaccacttaaagacaaaccacttaaactaaaaccacttaaaactaaaccacttaaatgcaaaccacttaaagtaaaaccacttaaaggcgcgccatgcttcatcagactct

SEQ ID NO: 5927 - DNA, 188 bp, Artificial Sequence; identical to SEQ ID NO: 5926
  Synthetic polynucleotide

SEQ ID NO: 5928 - DNA, 197 bp, Artificial Sequence
  Synthetic polynucleotide
atcatctcaccttgcctcctgtttgggcctgtcgaatacctgcaggggggtgggggaggggagaggggtgggggaggggtcgggggtgggggagggggacggggtgggggaggggctaggggtgggggaggggactggggtgggggaggggtgcggggtgggggagggggtaggcgcgccatgcttcatcagactct

SEQ ID NO: 5929 - DNA, 197 bp, Artificial Sequence; identical to SEQ ID NO: 5928
  Synthetic polynucleotide

SEQ ID NO: 5930 - DNA, 180 bp, Artificial Sequence
  Synthetic polynucleotide
atcatctcaccttgcctcctggcacctaactagcaggccctgcaggccgctgactccagaccgctgactcctcgccgctgactccgacccgctgactccctaccgctgactccactccgctgactcctgcccgctgactccgtaccgctgactccggcgcgccatgcttcatcagactct

SEQ ID NO: 5931 - DNA, 180 bp, Artificial Sequence; identical to SEQ ID NO: 5930
  Synthetic polynucleotide

SEQ ID NO: 5932 - DNA, 172 bp, Artificial Sequence
  Synthetic polynucleotide
atcatctcaccttgcctcctgacctatgggtcttatggcctgcaggatgaccttgaagaatgaccttgatcgatgaccttgagacatgaccttgactaatgaccttgaactatgaccttgatgcatgaccttgagtaatgaccttgaggcgcgccatgcttcatcagactct

SEQ ID NO: 5933 - DNA, 172 bp, Artificial Sequence; identical to SEQ ID NO: 5932
  Synthetic polynucleotide

SEQ ID NO: 5934 - DNA, 196 bp, Artificial Sequence
  Synthetic polynucleotide
atcatctcaccttgcctcctggaaatatcccgtaattgcctgcagggaatgttctatatagagaatgttctatattcggaatgttctatatgacgaatgttctatatctagaatgttctatatactgaatgttctatattgcgaatgttctatatgtagaatgttctatatggcgcgccatgcttcatcagactct

SEQ ID NO: 5935 - DNA, 196 bp, Artificial Sequence; identical to SEQ ID NO: 5934
  Synthetic polynucleotide

SEQ ID NO: 5936 - DNA, 190 bp, Artificial Sequence
  Synthetic polynucleotide
atcatctcaccttgcctcctggctgataatcagaaagacctgcaggaatatgcaaattagagaaatatgcaaattagtcgaatatgcaaattaggacaatatgcaaattagctaaatatgcaaattagactaatatgcaaattagtgcaatatgcaaattaggtaggcgcgccatgcttcatcagactct

SEQ ID NO: 5937 - DNA, 190 bp, Artificial Sequence; identical to SEQ ID NO: 5936
  Synthetic polynucleotide

SEQ ID NO: 5938 - DNA, 191 bp, Artificial Sequence
  Synthetic polynucleotide
atcatctcaccttgcctcctggctgcaaagccgaatcgcctgcaggtggaatgtcaggaatgtagatggaatgtcaggaatgttcgtggaatgtcaggaatgtgactggaatgtcaggaatgtctatggaatgtcaggaatgtacttggaatgtcaggaatgttgcggcgcgccatgcttcatcagactct

SEQ ID NO: 5939 - DNA, 191 bp, Artificial Sequence; identical to SEQ ID NO: 5938
  Synthetic polynucleotide

SEQ ID NO: 5940 - DNA, 190 bp, Artificial Sequence
  Synthetic polynucleotide
atcatctcaccttgcctcctggtcagcctcacgtacttcctgcaggatgaattaatgcatagaatgaattaatgcattcgatgaattaatgcatgacatgaattaatgcatctaatgaattaatgcatactatgaattaatgcattgcatgaattaatgcatgtaggcgcgccatgcttcatcagactct

SEQ ID NO: 5941 - DNA, 190 bp, Artificial Sequence; identical to SEQ ID NO: 5940
  Synthetic polynucleotide

SEQ ID NO: 5942 - DNA, 188 bp, Artificial Sequence
  Synthetic polynucleotide
atcatctcaccttgcctcctgttccacctgatacgtagcctgcagggctaaaaatagcagagctaaaaatagctcggctaaaaatagcgacgctaaaaatagcctagctaaaaatagcactgctaaaaatagctgcgctaaaaatagcgtagctaaaaatagcggcgcgccatgcttcatcagactct

SEQ ID NO: 5943 - DNA, 188 bp, Artificial Sequence; identical to SEQ ID NO: 5942
  Synthetic polynucleotide

SEQ ID NO: 5944 - DNA, 197 bp, Artificial Sequence
  Synthetic polynucleotide
atcatctcaccttgcctcctggcgtgtgttaccatgagcctgcaggcggaaccggaagtggagacggaaccggaagtggtcgcggaaccggaagtgggaccggaaccggaagtggctacggaaccggaagtggactcggaaccggaagtggtgccggaaccggaagtgggtaggcgcgccatgcttcatcagactct

SEQ ID NO: 5945 - DNA, 197 bp, Artificial Sequence; identical to SEQ ID NO: 5944
  Synthetic polynucleotide

SEQ ID NO: 5946 - DNA, 190 bp, Artificial Sequence
  Synthetic polynucleotide
atcatctcaccttgcctcctgtacaaagtcgctgtcatcctgcaggttctagaactttctagattctagaactttcttcgttctagaactttctgacttctagaactttctctattctagaactttctactttctagaactttcttgcttctagaactttctgtaggcgcgccatgcttcatcagactct

SEQ ID NO: 5947 - DNA, 190 bp, Artificial Sequence; identical to SEQ ID NO: 5946
  Synthetic polynucleotide

SEQ ID NO: 5948 - DNA, 172 bp, Artificial Sequence
  Synthetic polynucleotide
atcatctcaccttgcctcctgtatggacgacttacgaccctgcaggtgtaattatcagatgtaattatctcgtgtaattatcgactgtaattatcctatgtaattatcacttgtaattatctgctgtaattatcgtatgtaattatcggcgcgccatgcttcatcagactct

SEQ ID NO: 5949 - DNA, 172 bp, Artificial Sequence; identical to SEQ ID NO: 5948
  Synthetic polynucleotide

SEQ ID NO: 5950 - DNA, 197 bp, Artificial Sequence
  Synthetic polynucleotide
atcatctcaccttgcctcctgccgacgctgttaggaaccctgcaggcaaaccacaaaccccagacaaaccacaaacccctcgcaaaccacaaaccccgaccaaaccacaaaccccctacaaaccacaaaccccactcaaaccacaaacccctgccaaaccacaaaccccgtaggcgcgccatgcttcatcagactct

SEQ ID NO: 5951 - DNA, 197 bp, Artificial Sequence; identical to SEQ ID NO: 5950
  Synthetic polynucleotide

SEQ ID NO: 5952 - DNA, 172 bp, Artificial Sequence
  Synthetic polynucleotide
atcatctcaccttgcctcctgtcctacgaatagcgtctcctgcaggattcatgtgcagaattcatgtgctcgattcatgtgcgacattcatgtgcctaattcatgtgcactattcatgtgctgcattcatgtgcgtaattcatgtgcggcgcgccatgcttcatcagactct

SEQ ID NO: 5953 - DNA, 172 bp, Artificial Sequence; identical to SEQ ID NO: 5952
  Synthetic polynucleotide

SEQ ID NO: 5954 - DNA, 156 bp, Artificial Sequence
  Synthetic polynucleotide
atcatctcaccttgcctcctggccgaatagaactctctcctgcaggactttcacagaactttcactcgactttcacgacactttcacctaactttcacactactttcactgcactttcacgtaactttcacggcgcgccatgcttcatcagactct

SEQ ID NO: 5955 - DNA, 156 bp, Artificial Sequence; identical to SEQ ID NO: 5954
  Synthetic polynucleotide

SEQ ID NO: 5956 - DNA, 188 bp, Artificial Sequence
  Synthetic polynucleotide
atcatctcaccttgcctcctggttagatcatcagccttcctgcagggcgatcaccccaagagcgatcaccccatcggcgatcaccccagacgcgatcaccccactagcgatcaccccaactgcgatcaccccatgcgcgatcaccccagtagcgatcaccccaggcgcgccatgcttcatcagactct

SEQ ID NO: 5957 - DNA, 188 bp, Artificial Sequence; identical to SEQ ID NO: 5956
  Synthetic polynucleotide

SEQ ID NO: 5958 - DNA, 188 bp, Artificial Sequence
  Synthetic polynucleotide
atcatctcaccttgcctcctgtacagataggctctggccctgcagggtttgggaatacagagtttgggaatactcggtttgggaatacgacgtttgggaatacctagtttgggaatacactgtttgggaatactgcgtttgggaatacgtagtttgggaatacggcgcgccatgcttcatcagactct

SEQ ID NO: 5959 - DNA, 188 bp, Artificial Sequence; identical to SEQ ID NO: 5958
  Synthetic polynucleotide

SEQ ID NO: 5960 - DNA, 156 bp, Artificial Sequence
  Synthetic polynucleotide
atcatctcaccttgcctcctgcagtttatagggcttaacctgcaggataatcccagaataatccctcgataatcccgacataatcccctaataatcccactataatccctgcataatcccgtaataatcccggcgcgccatgcttcatcagactct

SEQ ID NO: 5961 - DNA, 156 bp, Artificial Sequence; identical to SEQ ID NO: 5960
  Synthetic polynucleotide

SEQ ID NO: 5962 - DNA, 172 bp, Artificial Sequence
  Synthetic polynucleotide
atcatctcaccttgcctcctgggttacgtctgacacgtcctgcaggtccccggggaagatccccggggatcgtccccggggagactccccggggactatccccggggaacttccccggggatgctccccggggagtatccccggggaggcgcgccatgcttcatcagactct

SEQ ID NO: 5963 - DNA, 172 bp, Artificial Sequence; identical to SEQ ID NO: 5962
  Synthetic polynucleotide

SEQ ID NO: 5964 - DNA, 196 bp, Artificial Sequence
  Synthetic polynucleotide
atcatctcaccttgcctcctgattagtagcgtcctattcctgcaggcggccaaaatgacagacggccaaaatgactcgcggccaaaatgacgaccggccaaaatgacctacggccaaaatgacactcggccaaaatgactgccggccaaaatgacgtacggccaaaatgacggcgcgccatgcttcatcagactct

SEQ ID NO: 5965 - DNA, 196 bp, Artificial Sequence; identical to SEQ ID NO: 5964
  Synthetic polynucleotide

SEQ ID NO: 5966 - DNA, 197 bp, Artificial Sequence
  Synthetic polynucleotide
atcatctcaccttgcctcctgttctctgtcggacaagacctgcaggttgaatgtttatttataaagattgaatgtttatttataatcgttgaatgtttatttataagacttgaatgtttatttataactattgaatgtttatttataaactttgaatgtttatttataatgcggcgcgccatgcttcatcagactct

SEQ ID NO: 5967 - DNA, 197 bp, Artificial Sequence; identical to SEQ ID NO: 5966
  Synthetic polynucleotide

SEQ ID NO: 5968 - DNA, 197 bp, Artificial Sequence
  Synthetic polynucleotide
atcatctcaccttgcctcctgtacatcctagggagatacctgcagggcaatcacttcctgtagagcaatcacttcctgttcggcaatcacttcctgtgacgcaatcacttcctgtctagcaatcacttcctgtactgcaatcacttcctgttgcgcaatcacttcctgtgtaggcgcgccatgcttcatcagactct

SEQ ID NO: 5969 - DNA, 197 bp, Artificial Sequence; identical to SEQ ID NO: 5968
  Synthetic polynucleotide

SEQ ID NO: 5970 - DNA, 190 bp, Artificial Sequence
  Synthetic polynucleotide
atcatctcaccttgcctcctgccgacagttattctgtacctgcaggaatatgcaaattatagaaatatgcaaattattcgaatatgcaaattatgacaatatgcaaattatctaaatatgcaaattatactaatatgcaaattattgcaatatgcaaattatgtaggcgcgccatgcttcatcagactct

SEQ ID NO: 5971 - DNA, 190 bp, Artificial Sequence; identical to SEQ ID NO: 5970
  Synthetic polynucleotide

SEQ ID NO: 5972 - DNA, 191 bp, Artificial Sequence
  Synthetic polynucleotide
atcatctcaccttgcctcctgactgggaggaataacatcctgcaggacattcctcgcattccaagaacattcctcgcattccatcgacattcctcgcattccagacacattcctcgcattccactaacattcctcgcattccaactacattcctcgcattccatgcggcgcgccatgcttcatcagactct

SEQ ID NO: 5973 - DNA, 191 bp, Artificial Sequence; identical to SEQ ID NO: 5972
  Synthetic polynucleotide

SEQ ID NO: 5974 - DNA, 172 bp, Artificial Sequence
  Synthetic polynucleotide
atcatctcaccttgcctcctgctacgaagattatctctcctgcaggttctgattggagattctgattggtcgttctgattgggacttctgattggctattctgattggactttctgattggtgcttctgattgggtattctgattggggcgcgccatgcttcatcagactct

SEQ ID NO: 5975 - DNA, 172 bp, Artificial Sequence; identical to SEQ ID NO: 5974
  Synthetic polynucleotide

SEQ ID NO: 5976 - DNA, 197 bp, Artificial Sequence
  Synthetic polynucleotide
atcatctcaccttgcctcctgaagtccgcgcctatgagcctgcaggtctcacgcaagcccggggagatctcacgcaagcccggggtcgtctcacgcaagcccgggggactctcacgcaagcccggggctatctcacgcaagcccggggacttctcacgcaagcccggggtgcggcgcgccatgcttcatcagactct

SEQ ID NO: 5977 - DNA, 197 bp, Artificial Sequence; identical to SEQ ID NO: 5976
  Synthetic polynucleotide

SEQ ID NO: 5978 - DNA, 180 bp, Artificial Sequence
  Synthetic polynucleotide
atcatctcaccttgcctcctggcgtgtagttgcgatctcctgcaggtcaagcgtgaaagatcaagcgtgaatcgtcaagcgtgaagactcaagcgtgaactatcaagcgtgaaacttcaagcgtgaatgctcaagcgtgaagtatcaagcgtgaaggcgcgccatgcttcatcagactct

SEQ ID NO: 5979 - DNA, 180 bp, Artificial Sequence; identical to SEQ ID NO: 5978
  Synthetic polynucleotide

SEQ ID NO: 5980 - DNA, 196 bp, Artificial Sequence
  Synthetic polynucleotide
atcatctcaccttgcctcctggctgagggttacgtagtcctgcaggtttcccagaaaagagatttcccagaaaagtcgtttcccagaaaaggactttcccagaaaagctatttcccagaaaagacttttcccagaaaagtgctttcccagaaaaggtatttcccagaaaagggcgcgccatgcttcatcagactct

SEQ ID NO: 5981 - DNA, 196 bp, Artificial Sequence; identical to SEQ ID NO: 5980
  Synthetic polynucleotide

SEQ ID NO: 5982 - DNA, 191 bp, Artificial Sequence
  Synthetic polynucleotide
atcatctcaccttgcctcctggagagcaaagagacagtcctgcaggagtagttaattagttacagaagtagttaattagttactcgagtagttaattagttacgacagtagttaattagttacctaagtagttaattagttacactagtagttaattagttactgcggcgcgccatgcttcatcagactct

SEQ ID NO: 5983 - DNA, 191 bp, Artificial Sequence; identical to SEQ ID NO: 5982
  Synthetic polynucleotide

SEQ ID NO: 5984 - DNA, 196 bp, Artificial Sequence
  Synthetic polynucleotide
atcatctcaccttgcctcctggactgaaagaagttaaccctgcaggatgaccttgatatagaatgaccttgatattcgatgaccttgatatgacatgaccttgatatctaatgaccttgatatactatgaccttgatattgcatgaccttgatatgtaatgaccttgatatggcgcgccatgcttcatcagactct

SEQ ID NO: 5985 - DNA, 196 bp, Artificial Sequence; identical to SEQ ID NO: 5984
  Synthetic polynucleotide

SEQ ID NO: 5986 - DNA, 197 bp, Artificial Sequence
  Synthetic polynucleotide
atcatctcaccttgcctcctgccaataggagcagttcgcctgcaggtggggggggcagataaggagatggggggggcagataaggtcgtggggggggcagataagggactggggggggcagataaggctatggggggggcagataaggacttggggggggcagataaggtgcggcgcgccatgcttcatcagactct

SEQ ID NO: 5987 - DNA, 197 bp, Artificial Sequence; identical to SEQ ID NO: 5986
  Synthetic polynucleotide

SEQ ID NO: 5988 - DNA, 196 bp, Artificial Sequence
  Synthetic polynucleotide
atcatctcaccttgcctcctgcggctttggccagtatgcctgcaggaaaaacaaacaacagaaaaaacaaacaactcgaaaaacaaacaacgacaaaaacaaacaacctaaaaaacaaacaacactaaaaacaaacaactgcaaaaacaaacaacgtaaaaaacaaacaacggcgcgccatgcttcatcagactct

SEQ ID NO: 5989 - DNA, 196 bp, Artificial Sequence; identical to SEQ ID NO: 5988
  Synthetic polynucleotide

SEQ ID NO: 5990 - DNA, 185 bp, Artificial Sequence
  Synthetic polynucleotide
atcatctcaccttgcctcctgagacgctagctatctgtcctgcaggtcacacctaggtgtgaagatcacacctaggtgtgatcgtcacacctaggtgtgagactcacacctaggtgtgactatcacacctaggtgtgaacttcacacctaggtgtgatgcggcgcgccatgcttcatcagactct

SEQ ID NO: 5991 - DNA, 185 bp, Artificial Sequence; identical to SEQ ID NO: 5990
  Synthetic polynucleotide

SEQ ID NO: 5992 - DNA, 156 bp, Artificial Sequence
  Synthetic polynucleotide
atcatctcaccttgcctcctgaaccctactttcgcacacctgcaggtgggatggagatgggatggtcgtgggatgggactgggatggctatgggatggacttgggatggtgctgggatgggtatgggatggggcgcgccatgcttcatcagactct

SEQ ID NO: 5993 - DNA, 156 bp, Artificial Sequence; identical to SEQ ID NO: 5992
  Synthetic polynucleotide

SEQ ID NO: 5994 - DNA, 156 bp, Artificial Sequence
  Synthetic polynucleotide
atcatctcaccttgcctcctggatccagtatcggtgttcctgcaggcgccctctagacgccctcttcgcgccctctgaccgccctctctacgccctctactcgccctcttgccgccctctgtacgccctctggcgcgccatgcttcatcagactct

SEQ ID NO: 5995 - DNA, 156 bp, Artificial Sequence; identical to SEQ ID NO: 5994
  Synthetic polynucleotide

SEQ ID NO: 5996 - DNA, 191 bp, Artificial Sequence
  Synthetic polynucleotide
atcatctcaccttgcctcctgttccatttggagccacacctgcaggaaacaatgcaattgtttagaaaacaatgcaattgttttcgaaacaatgcaattgtttgacaaacaatgcaattgtttctaaaacaatgcaattgtttactaaacaatgcaattgttttgcggcgcgccatgcttcatcagactct

SEQ ID NO: 5997 - DNA, 191 bp, Artificial Sequence; identical to SEQ ID NO: 5996
  Synthetic polynucleotide

SEQ ID NO: 5998 - DNA, 197 bp, Artificial Sequence
  Synthetic polynucleotide
atcatctcaccttgcctcctgcctcagtgctttgtgcccctgcaggagcaccatggacagcagaagcaccatggacagctcgagcaccatggacagcgacagcaccatggacagcctaagcaccatggacagcactagcaccatggacagctgcagcaccatggacagcgtaggcgcgccatgcttcatcagactct

SEQ ID NO: 5999 - DNA, 197 bp, Artificial Sequence; identical to SEQ ID NO: 5998
  Synthetic polynucleotide

SEQ ID NO: 6000 - DNA, 164 bp, Artificial Sequence
  Synthetic polynucleotide
atcatctcaccttgcctcctgatatgagctggtacacacctgcaggttttgttttagattttgtttttcgttttgttttgacttttgttttctattttgttttactttttgtttttgcttttgttttgtattttgttttggcgcgccatgcttcatcagactct

SEQ ID NO: 6001 - DNA, 164 bp, Artificial Sequence; identical to SEQ ID NO: 6000
  Synthetic polynucleotide

SEQ ID NO: 6002 - DNA, 172 bp, Artificial Sequence
  Synthetic polynucleotide
atcatctcaccttgcctcctgatgtccaataccactgacctgcaggccccgcgcccagaccccgcgccctcgccccgcgcccgacccccgcgcccctaccccgcgcccactccccgcgccctgcccccgcgcccgtaccccgcgcccggcgcgccatgcttcatcagactct

SEQ ID NO: 6003 - DNA, 172 bp, Artificial Sequence; identical to SEQ ID NO: 6002
  Synthetic polynucleotide

SEQ ID NO: 6004 - DNA, 196 bp, Artificial Sequence
  Synthetic polynucleotide
atcatctcaccttgcctcctgacataccgacgtcccgacctgcagggcaaggcattctgggaagtgtaagagcaaggcattctgggaagtgtatcggcaaggcattctgggaagtgtagacgcaaggcattctgggaagtgtactagcaaggcattctgggaagtgtaactggcgcgccatgcttcatcagactct

SEQ ID NO: 6005 - DNA, 196 bp, Artificial Sequence; identical to SEQ ID NO: 6004
  Synthetic polynucleotide

SEQ ID NO: 6006 - DNA, 188 bp, Artificial Sequence
  Synthetic polynucleotide
atcatctcaccttgcctcctgcaaccctttatcgggctcctgcaggtaatttgcataaagataatttgcataatcgtaatttgcataagactaatttgcataactataatttgcataaacttaatttgcataatgctaatttgcataagtataatttgcataaggcgcgccatgcttcatcagactct

SEQ ID NO: 6007 - DNA, 188 bp, Artificial Sequence; identical to SEQ ID NO: 6006
  Synthetic polynucleotide

SEQ ID NO: 6008 - DNA, 156 bp, Artificial Sequence
  Synthetic polynucleotide
atcatctcaccttgcctcctgccgctttagcatccaaccctgcaggaccaattaagaaccaattatcgaccaattagacaccaattactaaccaattaactaccaattatgcaccaattagtaaccaattaggcgcgccatgcttcatcagactct

SEQ ID NO: 6009 - DNA, 156 bp, Artificial Sequence; identical to SEQ ID NO: 6008
  Synthetic polynucleotide

SEQ ID NO: 6010 - DNA, 196 bp, Artificial Sequence
  Synthetic polynucleotide
atcatctcaccttgcctcctgatccatcgttgacagatcctgcagggaacatctggatgagagaacatctggatgtcggaacatctggatggacgaacatctggatgctagaacatctggatgactgaacatctggatgtgcgaacatctggatggtagaacatctggatgggcgcgccatgcttcatcagactct

SEQ ID NO: 6011 - DNA, 196 bp, Artificial Sequence; identical to SEQ ID NO: 6010
  Synthetic polynucleotide

SEQ ID NO: 6012 - DNA, 148 bp, Artificial Sequence
  Synthetic polynucleotide
atcatctcaccttgcctcctgttacggtcgtagcgtatcctgcaggcaataaaagacaataaatcgcaataaagaccaataaactacaataaaactcaataaatgccaataaagtacaataaaggcgcgccatgcttcatcagactct

SEQ ID NO: 6013 - DNA, 148 bp, Artificial Sequence; identical to SEQ ID NO: 6012
  Synthetic polynucleotide

SEQ ID NO: 6014 - DNA, 156 bp, Artificial Sequence
  Synthetic polynucleotide
atcatctcaccttgcctcctgctctttactaccgcctgcctgcagggccatctgagagccatctgtcggccatctggacgccatctgctagccatctgactgccatctgtgcgccatctggtagccatctgggcgcgccatgcttcatcagactct

SEQ ID NO: 6015 - DNA, 156 bp, Artificial Sequence; identical to SEQ ID NO: 6014
  Synthetic polynucleotide

SEQ ID NO: 6016 - DNA, 172 bp, Artificial Sequence
  Synthetic polynucleotide
atcatctcaccttgcctcctggagggtacaggtgagatcctgcaggtatgagtcatagatatgagtcattcgtatgagtcatgactatgagtcatctatatgagtcatacttatgagtcattgctatgagtcatgtatatgagtcatggcgcgccatgcttcatcagactct

SEQ ID NO: 6017 - DNA, 172 bp, Artificial Sequence; identical to SEQ ID NO: 6016
  Synthetic polynucleotide

SEQ ID NO: 6018 - DNA, 197 bp, Artificial Sequence
  Synthetic polynucleotide
atcatctcaccttgcctcctggtctaaggcgaatacaacctgcaggtctcgatatgactcaagatctcgatatgactcatcgtctcgatatgactcagactctcgatatgactcactatctcgatatgactcaacttctcgatatgactcatgctctcgatatgactcagtaggcgcgccatgcttcatcagactct

SEQ ID NO: 6019 - DNA, 197 bp, Artificial Sequence; identical to SEQ ID NO: 6018
  Synthetic polynucleotide

SEQ ID NO: 6020 - DNA, 197 bp, Artificial Sequence
  Synthetic polynucleotide
atcatctcaccttgcctcctgtaatgcaaacgacctgtcctgcaggaacaaacaacaagagagaaacaaacaacaagagtcgaacaaacaacaagaggacaacaaacaacaagagctaaacaaacaacaagagactaacaaacaacaagagtgcaacaaacaacaagaggtaggcgcgccatgcttcatcagactct

SEQ ID NO: 6021 - DNA, 197 bp, Artificial Sequence; identical to SEQ ID NO: 6020
  Synthetic polynucleotide

SEQ ID NO: 6022 - DNA, 148 bp, Artificial Sequence
  Synthetic polynucleotide
atcatctcaccttgcctcctgtagcttatcagtggtcccctgcaggtgacctcagatgacctctcgtgacctcgactgacctcctatgacctcacttgacctctgctgacctcgtatgacctcggcgcgccatgcttcatcagactct

SEQ ID NO: 6023 - DNA, 148 bp, Artificial Sequence; identical to SEQ ID NO: 6022
  Synthetic polynucleotide

SEQ ID NO: 6024 - DNA, 186 bp, Artificial Sequence
  Synthetic polynucleotide
atcatctcaccttgcctcctgaggtctccgcttattaacctgcaggaggtgtgaaaaaaggtgtgaagaaggtgtgaaaaaaggtgtgatcgaggtgtgaaaaaaggtgtgagacaggtgtgaaaaaaggtgtgactaaggtgtgaaaaaaggtgtgaactggcgcgccatgcttcatcagactct

SEQ ID NO: 6025 - DNA, 186 bp, Artificial Sequence; identical to SEQ ID NO: 6024
  Synthetic polynucleotide

SEQ ID NO: 6026 - DNA, 164 bp, Artificial Sequence
  Synthetic polynucleotide
atcatctcaccttgcctcctgcctgaaataagaagtgccctgcaggaccacctggagaaccacctggtcgaccacctgggacaccacctggctaaccacctggactaccacctggtgcaccacctgggtaaccacctggggcgcgccatgcttcatcagactct

SEQ ID NO: 6027 - DNA, 164 bp, Artificial Sequence; identical to SEQ ID NO: 6026
  Synthetic polynucleotide

SEQ ID NO: 6028 - DNA, 164 bp, Artificial Sequence
  Synthetic polynucleotide
atcatctcaccttgcctcctgttgtggatgagcattggcctgcaggttttatgggagattttatgggtcgttttatggggacttttatgggctattttatgggactttttatgggtgcttttatggggtattttatgggggcgcgccatgcttcatcagactct

SEQ ID NO: 6029 - DNA, 164 bp, Artificial Sequence; identical to SEQ ID NO: 6028
  Synthetic polynucleotide

SEQ ID NO: 6030 - DNA, 180 bp, Artificial Sequence
  Synthetic polynucleotide
atcatctcaccttgcctcctgtaacctccattcaacggcctgcaggaaccgaaaccaagaaaccgaaaccatcgaaccgaaaccagacaaccgaaaccactaaaccgaaaccaactaaccgaaaccatgcaaccgaaaccagtaaaccgaaaccaggcgcgccatgcttcatcagactct

SEQ ID NO: 6031 - DNA, 180 bp, Artificial Sequence; identical to SEQ ID NO: 6030
  Synthetic polynucleotide

SEQ ID NO: 6032 - DNA, 164 bp, Artificial Sequence
  Synthetic polynucleotide
atcatctcaccttgcctcctgcgcaatattccatatgccctgcaggtttgcgtaaagatttgcgtaatcgtttgcgtaagactttgcgtaactatttgcgtaaacttttgcgtaatgctttgcgtaagtatttgcgtaaggcgcgccatgcttcatcagactct

SEQ ID NO: 6033 - DNA, 164 bp, Artificial Sequence; identical to SEQ ID NO: 6032
  Synthetic polynucleotide

SEQ ID NO: 6034 - DNA, 191 bp, Artificial Sequence
  Synthetic polynucleotide
atcatctcaccttgcctcctgtgctcgaggtagacgtccctgcagggaggtcaaaaggtcacaagagaggtcaaaaggtcacatcggaggtcaaaaggtcacagacgaggtcaaaaggtcacactagaggtcaaaaggtcacaactgaggtcaaaaggtcacatgcggcgcgccatgcttcatcagactct

SEQ ID NO: 6035 - DNA, 191 bp, Artificial Sequence; identical to SEQ ID NO: 6034
  Synthetic polynucleotide

SEQ ID NO: 6036 - DNA, 196 bp, Artificial Sequence
  Synthetic polynucleotide
atcatctcaccttgcctcctgacttatgtagctcctgtcctgcaggtgacagctgtcaaagatgacagctgtcaatcgtgacagctgtcaagactgacagctgtcaactatgacagctgtcaaacttgacagctgtcaatgctgacagctgtcaagtatgacagctgtcaaggcgcgccatgcttcatcagactct

SEQ ID NO: 6037 - DNA, 196 bp, Artificial Sequence; identical to SEQ ID NO: 6036
  Synthetic polynucleotide

SEQ ID NO: 6038 - DNA, 197 bp, Artificial Sequence
  Synthetic polynucleotide
atcatctcaccttgcctcctgaataggaggaagtgggtcctgcaggtgcgcatgcgcagtgagatgcgcatgcgcagtgtcgtgcgcatgcgcagtggactgcgcatgcgcagtgctatgcgcatgcgcagtgacttgcgcatgcgcagtgtgctgcgcatgcgcagtggtaggcgcgccatgcttcatcagactct

SEQ ID NO: 6039 - DNA, 197 bp, Artificial Sequence; identical to SEQ ID NO: 6038
  Synthetic polynucleotide

SEQ ID NO: 6040 - DNA, 172 bp, Artificial Sequence
  Synthetic polynucleotide
atcatctcaccttgcctcctgatttcggttcacttctacctgcagggcatgacctcagagcatgacctctcggcatgacctcgacgcatgacctcctagcatgacctcactgcatgacctctgcgcatgacctcgtagcatgacctcggcgcgccatgcttcatcagactct

SEQ ID NO: 6041 - DNA, 172 bp, Artificial Sequence; identical to SEQ ID NO: 6040
  Synthetic polynucleotide

SEQ ID NO: 6042 - DNA, 185 bp, Artificial Sequence
  Synthetic polynucleotide
atcatctcaccttgcctcctgccttagtgaaactcacccctgcaggcagagctaattaccccagacagagctaattacccctcgcagagctaattaccccgaccagagctaattaccccctacagagctaattaccccactcagagctaattacccctgcggcgcgccatgcttcatcagactct

SEQ ID NO: 6043 - DNA, 185 bp, Artificial Sequence; identical to SEQ ID NO: 6042
  Synthetic polynucleotide

SEQ ID NO: 6044 - DNA, 190 bp, Artificial Sequence
  Synthetic polynucleotide
atcatctcaccttgcctcctggccacgagaatgttcttcctgcaggatggaaaattacagagaatggaaaattacagtcgatggaaaattacaggacatggaaaattacagctaatggaaaattacagactatggaaaattacagtgcatggaaaattacaggtaggcgcgccatgcttcatcagactct

SEQ ID NO: 6045 - DNA, 190 bp, Artificial Sequence; identical to SEQ ID NO: 6044
  Synthetic polynucleotide

SEQ ID NO: 6046 - DNA, 148 bp, Artificial Sequence
  Synthetic polynucleotide
atcatctcaccttgcctcctgtaagccctcataaagtccctgcaggaattaaaagaaattaaatcgaattaaagacaattaaactaaattaaaactaattaaatgcaattaaagtaaattaaaggcgcgccatgcttcatcagactct

SEQ ID NO: 6047 - DNA, 148 bp, Artificial Sequence; identical to SEQ ID NO: 6046
  Synthetic polynucleotide

SEQ ID NO: 6048 - DNA, 164 bp, Artificial Sequence
  Synthetic polynucleotide
atcatctcaccttgcctcctgtttaacggcatgtttctcctgcaggaccacctgtagaaccacctgttcgaccacctgtgacaccacctgtctaaccacctgtactaccacctgttgcaccacctgtgtaaccacctgtggcgcgccatgcttcatcagactct

SEQ ID NO: 6049 - DNA, 164 bp, Artificial Sequence; identical to SEQ ID NO: 6048
  Synthetic polynucleotide

SEQ ID NO: 6050 - DNA, 172 bp, Artificial Sequence
  Synthetic polynucleotide
atcatctcaccttgcctcctggacctggttcgaggttccctgcaggcgcgcgcgcgagacgcgcgcgcgtcgcgcgcgcgcggaccgcgcgcgcgctacgcgcgcgcgactcgcgcgcgcgtgccgcgcgcgcggtacgcgcgcgcgggcgcgccatgcttcatcagactct

SEQ ID NO: 6051 - DNA, 172 bp, Artificial Sequence; identical to SEQ ID NO: 6050
  Synthetic polynucleotide

SEQ ID NO: 6052 - DNA, 188 bp, Artificial Sequence
  Synthetic polynucleotide
atcatctcaccttgcctcctggggcacaagccacgaatcctgcaggagcctgtctgccagaagcctgtctgcctcgagcctgtctgccgacagcctgtctgccctaagcctgtctgccactagcctgtctgcctgcagcctgtctgccgtaagcctgtctgccggcgcgccatgcttcatcagactct

SEQ ID NO: 6053 - DNA, 188 bp, Artificial Sequence; identical to SEQ ID NO: 6052
  Synthetic polynucleotide

SEQ ID NO: 6054 - DNA, 172 bp, Artificial Sequence
  Synthetic polynucleotide
atcatctcaccttgcctcctgacgtcaccattggtaagcctgcaggattttccattagaattttccatttcgattttccattgacattttccattctaattttccattactattttccatttgcattttccattgtaattttccattggcgcgccatgcttcatcagactct

SEQ ID NO: 6055 - DNA, 172 bp, Artificial Sequence; identical to SEQ ID NO: 6054
  Synthetic polynucleotide

SEQ ID NO: 6056 - DNA, 172 bp, Artificial Sequence
  Synthetic polynucleotide
atcatctcaccttgcctcctgtattatcaaagccgcctcctgcaggtgtcaatattagatgtcaatatttcgtgtcaatattgactgtcaatattctatgtcaatattacttgtcaatatttgctgtcaatattgtatgtcaatattggcgcgccatgcttcatcagactct

SEQ ID NO: 6057 - DNA, 172 bp, Artificial Sequence; identical to SEQ ID NO: 6056
  Synthetic polynucleotide

SEQ ID NO: 6058 - DNA, 190 bp, Artificial Sequence
  Synthetic polynucleotide
atcatctcaccttgcctcctggcttaggcaatggttagcctgcaggctgtaattttccatagactgtaattttccattcgctgtaattttccatgacctgtaattttccatctactgtaattttccatactctgtaattttccattgcctgtaattttccatgtaggcgcgccatgcttcatcagactct

SEQ ID NO: 6059 - DNA, 190 bp, Artificial Sequence; identical to SEQ ID NO: 6058
  Synthetic polynucleotide

SEQ ID NO: 6060 - DNA, 156 bp, Artificial Sequence
  Synthetic polynucleotide
atcatctcaccttgcctcctgaaggttcgaaggaggtacctgcaggttgatacaagattgatacatcgttgatacagacttgatacactattgatacaactttgatacatgcttgatacagtattgatacaggcgcgccatgcttcatcagactct

SEQ ID NO: 6061 - DNA, 156 bp, Artificial Sequence; identical to SEQ ID NO: 6060
  Synthetic polynucleotide

SEQ ID NO: 6062 - DNA, 172 bp, Artificial Sequence
  Synthetic polynucleotide
atcatctcaccttgcctcctgacaatcactctgggatgcctgcaggcaggaagtagagacaggaagtagtcgcaggaagtaggaccaggaagtagctacaggaagtagactcaggaagtagtgccaggaagtaggtacaggaagtagggcgcgccatgcttcatcagactct

SEQ ID NO: 6063 - DNA, 172 bp, Artificial Sequence; identical to SEQ ID NO: 6062
  Synthetic polynucleotide

SEQ ID NO: 6064 - DNA, 197 bp, Artificial Sequence
  Synthetic polynucleotide
atcatctcaccttgcctcctgcgtcttccaggacatgacctgcaggggggtcaaaggtcacagaggggtcaaaggtcactcgggggtcaaaggtcacgacggggtcaaaggtcacctaggggtcaaaggtcacactggggtcaaaggtcactgcggggtcaaaggtcacgtaggcgcgccatgcttcatcagactct

SEQ ID NO: 6065 - DNA, 197 bp, Artificial Sequence; identical to SEQ ID NO: 6064
  Synthetic polynucleotide

SEQ ID NO: 6066 - DNA, 148 bp, Artificial Sequence
  Synthetic polynucleotide
atcatctcaccttgcctcctggatgcctggaagcagagcctgcaggtgactttagatgacttttcgtgactttgactgactttctatgactttacttgacttttgctgactttgtatgactttggcgcgccatgcttcatcagactct

SEQ ID NO: 6067 - DNA, 148 bp, Artificial Sequence; identical to SEQ ID NO: 6066
  Synthetic polynucleotide

SEQ ID NO: 6068 - DNA, 190 bp, Artificial Sequence
  Synthetic polynucleotide
atcatctcaccttgcctcctggtcgtgggcgataagaccctgcaggacagggagtgagtgagaacagggagtgagtgtcgacagggagtgagtggacacagggagtgagtgctaacagggagtgagtgactacagggagtgagtgtgcacagggagtgagtggtaggcgcgccatgcttcatcagactct

SEQ ID NO: 6069 - DNA, 190 bp, Artificial Sequence; identical to SEQ ID NO: 6068
  Synthetic polynucleotide

SEQ ID NO: 6070 - DNA, 197 bp, Artificial Sequence
  Synthetic polynucleotide
atcatctcaccttgcctcctgagtccactgcaagcaaccctgcaggatgccctgaggcagtagaatgccctgaggcagttcgatgccctgaggcagtgacatgccctgaggcagtctaatgccctgaggcagtactatgccctgaggcagttgcatgccctgaggcagtgtaggcgcgccatgcttcatcagactct

SEQ ID NO: 6071 - DNA, 197 bp, Artificial Sequence; identical to SEQ ID NO: 6070
  Synthetic polynucleotide

SEQ ID NO: 6072 - DNA, 190 bp, Artificial Sequence
  Synthetic polynucleotide
atcatctcaccttgcctcctgaagcgacccatacatcccctgcaggaaggggatttccaaagaaaggggatttccaatcgaaggggatttccaagacaaggggatttccaactaaaggggatttccaaactaaggggatttccaatgcaaggggatttccaagtaggcgcgccatgcttcatcagactct

SEQ ID NO: 6073 - DNA, 190 bp, Artificial Sequence; identical to SEQ ID NO: 6072
  Synthetic polynucleotide

SEQ ID NO: 6074 - DNA, 190 bp, Artificial Sequence
  Synthetic polynucleotide
atcatctcaccttgcctcctgcaatgtttctggtcacccctgcagggtcgtgtggggaaaagagtcgtgtggggaaatcggtcgtgtggggaaagacgtcgtgtggggaaactagtcgtgtggggaaaactgtcgtgtggggaaatgcgtcgtgtggggaaagtaggcgcgccatgcttcatcagactct

SEQ ID NO: 6075 - DNA, 190 bp, Artificial Sequence; identical to SEQ ID NO: 6074
  Synthetic polynucleotide

SEQ ID NO: 6076 - DNA, 197 bp, Artificial Sequence
  Synthetic polynucleotide
atcatctcaccttgcctcctgcatagaactcggcggaccctgcaggcagtttcactttcccagacagtttcactttccctcgcagtttcactttcccgaccagtttcactttcccctacagtttcactttcccactcagtttcactttccctgccagtttcactttcccgtaggcgcgccatgcttcatcagactct

SEQ ID NO: 6077 - DNA, 197 bp, Artificial Sequence; identical to SEQ ID NO: 6076
  Synthetic polynucleotide

SEQ ID NO: 6078 - DNA, 197 bp, Artificial Sequence
  Synthetic polynucleotide
atcatctcaccttgcctcctgagagccacgtcatgacacctgcaggtaatgatgatcactaagataatgatgatcactatcgtaatgatgatcactagactaatgatgatcactactataatgatgatcactaacttaatgatgatcactatgctaatgatgatcactagtaggcgcgccatgcttcatcagactct

SEQ ID NO: 6079 - DNA, 197 bp, Artificial Sequence; identical to SEQ ID NO: 6078
  Synthetic polynucleotide

SEQ ID NO: 6080 - DNA, 180 bp, Artificial Sequence
  Synthetic polynucleotide
atcatctcaccttgcctcctgtatgcatcattacagcgcctgcaggagggagattccagaagggagattcctcgagggagattccgacagggagattccctaagggagattccactagggagattcctgcagggagattccgtaagggagattccggcgcgccatgcttcatcagactct

SEQ ID NO: 6081 - DNA, 180 bp, Artificial Sequence; identical to SEQ ID NO: 6080
  Synthetic polynucleotide

SEQ ID NO: 6082 - DNA, 191 bp, Artificial Sequence
  Synthetic polynucleotide
atcatctcaccttgcctcctgagttattacagaggtcgcctgcaggatgggatttccgggaaatgggagaatgggatttccgggaaatgggtcgatgggatttccgggaaatggggacatgggatttccgggaaatgggctaatgggatttccgggaaatgggactggcgcgccatgcttcatcagactct

SEQ ID NO: 6083 - DNA, 191 bp, Artificial Sequence; identical to SEQ ID NO: 6082
  Synthetic polynucleotide

SEQ ID NO: 6084 - DNA, 197 bp, Artificial Sequence
  Synthetic polynucleotide
atcatctcaccttgcctcctgctcaacacatcattggccctgcaggttcagtttcattttcagattcagtttcattttctcgttcagtttcattttcgacttcagtttcattttcctattcagtttcattttcactttcagtttcattttctgcttcagtttcattttcgtaggcgcgccatgcttcatcagactct

SEQ ID NO: 6085 - DNA, 197 bp, Artificial Sequence; identical to SEQ ID NO: 6084
  Synthetic polynucleotide

SEQ ID NO: 6086 - DNA, 200 bp, Artificial Sequence
  Synthetic polynucleotide
atcatctcaccttgcctcctgttagctaggttaacagccctgcagggtcacgcttggctgccctcagagtcacgcttggctgccctctcggtcacgcttggctgccctcgacgtcacgcttggctgccctcctagtcacgcttggctgccctcactgtcacgcttggctgccctcggcgcgccatgcttcatcagactct

SEQ ID NO: 6087 - DNA, 200 bp, Artificial Sequence; identical to SEQ ID NO: 6086
  Synthetic polynucleotide

SEQ ID NO: 6088 - DNA, 191 bp, Artificial Sequence
  Synthetic polynucleotide
atcatctcaccttgcctcctgcaatgtgcatataggcccctgcaggaattttcacgcatgagttcacagaaattttcacgcatgagttcactcgaattttcacgcatgagttcacgacaattttcacgcatgagttcacctaaattttcacgcatgagttcacactggcgcgccatgcttcatcagactct

SEQ ID NO: 6089 - DNA, 191 bp, Artificial Sequence; identical to SEQ ID NO: 6088
  Synthetic polynucleotide

SEQ ID NO: 6090 - DNA, 196 bp, Artificial Sequence
  Synthetic polynucleotide
atcatctcaccttgcctcctgcttgtgctaatgctcgccctgcagggggctcgtggcggagagggctcgtggcggtcggggctcgtggcgggacgggctcgtggcggctagggctcgtggcggactgggctcgtggcggtgcgggctcgtggcgggtagggctcgtggcggggcgcgccatgcttcatcagactct

SEQ ID NO: 6091 - DNA, 196 bp, Artificial Sequence; identical to SEQ ID NO: 6090
  Synthetic polynucleotide

SEQ ID NO: 6092 - DNA, 164 bp, Artificial Sequence
  Synthetic polynucleotide
atcatctcaccttgcctcctgttgggagcgctaccacacctgcaggctgagtcacagactgagtcactcgctgagtcacgacctgagtcacctactgagtcacactctgagtcactgcctgagtcacgtactgagtcacggcgcgccatgcttcatcagactct

SEQ ID NO: 6093 - DNA, 164 bp, Artificial Sequence; identical to SEQ ID NO: 6092
  Synthetic polynucleotide

SEQ ID NO: 6094 - DNA, 198 bp, Artificial Sequence
  Synthetic polynucleotide
atcatctcaccttgcctcctgcaagtctctgcagacatcctgcaggtcttttaatttgcataattatatagatcttttaatttgcataattatattcgtcttttaatttgcataattatatgactcttttaatttgcataattatatctatcttttaatttgcataattatatggcgcgccatgcttcatcagactct

SEQ ID NO: 6095 - DNA, 198 bp, Artificial Sequence; identical to SEQ ID NO: 6094
  Synthetic polynucleotide

SEQ ID NO: 6096 - DNA, 164 bp, Artificial Sequence
  Synthetic polynucleotide
atcatctcaccttgcctcctgaggtagctgtcagatctcctgcaggatttgcataagaatttgcatatcgatttgcatagacatttgcatactaatttgcataactatttgcatatgcatttgcatagtaatttgcataggcgcgccatgcttcatcagactct

SEQ ID NO: 6097 - DNA, 164 bp, Artificial Sequence; identical to SEQ ID NO: 6096
  Synthetic polynucleotide

SEQ ID NO: 6098 - DNA, 156 bp, Artificial Sequence
  Synthetic polynucleotide
atcatctcaccttgcctcctgggttagtttggtcgcgccctgcaggtctcccaaagatctcccaatcgtctcccaagactctcccaactatctcccaaacttctcccaatgctctcccaagtatctcccaaggcgcgccatgcttcatcagactct

SEQ ID NO: 6099 - DNA, 156 bp, Artificial Sequence; identical to SEQ ID NO: 6098
  Synthetic polynucleotide

SEQ ID NO: 6100 - DNA, 190 bp, Artificial Sequence
  Synthetic polynucleotide
atcatctcaccttgcctcctgtaaatcagtagaggcatcctgcaggatggcgcgtgccgcagaatggcgcgtgccgctcgatggcgcgtgccgcgacatggcgcgtgccgcctaatggcgcgtgccgcactatggcgcgtgccgctgcatggcgcgtgccgcgtaggcgcgccatgcttcatcagactct

SEQ ID NO: 6101 - DNA, 190 bp, Artificial Sequence; identical to SEQ ID NO: 6100
  Synthetic polynucleotide

SEQ ID NO: 6102 - DNA, 172 bp, Artificial Sequence
  Synthetic polynucleotide
atcatctcaccttgcctcctgctgataatccatgcccgcctgcaggaccagatgttagaaccagatgtttcgaccagatgttgacaccagatgttctaaccagatgttactaccagatgtttgcaccagatgttgtaaccagatgttggcgcgccatgcttcatcagactct

SEQ ID NO: 6103 - DNA, 172 bp, Artificial Sequence; identical to SEQ ID NO: 6102
  Synthetic polynucleotide

SEQ ID NO: 6104 - DNA, 191 bp, Artificial Sequence
  Synthetic polynucleotide
atcatctcaccttgcctcctgtccgacagacgcaacctcctgcaggggtgatttccgggaaatggggagaggtgatttccgggaaatggggtcgggtgatttccgggaaatgggggacggtgatttccgggaaatggggctaggtgatttccgggaaatggggactggcgcgccatgcttcatcagactct

SEQ ID NO: 6105 - DNA, 191 bp, Artificial Sequence; identical to SEQ ID NO: 6104
  Synthetic polynucleotide

SEQ ID NO: 6106 - DNA, 172 bp, Artificial Sequence
  Synthetic polynucleotide
atcatctcaccttgcctcctgcggtcatgatgagaacacctgcaggaatgtatcaaagaaatgtatcaatcgaatgtatcaagacaatgtatcaactaaatgtatcaaactaatgtatcaatgcaatgtatcaagtaaatgtatcaaggcgcgccatgcttcatcagactct

SEQ ID NO: 6107 - DNA, 172 bp, Artificial Sequence; identical to SEQ ID NO: 6106
  Synthetic polynucleotide

SEQ ID NO: 6108 - DNA, 180 bp, Artificial Sequence
  Synthetic polynucleotide
atcatctcaccttgcctcctgacaacacccgaaatatacctgcaggtctcgtaaaaaagatctcgtaaaaatcgtctcgtaaaaagactctcgtaaaaactatctcgtaaaaaacttctcgtaaaaatgctctcgtaaaaagtatctcgtaaaaaggcgcgccatgcttcatcagactct

SEQ ID NO: 6109 - DNA, 180 bp, Artificial Sequence; identical to SEQ ID NO: 6108
  Synthetic polynucleotide

SEQ ID NO: 6110 - DNA, 197 bp, Artificial Sequence
  Synthetic polynucleotide
atcatctcaccttgcctcctgccatgttccattctggtcctgcagggaaaatgaaactgaaagagaaaatgaaactgaatcggaaaatgaaactgaagacgaaaatgaaactgaactagaaaatgaaactgaaactgaaaatgaaactgaatgcgaaaatgaaactgaagtaggcgcgccatgcttcatcagactct

SEQ ID NO: 6111 - DNA, 197 bp, Artificial Sequence; identical to SEQ ID NO: 6110
  Synthetic polynucleotide

SEQ ID NO: 6112 - DNA, 190 bp, Artificial Sequence
  Synthetic polynucleotide
atcatctcaccttgcctcctggcgtcctgtatgaatggcctgcaggtatgaatattcaaaagatatgaatattcaaatcgtatgaatattcaaagactatgaatattcaaactatatgaatattcaaaacttatgaatattcaaatgctatgaatattcaaagtaggcgcgccatgcttcatcagactct

SEQ ID NO: 6113 - DNA, 190 bp, Artificial Sequence; identical to SEQ ID NO: 6112
  Synthetic polynucleotide

SEQ ID NO: 6114 - DNA, 190 bp, Artificial Sequence
  Synthetic polynucleotide
atcatctcaccttgcctcctgtaaccagcatgtccagtcctgcaggtatgtgttgtgggtagatatgtgttgtgggttcgtatgtgttgtgggtgactatgtgttgtgggtctatatgtgttgtgggtacttatgtgttgtgggttgctatgtgttgtgggtgtaggcgcgccatgcttcatcagactct

SEQ ID NO: 6115 - DNA, 190 bp, Artificial Sequence; identical to SEQ ID NO: 6114
  Synthetic polynucleotide

SEQ ID NO: 6116 - DNA, 172 bp, Artificial Sequence
  Synthetic polynucleotide
atcatctcaccttgcctcctgcgactgttgtcgactgccctgcagggtgaccttggagagtgaccttggtcggtgaccttgggacgtgaccttggctagtgaccttggactgtgaccttggtgcgtgaccttgggtagtgaccttggggcgcgccatgcttcatcagactct

SEQ ID NO: 6117 - DNA, 172 bp, Artificial Sequence; identical to SEQ ID NO: 6116
  Synthetic polynucleotide

SEQ ID NO: 6118 - DNA, 190 bp, Artificial Sequence
  Synthetic polynucleotide
atcatctcaccttgcctcctgtgacggccgaatagttccctgcagggtttcccgccatttagagtttcccgccattttcggtttcccgccatttgacgtttcccgccatttctagtttcccgccatttactgtttcccgccattttgcgtttcccgccatttgtaggcgcgccatgcttcatcagactct

SEQ ID NO: 6119 - DNA, 190 bp, Artificial Sequence; identical to SEQ ID NO: 6118
  Synthetic polynucleotide

SEQ ID NO: 6120 - DNA, 191 bp, Artificial Sequence
  Synthetic polynucleotide
atcatctcaccttgcctcctgtctcgatctggtgtcgacctgcaggtatcaataacattgataagatatcaataacattgatatcgtatcaataacattgatagactatcaataacattgatactatatcaataacattgataacttatcaataacattgatatgcggcgcgccatgcttcatcagactct

SEQ ID NO: 6121 - DNA, 191 bp, Artificial Sequence; identical to SEQ ID NO: 6120
  Synthetic polynucleotide

SEQ ID NO: 6122 - DNA, 164 bp, Artificial Sequence
  Synthetic polynucleotide
atcatctcaccttgcctcctgttaaacgggcaagtacgcctgcaggtgaccttgaagatgaccttgatcgtgaccttgagactgaccttgactatgaccttgaacttgaccttgatgctgaccttgagtatgaccttgaggcgcgccatgcttcatcagactct

SEQ ID NO: 6123 - DNA, 164 bp, Artificial Sequence; identical to SEQ ID NO: 6122
  Synthetic polynucleotide

SEQ ID NO: 6124 - DNA, 156 bp, Artificial Sequence
  Synthetic polynucleotide
atcatctcaccttgcctcctgccactgctaataatcggcctgcaggtccggggtagatccggggttcgtccggggtgactccggggtctatccggggtacttccggggttgctccggggtgtatccggggtggcgcgccatgcttcatcagactct

SEQ ID NO: 6125 - DNA, 156 bp, Artificial Sequence; identical to SEQ ID NO: 6124
  Synthetic polynucleotide

SEQ ID NO: 6126 - DNA, 191 bp, Artificial Sequence
  Synthetic polynucleotide
atcatctcaccttgcctcctgcactagtgtggtcccaacctgcaggttaaccacttgaaaattagattaaccacttgaaaatttcgttaaccacttgaaaattgacttaaccacttgaaaattctattaaccacttgaaaattactttaaccacttgaaaatttgcggcgcgccatgcttcatcagactct

SEQ ID NO: 6127 - DNA, 191 bp, Artificial Sequence; identical to SEQ ID NO: 6126
  Synthetic polynucleotide

SEQ ID NO: 6128 - DNA, 172 bp, Artificial Sequence
  Synthetic polynucleotide
atcatctcaccttgcctcctgttgcatccacaattcgtcctgcagggctgagtcatagagctgagtcattcggctgagtcatgacgctgagtcatctagctgagtcatactgctgagtcattgcgctgagtcatgtagctgagtcatggcgcgccatgcttcatcagactct

SEQ ID NO: 6129 - DNA, 172 bp, Artificial Sequence; identical to SEQ ID NO: 6128
  Synthetic polynucleotide

SEQ ID NO: 6130 - DNA, 172 bp, Artificial Sequence
  Synthetic polynucleotide
atcatctcaccttgcctcctgtcttgtgaagctgggtgcctgcaggcacttccgctagacacttccgcttcgcacttccgctgaccacttccgctctacacttccgctactcacttccgcttgccacttccgctgtacacttccgctggcgcgccatgcttcatcagactct

SEQ ID NO: 6131 - DNA, 172 bp, Artificial Sequence; identical to SEQ ID NO: 6130
  Synthetic polynucleotide

SEQ ID NO: 6132 - DNA, 191 bp, Artificial Sequence
  Synthetic polynucleotide
atcatctcaccttgcctcctgaacacttcagacaacaacctgcagggataattaattagtttgagagataattaattagtttgtcggataattaattagtttggacgataattaattagtttgctagataattaattagtttgactgataattaattagtttgtgcggcgcgccatgcttcatcagactct

SEQ ID NO: 6133 - DNA, 191 bp, Artificial Sequence; identical to SEQ ID NO: 6132
  Synthetic polynucleotide

SEQ ID NO: 6134 - DNA, 196 bp, Artificial Sequence
  Synthetic polynucleotide
atcatctcaccttgcctcctgcagcaagaaacagcggtcctgcagggggtgagggggaaagagggtgagggggaatcggggtgagggggaagacgggtgagggggaactagggtgagggggaaactgggtgagggggaatgcgggtgagggggaagtagggtgagggggaaggcgcgccatgcttcatcagactct

SEQ ID NO: 6135 - DNA, 196 bp, Artificial Sequence; identical to SEQ ID NO: 6134
  Synthetic polynucleotide

SEQ ID NO: 6136 - DNA, 172 bp, Artificial Sequence
  Synthetic polynucleotide
atcatctcaccttgcctcctgagtcaggagtgtgaagacctgcaggaataacggaaagaaataacggaatcgaataacggaagacaataacggaactaaataacggaaactaataacggaatgcaataacggaagtaaataacggaaggcgcgccatgcttcatcagactct

SEQ ID NO: 6137 - DNA, 172 bp, Artificial Sequence; identical to SEQ ID NO: 6136
  Synthetic polynucleotide

SEQ ID NO: 6138 - DNA, 164 bp, Artificial Sequence
  Synthetic polynucleotide
atcatctcaccttgcctcctgctattaacgggtaccaacctgcaggtgtttacgaagatgtttacgatcgtgtttacgagactgtttacgactatgtttacgaacttgtttacgatgctgtttacgagtatgtttacgaggcgcgccatgcttcatcagactct

SEQ ID NO: 6139 - DNA, 164 bp, Artificial Sequence; identical to SEQ ID NO: 6138
  Synthetic polynucleotide

SEQ ID NO: 6140 - DNA, 148 bp, Artificial Sequence
  Synthetic polynucleotide
atcatctcaccttgcctcctgaagtaagcgggagaccccctgcaggcattaacagacattaactcgcattaacgaccattaacctacattaacactcattaactgccattaacgtacattaacggcgcgccatgcttcatcagactct

SEQ ID NO: 6141 - DNA, 148 bp, Artificial Sequence; identical to SEQ ID NO: 6140
  Synthetic polynucleotide

SEQ ID NO: 6142 - DNA, 188 bp, Artificial Sequence
  Synthetic polynucleotide
atcatctcaccttgcctcctgcaccaacgcaattcccacctgcaggtggactttggccagatggactttggcctcgtggactttggccgactggactttggccctatggactttggccacttggactttggcctgctggactttggccgtatggactttggccggcgcgccatgcttcatcagactct

SEQ ID NO: 6143 - DNA, 188 bp, Artificial Sequence; identical to SEQ ID NO: 6142
  Synthetic polynucleotide

SEQ ID NO: 6144 - DNA, 197 bp, Artificial Sequence
  Synthetic polynucleotide
atcatctcaccttgcctcctgtgtgttagctctcagatcctgcaggccattgttatgcaaaagaccattgttatgcaaatcgccattgttatgcaaagacccattgttatgcaaactaccattgttatgcaaaactccattgttatgcaaatgcccattgttatgcaaagtaggcgcgccatgcttcatcagactct

SEQ ID NO: 6145 - DNA, 197 bp, Artificial Sequence; identical to SEQ ID NO: 6144
  Synthetic polynucleotide

SEQ ID NO: 6146 - DNA, 180 bp, Artificial Sequence
  Synthetic polynucleotide
atcatctcaccttgcctcctgaagagatcgaggctggtcctgcagggtgtggggaaaagagtgtggggaaatcggtgtggggaaagacgtgtggggaaactagtgtggggaaaactgtgtggggaaatgcgtgtggggaaagtagtgtggggaaaggcgcgccatgcttcatcagactct

SEQ ID NO: 6147 - DNA, 180 bp, Artificial Sequence; identical to SEQ ID NO: 6146
  Synthetic polynucleotide

SEQ ID NO: 6148 - DNA, 180 bp, Artificial Sequence
  Synthetic polynucleotide
atcatctcaccttgcctcctgtcagtttcgtgtctaggcctgcaggtggtttcggttagatggtttcggtttcgtggtttcggttgactggtttcggttctatggtttcggttacttggtttcggtttgctggtttcggttgtatggtttcggttggcgcgccatgcttcatcagactct

SEQ ID NO: 6149 - DNA, 180 bp, Artificial Sequence; identical to SEQ ID NO: 6148
  Synthetic polynucleotide

SEQ ID NO: 6150 - DNA, 185 bp, Artificial Sequence
  Synthetic polynucleotide
atcatctcaccttgcctcctgttgacttcagtgcaccgcctgcaggaagataagataagataagaaagataagataagatatcgaagataagataagatagacaagataagataagatactaaagataagataagataactaagataagataagatatgcggcgcgccatgcttcatcagactct

SEQ ID NO: 6151 - DNA, 185 bp, Artificial Sequence; identical to SEQ ID NO: 6150
  Synthetic polynucleotide

SEQ ID NO: 6152 - DNA, 191 bp, Artificial Sequence
  Synthetic polynucleotide
atcatctcaccttgcctcctgacagtagaaaccgaagtcctgcaggaattttacatgtatttaagaaattttacatgtatttatcgaattttacatgtatttagacaattttacatgtatttactaaattttacatgtatttaactaattttacatgtatttatgcggcgcgccatgcttcatcagactct

SEQ ID NO: 6153 - DNA, 191 bp, Artificial Sequence; identical to SEQ ID NO: 6152
  Synthetic polynucleotide

SEQ ID NO: 6154 - DNA, 172 bp, Artificial Sequence
  Synthetic polynucleotide
atcatctcaccttgcctcctgcgtgcacgaacctgatacctgcaggatgccagaccagaatgccagacctcgatgccagaccgacatgccagaccctaatgccagaccactatgccagacctgcatgccagaccgtaatgccagaccggcgcgccatgcttcatcagactct

SEQ ID NO: 6155 - DNA, 172 bp, Artificial Sequence; identical to SEQ ID NO: 6154
  Synthetic polynucleotide

SEQ ID NO: 6156 - DNA, 172 bp, Artificial Sequence
  Synthetic polynucleotide
atcatctcaccttgcctcctgctcctttgcctctgttacctgcaggggacttgtctagaggacttgtcttcgggacttgtctgacggacttgtctctaggacttgtctactggacttgtcttgcggacttgtctgtaggacttgtctggcgcgccatgcttcatcagactct

SEQ ID NO: 6157 - DNA, 172 bp, Artificial Sequence; identical to SEQ ID NO: 6156
  Synthetic polynucleotide

SEQ ID NO: 6158 - DNA, 188 bp, Artificial Sequence
  Synthetic polynucleotide
atcatctcaccttgcctcctgtcgcgtagactttgacgcctgcaggcggcacgtgccaagacggcacgtgccatcgcggcacgtgccagaccggcacgtgccactacggcacgtgccaactcggcacgtgccatgccggcacgtgccagtacggcacgtgccaggcgcgccatgcttcatcagactct

SEQ ID NO: 6159 - DNA, 188 bp, Artificial Sequence; identical to SEQ ID NO: 6158
  Synthetic polynucleotide

SEQ ID NO: 6160 - DNA, 148 bp, Artificial Sequence
  Synthetic polynucleotide
atcatctcaccttgcctcctgtggtgcgtaccttgagccctgcaggcttatcaagacttatcatcgcttatcagaccttatcactacttatcaactcttatcatgccttatcagtacttatcaggcgcgccatgcttcatcagactct

SEQ ID NO: 6161 - DNA, 148 bp, Artificial Sequence; identical to SEQ ID NO: 6160
  Synthetic polynucleotide

SEQ ID NO: 6162 - DNA, 190 bp, Artificial Sequence
  Synthetic polynucleotide
atcatctcaccttgcctcctgagccttgtcgaaaggttcctgcaggattattgattttttagaattattgatttttttcgattattgattttttgacattattgattttttctaattattgattttttactattattgatttttttgcattattgattttttgtaggcgcgccatgcttcatcagactct

SEQ ID NO: 6163 - DNA, 190 bp, Artificial Sequence; identical to SEQ ID NO: 6162
  Synthetic polynucleotide

SEQ ID NO: 6164 - DNA, 188 bp, Artificial Sequence
  Synthetic polynucleotide
atcatctcaccttgcctcctggattcctatgtgttagccctgcaggaaacaaacaatcagaaaacaaacaatctcgaaacaaacaatcgacaaacaaacaatcctaaaacaaacaatcactaaacaaacaatctgcaaacaaacaatcgtaaaacaaacaatcggcgcgccatgcttcatcagactct

SEQ ID NO: 6165 - DNA, 188 bp, Artificial Sequence; identical to SEQ ID NO: 6164
  Synthetic polynucleotide

SEQ ID NO: 6166 - DNA, 188 bp, Artificial Sequence
  Synthetic polynucleotide
atcatctcaccttgcctcctgatttgtagctgcacaatcctgcaggcggcacgtgccgagacggcacgtgccgtcgcggcacgtgccggaccggcacgtgccgctacggcacgtgccgactcggcacgtgccgtgccggcacgtgccggtacggcacgtgccgggcgcgccatgcttcatcagactct

SEQ ID NO: 6167 - DNA, 188 bp, Artificial Sequence; identical to SEQ ID NO: 6166
  Synthetic polynucleotide

SEQ ID NO: 6168 - DNA, 180 bp, Artificial Sequence
  Synthetic polynucleotide
atcatctcaccttgcctcctgaaattgttcgcagagatcctgcaggtaggtgtgaagagataggtgtgaagtcgtaggtgtgaaggactaggtgtgaagctataggtgtgaagacttaggtgtgaagtgctaggtgtgaaggtataggtgtgaagggcgcgccatgcttcatcagactct

SEQ ID NO: 6169 - DNA, 180 bp, Artificial Sequence; identical to SEQ ID NO: 6168
  Synthetic polynucleotide

SEQ ID NO: 6170 - DNA, 156 bp, Artificial Sequence
  Synthetic polynucleotide
atcatctcaccttgcctcctgcttgtaaatcacccagccctgcaggaaggtcacagaaaggtcactcgaaggtcacgacaaggtcacctaaaggtcacactaaggtcactgcaaggtcacgtaaaggtcacggcgcgccatgcttcatcagactct

SEQ ID NO: 6171 - DNA, 156 bp, Artificial Sequence; identical to SEQ ID NO: 6170
  Synthetic polynucleotide

SEQ ID NO: 6172 - DNA, 191 bp, Artificial Sequence
  Synthetic polynucleotide
atcatctcaccttgcctcctgtcttcgtgggttccctgcctgcagggccacaggaagtaacacagagccacaggaagtaacactcggccacaggaagtaacacgacgccacaggaagtaacacctagccacaggaagtaacacactgccacaggaagtaacactgcggcgcgccatgcttcatcagactct

SEQ ID NO: 6173 - DNA, 191 bp, Artificial Sequence; identical to SEQ ID NO: 6172
  Synthetic polynucleotide

SEQ ID NO: 6174 - DNA, 188 bp, Artificial Sequence
  Synthetic polynucleotide
atcatctcaccttgcctcctgtaatacgaccctcatggcctgcaggcaacgtccgcggagacaacgtccgcggtcgcaacgtccgcgggaccaacgtccgcggctacaacgtccgcggactcaacgtccgcggtgccaacgtccgcgggtacaacgtccgcggggcgcgccatgcttcatcagactct

SEQ ID NO: 6175 - DNA, 188 bp, Artificial Sequence; identical to SEQ ID NO: 6174
  Synthetic polynucleotide

SEQ ID NO: 6176 - DNA, 190 bp, Artificial Sequence
  Synthetic polynucleotide
atcatctcaccttgcctcctgccgtcagagacatatcacctgcagggcgaaacatctggaagagcgaaacatctggatcggcgaaacatctggagacgcgaaacatctggactagcgaaacatctggaactgcgaaacatctggatgcgcgaaacatctggagtaggcgcgccatgcttcatcagactct

SEQ ID NO: 6177 - DNA, 190 bp, Artificial Sequence; identical to SEQ ID NO: 6176
  Synthetic polynucleotide

SEQ ID NO: 6178 - DNA, 164 bp, Artificial Sequence
  Synthetic polynucleotide
atcatctcaccttgcctcctgcgtagttgagggttcgacctgcaggggattatccagaggattatcctcgggattatccgacggattatccctaggattatccactggattatcctgcggattatccgtaggattatccggcgcgccatgcttcatcagactct

SEQ ID NO: 6179 - DNA, 164 bp, Artificial Sequence; identical to SEQ ID NO: 6178
  Synthetic polynucleotide

SEQ ID NO: 6180 - DNA, 196 bp, Artificial Sequence
  Synthetic polynucleotide
atcatctcaccttgcctcctgattacaaaggccaactacctgcaggtactgggaataccagatactgggaatacctcgtactgggaataccgactactgggaataccctatactgggaataccacttactgggaatacctgctactgggaataccgtatactgggaataccggcgcgccatgcttcatcagactct

SEQ ID NO: 6181 - DNA, 196 bp, Artificial Sequence; identical to SEQ ID NO: 6180
  Synthetic polynucleotide

SEQ ID NO: 6182 - DNA, 172 bp, Artificial Sequence
  Synthetic polynucleotide
atcatctcaccttgcctcctgatacatcttgttccgaacctgcagggtcattaagaagagtcattaagatcggtcattaagagacgtcattaagactagtcattaagaactgtcattaagatgcgtcattaagagtagtcattaagaggcgcgccatgcttcatcagactct

SEQ ID NO: 6183 - DNA, 172 bp, Artificial Sequence; identical to SEQ ID NO: 6182
  Synthetic polynucleotide

SEQ ID NO: 6184 - DNA, 164 bp, Artificial Sequence
  Synthetic polynucleotide
atcatctcaccttgcctcctgttagccatcgaggccgtcctgcaggattggcactagaattggcacttcgattggcactgacattggcactctaattggcactactattggcacttgcattggcactgtaattggcactggcgcgccatgcttcatcagactct

SEQ ID NO: 6185 - DNA, 164 bp, Artificial Sequence; identical to SEQ ID NO: 6184
  Synthetic polynucleotide

SEQ ID NO: 6186 - DNA, 140 bp, Artificial Sequence
  Synthetic polynucleotide
atcatctcaccttgcctcctgcccttctctaagcctctcctgcaggtcaaagagatcaaagtcgtcaaaggactcaaagctatcaaagacttcaaagtgctcaaaggtatcaaagggcgcgccatgcttcatcagactct

SEQ ID NO: 6187 - DNA, 140 bp, Artificial Sequence; identical to SEQ ID NO: 6186
  Synthetic polynucleotide

SEQ ID NO: 6188 - DNA, 172 bp, Artificial Sequence
  Synthetic polynucleotide
atcatctcaccttgcctcctggtcagtgcccgttaagacctgcagggtagcaaccaagagtagcaaccatcggtagcaaccagacgtagcaaccactagtagcaaccaactgtagcaaccatgcgtagcaaccagtagtagcaaccaggcgcgccatgcttcatcagactct

SEQ ID NO: 6189 - DNA, 172 bp, Artificial Sequence; identical to SEQ ID NO: 6188
  Synthetic polynucleotide

SEQ ID NO: 6190 - DNA, 180 bp, Artificial Sequence
  Synthetic polynucleotide
atcatctcaccttgcctcctgcaaagaatcaacgcgctcctgcaggctgtctggctaagactgtctggctatcgctgtctggctagacctgtctggctactactgtctggctaactctgtctggctatgcctgtctggctagtactgtctggctaggcgcgccatgcttcatcagactct

SEQ ID NO: 6191 - DNA, 180 bp, Artificial Sequence; identical to SEQ ID NO: 6190
  Synthetic polynucleotide

SEQ ID NO: 6192 - DNA, 156 bp, Artificial Sequence
  Synthetic polynucleotide
atcatctcaccttgcctcctgtggctatgtgacatgaccctgcaggaaggtcaaagaaaggtcaatcgaaggtcaagacaaggtcaactaaaggtcaaactaaggtcaatgcaaggtcaagtaaaggtcaaggcgcgccatgcttcatcagactct

SEQ ID NO: 6193 - DNA, 156 bp, Artificial Sequence; identical to SEQ ID NO: 6192
  Synthetic polynucleotide

SEQ ID NO: 6194 - DNA, 180 bp, Artificial Sequence
  Synthetic polynucleotide
atcatctcaccttgcctcctgcctgaggctcttactgacctgcaggttgattaatgcagattgattaatgctcgttgattaatgcgacttgattaatgcctattgattaatgcactttgattaatgctgcttgattaatgcgtattgattaatgcggcgcgccatgcttcatcagactct

SEQ ID NO: 6195 - DNA, 180 bp, Artificial Sequence; identical to SEQ ID NO: 6194
  Synthetic polynucleotide

SEQ ID NO: 6196 - DNA, 200 bp, Artificial Sequence
  Synthetic polynucleotide
atcatctcaccttgcctcctgcgtcaagttgcaccggacctgcaggacagggtcaaaggtcaagaagaacagggtcaaaggtcaagatcgacagggtcaaaggtcaagagacacagggtcaaaggtcaagactaacagggtcaaaggtcaagaactacagggtcaaaggtcaagaggcgcgccatgcttcatcagactct

SEQ ID NO: 6197 - DNA, 200 bp, Artificial Sequence; identical to SEQ ID NO: 6196
  Synthetic polynucleotide

SEQ ID NO: 6198 - DNA, 196 bp, Artificial Sequence
  Synthetic polynucleotide
atcatctcaccttgcctcctggcgagttaaactgctgtcctgcagggaggggcgcagctgcgccccatagagaggggcgcagctgcgccccattcggaggggcgcagctgcgccccatgacgaggggcgcagctgcgccccatctagaggggcgcagctgcgccccatactggcgcgccatgcttcatcagactct

SEQ ID NO: 6199 - DNA, 196 bp, Artificial Sequence; identical to SEQ ID NO: 6198
  Synthetic polynucleotide

SEQ ID NO: 6200 - DNA, 172 bp, Artificial Sequence
  Synthetic polynucleotide
atcatctcaccttgcctcctggtccgctgcctctaagacctgcaggttagcaggaaagattagcaggaatcgttagcaggaagacttagcaggaactattagcaggaaactttagcaggaatgcttagcaggaagtattagcaggaaggcgcgccatgcttcatcagactct

SEQ ID NO: 6201 - DNA, 172 bp, Artificial Sequence; identical to SEQ ID NO: 6200
  Synthetic polynucleotide

SEQ ID NO: 6202 - DNA, 180 bp, Artificial Sequence
  Synthetic polynucleotide
atcatctcaccttgcctcctgtactcgtgcagcaaattcctgcaggtgacgtcagtgagatgacgtcagtgtcgtgacgtcagtggactgacgtcagtgctatgacgtcagtgacttgacgtcagtgtgctgacgtcagtggtatgacgtcagtgggcgcgccatgcttcatcagactct

SEQ ID NO: 6203 - DNA, 180 bp, Artificial Sequence; identical to SEQ ID NO: 6202
  Synthetic polynucleotide

SEQ ID NO: 6204 - DNA, 190 bp, Artificial Sequence
  Synthetic polynucleotide
atcatctcaccttgcctcctgagctagatgaagatcatcctgcaggattcccaagggaatagaattcccaagggaattcgattcccaagggaatgacattcccaagggaatctaattcccaagggaatactattcccaagggaattgcattcccaagggaatgtaggcgcgccatgcttcatcagactct

SEQ ID NO: 6205 - DNA, 190 bp, Artificial Sequence; identical to SEQ ID NO: 6204
  Synthetic polynucleotide

SEQ ID NO: 6206 - DNA, 172 bp, Artificial Sequence
  Synthetic polynucleotide
atcatctcaccttgcctcctgtatgacctctgagtgtacctgcaggagagataagaagaagagataagatcgagagataagagacagagataagactaagagataagaactagagataagatgcagagataagagtaagagataagaggcgcgccatgcttcatcagactct

SEQ ID NO: 6207 - DNA, 172 bp, Artificial Sequence; identical to SEQ ID NO: 6206
  Synthetic polynucleotide

SEQ ID NO: 6208 - DNA, 190 bp, Artificial Sequence
  Synthetic polynucleotide
atcatctcaccttgcctcctgtctttcgatgcgtcggtcctgcagggcacctcgcacagcagagcacctcgcacagctcggcacctcgcacagcgacgcacctcgcacagcctagcacctcgcacagcactgcacctcgcacagctgcgcacctcgcacagcgtaggcgcgccatgcttcatcagactct

SEQ ID NO: 6209 - DNA, 190 bp, Artificial Sequence; identical to SEQ ID NO: 6208
  Synthetic polynucleotide

SEQ ID NO: 6210 - DNA, 180 bp, Artificial Sequence
  Synthetic polynucleotide
atcatctcaccttgcctcctgccatgtatattgccttccctgcaggggtaataaaaaagaggtaataaaaatcgggtaataaaaagacggtaataaaaactaggtaataaaaaactggtaataaaaatgcggtaataaaaagtaggtaataaaaaggcgcgccatgcttcatcagactct

SEQ ID NO: 6211 - DNA, 180 bp, Artificial Sequence; identical to SEQ ID NO: 6210
  Synthetic polynucleotide

SEQ ID NO: 6212 - DNA, 188 bp, Artificial Sequence
  Synthetic polynucleotide
atcatctcaccttgcctcctggaagaaggcacggtctccctgcagggaaagcgaaactagagaaagcgaaacttcggaaagcgaaactgacgaaagcgaaactctagaaagcgaaactactgaaagcgaaacttgcgaaagcgaaactgtagaaagcgaaactggcgcgccatgcttcatcagactct

SEQ ID NO: 6213 - DNA, 188 bp, Artificial Sequence; identical to SEQ ID NO: 6212
  Synthetic polynucleotide

SEQ ID NO: 6214 - DNA, 185 bp, Artificial Sequence
  Synthetic polynucleotide
atcatctcaccttgcctcctgctgacccagagaatgatcctgcaggggttatttttaaaccgagaggttatttttaaaccgtcgggttatttttaaaccggacggttatttttaaaccgctaggttatttttaaaccgactggttatttttaaaccgtgcggcgcgccatgcttcatcagactct

SEQ ID NO: 6215 - DNA, 185 bp, Artificial Sequence; identical to SEQ ID NO: 6214
  Synthetic polynucleotide

SEQ ID NO: 6216 - DNA, 156 bp, Artificial Sequence
  Synthetic polynucleotide
atcatctcaccttgcctcctggcactacacaaagtgatcctgcaggcaggaaggagacaggaaggtcgcaggaagggaccaggaaggctacaggaaggactcaggaaggtgccaggaagggtacaggaaggggcgcgccatgcttcatcagactct

SEQ ID NO: 6217 - DNA, 156 bp, Artificial Sequence; identical to SEQ ID NO: 6216
  Synthetic polynucleotide

SEQ ID NO: 6218 - DNA, 164 bp, Artificial Sequence
  Synthetic polynucleotide
atcatctcaccttgcctcctgggttatgacgtgagctacctgcagggctgattacagagctgattactcggctgattacgacgctgattacctagctgattacactgctgattactgcgctgattacgtagctgattacggcgcgccatgcttcatcagactct

SEQ ID NO: 6219 - DNA, 164 bp, Artificial Sequence; identical to SEQ ID NO: 6218
  Synthetic polynucleotide

SEQ ID NO: 6220 - DNA, 180 bp, Artificial Sequence
  Synthetic polynucleotide
atcatctcaccttgcctcctgctgtgtttcattcggaacctgcaggtttttattaccagatttttattacctcgtttttattaccgactttttattaccctatttttattaccacttttttattacctgctttttattaccgtatttttattaccggcgcgccatgcttcatcagactct

SEQ ID NO: 6221 - DNA, 180 bp, Artificial Sequence; identical to SEQ ID NO: 6220
  Synthetic polynucleotide

SEQ ID NO: 6222 - DNA, 172 bp, Artificial Sequence
  Synthetic polynucleotide
atcatctcaccttgcctcctgtcacactgactggatggcctgcaggggtggtcatgagaggtggtcatgtcgggtggtcatggacggtggtcatgctaggtggtcatgactggtggtcatgtgcggtggtcatggtaggtggtcatgggcgcgccatgcttcatcagactct

SEQ ID NO: 6223 - DNA, 172 bp, Artificial Sequence; identical to SEQ ID NO: 6222
  Synthetic polynucleotide

SEQ ID NO: 6224 - DNA, 180 bp, Artificial Sequence
  Synthetic polynucleotide
atcatctcaccttgcctcctggctctatcttacactagcctgcagggagtgagtcatagagagtgagtcattcggagtgagtcatgacgagtgagtcatctagagtgagtcatactgagtgagtcattgcgagtgagtcatgtagagtgagtcatggcgcgccatgcttcatcagactct

SEQ ID NO: 6225 - DNA, 180 bp, Artificial Sequence; identical to SEQ ID NO: 6224
  Synthetic polynucleotide

SEQ ID NO: 6226 - DNA, 188 bp, Artificial Sequence
  Synthetic polynucleotide
atcatctcaccttgcctcctggtgtactcgataaaccgcctgcaggtaatttatgcatagataatttatgcattcgtaatttatgcatgactaatttatgcatctataatttatgcatacttaatttatgcattgctaatttatgcatgtataatttatgcatggcgcgccatgcttcatcagactct

SEQ ID NO: 6227 - DNA, 188 bp, Artificial Sequence; identical to SEQ ID NO: 6226
  Synthetic polynucleotide

SEQ ID NO: 6228 - DNA, 148 bp, Artificial Sequence
  Synthetic polynucleotide
atcatctcaccttgcctcctgagacatgtctcgtcctccctgcaggcttatctagacttatcttcgcttatctgaccttatctctacttatctactcttatcttgccttatctgtacttatctggcgcgccatgcttcatcagactct

SEQ ID NO: 6229 - DNA, 148 bp, Artificial Sequence; identical to SEQ ID NO: 6228
  Synthetic polynucleotide

SEQ ID NO: 6230 - DNA, 199 bp, Artificial Sequence
  Synthetic polynucleotide
atcatctcaccttgcctcctgccaaatttacatagctgcctgcaggtgttggctccgtgccaaattgaacaggtgagatgttggctccgtgccaaattgaacaggtgtcgtgttggctccgtgccaaattgaacaggtggactgttggctccgtgccaaattgaacaggtgctaggcgcgccatgcttcatcagactct

SEQ ID NO: 6231 - DNA, 199 bp, Artificial Sequence; identical to SEQ ID NO: 6230
  Synthetic polynucleotide

SEQ ID NO: 6232 - DNA, 197 bp, Artificial Sequence
  Synthetic polynucleotide
atcatctcaccttgcctcctgttctctttgaggtgacacctgcaggaaccgcttccgggtcagaaaccgcttccgggtctcgaaccgcttccgggtcgacaaccgcttccgggtcctaaaccgcttccgggtcactaaccgcttccgggtctgcaaccgcttccgggtcgtaggcgcgccatgcttcatcagactct

SEQ ID NO: 6233 - DNA, 197 bp, Artificial Sequence; identical to SEQ ID NO: 6232
  Synthetic polynucleotide

SEQ ID NO: 6234 - DNA, 172 bp, Artificial Sequence
  Synthetic polynucleotide
atcatctcaccttgcctcctgctcaaccctgtacgttccctgcaggcgcgcgaaacagacgcgcgaaactcgcgcgcgaaacgaccgcgcgaaacctacgcgcgaaacactcgcgcgaaactgccgcgcgaaacgtacgcgcgaaacggcgcgccatgcttcatcagactct

SEQ ID NO: 6235 - DNA, 172 bp, Artificial Sequence; identical to SEQ ID NO: 6234
  Synthetic polynucleotide

SEQ ID NO: 6236 - DNA, 180 bp, Artificial Sequence
  Synthetic polynucleotide
atcatctcaccttgcctcctgcctgaagtgggcaaatccctgcaggtaattattaatagataattattaattcgtaattattaatgactaattattaatctataattattaatacttaattattaattgctaattattaatgtataattattaatggcgcgccatgcttcatcagactct

SEQ ID NO: 6237 - DNA, 180 bp, Artificial Sequence; identical to SEQ ID NO: 6236
  Synthetic polynucleotide

SEQ ID NO: 6238 - DNA, 191 bp, Artificial Sequence
  Synthetic polynucleotide
atcatctcaccttgcctcctgcccgacagatgatgaatcctgcagggtaactaattaactactagagtaactaattaactacttcggtaactaattaactactgacgtaactaattaactactctagtaactaattaactactactgtaactaattaactacttgcggcgcgccatgcttcatcagactct

SEQ ID NO: 6239 - DNA, 191 bp, Artificial Sequence; identical to SEQ ID NO: 6238
  Synthetic polynucleotide

SEQ ID NO: 6240 - DNA, 156 bp, Artificial Sequence
  Synthetic polynucleotide
atcatctcaccttgcctcctgactaaggaggcggtggacctgcaggaaggtcatagaaaggtcattcgaaggtcatgacaaggtcatctaaaggtcatactaaggtcattgcaaggtcatgtaaaggtcatggcgcgccatgcttcatcagactct

SEQ ID NO: 6241 - DNA, 156 bp, Artificial Sequence; identical to SEQ ID NO: 6240
  Synthetic polynucleotide

SEQ ID NO: 6242 - DNA, 196 bp, Artificial Sequence
  Synthetic polynucleotide
atcatctcaccttgcctcctgaggatcctcctttcgtccctgcaggattatgctaatttagaattatgctaattttcgattatgctaatttgacattatgctaatttctaattatgctaatttactattatgctaattttgcattatgctaatttgtaattatgctaatttggcgcgccatgcttcatcagactct

SEQ ID NO: 6243 - DNA, 196 bp, Artificial Sequence; identical to SEQ ID NO: 6242
  Synthetic polynucleotide

SEQ ID NO: 6244 - DNA, 164 bp, Artificial Sequence
  Synthetic polynucleotide
atcatctcaccttgcctcctgcttagacagtacctcaacctgcagggtgacgtgtagagtgacgtgttcggtgacgtgtgacgtgacgtgtctagtgacgtgtactgtgacgtgttgcgtgacgtgtgtagtgacgtgtggcgcgccatgcttcatcagactct

SEQ ID NO: 6245 - DNA, 164 bp, Artificial Sequence; identical to SEQ ID NO: 6244
  Synthetic polynucleotide

SEQ ID NO: 6246 - DNA, 156 bp, Artificial Sequence
  Synthetic polynucleotide
atcatctcaccttgcctcctgtcctattagactaactgcctgcagggtaattaaagagtaattaatcggtaattaagacgtaattaactagtaattaaactgtaattaatgcgtaattaagtagtaattaaggcgcgccatgcttcatcagactct

SEQ ID NO: 6247 - DNA, 156 bp, Artificial Sequence; identical to SEQ ID NO: 6246
  Synthetic polynucleotide

SEQ ID NO: 6248 - DNA, 156 bp, Artificial Sequence
  Synthetic polynucleotide
atcatctcaccttgcctcctgaccatggttgtgtgtaacctgcagggtaattacagagtaattactcggtaattacgacgtaattacctagtaattacactgtaattactgcgtaattacgtagtaattacggcgcgccatgcttcatcagactct

SEQ ID NO: 6249 - DNA, 156 bp, Artificial Sequence; identical to SEQ ID NO: 6248
  Synthetic polynucleotide

SEQ ID NO: 6250 - DNA, 164 bp, Artificial Sequence
  Synthetic polynucleotide
atcatctcaccttgcctcctgatcctcctatcggtcaacctgcaggaattacatgagaaattacatgtcgaattacatggacaattacatgctaaattacatgactaattacatgtgcaattacatggtaaattacatgggcgcgccatgcttcatcagactct

SEQ ID NO: 6251 - DNA, 164 bp, Artificial Sequence; identical to SEQ ID NO: 6250
  Synthetic polynucleotide

SEQ ID NO: 6252 - DNA, 164 bp, Artificial Sequence
  Synthetic polynucleotide
atcatctcaccttgcctcctggccattatctggctgctcctgcaggctgcccgcaagactgcccgcatcgctgcccgcagacctgcccgcactactgcccgcaactctgcccgcatgcctgcccgcagtactgcccgcaggcgcgccatgcttcatcagactct

SEQ ID NO: 6253 - DNA, 164 bp, Artificial Sequence; identical to SEQ ID NO: 6252
  Synthetic polynucleotide

SEQ ID NO: 6254 - DNA, 172 bp, Artificial Sequence
  Synthetic polynucleotide
atcatctcaccttgcctcctgcttcactgtaaaggtgtcctgcaggaattgatacaagaaattgatacatcgaattgatacagacaattgatacactaaattgatacaactaattgatacatgcaattgatacagtaaattgatacaggcgcgccatgcttcatcagactct

SEQ ID NO: 6255 - DNA, 172 bp, Artificial Sequence; identical to SEQ ID NO: 6254
  Synthetic polynucleotide

SEQ ID NO: 6256 - DNA, 172 bp, Artificial Sequence
  Synthetic polynucleotide
atcatctcaccttgcctcctggtctcctttagaggctccctgcaggagatttgaatagaagatttgaattcgagatttgaatgacagatttgaatctaagatttgaatactagatttgaattgcagatttgaatgtaagatttgaatggcgcgccatgcttcatcagactct

SEQ ID NO: 6257 - DNA, 172 bp, Artificial Sequence; identical to SEQ ID NO: 6256
  Synthetic polynucleotide

SEQ ID NO: 6258 - DNA, 172 bp, Artificial Sequence
  Synthetic polynucleotide
atcatctcaccttgcctcctggaacttcttggcaaggccctgcaggattttgctgaagaattttgctgatcgattttgctgagacattttgctgactaattttgctgaactattttgctgatgcattttgctgagtaattttgctgaggcgcgccatgcttcatcagactct

SEQ ID NO: 6259 - DNA, 172 bp, Artificial Sequence; identical to SEQ ID NO: 6258
  Synthetic polynucleotide

SEQ ID NO: 6260 - DNA, 156 bp, Artificial Sequence
  Synthetic polynucleotide
atcatctcaccttgcctcctgatatacaacgtagtacgcctgcagggtaattagagagtaattagtcggtaattaggacgtaattagctagtaattagactgtaattagtgcgtaattaggtagtaattagggcgcgccatgcttcatcagactct

SEQ ID NO: 6261 - DNA, 156 bp, Artificial Sequence; identical to SEQ ID NO: 6260
  Synthetic polynucleotide

SEQ ID NO: 6262 - DNA, 172 bp, Artificial Sequence
  Synthetic polynucleotide
atcatctcaccttgcctcctgtacgggtttcgggtccacctgcaggcgcgcgcgctagacgcgcgcgcttcgcgcgcgcgctgaccgcgcgcgctctacgcgcgcgctactcgcgcgcgcttgccgcgcgcgctgtacgcgcgcgctggcgcgccatgcttcatcagactct

SEQ ID NO: 6263 - DNA, 172 bp, Artificial Sequence; identical to SEQ ID NO: 6262
  Synthetic polynucleotide

SEQ ID NO: 6264 - DNA, 156 bp, Artificial Sequence
  Synthetic polynucleotide
atcatctcaccttgcctcctggcaagatgtaggtgagtcctgcaggcaggaagtagacaggaagttcgcaggaagtgaccaggaagtctacaggaagtactcaggaagttgccaggaagtgtacaggaagtggcgcgccatgcttcatcagactct

SEQ ID NO: 6265 - DNA, 156 bp, Artificial Sequence; identical to SEQ ID NO: 6264
  Synthetic polynucleotide

SEQ ID NO: 6266 - DNA, 164 bp, Artificial Sequence
  Synthetic polynucleotide
atcatctcaccttgcctcctgtgtgaaggccgaaagtccctgcagggagggtgggagagagggtgggtcggagggtggggacgagggtgggctagagggtgggactgagggtgggtgcgagggtggggtagagggtgggggcgcgccatgcttcatcagactct

SEQ ID NO: 6267 - DNA, 164 bp, Artificial Sequence; identical to SEQ ID NO: 6266
  Synthetic polynucleotide

SEQ ID NO: 6268 - DNA, 197 bp, Artificial Sequence
  Synthetic polynucleotide
atcatctcaccttgcctcctgtagggagggtaatcatacctgcaggtgacctttagatgaccttagatgacctttagatgacctttcgtgacctttagatgaccttgactgacctttagatgaccttctatgacctttagatgaccttacttgacctttagatgacctttgcggcgcgccatgcttcatcagactct

SEQ ID NO: 6269 - DNA, 197 bp, Artificial Sequence; identical to SEQ ID NO: 6268
  Synthetic polynucleotide

SEQ ID NO: 6270 - DNA, 197 bp, Artificial Sequence
  Synthetic polynucleotide
atcatctcaccttgcctcctggcacaccaaagctcatgcctgcaggatgaatggaattcatagaatgaatggaattcattcgatgaatggaattcatgacatgaatggaattcatctaatgaatggaattcatactatgaatggaattcattgcatgaatggaattcatgtaggcgcgccatgcttcatcagactct

SEQ ID NO: 6271 - DNA, 197 bp, Artificial Sequence; identical to SEQ ID NO: 6270
  Synthetic polynucleotide

SEQ ID NO: 6272 - DNA, 188 bp, Artificial Sequence
  Synthetic polynucleotide
atcatctcaccttgcctcctgtagcgtcctttcgagatcctgcagggaaagcgaaaccagagaaagcgaaacctcggaaagcgaaaccgacgaaagcgaaaccctagaaagcgaaaccactgaaagcgaaacctgcgaaagcgaaaccgtagaaagcgaaaccggcgcgccatgcttcatcagactct

SEQ ID NO: 6273 - DNA, 188 bp, Artificial Sequence; identical to SEQ ID NO: 6272
  Synthetic polynucleotide

SEQ ID NO: 6274 - DNA, 172 bp, Artificial Sequence
  Synthetic polynucleotide
atcatctcaccttgcctcctgagcgtgggacgaaagagcctgcaggcacattccatagacacattccattcgcacattccatgaccacattccatctacacattccatactcacattccattgccacattccatgtacacattccatggcgcgccatgcttcatcagactct

SEQ ID NO: 6275 - DNA, 172 bp, Artificial Sequence; identical to SEQ ID NO: 6274
  Synthetic polynucleotide

SEQ ID NO: 6276 - DNA, 198 bp, Artificial Sequence
  Synthetic polynucleotide
atcatctcaccttgcctcctgtgtgatctgtggagtttcctgcaggcagatgccgcccacgcattattcagacagatgccgcccacgcattattctcgcagatgccgcccacgcattattcgaccagatgccgcccacgcattattcctacagatgccgcccacgcattattcggcgcgccatgcttcatcagactct

SEQ ID NO: 6277 - DNA, 198 bp, Artificial Sequence; identical to SEQ ID NO: 6276
  Synthetic polynucleotide

SEQ ID NO: 6278 - DNA, 197 bp, Artificial Sequence
  Synthetic polynucleotide
atcatctcaccttgcctcctgtgtcgaggtgctctgtacctgcaggccacttccgggttcgagaccacttccgggttcgtcgccacttccgggttcggacccacttccgggttcgctaccacttccgggttcgactccacttccgggttcgtgcccacttccgggttcggtaggcgcgccatgcttcatcagactct

SEQ ID NO: 6279 - DNA, 197 bp, Artificial Sequence; identical to SEQ ID NO: 6278
  Synthetic polynucleotide

SEQ ID NO: 6280 - DNA, 188 bp, Artificial Sequence
  Synthetic polynucleotide
atcatctcaccttgcctcctgtaggtctcaaacggtggcctgcaggcttcctctttttagacttcctcttttttcgcttcctctttttgaccttcctctttttctacttcctctttttactcttcctcttttttgccttcctctttttgtacttcctctttttggcgcgccatgcttcatcagactct

SEQ ID NO: 6281 - DNA, 188 bp, Artificial Sequence; identical to SEQ ID NO: 6280
  Synthetic polynucleotide

SEQ ID NO: 6282 - DNA, 156 bp, Artificial Sequence
  Synthetic polynucleotide
atcatctcaccttgcctcctgagtcggttagctctttacctgcaggatctgataagaatctgatatcgatctgatagacatctgatactaatctgataactatctgatatgcatctgatagtaatctgataggcgcgccatgcttcatcagactct

SEQ ID NO: 6283 - DNA, 156 bp, Artificial Sequence; identical to SEQ ID NO: 6282
  Synthetic polynucleotide

SEQ ID NO: 6284 - DNA, 196 bp, Artificial Sequence
  Synthetic polynucleotide
atcatctcaccttgcctcctggaccattgatcggcgcacctgcaggggccacgtgacccagaggccacgtgaccctcgggccacgtgacccgacggccacgtgacccctaggccacgtgacccactggccacgtgaccctgcggccacgtgacccgtaggccacgtgacccggcgcgccatgcttcatcagactct

SEQ ID NO: 6285 - DNA, 196 bp, Artificial Sequence; identical to SEQ ID NO: 6284
  Synthetic polynucleotide

SEQ ID NO: 6286 - DNA, 191 bp, Artificial Sequence
  Synthetic polynucleotide
atcatctcaccttgcctcctgaacaaacgatattagggcctgcagggattaattaattaagtcagagattaattaattaagtctcggattaattaattaagtcgacgattaattaattaagtcctagattaattaattaagtcactgattaattaattaagtctgcggcgcgccatgcttcatcagactct

SEQ ID NO: 6287 - DNA, 191 bp, Artificial Sequence; identical to SEQ ID NO: 6286
  Synthetic polynucleotide

SEQ ID NO: 6288 - DNA, 148 bp, Artificial Sequence
  Synthetic polynucleotide
atcatctcaccttgcctcctgggaagatgtagtcggaacctgcaggcatgactagacatgacttcgcatgactgaccatgactctacatgactactcatgacttgccatgactgtacatgactggcgcgccatgcttcatcagactct

SEQ ID NO: 6289 - DNA, 148 bp, Artificial Sequence; identical to SEQ ID NO: 6288
  Synthetic polynucleotide

SEQ ID NO: 6290 - DNA, 188 bp, Artificial Sequence
  Synthetic polynucleotide
atcatctcaccttgcctcctgtttgagtacttacatggcctgcaggaaaggtgtcaaaagaaaaggtgtcaaatcgaaaggtgtcaaagacaaaggtgtcaaactaaaaggtgtcaaaactaaaggtgtcaaatgcaaaggtgtcaaagtaaaaggtgtcaaaggcgcgccatgcttcatcagactct

SEQ ID NO: 6291 - DNA, 188 bp, Artificial Sequence; identical to SEQ ID NO: 6290
  Synthetic polynucleotide

SEQ ID NO: 6292 - DNA, 197 bp, Artificial Sequence
  Synthetic polynucleotide
atcatctcaccttgcctcctggtaagtcacacagtcttcctgcaggctgactcatttccacattagactgactcatttccacatttcgctgactcatttccacattgacctgactcatttccacattctactgactcatttccacattactctgactcatttccacatttgcggcgcgccatgcttcatcagactct

SEQ ID NO: 6293 - DNA, 197 bp, Artificial Sequence; identical to SEQ ID NO: 6292
  Synthetic polynucleotide

SEQ ID NO: 6294 - DNA, 197 bp, Artificial Sequence
  Synthetic polynucleotide
atcatctcaccttgcctcctggtggcttgcagcatatacctgcaggttcgaaacgttcgaaagattcgaaacgttcgaatcgttcgaaacgttcgaagacttcgaaacgttcgaactattcgaaacgttcgaaactttcgaaacgttcgaatgcttcgaaacgttcgaagtaggcgcgccatgcttcatcagactct

SEQ ID NO: 6295 - DNA, 197 bp, Artificial Sequence; identical to SEQ ID NO: 6294
  Synthetic polynucleotide

SEQ ID NO: 6296 - DNA, 188 bp, Artificial Sequence
  Synthetic polynucleotide
atcatctcaccttgcctcctgctattagactaagcgaacctgcagggtttggcgcgaaagagtttggcgcgaatcggtttggcgcgaagacgtttggcgcgaactagtttggcgcgaaactgtttggcgcgaatgcgtttggcgcgaagtagtttggcgcgaaggcgcgccatgcttcatcagactct

SEQ ID NO: 6297 - DNA, 188 bp, Artificial Sequence; identical to SEQ ID NO: 6296
  Synthetic polynucleotide

SEQ ID NO: 6298 - DNA, 191 bp, Artificial Sequence
  Synthetic polynucleotide
atcatctcaccttgcctcctgttaccttcttccctcctcctgcaggggaaagcgaaactgaaaagaggaaagcgaaactgaaatcgggaaagcgaaactgaaagacggaaagcgaaactgaaactaggaaagcgaaactgaaaactggaaagcgaaactgaaatgcggcgcgccatgcttcatcagactct

SEQ ID NO: 6299 - DNA, 191 bp, Artificial Sequence; identical to SEQ ID NO: 6298
  Synthetic polynucleotide

SEQ ID NO: 6300 - DNA, 188 bp, Artificial Sequence
  Synthetic polynucleotide
atcatctcaccttgcctcctgcgaccagtgtaatcccacctgcagggggcccatttccagagggcccatttcctcggggcccatttccgacgggcccatttccctagggcccatttccactgggcccatttcctgcgggcccatttccgtagggcccatttccggcgcgccatgcttcatcagactct

SEQ ID NO: 6301 - DNA, 188 bp, Artificial Sequence; identical to SEQ ID NO: 6300
  Synthetic polynucleotide

SEQ ID NO: 6302 - DNA, 156 bp, Artificial Sequence
  Synthetic polynucleotide
atcatctcaccttgcctcctgatgacatgaacgaatgtcctgcaggccgttactagaccgttacttcgccgttactgacccgttactctaccgttactactccgttacttgcccgttactgtaccgttactggcgcgccatgcttcatcagactct

SEQ ID NO: 6303 - DNA, 156 bp, Artificial Sequence; identical to SEQ ID NO: 6302
  Synthetic polynucleotide

SEQ ID NO: 6304 - DNA, 172 bp, Artificial Sequence
  Synthetic polynucleotide
atcatctcaccttgcctcctgttctattagtcgtcatccctgcaggcaggaaataaagacaggaaataatcgcaggaaataagaccaggaaataactacaggaaataaactcaggaaataatgccaggaaataagtacaggaaataaggcgcgccatgcttcatcagactct

SEQ ID NO: 6305 - DNA, 172 bp, Artificial Sequence; identical to SEQ ID NO: 6304
  Synthetic polynucleotide

SEQ ID NO: 6306 - DNA, 164 bp, Artificial Sequence
  Synthetic polynucleotide
atcatctcaccttgcctcctgtcgggatgtcccactagcctgcaggtttcgcaatagatttcgcaattcgtttcgcaatgactttcgcaatctatttcgcaatacttttcgcaattgctttcgcaatgtatttcgcaatggcgcgccatgcttcatcagactct

SEQ ID NO: 6307 - DNA, 164 bp, Artificial Sequence; identical to SEQ ID NO: 6306
  Synthetic polynucleotide

SEQ ID NO: 6308 - DNA, 180 bp, Artificial Sequence
  Synthetic polynucleotide
atcatctcaccttgcctcctggggtattgtcgcaataccctgcaggccaccagagggagaccaccagagggtcgccaccagaggggacccaccagagggctaccaccagagggactccaccagagggtgcccaccagaggggtaccaccagagggggcgcgccatgcttcatcagactct

SEQ ID NO: 6309 - DNA, 180 bp, Artificial Sequence; identical to SEQ ID NO: 6308
  Synthetic polynucleotide

SEQ ID NO: 6310 - DNA, 164 bp, Artificial Sequence
  Synthetic polynucleotide
atcatctcaccttgcctcctggtttggaactgtatagtcctgcagggattttttcagagattttttctcggattttttcgacgattttttcctagattttttcactgattttttctgcgattttttcgtagattttttcggcgcgccatgcttcatcagactct

SEQ ID NO: 6311 - DNA, 164 bp, Artificial Sequence; identical to SEQ ID NO: 6310
  Synthetic polynucleotide

SEQ ID NO: 6312 - DNA, 196 bp, Artificial Sequence
  Synthetic polynucleotide
atcatctcaccttgcctcctggggcggatcatacctaacctgcaggggaagagtcacgtgaccaatacagaggaagagtcacgtgaccaatactcgggaagagtcacgtgaccaatacgacggaagagtcacgtgaccaatacctaggaagagtcacgtgaccaatacactggcgcgccatgcttcatcagactct

SEQ ID NO: 6313 - DNA, 196 bp, Artificial Sequence; identical to SEQ ID NO: 6312
  Synthetic polynucleotide

SEQ ID NO: 6314 - DNA, 156 bp, Artificial Sequence
  Synthetic polynucleotide
atcatctcaccttgcctcctggagtgttcccagagtagcctgcaggcgtgggaaagacgtgggaatcgcgtgggaagaccgtgggaactacgtgggaaactcgtgggaatgccgtgggaagtacgtgggaaggcgcgccatgcttcatcagactct

SEQ ID NO: 6315 - DNA, 156 bp, Artificial Sequence; identical to SEQ ID NO: 6314
  Synthetic polynucleotide

SEQ ID NO: 6316 - DNA, 190 bp, Artificial Sequence
  Synthetic polynucleotide
atcatctcaccttgcctcctgaatacactttgggaacgcctgcaggcttcgcggggggtcagacttcgcggggggtctcgcttcgcggggggtcgaccttcgcggggggtcctacttcgcggggggtcactcttcgcggggggtctgccttcgcggggggtcgtaggcgcgccatgcttcatcagactct

SEQ ID NO: 6317 - DNA, 190 bp, Artificial Sequence; identical to SEQ ID NO: 6316
  Synthetic polynucleotide

SEQ ID NO: 6318 - DNA, 185 bp, Artificial Sequence
  Synthetic polynucleotide
atcatctcaccttgcctcctgcctagcacgacgtttcacctgcaggagaccccccacgaagcagaagaccccccacgaagctcgagaccccccacgaagcgacagaccccccacgaagcctaagaccccccacgaagcactagaccccccacgaagctgcggcgcgccatgcttcatcagactct

SEQ ID NO: 6319 - DNA, 185 bp, Artificial Sequence; identical to SEQ ID NO: 6318
  Synthetic polynucleotide

SEQ ID NO: 6320 - DNA, 188 bp, Artificial Sequence
  Synthetic polynucleotide
atcatctcaccttgcctcctggtcaaagtaggttcacgcctgcaggaaccacgtgctcagaaaccacgtgctctcgaaccacgtgctcgacaaccacgtgctcctaaaccacgtgctcactaaccacgtgctctgcaaccacgtgctcgtaaaccacgtgctcggcgcgccatgcttcatcagactct

SEQ ID NO: 6321 - DNA, 188 bp, Artificial Sequence; identical to SEQ ID NO: 6320
  Synthetic polynucleotide

SEQ ID NO: 6322 - DNA, 196 bp, Artificial Sequence
  Synthetic polynucleotide
atcatctcaccttgcctcctgacgaagagtatcgcgggcctgcaggttatatacttattagattatatacttatttcgttatatacttattgacttatatacttattctattatatacttattactttatatacttatttgcttatatacttattgtattatatacttattggcgcgccatgcttcatcagactct

SEQ ID NO: 6323 - DNA, 196 bp, Artificial Sequence; identical to SEQ ID NO: 6322
  Synthetic polynucleotide

SEQ ID NO: 6324 - DNA, 164 bp, Artificial Sequence
  Synthetic polynucleotide
atcatctcaccttgcctcctgctgattcacatcggcaccctgcaggcaacaggtgagacaacaggtgtcgcaacaggtggaccaacaggtgctacaacaggtgactcaacaggtgtgccaacaggtggtacaacaggtgggcgcgccatgcttcatcagactct

SEQ ID NO: 6325 - DNA, 164 bp, Artificial Sequence; identical to SEQ ID NO: 6324
  Synthetic polynucleotide

SEQ ID NO: 6326 - DNA, 164 bp, Artificial Sequence
  Synthetic polynucleotide
atcatctcaccttgcctcctgcggcctagggcattcttcctgcaggctggactttagactggacttttcgctggactttgacctggactttctactggactttactctggacttttgcctggactttgtactggactttggcgcgccatgcttcatcagactct

SEQ ID NO: 6327 - DNA, 164 bp, Artificial Sequence; identical to SEQ ID NO: 6326
  Synthetic polynucleotide

SEQ ID NO: 6328 - DNA, 196 bp, Artificial Sequence
  Synthetic polynucleotide
atcatctcaccttgcctcctgtggcactgggttcgacacctgcaggatggaaatttccaagaatggaaatttccatcgatggaaatttccagacatggaaatttccactaatggaaatttccaactatggaaatttccatgcatggaaatttccagtaatggaaatttccaggcgcgccatgcttcatcagactct

SEQ ID NO: 6329 - DNA, 196 bp, Artificial Sequence; identical to SEQ ID NO: 6328
  Synthetic polynucleotide

SEQ ID NO: 6330 - DNA, 156 bp, Artificial Sequence
  Synthetic polynucleotide
atcatctcaccttgcctcctgaccgaagaccgtagttgcctgcaggcaggaaatagacaggaaattcgcaggaaatgaccaggaaatctacaggaaatactcaggaaattgccaggaaatgtacaggaaatggcgcgccatgcttcatcagactct

SEQ ID NO: 6331 - DNA, 156 bp, Artificial Sequence; identical to SEQ ID NO: 6330
  Synthetic polynucleotide

SEQ ID NO: 6332 - DNA, 164 bp, Artificial Sequence
  Synthetic polynucleotide
atcatctcaccttgcctcctgatcgtagcggattgaaacctgcagggggttgcccagagggttgccctcggggttgcccgacgggttgcccctagggttgcccactgggttgccctgcgggttgcccgtagggttgcccggcgcgccatgcttcatcagactct

SEQ ID NO: 6333 - DNA, 164 bp, Artificial Sequence; identical to SEQ ID NO: 6332
  Synthetic polynucleotide

SEQ ID NO: 6334 - DNA, 190 bp, Artificial Sequence
  Synthetic polynucleotide
atcatctcaccttgcctcctgtagtcgacacgatctggcctgcaggggtgactcatcctgagaggtgactcatcctgtcgggtgactcatcctggacggtgactcatcctgctaggtgactcatcctgactggtgactcatcctgtgcggtgactcatcctggtaggcgcgccatgcttcatcagactct

SEQ ID NO: 6335 - DNA, 190 bp, Artificial Sequence; identical to SEQ ID NO: 6334
  Synthetic polynucleotide

SEQ ID NO: 6336 - DNA, 197 bp, Artificial Sequence
  Synthetic polynucleotide
atcatctcaccttgcctcctgggtattcaaggctcgcgcctgcaggtcacttcctctttttagatcacttcctcttttttcgtcacttcctctttttgactcacttcctctttttctatcacttcctctttttacttcacttcctcttttttgctcacttcctctttttgtaggcgcgccatgcttcatcagactct

SEQ ID NO: 6337 - DNA, 197 bp, Artificial Sequence; identical to SEQ ID NO: 6336
  Synthetic polynucleotide

SEQ ID NO: 6338 - DNA, 197 bp, Artificial Sequence
  Synthetic polynucleotide
atcatctcaccttgcctcctgggacataaggttagggacctgcaggtggttgctctttttgagatggttgctctttttgtcgtggttgctctttttggactggttgctctttttgctatggttgctctttttgacttggttgctctttttgtgctggttgctctttttggtaggcgcgccatgcttcatcagactct

SEQ ID NO: 6339 - DNA, 197 bp, Artificial Sequence; identical to SEQ ID NO: 6338
  Synthetic polynucleotide

SEQ ID NO: 6340 - DNA, 172 bp, Artificial Sequence
  Synthetic polynucleotide
atcatctcaccttgcctcctgctaggacaaatcgatcacctgcagggccccgcccaagagccccgcccatcggccccgcccagacgccccgcccactagccccgcccaactgccccgcccatgcgccccgcccagtagccccgcccaggcgcgccatgcttcatcagactct

SEQ ID NO: 6341 - DNA, 172 bp, Artificial Sequence; identical to SEQ ID NO: 6340
  Synthetic polynucleotide

SEQ ID NO: 6342 - DNA, 185 bp, Artificial Sequence
  Synthetic polynucleotide
atcatctcaccttgcctcctgcctacattaccgctcttcctgcaggaggttaattgagtaaaagaaggttaattgagtaaatcgaggttaattgagtaaagacaggttaattgagtaaactaaggttaattgagtaaaactaggttaattgagtaaatgcggcgcgccatgcttcatcagactct

SEQ ID NO: 6343 - DNA, 185 bp, Artificial Sequence; identical to SEQ ID NO: 6342
  Synthetic polynucleotide

SEQ ID NO: 6344 - DNA, 172 bp, Artificial Sequence
  Synthetic polynucleotide
atcatctcaccttgcctcctgatcctaggcttgactggcctgcaggtttttatgggagatttttatgggtcgtttttatggggactttttatgggctatttttatgggacttttttatgggtgctttttatggggtatttttatgggggcgcgccatgcttcatcagactct

SEQ ID NO: 6345 - DNA, 172 bp, Artificial Sequence; identical to SEQ ID NO: 6344
  Synthetic polynucleotide

SEQ ID NO: 6346 - DNA, 197 bp, Artificial Sequence
  Synthetic polynucleotide
atcatctcaccttgcctcctgacgcgtggttgaacagtcctgcagggtgatttaacataatagagtgatttaacataattcggtgatttaacataatgacgtgatttaacataatctagtgatttaacataatactgtgatttaacataattgcgtgatttaacataatgtaggcgcgccatgcttcatcagactct

SEQ ID NO: 6347 - DNA, 197 bp, Artificial Sequence; identical to SEQ ID NO: 6346
  Synthetic polynucleotide

SEQ ID NO: 6348 - DNA, 188 bp, Artificial Sequence
  Synthetic polynucleotide
atcatctcaccttgcctcctgcgctcttggttggaaagcctgcaggtgtcacgtggtcagatgtcacgtggtctcgtgtcacgtggtcgactgtcacgtggtcctatgtcacgtggtcacttgtcacgtggtctgctgtcacgtggtcgtatgtcacgtggtcggcgcgccatgcttcatcagactct

SEQ ID NO: 6349 - DNA, 188 bp, Artificial Sequence; identical to SEQ ID NO: 6348
  Synthetic polynucleotide

SEQ ID NO: 6350 - DNA, 156 bp, Artificial Sequence
  Synthetic polynucleotide
atcatctcaccttgcctcctggtgttgtcgactcagcacctgcaggtctaaattagatctaaatttcgtctaaattgactctaaattctatctaaattacttctaaatttgctctaaattgtatctaaattggcgcgccatgcttcatcagactct

SEQ ID NO: 6351 - DNA, 156 bp, Artificial Sequence; identical to SEQ ID NO: 6350
  Synthetic polynucleotide

SEQ ID NO: 6352 - DNA, 188 bp, Artificial Sequence
  Synthetic polynucleotide
atcatctcaccttgcctcctgcacacagggtatccaatcctgcaggtgaccttgacctagatgaccttgaccttcgtgaccttgacctgactgaccttgacctctatgaccttgacctacttgaccttgaccttgctgaccttgacctgtatgaccttgacctggcgcgccatgcttcatcagactct

SEQ ID NO: 6353 - DNA, 188 bp, Artificial Sequence; identical to SEQ ID NO: 6352
  Synthetic polynucleotide

SEQ ID NO: 6354 - DNA, 172 bp, Artificial Sequence
  Synthetic polynucleotide
atcatctcaccttgcctcctggttagggctgataaagacctgcaggagccccccaaagaagccccccaatcgagccccccaagacagccccccaactaagccccccaaactagccccccaatgcagccccccaagtaagccccccaaggcgcgccatgcttcatcagactct

SEQ ID NO: 6355 - DNA, 172 bp, Artificial Sequence; identical to SEQ ID NO: 6354
  Synthetic polynucleotide

SEQ ID NO: 6356 - DNA, 191 bp, Artificial Sequence
  Synthetic polynucleotide
atcatctcaccttgcctcctgtagacctctcgcttgtgcctgcaggcaataccggaagtgtaaagacaataccggaagtgtaatcgcaataccggaagtgtaagaccaataccggaagtgtaactacaataccggaagtgtaaactcaataccggaagtgtaatgcggcgcgccatgcttcatcagactct

SEQ ID NO: 6357 - DNA, 191 bp, Artificial Sequence; identical to SEQ ID NO: 6356
  Synthetic polynucleotide

SEQ ID NO: 6358 - DNA, 197 bp, Artificial Sequence
  Synthetic polynucleotide
atcatctcaccttgcctcctgatgggctcaggtagctccctgcaggattccctgaggggaaagaattccctgaggggaatcgattccctgaggggaagacattccctgaggggaactaattccctgaggggaaactattccctgaggggaatgcattccctgaggggaagtaggcgcgccatgcttcatcagactct

SEQ ID NO: 6359 - DNA, 197 bp, Artificial Sequence; identical to SEQ ID NO: 6358
  Synthetic polynucleotide

SEQ ID NO: 6360 - DNA, 180 bp, Artificial Sequence
  Synthetic polynucleotide
atcatctcaccttgcctcctgtatttctggactataggcctgcagggaccatctggtagagaccatctggttcggaccatctggtgacgaccatctggtctagaccatctggtactgaccatctggttgcgaccatctggtgtagaccatctggtggcgcgccatgcttcatcagactct

SEQ ID NO: 6361 - DNA, 180 bp, Artificial Sequence; identical to SEQ ID NO: 6360
  Synthetic polynucleotide

SEQ ID NO: 6362 - DNA, 156 bp, Artificial Sequence
  Synthetic polynucleotide
atcatctcaccttgcctcctgagtacggacctctcgttcctgcaggtctagtggagatctagtggtcgtctagtgggactctagtggctatctagtggacttctagtggtgctctagtgggtatctagtggggcgcgccatgcttcatcagactct

SEQ ID NO: 6363 - DNA, 156 bp, Artificial Sequence; identical to SEQ ID NO: 6362
  Synthetic polynucleotide

SEQ ID NO: 6364 - DNA, 191 bp, Artificial Sequence
  Synthetic polynucleotide
atcatctcaccttgcctcctgtcatgacagcggagcgacctgcaggctcatgcataattaatgagactcatgcataattaatgtcgctcatgcataattaatggacctcatgcataattaatgctactcatgcataattaatgactctcatgcataattaatgtgcggcgcgccatgcttcatcagactct

SEQ ID NO: 6365 - DNA, 191 bp, Artificial Sequence; identical to SEQ ID NO: 6364
  Synthetic polynucleotide

SEQ ID NO: 6366 - DNA, 191 bp, Artificial Sequence
  Synthetic polynucleotide
atcatctcaccttgcctcctgtcgtatccgcctcaacgcctgcagggcccccacctccccgccagagcccccacctccccgcctcggcccccacctccccgccgacgcccccacctccccgccctagcccccacctccccgccactgcccccacctccccgcctgcggcgcgccatgcttcatcagactct

SEQ ID NO: 6367 - DNA, 191 bp, Artificial Sequence; identical to SEQ ID NO: 6366
  Synthetic polynucleotide

SEQ ID NO: 6368 - DNA, 197 bp, Artificial Sequence
  Synthetic polynucleotide
atcatctcaccttgcctcctgtaggtgcgtttgtaggccctgcaggaagccccccaaaaatagaaagccccccaaaaattcgaagccccccaaaaatgacaagccccccaaaaatctaaagccccccaaaaatactaagccccccaaaaattgcaagccccccaaaaatgtaggcgcgccatgcttcatcagactct

SEQ ID NO: 6369 - DNA, 197 bp, Artificial Sequence; identical to SEQ ID NO: 6368
  Synthetic polynucleotide

SEQ ID NO: 6370 - DNA, 188 bp, Artificial Sequence
  Synthetic polynucleotide
atcatctcaccttgcctcctgtatcgaggtcgcattcccctgcaggctgttgaatattagactgttgaatatttcgctgttgaatattgacctgttgaatattctactgttgaatattactctgttgaatatttgcctgttgaatattgtactgttgaatattggcgcgccatgcttcatcagactct

SEQ ID NO: 6371 - DNA, 188 bp, Artificial Sequence; identical to SEQ ID NO: 6370
  Synthetic polynucleotide

SEQ ID NO: 6372 - DNA, 188 bp, Artificial Sequence
  Synthetic polynucleotide
atcatctcaccttgcctcctgaaacagtgatatctaggcctgcagggtacaggtgaatagagtacaggtgaattcggtacaggtgaatgacgtacaggtgaatctagtacaggtgaatactgtacaggtgaattgcgtacaggtgaatgtagtacaggtgaatggcgcgccatgcttcatcagactct

SEQ ID NO: 6373 - DNA, 188 bp, Artificial Sequence; identical to SEQ ID NO: 6372
  Synthetic polynucleotide

SEQ ID NO: 6374 - DNA, 180 bp, Artificial Sequence
  Synthetic polynucleotide
atcatctcaccttgcctcctggatcttacaagttaggacctgcaggaagatggcggcagaaagatggcggctcgaagatggcggcgacaagatggcggcctaaagatggcggcactaagatggcggctgcaagatggcggcgtaaagatggcggcggcgcgccatgcttcatcagactct

SEQ ID NO: 6375 - DNA, 180 bp, Artificial Sequence; identical to SEQ ID NO: 6374
  Synthetic polynucleotide

SEQ ID NO: 6376 - DNA, 191 bp, Artificial Sequence
  Synthetic polynucleotide
atcatctcaccttgcctcctggtgtgacgattactgtacctgcaggcgaattaattaaaaaccagacgaattaattaaaaacctcgcgaattaattaaaaaccgaccgaattaattaaaaaccctacgaattaattaaaaaccactcgaattaattaaaaacctgcggcgcgccatgcttcatcagactct

SEQ ID NO: 6377 - DNA, 191 bp, Artificial Sequence; identical to SEQ ID NO: 6376
  Synthetic polynucleotide

SEQ ID NO: 6378 - DNA, 191 bp, Artificial Sequence
  Synthetic polynucleotide
atcatctcaccttgcctcctgaagcagcacgataatttcctgcaggaatcgcactgcattccgagaaatcgcactgcattccgtcgaatcgcactgcattccggacaatcgcactgcattccgctaaatcgcactgcattccgactaatcgcactgcattccgtgcggcgcgccatgcttcatcagactct

SEQ ID NO: 6379 - DNA, 191 bp, Artificial Sequence; identical to SEQ ID NO: 6378
  Synthetic polynucleotide

SEQ ID NO: 6380 - DNA, 190 bp, Artificial Sequence
  Synthetic polynucleotide
atcatctcaccttgcctcctggccaatgtttaggtaggcctgcagggaaagtgaaagtgaagagaaagtgaaagtgatcggaaagtgaaagtgagacgaaagtgaaagtgactagaaagtgaaagtgaactgaaagtgaaagtgatgcgaaagtgaaagtgagtaggcgcgccatgcttcatcagactct

SEQ ID NO: 6381 - DNA, 190 bp, Artificial Sequence; identical to SEQ ID NO: 6380
  Synthetic polynucleotide

SEQ ID NO: 6382 - DNA, 190 bp, Artificial Sequence
  Synthetic polynucleotide
atcatctcaccttgcctcctgttaccacacacttagtccctgcagggtgttgtttacaacagagtgttgtttacaactcggtgttgtttacaacgacgtgttgtttacaacctagtgttgtttacaacactgtgttgtttacaactgcgtgttgtttacaacgtaggcgcgccatgcttcatcagactct

SEQ ID NO: 6383 - DNA, 190 bp, Artificial Sequence; identical to SEQ ID NO: 6382
  Synthetic polynucleotide

SEQ ID NO: 6384 - DNA, 197 bp, Artificial Sequence
  Synthetic polynucleotide
atcatctcaccttgcctcctgtcaatgggttgtgggatcctgcagggcgcagcggggggtcagagcgcagcggggggtctcggcgcagcggggggtcgacgcgcagcggggggtcctagcgcagcggggggtcactgcgcagcggggggtctgcgcgcagcggggggtcgtaggcgcgccatgcttcatcagactct

SEQ ID NO: 6385 - DNA, 197 bp, Artificial Sequence; identical to SEQ ID NO: 6384
  Synthetic polynucleotide

SEQ ID NO: 6386 - DNA, 148 bp, Artificial Sequence
  Synthetic polynucleotide
atcatctcaccttgcctcctgaccggccaagcacttaacctgcaggtaatctgagataatctgtcgtaatctggactaatctgctataatctgacttaatctgtgctaatctggtataatctgggcgcgccatgcttcatcagactct

SEQ ID NO: 6387 - DNA, 148 bp, Artificial Sequence; identical to SEQ ID NO: 6386
  Synthetic polynucleotide

SEQ ID NO: 6388 - DNA, 200 bp, Artificial Sequence
  Synthetic polynucleotide
atcatctcaccttgcctcctgttatcaccggcccaaagcctgcaggtctgcctagcaacaggtgaagatctgcctagcaacaggtgatcgtctgcctagcaacaggtgagactctgcctagcaacaggtgactatctgcctagcaacaggtgaacttctgcctagcaacaggtgaggcgcgccatgcttcatcagactct

SEQ ID NO: 6389 - DNA, 200 bp, Artificial Sequence; identical to SEQ ID NO: 6388
  Synthetic polynucleotide

SEQ ID NO: 6390 - DNA, 172 bp, Artificial Sequence
  Synthetic polynucleotide
atcatctcaccttgcctcctggtgccgaattggtgacccctgcaggccttataaggagaccttataaggtcgccttataagggacccttataaggctaccttataaggactccttataaggtgcccttataagggtaccttataaggggcgcgccatgcttcatcagactct

SEQ ID NO: 6391 - DNA, 172 bp, Artificial Sequence; identical to SEQ ID NO: 6390
  Synthetic polynucleotide

SEQ ID NO: 6392 - DNA, 172 bp, Artificial Sequence
  Synthetic polynucleotide
atcatctcaccttgcctcctgataacatcccacgtaaacctgcagggtgacgtagcagagtgacgtagctcggtgacgtagcgacgtgacgtagcctagtgacgtagcactgtgacgtagctgcgtgacgtagcgtagtgacgtagcggcgcgccatgcttcatcagactct

SEQ ID NO: 6393 - DNA, 172 bp, Artificial Sequence; identical to SEQ ID NO: 6392
  Synthetic polynucleotide

SEQ ID NO: 6394 - DNA, 156 bp, Artificial Sequence
  Synthetic polynucleotide
atcatctcaccttgcctcctgcgaacctaacagcgcatcctgcaggcacgtgtcagacacgtgtctcgcacgtgtcgaccacgtgtcctacacgtgtcactcacgtgtctgccacgtgtcgtacacgtgtcggcgcgccatgcttcatcagactct

SEQ ID NO: 6395 - DNA, 156 bp, Artificial Sequence; identical to SEQ ID NO: 6394
  Synthetic polynucleotide

SEQ ID NO: 6396 - DNA, 185 bp, Artificial Sequence
  Synthetic polynucleotide
atcatctcaccttgcctcctgaaacgtccttacacacccctgcaggtcacaccttcacacctagatcacaccttcacaccttcgtcacaccttcacacctgactcacaccttcacacctctatcacaccttcacacctacttcacaccttcacaccttgcggcgcgccatgcttcatcagactct

SEQ ID NO: 6397 - DNA, 185 bp, Artificial Sequence; identical to SEQ ID NO: 6396
  Synthetic polynucleotide

SEQ ID NO: 6398 - DNA, 172 bp, Artificial Sequence
  Synthetic polynucleotide
atcatctcaccttgcctcctgcctctgacatccttacacctgcaggccccacccccagaccccaccccctcgccccacccccgacccccacccccctaccccacccccactccccaccccctgcccccacccccgtaccccacccccggcgcgccatgcttcatcagactct

SEQ ID NO: 6399 - DNA, 172 bp, Artificial Sequence; identical to SEQ ID NO: 6398
  Synthetic polynucleotide

SEQ ID NO: 6400 - DNA, 188 bp, Artificial Sequence
  Synthetic polynucleotide
atcatctcaccttgcctcctgcgcagttcggaaaggagcctgcaggacggacacaatgagaacggacacaatgtcgacggacacaatggacacggacacaatgctaacggacacaatgactacggacacaatgtgcacggacacaatggtaacggacacaatgggcgcgccatgcttcatcagactct

SEQ ID NO: 6401 - DNA, 188 bp, Artificial Sequence; identical to SEQ ID NO: 6400
  Synthetic polynucleotide

SEQ ID NO: 6402 - DNA, 156 bp, Artificial Sequence
  Synthetic polynucleotide
atcatctcaccttgcctcctgtgaactcttagccatgccctgcaggcgtgggcgagacgtgggcgtcgcgtgggcggaccgtgggcgctacgtgggcgactcgtgggcgtgccgtgggcggtacgtgggcgggcgcgccatgcttcatcagactct

SEQ ID NO: 6403 - DNA, 156 bp, Artificial Sequence; identical to SEQ ID NO: 6402
  Synthetic polynucleotide

SEQ ID NO: 6404 - DNA, 191 bp, Artificial Sequence
  Synthetic polynucleotide
atcatctcaccttgcctcctgccatgagtttggccggacctgcaggcgaacccggaagtgaggagacgaacccggaagtgaggtcgcgaacccggaagtgagggaccgaacccggaagtgaggctacgaacccggaagtgaggactcgaacccggaagtgaggtgcggcgcgccatgcttcatcagactct

SEQ ID NO: 6405 - DNA, 191 bp, Artificial Sequence; identical to SEQ ID NO: 6404
  Synthetic polynucleotide

SEQ ID NO: 6406 - DNA, 197 bp, Artificial Sequence
  Synthetic polynucleotide
atcatctcaccttgcctcctgtgtctaaggactgctgtcctgcaggggaaagcgaaaccaaaacagaggaaagcgaaaccaaaactcgggaaagcgaaaccaaaacgacggaaagcgaaaccaaaacctaggaaagcgaaaccaaaacactggaaagcgaaaccaaaactgcggcgcgccatgcttcatcagactct

SEQ ID NO: 6407 - DNA, 197 bp, Artificial Sequence; identical to SEQ ID NO: 6406
  Synthetic polynucleotide

SEQ ID NO: 6408 - DNA, 185 bp, Artificial Sequence
  Synthetic polynucleotide
atcatctcaccttgcctcctgtactgtaggttggacttcctgcaggaatggcgtctggcattagaaatggcgtctggcatttcgaatggcgtctggcattgacaatggcgtctggcattctaaatggcgtctggcattactaatggcgtctggcatttgcggcgcgccatgcttcatcagactct

SEQ ID NO: 6409 - DNA, 185 bp, Artificial Sequence; identical to SEQ ID NO: 6408
  Synthetic polynucleotide

SEQ ID NO: 6410 - DNA, 197 bp, Artificial Sequence
  Synthetic polynucleotide
atcatctcaccttgcctcctgccagttaaacggagatacctgcaggaagaaaagaaaaaaaagaaagaaaagaaaaaaatcgaagaaaagaaaaaaagacaagaaaagaaaaaaactaaagaaaagaaaaaaaactaagaaaagaaaaaaatgcaagaaaagaaaaaaagtaggcgcgccatgcttcatcagactct

SEQ ID NO: 6411 - DNA, 197 bp, Artificial Sequence; identical to SEQ ID NO: 6410
  Synthetic polynucleotide

SEQ ID NO: 6412 - DNA, 172 bp, Artificial Sequence
  Synthetic polynucleotide
atcatctcaccttgcctcctgacgtttgcctaatggctcctgcagggccccgccccagagccccgcccctcggccccgccccgacgccccgccccctagccccgccccactgccccgcccctgcgccccgccccgtagccccgccccggcgcgccatgcttcatcagactct

SEQ ID NO: 6413 - DNA, 172 bp, Artificial Sequence; identical to SEQ ID NO: 6412
  Synthetic polynucleotide

SEQ ID NO: 6414 - DNA, 197 bp, Artificial Sequence
  Synthetic polynucleotide
atcatctcaccttgcctcctgagccaaagagactggagcctgcaggcccggtcacgtgaccagacccggtcacgtgacctcgcccggtcacgtgaccgaccccggtcacgtgaccctacccggtcacgtgaccactcccggtcacgtgacctgccccggtcacgtgaccgtaggcgcgccatgcttcatcagactct

SEQ ID NO: 6415 - DNA, 197 bp, Artificial Sequence; identical to SEQ ID NO: 6414
  Synthetic polynucleotide

SEQ ID NO: 6416 - DNA, 191 bp, Artificial Sequence
  Synthetic polynucleotide
atcatctcaccttgcctcctggcctggttaaggaaccgcctgcaggctcgggcgccccctggtggccagactcgggcgccccctggtggcctcgctcgggcgccccctggtggccgacctcgggcgccccctggtggccctactcgggcgccccctggtggccactggcgcgccatgcttcatcagactct

SEQ ID NO: 6417 - DNA, 191 bp, Artificial Sequence; identical to SEQ ID NO: 6416
  Synthetic polynucleotide

SEQ ID NO: 6418 - DNA, 191 bp, Artificial Sequence
  Synthetic polynucleotide
atcatctcaccttgcctcctgcggtttcccagtgtgctcctgcaggacggctagttaacagctagaacggctagttaacagcttcgacggctagttaacagctgacacggctagttaacagctctaacggctagttaacagctactacggctagttaacagcttgcggcgcgccatgcttcatcagactct

SEQ ID NO: 6419 - DNA, 191 bp, Artificial Sequence; identical to SEQ ID NO: 6418
  Synthetic polynucleotide

SEQ ID NO: 6420 - DNA, 197 bp, Artificial Sequence
  Synthetic polynucleotide
atcatctcaccttgcctcctgtgtacctatgcgcccgacctgcaggttgctgactcagcaaagattgctgactcagcaatcgttgctgactcagcaagacttgctgactcagcaactattgctgactcagcaaactttgctgactcagcaatgcttgctgactcagcaagtaggcgcgccatgcttcatcagactct

SEQ ID NO: 6421 - DNA, 197 bp, Artificial Sequence; identical to SEQ ID NO: 6420
  Synthetic polynucleotide

SEQ ID NO: 6422 - DNA, 180 bp, Artificial Sequence
  Synthetic polynucleotide
atcatctcaccttgcctcctgggacccgagaattgaatcctgcaggaaaatggcggtagaaaaatggcggttcgaaaatggcggtgacaaaatggcggtctaaaaatggcggtactaaaatggcggttgcaaaatggcggtgtaaaaatggcggtggcgcgccatgcttcatcagactct

SEQ ID NO: 6423 - DNA, 180 bp, Artificial Sequence; identical to SEQ ID NO: 6422
  Synthetic polynucleotide

SEQ ID NO: 6424 - DNA, 164 bp, Artificial Sequence
  Synthetic polynucleotide
atcatctcaccttgcctcctgtatagggacaacgacggcctgcagggaacaatggagagaacaatggtcggaacaatgggacgaacaatggctagaacaatggactgaacaatggtgcgaacaatgggtagaacaatggggcgcgccatgcttcatcagactct

SEQ ID NO: 6425 - DNA, 164 bp, Artificial Sequence; identical to SEQ ID NO: 6424
  Synthetic polynucleotide

SEQ ID NO: 6426 - DNA, 180 bp, Artificial Sequence
  Synthetic polynucleotide
atcatctcaccttgcctcctggaggcaattcggctccacctgcaggtcttcacacctagatcttcacaccttcgtcttcacacctgactcttcacacctctatcttcacacctacttcttcacaccttgctcttcacacctgtatcttcacacctggcgcgccatgcttcatcagactct

SEQ ID NO: 6427 - DNA, 180 bp, Artificial Sequence; identical to SEQ ID NO: 6426
  Synthetic polynucleotide

SEQ ID NO: 6428 - DNA, 156 bp, Artificial Sequence
  Synthetic polynucleotide
atcatctcaccttgcctcctgtttacggttgcaaacgccctgcaggcacgtgttagacacgtgtttcgcacgtgttgaccacgtgttctacacgtgttactcacgtgtttgccacgtgttgtacacgtgttggcgcgccatgcttcatcagactct

SEQ ID NO: 6429 - DNA, 156 bp, Artificial Sequence; identical to SEQ ID NO: 6428
  Synthetic polynucleotide

SEQ ID NO: 6430 - DNA, 190 bp, Artificial Sequence
  Synthetic polynucleotide
atcatctcaccttgcctcctgacagcagattgactccccctgcaggatgatcgaatcaaaagaatgatcgaatcaaatcgatgatcgaatcaaagacatgatcgaatcaaactaatgatcgaatcaaaactatgatcgaatcaaatgcatgatcgaatcaaagtaggcgcgccatgcttcatcagactct

SEQ ID NO: 6431 - DNA, 190 bp, Artificial Sequence; identical to SEQ ID NO: 6430
  Synthetic polynucleotide

SEQ ID NO: 6432 - DNA, 200 bp, Artificial Sequence
  Synthetic polynucleotide
atcatctcaccttgcctcctgtgcccactttgttctcccctgcaggaaagaggaagtgaaactagagaaaagaggaagtgaaactagtcgaaagaggaagtgaaactaggacaaagaggaagtgaaactagctaaaagaggaagtgaaactagactaaagaggaagtgaaactagggcgcgccatgcttcatcagactct

SEQ ID NO: 6433 - DNA, 200 bp, Artificial Sequence; identical to SEQ ID NO: 6432
  Synthetic polynucleotide

SEQ ID NO: 6434 - DNA, 172 bp, Artificial Sequence
  Synthetic polynucleotide
atcatctcaccttgcctcctggagttgccttaagtttccctgcaggaaagataagcagaaaagataagctcgaaagataagcgacaaagataagcctaaaagataagcactaaagataagctgcaaagataagcgtaaaagataagcggcgcgccatgcttcatcagactct

SEQ ID NO: 6435 - DNA, 172 bp, Artificial Sequence; identical to SEQ ID NO: 6434
  Synthetic polynucleotide

SEQ ID NO: 6436 - DNA, 148 bp, Artificial Sequence
  Synthetic polynucleotide
atcatctcaccttgcctcctgatttagggctacattgacctgcaggcacttaaagacacttaatcgcacttaagaccacttaactacacttaaactcacttaatgccacttaagtacacttaaggcgcgccatgcttcatcagactct

SEQ ID NO: 6437 - DNA, 148 bp, Artificial Sequence; identical to SEQ ID NO: 6436
  Synthetic polynucleotide

SEQ ID NO: 6438 - DNA, 197 bp, Artificial Sequence
  Synthetic polynucleotide
atcatctcaccttgcctcctggtaggttctccagctttcctgcaggctgatttgcatattcagactgatttgcatattctcgctgatttgcatattcgacctgatttgcatattcctactgatttgcatattcactctgatttgcatattctgcctgatttgcatattcgtaggcgcgccatgcttcatcagactct

SEQ ID NO: 6439 - DNA, 197 bp, Artificial Sequence; identical to SEQ ID NO: 6438
  Synthetic polynucleotide

SEQ ID NO: 6440 - DNA, 190 bp, Artificial Sequence
  Synthetic polynucleotide
atcatctcaccttgcctcctggcttgacgaagtgccaccctgcagggctgtccctggtgcagagctgtccctggtgctcggctgtccctggtgcgacgctgtccctggtgcctagctgtccctggtgcactgctgtccctggtgctgcgctgtccctggtgcgtaggcgcgccatgcttcatcagactct

SEQ ID NO: 6441 - DNA, 190 bp, Artificial Sequence; identical to SEQ ID NO: 6440
  Synthetic polynucleotide

SEQ ID NO: 6442 - DNA, 180 bp, Artificial Sequence
  Synthetic polynucleotide
atcatctcaccttgcctcctggtacctcctgagagtcacctgcaggtattgcacaatagatattgcacaattcgtattgcacaatgactattgcacaatctatattgcacaatacttattgcacaattgctattgcacaatgtatattgcacaatggcgcgccatgcttcatcagactct

SEQ ID NO: 6443 - DNA, 180 bp, Artificial Sequence; identical to SEQ ID NO: 6442
  Synthetic polynucleotide

SEQ ID NO: 6444 - DNA, 172 bp, Artificial Sequence
  Synthetic polynucleotide
atcatctcaccttgcctcctgttaatgcctctaatgaccctgcaggtttcacttccagatttcacttcctcgtttcacttccgactttcacttccctatttcacttccacttttcacttcctgctttcacttccgtatttcacttccggcgcgccatgcttcatcagactct

SEQ ID NO: 6445 - DNA, 172 bp, Artificial Sequence; identical to SEQ ID NO: 6444
  Synthetic polynucleotide

SEQ ID NO: 6446 - DNA, 191 bp, Artificial Sequence
  Synthetic polynucleotide
atcatctcaccttgcctcctgcggaatggtgtggctcacctgcaggttaggtcgtaaaatttcagattaggtcgtaaaatttctcgttaggtcgtaaaatttcgacttaggtcgtaaaatttcctattaggtcgtaaaatttcactttaggtcgtaaaatttctgcggcgcgccatgcttcatcagactct

SEQ ID NO: 6447 - DNA, 191 bp, Artificial Sequence; identical to SEQ ID NO: 6446
  Synthetic polynucleotide

SEQ ID NO: 6448 - DNA, 180 bp, Artificial Sequence
  Synthetic polynucleotide
atcatctcaccttgcctcctggcgtttggctatcctcacctgcaggttccattgtttagattccattgttttcgttccattgtttgacttccattgtttctattccattgtttactttccattgttttgcttccattgtttgtattccattgtttggcgcgccatgcttcatcagactct

SEQ ID NO: 6449 - DNA, 180 bp, Artificial Sequence; identical to SEQ ID NO: 6448
  Synthetic polynucleotide

SEQ ID NO: 6450 - DNA, 191 bp, Artificial Sequence
  Synthetic polynucleotide
atcatctcaccttgcctcctgacctcacgatggtctagcctgcaggcgaattaattaataatgagacgaattaattaataatgtcgcgaattaattaataatggaccgaattaattaataatgctacgaattaattaataatgactcgaattaattaataatgtgcggcgcgccatgcttcatcagactct

SEQ ID NO: 6451 - DNA, 191 bp, Artificial Sequence; identical to SEQ ID NO: 6450
  Synthetic polynucleotide

SEQ ID NO: 6452 - DNA, 188 bp, Artificial Sequence
  Synthetic polynucleotide
atcatctcaccttgcctcctgggctattagcctccttacctgcagggcctcccacgccagagcctcccacgcctcggcctcccacgccgacgcctcccacgccctagcctcccacgccactgcctcccacgcctgcgcctcccacgccgtagcctcccacgccggcgcgccatgcttcatcagactct

SEQ ID NO: 6453 - DNA, 188 bp, Artificial Sequence; identical to SEQ ID NO: 6452
  Synthetic polynucleotide

SEQ ID NO: 6454 - DNA, 188 bp, Artificial Sequence
  Synthetic polynucleotide
atcatctcaccttgcctcctgctcacggatacaacggccctgcaggcagcacctggcgagacagcacctggcgtcgcagcacctggcggaccagcacctggcgctacagcacctggcgactcagcacctggcgtgccagcacctggcggtacagcacctggcgggcgcgccatgcttcatcagactct

SEQ ID NO: 6455 - DNA, 188 bp, Artificial Sequence; identical to SEQ ID NO: 6454
  Synthetic polynucleotide

SEQ ID NO: 6456 - DNA, 180 bp, Artificial Sequence
  Synthetic polynucleotide
atcatctcaccttgcctcctggtcgtgggtaaccgtgacctgcaggaaaatggcggcagaaaaatggcggctcgaaaatggcggcgacaaaatggcggcctaaaaatggcggcactaaaatggcggctgcaaaatggcggcgtaaaaatggcggcggcgcgccatgcttcatcagactct

SEQ ID NO: 6457 - DNA, 180 bp, Artificial Sequence; identical to SEQ ID NO: 6456
  Synthetic polynucleotide

SEQ ID NO: 6458 - DNA, 185 bp, Artificial Sequence
  Synthetic polynucleotide
atcatctcaccttgcctcctggaattgggtcttcatctcctgcaggatgcataattaatgagagaatgcataattaatgagtcgatgcataattaatgaggacatgcataattaatgagctaatgcataattaatgagactatgcataattaatgagtgcggcgcgccatgcttcatcagactct

SEQ ID NO: 6459 - DNA, 185 bp, Artificial Sequence; identical to SEQ ID NO: 6458
  Synthetic polynucleotide

SEQ ID NO: 6460 - DNA, 148 bp, Artificial Sequence
  Synthetic polynucleotide
atcatctcaccttgcctcctgacttacgtgtaaccttgcctgcaggttaagtgagattaagtgtcgttaagtggacttaagtgctattaagtgactttaagtgtgcttaagtggtattaagtgggcgcgccatgcttcatcagactct

SEQ ID NO: 6461 - DNA, 148 bp, Artificial Sequence; identical to SEQ ID NO: 6460
  Synthetic polynucleotide

SEQ ID NO: 6462 - DNA, 190 bp, Artificial Sequence
  Synthetic polynucleotide
atcatctcaccttgcctcctgacctgtattgtggtagccctgcaggccatcgatccccctagaccatcgatcccccttcgccatcgatccccctgacccatcgatccccctctaccatcgatccccctactccatcgatcccccttgcccatcgatccccctgtaggcgcgccatgcttcatcagactct

SEQ ID NO: 6463 - DNA, 190 bp, Artificial Sequence; identical to SEQ ID NO: 6462
  Synthetic polynucleotide

SEQ ID NO: 6464 - DNA, 197 bp, Artificial Sequence
  Synthetic polynucleotide
atcatctcaccttgcctcctgtagatgcaagtaatgcacctgcagggcacccctgggtgccagagcacccctgggtgcctcggcacccctgggtgccgacgcacccctgggtgccctagcacccctgggtgccactgcacccctgggtgcctgcgcacccctgggtgccgtaggcgcgccatgcttcatcagactct

SEQ ID NO: 6465 - DNA, 197 bp, Artificial Sequence; identical to SEQ ID NO: 6464
  Synthetic polynucleotide

SEQ ID NO: 6466 - DNA, 180 bp, Artificial Sequence
  Synthetic polynucleotide
atcatctcaccttgcctcctggcagggtcccaaacgaacctgcaggttaagcaaacaagattaagcaaacatcgttaagcaaacagacttaagcaaacactattaagcaaacaactttaagcaaacatgcttaagcaaacagtattaagcaaacaggcgcgccatgcttcatcagactct

SEQ ID NO: 6467 - DNA, 180 bp, Artificial Sequence; identical to SEQ ID NO: 6466
  Synthetic polynucleotide

SEQ ID NO: 6468 - DNA, 172 bp, Artificial Sequence
  Synthetic polynucleotide
atcatctcaccttgcctcctgttattcggtccggaaatcctgcagggggccccccgagagggccccccgtcggggccccccggacgggccccccgctagggccccccgactgggccccccgtgcgggccccccggtagggccccccgggcgcgccatgcttcatcagactct

SEQ ID NO: 6469 - DNA, 172 bp, Artificial Sequence; identical to SEQ ID NO: 6468
  Synthetic polynucleotide

SEQ ID NO: 6470 - DNA, 197 bp, Artificial Sequence
  Synthetic polynucleotide
atcatctcaccttgcctcctgcatagtgcaacatggtccctgcaggaaatatgcaaatcacagaaaatatgcaaatcactcgaaatatgcaaatcacgacaaatatgcaaatcacctaaaatatgcaaatcacactaaatatgcaaatcactgcaaatatgcaaatcacgtaggcgcgccatgcttcatcagactct

SEQ ID NO: 6471 - DNA, 197 bp, Artificial Sequence; identical to SEQ ID NO: 6470
  Synthetic polynucleotide

SEQ ID NO: 6472 - DNA, 148 bp, Artificial Sequence
  Synthetic polynucleotide
atcatctcaccttgcctcctgggtcacaagagctaagccctgcaggttcacttagattcactttcgttcacttgacttcacttctattcacttactttcactttgcttcacttgtattcacttggcgcgccatgcttcatcagactct

SEQ ID NO: 6473 - DNA, 148 bp, Artificial Sequence; identical to SEQ ID NO: 6472
  Synthetic polynucleotide

SEQ ID NO: 6474 - DNA, 148 bp, Artificial Sequence
  Synthetic polynucleotide
atcatctcaccttgcctcctgggcccgtgagcttattacctgcaggtgataccagatgatacctcgtgataccgactgataccctatgataccacttgatacctgctgataccgtatgataccggcgcgccatgcttcatcagactct

SEQ ID NO: 6475 - DNA, 148 bp, Artificial Sequence; identical to SEQ ID NO: 6474
  Synthetic polynucleotide

SEQ ID NO: 6476 - DNA, 191 bp, Artificial Sequence
  Synthetic polynucleotide
atcatctcaccttgcctcctgttgctcgaaagtagcttcctgcaggaaatctattgttcactaagaaaatctattgttcactatcgaaatctattgttcactagacaaatctattgttcactactaaaatctattgttcactaactaaatctattgttcactatgcggcgcgccatgcttcatcagactct

SEQ ID NO: 6477 - DNA, 191 bp, Artificial Sequence; identical to SEQ ID NO: 6476
  Synthetic polynucleotide

SEQ ID NO: 6478 - DNA, 196 bp, Artificial Sequence
  Synthetic polynucleotide
atcatctcaccttgcctcctgagtcggatctatacaggcctgcaggtcccagaaaagtcagatcccagaaaagtctcgtcccagaaaagtcgactcccagaaaagtcctatcccagaaaagtcacttcccagaaaagtctgctcccagaaaagtcgtatcccagaaaagtcggcgcgccatgcttcatcagactct

SEQ ID NO: 6479 - DNA, 196 bp, Artificial Sequence; identical to SEQ ID NO: 6478
  Synthetic polynucleotide

SEQ ID NO: 6480 - DNA, 190 bp, Artificial Sequence
  Synthetic polynucleotide
atcatctcaccttgcctcctggacactagcacgggctacctgcaggacgaaagcgaaagtagaacgaaagcgaaagttcgacgaaagcgaaagtgacacgaaagcgaaagtctaacgaaagcgaaagtactacgaaagcgaaagttgcacgaaagcgaaagtgtaggcgcgccatgcttcatcagactct

SEQ ID NO: 6481 - DNA, 190 bp, Artificial Sequence; identical to SEQ ID NO: 6480
  Synthetic polynucleotide

SEQ ID NO: 6482 - DNA, 156 bp, Artificial Sequence
  Synthetic polynucleotide
atcatctcaccttgcctcctgtgagttcatgctaccgacctgcaggttgtaattagattgtaatttcgttgtaattgacttgtaattctattgtaattactttgtaatttgcttgtaattgtattgtaattggcgcgccatgcttcatcagactct

SEQ ID NO: 6483 - DNA, 156 bp, Artificial Sequence; identical to SEQ ID NO: 6482
  Synthetic polynucleotide

SEQ ID NO: 6484 - DNA, 185 bp, Artificial Sequence
  Synthetic polynucleotide
atcatctcaccttgcctcctgctttaccatgtctacggcctgcaggtaattggtgttaaatgagataattggtgttaaatgtcgtaattggtgttaaatggactaattggtgttaaatgctataattggtgttaaatgacttaattggtgttaaatgtgcggcgcgccatgcttcatcagactct

SEQ ID NO: 6485 - DNA, 185 bp, Artificial Sequence; identical to SEQ ID NO: 6484
  Synthetic polynucleotide

SEQ ID NO: 6486 - DNA, 191 bp, Artificial Sequence
  Synthetic polynucleotide
atcatctcaccttgcctcctgctcaagctagtctactgcctgcaggtttctctccagtatgaaagatttctctccagtatgaatcgtttctctccagtatgaagactttctctccagtatgaactatttctctccagtatgaaacttttctctccagtatgaatgcggcgcgccatgcttcatcagactct

SEQ ID NO: 6487 - DNA, 191 bp, Artificial Sequence; identical to SEQ ID NO: 6486
  Synthetic polynucleotide

SEQ ID NO: 6488 - DNA, 191 bp, Artificial Sequence
  Synthetic polynucleotide
atcatctcaccttgcctcctgctctcggtattacaatgcctgcaggggtttttaattaattcgagaggtttttaattaattcgtcgggtttttaattaattcggacggtttttaattaattcgctaggtttttaattaattcgactggtttttaattaattcgtgcggcgcgccatgcttcatcagactct

SEQ ID NO: 6489 - DNA, 191 bp, Artificial Sequence; identical to SEQ ID NO: 6488
  Synthetic polynucleotide

SEQ ID NO: 6490 - DNA, 197 bp, Artificial Sequence
  Synthetic polynucleotide
atcatctcaccttgcctcctgtatgtcgccagacatgtcctgcaggttggccccgcccactagattggccccgcccacttcgttggccccgcccactgacttggccccgcccactctattggccccgcccactactttggccccgcccacttgcttggccccgcccactgtaggcgcgccatgcttcatcagactct

SEQ ID NO: 6491 - DNA, 197 bp, Artificial Sequence; identical to SEQ ID NO: 6490
  Synthetic polynucleotide

SEQ ID NO: 6492 - DNA, 156 bp, Artificial Sequence
  Synthetic polynucleotide
atcatctcaccttgcctcctgcattgctgtcttaatgtcctgcaggcacctgccagacacctgcctcgcacctgccgaccacctgccctacacctgccactcacctgcctgccacctgccgtacacctgccggcgcgccatgcttcatcagactct

SEQ ID NO: 6493 - DNA, 156 bp, Artificial Sequence; identical to SEQ ID NO: 6492
  Synthetic polynucleotide

SEQ ID NO: 6494 - DNA, 180 bp, Artificial Sequence
  Synthetic polynucleotide
atcatctcaccttgcctcctgtgttattgtcaacgggtcctgcaggtgttacataacagatgttacataactcgtgttacataacgactgttacataacctatgttacataacacttgttacataactgctgttacataacgtatgttacataacggcgcgccatgcttcatcagactct

SEQ ID NO: 6495 - DNA, 180 bp, Artificial Sequence; identical to SEQ ID NO: 6494
  Synthetic polynucleotide

SEQ ID NO: 6496 - DNA, 191 bp, Artificial Sequence
  Synthetic polynucleotide
atcatctcaccttgcctcctgccagagtcaccgactaacctgcaggtccctttacagcgtcctagatccctttacagcgtccttcgtccctttacagcgtcctgactccctttacagcgtcctctatccctttacagcgtcctacttccctttacagcgtccttgcggcgcgccatgcttcatcagactct

SEQ ID NO: 6497 - DNA, 191 bp, Artificial Sequence; identical to SEQ ID NO: 6496
  Synthetic polynucleotide

SEQ ID NO: 6498 - DNA, 190 bp, Artificial Sequence
  Synthetic polynucleotide
atcatctcaccttgcctcctgtatatcaggctgaccttcctgcagggagttgtgcaatatagagagttgtgcaatattcggagttgtgcaatatgacgagttgtgcaatatctagagttgtgcaatatactgagttgtgcaatattgcgagttgtgcaatatgtaggcgcgccatgcttcatcagactct

SEQ ID NO: 6499 - DNA, 190 bp, Artificial Sequence; identical to SEQ ID NO: 6498
  Synthetic polynucleotide

SEQ ID NO: 6500 - DNA, 191 bp, Artificial Sequence
  Synthetic polynucleotide
atcatctcaccttgcctcctgaatagcagctagagaaccctgcaggtcaattaattaatggatagatcaattaattaatggattcgtcaattaattaatggatgactcaattaattaatggatctatcaattaattaatggatacttcaattaattaatggattgcggcgcgccatgcttcatcagactct

SEQ ID NO: 6501 - DNA, 191 bp, Artificial Sequence; identical to SEQ ID NO: 6500
  Synthetic polynucleotide

SEQ ID NO: 6502 - DNA, 190 bp, Artificial Sequence
  Synthetic polynucleotide
atcatctcaccttgcctcctgagctgcgtacaaacagtcctgcaggggttgccatggtaaagaggttgccatggtaatcgggttgccatggtaagacggttgccatggtaactaggttgccatggtaaactggttgccatggtaatgcggttgccatggtaagtaggcgcgccatgcttcatcagactct

SEQ ID NO: 6503 - DNA, 190 bp, Artificial Sequence; identical to SEQ ID NO: 6502
  Synthetic polynucleotide

SEQ ID NO: 6504 - DNA, 190 bp, Artificial Sequence
  Synthetic polynucleotide
atcatctcaccttgcctcctgcaagtactcctgtatcgcctgcagggcggtaatcttcctagagcggtaatcttccttcggcggtaatcttcctgacgcggtaatcttcctctagcggtaatcttcctactgcggtaatcttccttgcgcggtaatcttcctgtaggcgcgccatgcttcatcagactct

SEQ ID NO: 6505 - DNA, 190 bp, Artificial Sequence; identical to SEQ ID NO: 6504
  Synthetic polynucleotide

SEQ ID NO: 6506 - DNA, 190 bp, Artificial Sequence
  Synthetic polynucleotide
atcatctcaccttgcctcctgaacgtattaccgtagtccctgcagggtgccacgtcatcaagagtgccacgtcatcatcggtgccacgtcatcagacgtgccacgtcatcactagtgccacgtcatcaactgtgccacgtcatcatgcgtgccacgtcatcagtaggcgcgccatgcttcatcagactct

SEQ ID NO: 6507 - DNA, 190 bp, Artificial Sequence; identical to SEQ ID NO: 6506
  Synthetic polynucleotide

SEQ ID NO: 6508 - DNA, 200 bp, Artificial Sequence
  Synthetic polynucleotide
atcatctcaccttgcctcctgctctttaagctgcatctcctgcaggtgccaacttccccattagtggtcgcctccaagatgccaacttccccattagtggtcgcctccatcgtgccaacttccccattagtggtcgcctccagactgccaacttccccattagtggtcgcctccaggcgcgccatgcttcatcagactct

SEQ ID NO: 6509 - DNA, 200 bp, Artificial Sequence; identical to SEQ ID NO: 6508
  Synthetic polynucleotide

SEQ ID NO: 6510 - DNA, 180 bp, Artificial Sequence
  Synthetic polynucleotide
atcatctcaccttgcctcctgatcctgtgcaactcattcctgcaggcgccaaggagcagacgccaaggagctcgcgccaaggagcgaccgccaaggagcctacgccaaggagcactcgccaaggagctgccgccaaggagcgtacgccaaggagcggcgcgccatgcttcatcagactct

SEQ ID NO: 6511 - DNA, 180 bp, Artificial Sequence; identical to SEQ ID NO: 6510
  Synthetic polynucleotide

SEQ ID NO: 6512 - DNA, 197 bp, Artificial Sequence
  Synthetic polynucleotide
atcatctcaccttgcctcctgaaggaactgaagcgccgcctgcaggcgtcgccatggcaacagacgtcgccatggcaactcgcgtcgccatggcaacgaccgtcgccatggcaacctacgtcgccatggcaacactcgtcgccatggcaactgccgtcgccatggcaacgtaggcgcgccatgcttcatcagactct

SEQ ID NO: 6513 - DNA, 197 bp, Artificial Sequence; identical to SEQ ID NO: 6512
  Synthetic polynucleotide

SEQ ID NO: 6514 - DNA, 185 bp, Artificial Sequence
  Synthetic polynucleotide
atcatctcaccttgcctcctgatttgtcagtcgttactcctgcaggtaattgctgctaaatgagataattgctgctaaatgtcgtaattgctgctaaatggactaattgctgctaaatgctataattgctgctaaatgacttaattgctgctaaatgtgcggcgcgccatgcttcatcagactct

SEQ ID NO: 6515 - DNA, 185 bp, Artificial Sequence; identical to SEQ ID NO: 6514
  Synthetic polynucleotide

SEQ ID NO: 6516 - DNA, 164 bp, Artificial Sequence
  Synthetic polynucleotide
atcatctcaccttgcctcctgcacctggccacagaaatcctgcaggcaaggtcatagacaaggtcattcgcaaggtcatgaccaaggtcatctacaaggtcatactcaaggtcattgccaaggtcatgtacaaggtcatggcgcgccatgcttcatcagactct

SEQ ID NO: 6517 - DNA, 164 bp, Artificial Sequence; identical to SEQ ID NO: 6516
  Synthetic polynucleotide

SEQ ID NO: 6518 - DNA, 197 bp, Artificial Sequence
  Synthetic polynucleotide
atcatctcaccttgcctcctgttagttcatgttggatgcctgcaggccccgccttttatacagaccccgccttttatactcgccccgccttttatacgacccccgccttttatacctaccccgccttttatacactccccgccttttatactgcccccgccttttatacgtaggcgcgccatgcttcatcagactct

SEQ ID NO: 6519 - DNA, 197 bp, Artificial Sequence; identical to SEQ ID NO: 6518
  Synthetic polynucleotide

SEQ ID NO: 6520 - DNA, 200 bp, Artificial Sequence
  Synthetic polynucleotide
atcatctcaccttgcctcctgtcaccagtgggataacccctgcaggtcttgacctttgaccctgtagatcttgacctttgaccctgttcgtcttgacctttgaccctgtgactcttgacctttgaccctgtctatcttgacctttgaccctgtacttcttgacctttgaccctgtggcgcgccatgcttcatcagactct

SEQ ID NO: 6521 - DNA, 200 bp, Artificial Sequence; identical to SEQ ID NO: 6520
  Synthetic polynucleotide

SEQ ID NO: 6522 - DNA, 164 bp, Artificial Sequence
  Synthetic polynucleotide
atcatctcaccttgcctcctgtgggcagtgaaccctctcctgcaggttgtttatcagattgtttatctcgttgtttatcgacttgtttatcctattgtttatcactttgtttatctgcttgtttatcgtattgtttatcggcgcgccatgcttcatcagactct

SEQ ID NO: 6523 - DNA, 164 bp, Artificial Sequence; identical to SEQ ID NO: 6522
  Synthetic polynucleotide

SEQ ID NO: 6524 - DNA, 191 bp, Artificial Sequence
  Synthetic polynucleotide
atcatctcaccttgcctcctggtactgcttccggtcttcctgcagggatcactgcaattgatgagagatcactgcaattgatgtcggatcactgcaattgatggacgatcactgcaattgatgctagatcactgcaattgatgactgatcactgcaattgatgtgcggcgcgccatgcttcatcagactct

SEQ ID NO: 6525 - DNA, 191 bp, Artificial Sequence; identical to SEQ ID NO: 6524
  Synthetic polynucleotide

SEQ ID NO: 6526 - DNA, 164 bp, Artificial Sequence
  Synthetic polynucleotide
atcatctcaccttgcctcctggacttagagcaaccggtcctgcaggacagataacagaacagataactcgacagataacgacacagataacctaacagataacactacagataactgcacagataacgtaacagataacggcgcgccatgcttcatcagactct

SEQ ID NO: 6527 - DNA, 164 bp, Artificial Sequence; identical to SEQ ID NO: 6526
  Synthetic polynucleotide

SEQ ID NO: 6528 - DNA, 148 bp, Artificial Sequence
  Synthetic polynucleotide
atcatctcaccttgcctcctgaaggatttctaagcagccctgcaggtgataagagatgataagtcgtgataaggactgataagctatgataagacttgataagtgctgataaggtatgataagggcgcgccatgcttcatcagactct

SEQ ID NO: 6529 - DNA, 148 bp, Artificial Sequence; identical to SEQ ID NO: 6528
  Synthetic polynucleotide

SEQ ID NO: 6530 - DNA, 186 bp, Artificial Sequence
  Synthetic polynucleotide
atcatctcaccttgcctcctgcagaccttattagactgcctgcaggggcccaggtcaccctgacctagaggcccaggtcaccctgaccttcgggcccaggtcaccctgacctgacggcccaggtcaccctgacctctaggcccaggtcaccctgacctactggcgcgccatgcttcatcagactct

SEQ ID NO: 6531 - DNA, 186 bp, Artificial Sequence; identical to SEQ ID NO: 6530
  Synthetic polynucleotide

SEQ ID NO: 6532 - DNA, 188 bp, Artificial Sequence
  Synthetic polynucleotide
atcatctcaccttgcctcctgtcggtcccgcaatactgcctgcaggtgcacttccggtagatgcacttccggttcgtgcacttccggtgactgcacttccggtctatgcacttccggtacttgcacttccggttgctgcacttccggtgtatgcacttccggtggcgcgccatgcttcatcagactct

SEQ ID NO: 6533 - DNA, 188 bp, Artificial Sequence; identical to SEQ ID NO: 6532
  Synthetic polynucleotide

SEQ ID NO: 6534 - DNA, 191 bp, Artificial Sequence
  Synthetic polynucleotide
atcatctcaccttgcctcctggtgcggtctatgtaccccctgcaggccctgccccccccttccagaccctgccccccccttcctcgccctgccccccccttccgacccctgccccccccttccctaccctgccccccccttccactccctgccccccccttcctgcggcgcgccatgcttcatcagactct

SEQ ID NO: 6535 - DNA, 191 bp, Artificial Sequence; identical to SEQ ID NO: 6534
  Synthetic polynucleotide

SEQ ID NO: 6536 - DNA, 172 bp, Artificial Sequence
  Synthetic polynucleotide
atcatctcaccttgcctcctgcatcgagacgtcaatagcctgcaggaggaagtgaaagaaggaagtgaatcgaggaagtgaagacaggaagtgaactaaggaagtgaaactaggaagtgaatgcaggaagtgaagtaaggaagtgaaggcgcgccatgcttcatcagactct

SEQ ID NO: 6537 - DNA, 172 bp, Artificial Sequence; identical to SEQ ID NO: 6536
  Synthetic polynucleotide

SEQ ID NO: 6538 - DNA, 180 bp, Artificial Sequence
  Synthetic polynucleotide
atcatctcaccttgcctcctgaaggtgcagaccagtaccctgcagggaggggccggcagagaggggccggctcggaggggccggcgacgaggggccggcctagaggggccggcactgaggggccggctgcgaggggccggcgtagaggggccggcggcgcgccatgcttcatcagactct

SEQ ID NO: 6539 - DNA, 180 bp, Artificial Sequence; identical to SEQ ID NO: 6538
  Synthetic polynucleotide

SEQ ID NO: 6540 - DNA, 164 bp, Artificial Sequence
  Synthetic polynucleotide
atcatctcaccttgcctcctgtgaacctgatctcgatccctgcaggttgtttattagattgtttatttcgttgtttattgacttgtttattctattgtttattactttgtttatttgcttgtttattgtattgtttattggcgcgccatgcttcatcagactct

SEQ ID NO: 6541 - DNA, 164 bp, Artificial Sequence; identical to SEQ ID NO: 6540
  Synthetic polynucleotide

SEQ ID NO: 6542 - DNA, 156 bp, Artificial Sequence
  Synthetic polynucleotide
atcatctcaccttgcctcctgttctgagaataccggcacctgcaggcctttgaaagacctttgaatcgcctttgaagaccctttgaactacctttgaaactcctttgaatgccctttgaagtacctttgaaggcgcgccatgcttcatcagactct

SEQ ID NO: 6543 - DNA, 156 bp, Artificial Sequence; identical to SEQ ID NO: 6542
  Synthetic polynucleotide

SEQ ID NO: 6544 - DNA, 180 bp, Artificial Sequence
  Synthetic polynucleotide
atcatctcaccttgcctcctggtgtgcctgagatgcaacctgcagggtgggcgtggcagagtgggcgtggctcggtgggcgtggcgacgtgggcgtggcctagtgggcgtggcactgtgggcgtggctgcgtgggcgtggcgtagtgggcgtggcggcgcgccatgcttcatcagactct

SEQ ID NO: 6545 - DNA, 180 bp, Artificial Sequence; identical to SEQ ID NO: 6544
  Synthetic polynucleotide

SEQ ID NO: 6546 - DNA, 156 bp, Artificial Sequence
  Synthetic polynucleotide
atcatctcaccttgcctcctggcattgttgcatagagtcctgcaggcttatcagagacttatcagtcgcttatcaggaccttatcagctacttatcagactcttatcagtgccttatcaggtacttatcagggcgcgccatgcttcatcagactct

SEQ ID NO: 6547 - DNA, 156 bp, Artificial Sequence; identical to SEQ ID NO: 6546
  Synthetic polynucleotide

SEQ ID NO: 6548 - DNA, 172 bp, Artificial Sequence
  Synthetic polynucleotide
atcatctcaccttgcctcctggcaatgactatgaggagcctgcaggcgcatgcgcaagacgcatgcgcatcgcgcatgcgcagaccgcatgcgcactacgcatgcgcaactcgcatgcgcatgccgcatgcgcagtacgcatgcgcaggcgcgccatgcttcatcagactct

SEQ ID NO: 6549 - DNA, 172 bp, Artificial Sequence; identical to SEQ ID NO: 6548
  Synthetic polynucleotide

SEQ ID NO: 6550 - DNA, 190 bp, Artificial Sequence
  Synthetic polynucleotide
atcatctcaccttgcctcctgacgatacggtgctgcaccctgcaggtctgattggttagtagatctgattggttagttcgtctgattggttagtgactctgattggttagtctatctgattggttagtacttctgattggttagttgctctgattggttagtgtaggcgcgccatgcttcatcagactct

SEQ ID NO: 6551 - DNA, 190 bp, Artificial Sequence; identical to SEQ ID NO: 6550
  Synthetic polynucleotide

SEQ ID NO: 6552 - DNA, 180 bp, Artificial Sequence
  Synthetic polynucleotide
atcatctcaccttgcctcctgaaaggtcgcaacgtgtccctgcaggttaattaatatagattaattaatattcgttaattaatatgacttaattaatatctattaattaatatactttaattaatattgcttaattaatatgtattaattaatatggcgcgccatgcttcatcagactct

SEQ ID NO: 6553 - DNA, 180 bp, Artificial Sequence; identical to SEQ ID NO: 6552
  Synthetic polynucleotide

SEQ ID NO: 6554 - DNA, 197 bp, Artificial Sequence
  Synthetic polynucleotide
atcatctcaccttgcctcctgtcccttcggtattgcatcctgcaggaacatgcccgggcatgtcagaaacatgcccgggcatgtctcgaacatgcccgggcatgtcgacaacatgcccgggcatgtcctaaacatgcccgggcatgtcactaacatgcccgggcatgtctgcggcgcgccatgcttcatcagactct

SEQ ID NO: 6555 - DNA, 197 bp, Artificial Sequence; identical to SEQ ID NO: 6554
  Synthetic polynucleotide

SEQ ID NO: 6556 - DNA, 179 bp, Artificial Sequence
  Synthetic polynucleotide
atcatctcaccttgcctcctgagcgttactgcaggagtcctgcaggaatttcacacctaggtgtgactagagaaatttcacacctaggtgtgactagtcgaatttcacacctaggtgtgactaggacaatttcacacctaggtgtgactagctaggcgcgccatgcttcatcagactct

SEQ ID NO: 6557 - DNA, 179 bp, Artificial Sequence; identical to SEQ ID NO: 6556
  Synthetic polynucleotide

SEQ ID NO: 6558 - DNA, 191 bp, Artificial Sequence
  Synthetic polynucleotide
atcatctcaccttgcctcctggtgcttaagcatactgacctgcaggtgacctctcggtgacctagatgacctctcggtgaccttcgtgacctctcggtgacctgactgacctctcggtgacctctatgacctctcggtgacctacttgacctctcggtgaccttgcggcgcgccatgcttcatcagactct

SEQ ID NO: 6559 - DNA, 191 bp, Artificial Sequence; identical to SEQ ID NO: 6558
  Synthetic polynucleotide

SEQ ID NO: 6560 - DNA, 172 bp, Artificial Sequence
  Synthetic polynucleotide
atcatctcaccttgcctcctgctgattctgagaccgcgcctgcaggatgctaattaagaatgctaattatcgatgctaattagacatgctaattactaatgctaattaactatgctaattatgcatgctaattagtaatgctaattaggcgcgccatgcttcatcagactct

SEQ ID NO: 6561 - DNA, 172 bp, Artificial Sequence; identical to SEQ ID NO: 6560
  Synthetic polynucleotide

SEQ ID NO: 6562 - DNA, 196 bp, Artificial Sequence
  Synthetic polynucleotide
atcatctcaccttgcctcctgtttgtattgcattgccccctgcaggatatagaacattcagaatatagaacattctcgatatagaacattcgacatatagaacattcctaatatagaacattcactatatagaacattctgcatatagaacattcgtaatatagaacattcggcgcgccatgcttcatcagactct

SEQ ID NO: 6563 - DNA, 196 bp, Artificial Sequence; identical to SEQ ID NO: 6562
  Synthetic polynucleotide

SEQ ID NO: 6564 - DNA, 186 bp, Artificial Sequence
  Synthetic polynucleotide
atcatctcaccttgcctcctgccaacgccgaagtggatcctgcaggccccccccccgcccccgcacagaccccccccccgcccccgcactcgccccccccccgcccccgcacgacccccccccccgcccccgcacctaccccccccccgcccccgcacactggcgcgccatgcttcatcagactct

SEQ ID NO: 6565 - DNA, 186 bp, Artificial Sequence; identical to SEQ ID NO: 6564
  Synthetic polynucleotide

SEQ ID NO: 6566 - DNA, 191 bp, Artificial Sequence
  Synthetic polynucleotide
atcatctcaccttgcctcctgtctgatacttgtgttagcctgcagggcaacctcattatcgtcagagcaacctcattatcgtctcggcaacctcattatcgtcgacgcaacctcattatcgtcctagcaacctcattatcgtcactgcaacctcattatcgtctgcggcgcgccatgcttcatcagactct

SEQ ID NO: 6567 - DNA, 191 bp, Artificial Sequence; identical to SEQ ID NO: 6566
  Synthetic polynucleotide

SEQ ID NO: 6568 - DNA, 191 bp, Artificial Sequence
  Synthetic polynucleotide
atcatctcaccttgcctcctgtgaggtattcgttctttcctgcaggggaggaggagggggaggaggaagaggaggaggagggggaggaggatcgggaggaggagggggaggaggagacggaggaggagggggaggaggactaggaggaggagggggaggaggaactggcgcgccatgcttcatcagactct

SEQ ID NO: 6569 - DNA, 191 bp, Artificial Sequence; identical to SEQ ID NO: 6568
  Synthetic polynucleotide

SEQ ID NO: 6570 - DNA, 172 bp, Artificial Sequence
  Synthetic polynucleotide
atcatctcaccttgcctcctgcccgtcgtagagtgttacctgcaggctgagtcaccagactgagtcacctcgctgagtcaccgacctgagtcaccctactgagtcaccactctgagtcacctgcctgagtcaccgtactgagtcaccggcgcgccatgcttcatcagactct

SEQ ID NO: 6571 - DNA, 172 bp, Artificial Sequence; identical to SEQ ID NO: 6570
  Synthetic polynucleotide

SEQ ID NO: 6572 - DNA, 180 bp, Artificial Sequence
  Synthetic polynucleotide
atcatctcaccttgcctcctggggcgttcgataataaacctgcagggggggcggggtagagggggcggggttcggggggcggggtgacgggggcggggtctagggggcggggtactgggggcggggttgcgggggcggggtgtagggggcggggtggcgcgccatgcttcatcagactct

SEQ ID NO: 6573 - DNA, 180 bp, Artificial Sequence; identical to SEQ ID NO: 6572
  Synthetic polynucleotide

SEQ ID NO: 6574 - DNA, 197 bp, Artificial Sequence
  Synthetic polynucleotide
atcatctcaccttgcctcctgtgtcacctcatctaacacctgcaggcatgtctgggcatgtagacatgtctgggcatgttcgcatgtctgggcatgtgaccatgtctgggcatgtctacatgtctgggcatgtactcatgtctgggcatgttgccatgtctgggcatgtgtaggcgcgccatgcttcatcagactct

SEQ ID NO: 6575 - DNA, 197 bp, Artificial Sequence; identical to SEQ ID NO: 6574
  Synthetic polynucleotide

SEQ ID NO: 6576 - DNA, 190 bp, Artificial Sequence
  Synthetic polynucleotide
atcatctcaccttgcctcctgacacttcggcagatcgccctgcaggcgtcgtgggtggtcagacgtcgtgggtggtctcgcgtcgtgggtggtcgaccgtcgtgggtggtcctacgtcgtgggtggtcactcgtcgtgggtggtctgccgtcgtgggtggtcgtaggcgcgccatgcttcatcagactct

SEQ ID NO: 6577 - DNA, 190 bp, Artificial Sequence; identical to SEQ ID NO: 6576
  Synthetic polynucleotide

SEQ ID NO: 6578 - DNA, 164 bp, Artificial Sequence
  Synthetic polynucleotide
atcatctcaccttgcctcctgtaagagacatccagaaacctgcaggctgtttcagagactgtttcagtcgctgtttcaggacctgtttcagctactgtttcagactctgtttcagtgcctgtttcaggtactgtttcagggcgcgccatgcttcatcagactct

SEQ ID NO: 6579 - DNA, 164 bp, Artificial Sequence; identical to SEQ ID NO: 6578
  Synthetic polynucleotide

SEQ ID NO: 6580 - DNA, 196 bp, Artificial Sequence
  Synthetic polynucleotide
atcatctcaccttgcctcctgagcgcccaagaatgtctcctgcaggtgcaacaggtggtagatgcaacaggtggttcgtgcaacaggtggtgactgcaacaggtggtctatgcaacaggtggtacttgcaacaggtggttgctgcaacaggtggtgtatgcaacaggtggtggcgcgccatgcttcatcagactct

SEQ ID NO: 6581 - DNA, 196 bp, Artificial Sequence; identical to SEQ ID NO: 6580
  Synthetic polynucleotide

SEQ ID NO: 6582 - DNA, 191 bp, Artificial Sequence
  Synthetic polynucleotide
atcatctcaccttgcctcctgccacttgagcgcaaccacctgcagggtccactaattagttctagagtccactaattagttcttcggtccactaattagttctgacgtccactaattagttctctagtccactaattagttctactgtccactaattagttcttgcggcgcgccatgcttcatcagactct

SEQ ID NO: 6583 - DNA, 191 bp, Artificial Sequence; identical to SEQ ID NO: 6582
  Synthetic polynucleotide

SEQ ID NO: 6584 - DNA, 180 bp, Artificial Sequence
  Synthetic polynucleotide
atcatctcaccttgcctcctgagtctcacaagtgctatcctgcagggggggcggggcagagggggcggggctcggggggcggggcgacgggggcggggcctagggggcggggcactgggggcggggctgcgggggcggggcgtagggggcggggcggcgcgccatgcttcatcagactct

SEQ ID NO: 6585 - DNA, 180 bp, Artificial Sequence; identical to SEQ ID NO: 6584
  Synthetic polynucleotide

SEQ ID NO: 6586 - DNA, 197 bp, Artificial Sequence
  Synthetic polynucleotide
atcatctcaccttgcctcctgatacctgtttgttgctccctgcaggctggccacgaggcttagactggccacgaggctttcgctggccacgaggcttgacctggccacgaggcttctactggccacgaggcttactctggccacgaggctttgcctggccacgaggcttgtaggcgcgccatgcttcatcagactct

SEQ ID NO: 6587 - DNA, 197 bp, Artificial Sequence; identical to SEQ ID NO: 6586
  Synthetic polynucleotide

SEQ ID NO: 6588 - DNA, 197 bp, Artificial Sequence
  Synthetic polynucleotide
atcatctcaccttgcctcctgggatttggtatatgcctcctgcaggtgaccccgccaacaaagatgaccccgccaacaatcgtgaccccgccaacaagactgaccccgccaacaactatgaccccgccaacaaacttgaccccgccaacaatgctgaccccgccaacaagtaggcgcgccatgcttcatcagactct

SEQ ID NO: 6589 - DNA, 197 bp, Artificial Sequence; identical to SEQ ID NO: 6588
  Synthetic polynucleotide

SEQ ID NO: 6590 - DNA, 185 bp, Artificial Sequence
  Synthetic polynucleotide
atcatctcaccttgcctcctgcagatcatgttactcgtcctgcaggaaattattgttcttaaagaaaattattgttcttaatcgaaattattgttcttaagacaaattattgttcttaactaaaattattgttcttaaactaaattattgttcttaatgcggcgcgccatgcttcatcagactct

SEQ ID NO: 6591 - DNA, 185 bp, Artificial Sequence; identical to SEQ ID NO: 6590
  Synthetic polynucleotide

SEQ ID NO: 6592 - DNA, 148 bp, Artificial Sequence
  Synthetic polynucleotide
atcatctcaccttgcctcctgaaatgtgccgacagggacctgcagggtattttagagtatttttcggtattttgacgtattttctagtattttactgtatttttgcgtattttgtagtattttggcgcgccatgcttcatcagactct

SEQ ID NO: 6593 - DNA, 148 bp, Artificial Sequence; identical to SEQ ID NO: 6592
  Synthetic polynucleotide

SEQ ID NO: 6594 - DNA, 180 bp, Artificial Sequence
  Synthetic polynucleotide
atcatctcaccttgcctcctgatgacattcgatgtacgcctgcaggtattgtttattagatattgtttatttcgtattgtttattgactattgtttattctatattgtttattacttattgtttatttgctattgtttattgtatattgtttattggcgcgccatgcttcatcagactct

SEQ ID NO: 6595 - DNA, 180 bp, Artificial Sequence; identical to SEQ ID NO: 6594
  Synthetic polynucleotide

SEQ ID NO: 6596 - DNA, 190 bp, Artificial Sequence
  Synthetic polynucleotide
atcatctcaccttgcctcctgacttacgcgccgaccttcctgcagggttaattattaaccagagttaattattaacctcggttaattattaaccgacgttaattattaaccctagttaattattaaccactgttaattattaacctgcgttaattattaaccgtaggcgcgccatgcttcatcagactct

SEQ ID NO: 6597 - DNA, 190 bp, Artificial Sequence; identical to SEQ ID NO: 6596
  Synthetic polynucleotide

SEQ ID NO: 6598 - DNA, 180 bp, Artificial Sequence
  Synthetic polynucleotide
atcatctcaccttgcctcctgtgttgctgtacgcgtaacctgcaggcttctgggaaaagacttctgggaaatcgcttctgggaaagaccttctgggaaactacttctgggaaaactcttctgggaaatgccttctgggaaagtacttctgggaaaggcgcgccatgcttcatcagactct

SEQ ID NO: 6599 - DNA, 180 bp, Artificial Sequence; identical to SEQ ID NO: 6598
  Synthetic polynucleotide

SEQ ID NO: 6600 - DNA, 172 bp, Artificial Sequence
  Synthetic polynucleotide
atcatctcaccttgcctcctggaccaactatcgactaccctgcaggcttatctctaagacttatctctatcgcttatctctagaccttatctctactacttatctctaactcttatctctatgccttatctctagtacttatctctaggcgcgccatgcttcatcagactct

SEQ ID NO: 6601 - DNA, 172 bp, Artificial Sequence; identical to SEQ ID NO: 6600
  Synthetic polynucleotide

SEQ ID NO: 6602 - DNA, 188 bp, Artificial Sequence
  Synthetic polynucleotide
atcatctcaccttgcctcctgatatcagaggagcccagcctgcaggaccctcgaacccagaaccctcgaaccctcgaccctcgaacccgacaccctcgaacccctaaccctcgaacccactaccctcgaaccctgcaccctcgaacccgtaaccctcgaacccggcgcgccatgcttcatcagactct

SEQ ID NO: 6603 - DNA, 188 bp, Artificial Sequence; identical to SEQ ID NO: 6602
  Synthetic polynucleotide

SEQ ID NO: 6604 - DNA, 197 bp, Artificial Sequence
  Synthetic polynucleotide
atcatctcaccttgcctcctgcgataaatcgtatttcccctgcaggtcttggcaagaagccaaaagatcttggcaagaagccaaatcgtcttggcaagaagccaaagactcttggcaagaagccaaactatcttggcaagaagccaaaacttcttggcaagaagccaaatgcggcgcgccatgcttcatcagactct

SEQ ID NO: 6605 - DNA, 197 bp, Artificial Sequence; identical to SEQ ID NO: 6604
  Synthetic polynucleotide

SEQ ID NO: 6606 - DNA, 172 bp, Artificial Sequence
  Synthetic polynucleotide
atcatctcaccttgcctcctgactgctagaacctacatcctgcaggacttcctgttagaacttcctgtttcgacttcctgttgacacttcctgttctaacttcctgttactacttcctgtttgcacttcctgttgtaacttcctgttggcgcgccatgcttcatcagactct

SEQ ID NO: 6607 - DNA, 172 bp, Artificial Sequence; identical to SEQ ID NO: 6606
  Synthetic polynucleotide

SEQ ID NO: 6608 - DNA, 196 bp, Artificial Sequence
  Synthetic polynucleotide
atcatctcaccttgcctcctggcaacttaaccgcctaacctgcaggtgaataacattcaagatgaataacattcatcgtgaataacattcagactgaataacattcactatgaataacattcaacttgaataacattcatgctgaataacattcagtatgaataacattcaggcgcgccatgcttcatcagactct

SEQ ID NO: 6609 - DNA, 196 bp, Artificial Sequence; identical to SEQ ID NO: 6608
  Synthetic polynucleotide

SEQ ID NO: 6610 - DNA, 164 bp, Artificial Sequence
  Synthetic polynucleotide
atcatctcaccttgcctcctgtctatagcgttatcagccctgcagggtgacgtaaagagtgacgtaatcggtgacgtaagacgtgacgtaactagtgacgtaaactgtgacgtaatgcgtgacgtaagtagtgacgtaaggcgcgccatgcttcatcagactct

SEQ ID NO: 6611 - DNA, 164 bp, Artificial Sequence; identical to SEQ ID NO: 6610
  Synthetic polynucleotide

SEQ ID NO: 6612 - DNA, 164 bp, Artificial Sequence
  Synthetic polynucleotide
atcatctcaccttgcctcctgttgcatctcctggctgtcctgcaggtaacgcgatagataacgcgattcgtaacgcgatgactaacgcgatctataacgcgatacttaacgcgattgctaacgcgatgtataacgcgatggcgcgccatgcttcatcagactct

SEQ ID NO: 6613 - DNA, 164 bp, Artificial Sequence; identical to SEQ ID NO: 6612
  Synthetic polynucleotide

SEQ ID NO: 6614 - DNA, 190 bp, Artificial Sequence
  Synthetic polynucleotide
atcatctcaccttgcctcctgggcgaattgaagggacacctgcaggtaattagctaattaagataattagctaattatcgtaattagctaattagactaattagctaattactataattagctaattaacttaattagctaattatgctaattagctaattagtaggcgcgccatgcttcatcagactct

SEQ ID NO: 6615 - DNA, 190 bp, Artificial Sequence; identical to SEQ ID NO: 6614
  Synthetic polynucleotide

SEQ ID NO: 6616 - DNA, 185 bp, Artificial Sequence
  Synthetic polynucleotide
atcatctcaccttgcctcctgcgatggtttaaagtgggcctgcagggagttcatcgggttcaagagagttcatcgggttcatcggagttcatcgggttcagacgagttcatcgggttcactagagttcatcgggttcaactgagttcatcgggttcatgcggcgcgccatgcttcatcagactct

SEQ ID NO: 6617 - DNA, 185 bp, Artificial Sequence; identical to SEQ ID NO: 6616
  Synthetic polynucleotide

SEQ ID NO: 6618 - DNA, 191 bp, Artificial Sequence
  Synthetic polynucleotide
atcatctcaccttgcctcctgcctaactaggtctatcccctgcaggaaacactgcaattgtttagaaaacactgcaattgttttcgaaacactgcaattgtttgacaaacactgcaattgtttctaaaacactgcaattgtttactaaacactgcaattgttttgcggcgcgccatgcttcatcagactct

SEQ ID NO: 6619 - DNA, 191 bp, Artificial Sequence; identical to SEQ ID NO: 6618
  Synthetic polynucleotide

SEQ ID NO: 6620 - DNA, 172 bp, Artificial Sequence
  Synthetic polynucleotide
atcatctcaccttgcctcctggacacattgttatacagcctgcagggcgtaattagagagcgtaattagtcggcgtaattaggacgcgtaattagctagcgtaattagactgcgtaattagtgcgcgtaattaggtagcgtaattagggcgcgccatgcttcatcagactct

SEQ ID NO: 6621 - DNA, 172 bp, Artificial Sequence; identical to SEQ ID NO: 6620
  Synthetic polynucleotide

SEQ ID NO: 6622 - DNA, 186 bp, Artificial Sequence
  Synthetic polynucleotide
atcatctcaccttgcctcctgacagctatgcgcaccagcctgcaggtcacttttggctttcctttaagatcacttttggctttcctttatcgtcacttttggctttcctttagactcacttttggctttcctttactatcacttttggctttcctttaactggcgcgccatgcttcatcagactct

SEQ ID NO: 6623 - DNA, 186 bp, Artificial Sequence; identical to SEQ ID NO: 6622
  Synthetic polynucleotide

SEQ ID NO: 6624 - DNA, 200 bp, Artificial Sequence
  Synthetic polynucleotide
atcatctcaccttgcctcctgccttcaatctaagaacgcctgcagggcgctgtccgtggtgctgaagagcgctgtccgtggtgctgatcggcgctgtccgtggtgctgagacgcgctgtccgtggtgctgactagcgctgtccgtggtgctgaactgcgctgtccgtggtgctgaggcgcgccatgcttcatcagactct

SEQ ID NO: 6625 - DNA, 200 bp, Artificial Sequence; identical to SEQ ID NO: 6624
  Synthetic polynucleotide

SEQ ID NO: 6626 - DNA, 188 bp, Artificial Sequence
  Synthetic polynucleotide
atcatctcaccttgcctcctgatgatcattcccgcacgcctgcaggacgcccacgcatagaacgcccacgcattcgacgcccacgcatgacacgcccacgcatctaacgcccacgcatactacgcccacgcattgcacgcccacgcatgtaacgcccacgcatggcgcgccatgcttcatcagactct

SEQ ID NO: 6627 - DNA, 188 bp, Artificial Sequence; identical to SEQ ID NO: 6626
  Synthetic polynucleotide

SEQ ID NO: 6628 - DNA, 197 bp, Artificial Sequence
  Synthetic polynucleotide
atcatctcaccttgcctcctgatccggcttgacaacggcctgcaggatagcgccccctggtggcagaatagcgccccctggtggctcgatagcgccccctggtggcgacatagcgccccctggtggcctaatagcgccccctggtggcactatagcgccccctggtggctgcggcgcgccatgcttcatcagactct

SEQ ID NO: 6629 - DNA, 197 bp, Artificial Sequence; identical to SEQ ID NO: 6628
  Synthetic polynucleotide

SEQ ID NO: 6630 - DNA, 191 bp, Artificial Sequence
  Synthetic polynucleotide
atcatctcaccttgcctcctgtctacgcaagactccaccctgcagggatgttaactagttttcagagatgttaactagttttctcggatgttaactagttttcgacgatgttaactagttttcctagatgttaactagttttcactgatgttaactagttttctgcggcgcgccatgcttcatcagactct

SEQ ID NO: 6631 - DNA, 191 bp, Artificial Sequence; identical to SEQ ID NO: 6630
  Synthetic polynucleotide

SEQ ID NO: 6632 - DNA, 183 bp, Artificial Sequence
  Synthetic polynucleotide
atcatctcaccttgcctcctgggaggcctcttcgttaccctgcaggggttattaattggttatattggttaagaggttattaattggttatattggttatcgggttattaattggttatattggttagacggttattaattggttatattggttactaggcgcgccatgcttcatcagactct

SEQ ID NO: 6633 - DNA, 183 bp, Artificial Sequence; identical to SEQ ID NO: 6632
  Synthetic polynucleotide

SEQ ID NO: 6634 - DNA, 190 bp, Artificial Sequence
  Synthetic polynucleotide
atcatctcaccttgcctcctggcgtggcacaagatctgcctgcaggctgaggtaattaatagactgaggtaattaattcgctgaggtaattaatgacctgaggtaattaatctactgaggtaattaatactctgaggtaattaattgcctgaggtaattaatgtaggcgcgccatgcttcatcagactct

SEQ ID NO: 6635 - DNA, 190 bp, Artificial Sequence; identical to SEQ ID NO: 6634
  Synthetic polynucleotide

SEQ ID NO: 6636 - DNA, 164 bp, Artificial Sequence
  Synthetic polynucleotide
atcatctcaccttgcctcctgagggtaccagcttattacctgcagggttgctatgagagttgctatgtcggttgctatggacgttgctatgctagttgctatgactgttgctatgtgcgttgctatggtagttgctatgggcgcgccatgcttcatcagactct

SEQ ID NO: 6637 - DNA, 164 bp, Artificial Sequence; identical to SEQ ID NO: 6636
  Synthetic polynucleotide

SEQ ID NO: 6638 - DNA, 148 bp, Artificial Sequence
  Synthetic polynucleotide
atcatctcaccttgcctcctgtttataggtccttctgacctgcaggtttgacaagatttgacatcgtttgacagactttgacactatttgacaacttttgacatgctttgacagtatttgacaggcgcgccatgcttcatcagactct

SEQ ID NO: 6639 - DNA, 148 bp, Artificial Sequence; identical to SEQ ID NO: 6638
  Synthetic polynucleotide

SEQ ID NO: 6640 - DNA, 196 bp, Artificial Sequence
  Synthetic polynucleotide
atcatctcaccttgcctcctgacaggcatcattgtgcacctgcaggtaatttccggtggagataatttccggtggtcgtaatttccggtgggactaatttccggtggctataatttccggtggacttaatttccggtggtgctaatttccggtgggtataatttccggtggggcgcgccatgcttcatcagactct

SEQ ID NO: 6641 - DNA, 196 bp, Artificial Sequence; identical to SEQ ID NO: 6640
  Synthetic polynucleotide

SEQ ID NO: 6642 - DNA, 188 bp, Artificial Sequence
  Synthetic polynucleotide
atcatctcaccttgcctcctggaccaacctgtttggcacctgcaggaaatttgctgacagaaaatttgctgactcgaaatttgctgacgacaaatttgctgacctaaaatttgctgacactaaatttgctgactgcaaatttgctgacgtaaaatttgctgacggcgcgccatgcttcatcagactct

SEQ ID NO: 6643 - DNA, 188 bp, Artificial Sequence; identical to SEQ ID NO: 6642
  Synthetic polynucleotide

SEQ ID NO: 6644 - DNA, 172 bp, Artificial Sequence
  Synthetic polynucleotide
atcatctcaccttgcctcctggatttaaccggctggcacctgcaggtgcgtgggcgagatgcgtgggcgtcgtgcgtgggcggactgcgtgggcgctatgcgtgggcgacttgcgtgggcgtgctgcgtgggcggtatgcgtgggcgggcgcgccatgcttcatcagactct

SEQ ID NO: 6645 - DNA, 172 bp, Artificial Sequence; identical to SEQ ID NO: 6644
  Synthetic polynucleotide

SEQ ID NO: 6646 - DNA, 183 bp, Artificial Sequence
  Synthetic polynucleotide
atcatctcaccttgcctcctgattagcatgagactgcccctgcaggacatagtgacacctaggtgtgaaatagaacatagtgacacctaggtgtgaaattcgacatagtgacacctaggtgtgaaatgacacatagtgacacctaggtgtgaaatctaggcgcgccatgcttcatcagactct

SEQ ID NO: 6647 - DNA, 183 bp, Artificial Sequence; identical to SEQ ID NO: 6646
  Synthetic polynucleotide

SEQ ID NO: 6648 - DNA, 196 bp, Artificial Sequence
  Synthetic polynucleotide
atcatctcaccttgcctcctgggtacttaggtgtggtgcctgcaggaatccagatgttgagaaatccagatgttgtcgaatccagatgttggacaatccagatgttgctaaatccagatgttgactaatccagatgttgtgcaatccagatgttggtaaatccagatgttgggcgcgccatgcttcatcagactct

SEQ ID NO: 6649 - DNA, 196 bp, Artificial Sequence; identical to SEQ ID NO: 6648
  Synthetic polynucleotide

SEQ ID NO: 6650 - DNA, 196 bp, Artificial Sequence
  Synthetic polynucleotide
atcatctcaccttgcctcctgtacatggaaaccggcaccctgcaggggcctgggggcggagaggcctgggggcggtcgggcctgggggcgggacggcctgggggcggctaggcctgggggcggactggcctgggggcggtgcggcctgggggcgggtaggcctgggggcggggcgcgccatgcttcatcagactct

SEQ ID NO: 6651 - DNA, 196 bp, Artificial Sequence; identical to SEQ ID NO: 6650
  Synthetic polynucleotide

SEQ ID NO: 6652 - DNA, 191 bp, Artificial Sequence
  Synthetic polynucleotide
atcatctcaccttgcctcctgacgtaaccgttgaggcccctgcaggagctgttaactagccgtagaagctgttaactagccgttcgagctgttaactagccgtgacagctgttaactagccgtctaagctgttaactagccgtactagctgttaactagccgttgcggcgcgccatgcttcatcagactct

SEQ ID NO: 6653 - DNA, 191 bp, Artificial Sequence; identical to SEQ ID NO: 6652
  Synthetic polynucleotide

SEQ ID NO: 6654 - DNA, 190 bp, Artificial Sequence
  Synthetic polynucleotide
atcatctcaccttgcctcctgacagtctgagcaggattcctgcaggtgaatagtcattcaagatgaatagtcattcatcgtgaatagtcattcagactgaatagtcattcactatgaatagtcattcaacttgaatagtcattcatgctgaatagtcattcagtaggcgcgccatgcttcatcagactct

SEQ ID NO: 6655 - DNA, 190 bp, Artificial Sequence; identical to SEQ ID NO: 6654
  Synthetic polynucleotide

SEQ ID NO: 6656 - DNA, 180 bp, Artificial Sequence
  Synthetic polynucleotide
atcatctcaccttgcctcctgccatgacatatgagttccctgcaggagaccccccacagaagaccccccactcgagaccccccacgacagaccccccacctaagaccccccacactagaccccccactgcagaccccccacgtaagaccccccacggcgcgccatgcttcatcagactct

SEQ ID NO: 6657 - DNA, 180 bp, Artificial Sequence; identical to SEQ ID NO: 6656
  Synthetic polynucleotide

SEQ ID NO: 6658 - DNA, 191 bp, Artificial Sequence
  Synthetic polynucleotide
atcatctcaccttgcctcctgcaacggcacagttatgccctgcagggggaacacaatgttcccagagggaacacaatgttccctcggggaacacaatgttcccgacgggaacacaatgttcccctagggaacacaatgttcccactgggaacacaatgttccctgcggcgcgccatgcttcatcagactct

SEQ ID NO: 6659 - DNA, 191 bp, Artificial Sequence; identical to SEQ ID NO: 6658
  Synthetic polynucleotide

SEQ ID NO: 6660 - DNA, 164 bp, Artificial Sequence
  Synthetic polynucleotide
atcatctcaccttgcctcctgctgtgatagtacaaccgcctgcaggtgcacgtgcagatgcacgtgctcgtgcacgtgcgactgcacgtgcctatgcacgtgcacttgcacgtgctgctgcacgtgcgtatgcacgtgcggcgcgccatgcttcatcagactct

SEQ ID NO: 6661 - DNA, 164 bp, Artificial Sequence; identical to SEQ ID NO: 6660
  Synthetic polynucleotide

SEQ ID NO: 6662 - DNA, 185 bp, Artificial Sequence
  Synthetic polynucleotide
atcatctcaccttgcctcctgtgcttcatccttgaggccctgcaggggggtaattagctctgagaggggtaattagctctgtcgggggtaattagctctggacggggtaattagctctgctaggggtaattagctctgactggggtaattagctctgtgcggcgcgccatgcttcatcagactct

SEQ ID NO: 6663 - DNA, 185 bp, Artificial Sequence; identical to SEQ ID NO: 6662
  Synthetic polynucleotide

SEQ ID NO: 6664 - DNA, 197 bp, Artificial Sequence
  Synthetic polynucleotide
atcatctcaccttgcctcctgcttagttattagcactgcctgcaggaaattgctgactcagagaaaattgctgactcagtcgaaattgctgactcaggacaaattgctgactcagctaaaattgctgactcagactaaattgctgactcagtgcaaattgctgactcaggtaggcgcgccatgcttcatcagactct

SEQ ID NO: 6665 - DNA, 197 bp, Artificial Sequence; identical to SEQ ID NO: 6664
  Synthetic polynucleotide

SEQ ID NO: 6666 - DNA, 186 bp, Artificial Sequence
  Synthetic polynucleotide
atcatctcaccttgcctcctgatctagaccgctggcagcctgcaggtccttatctgcccccaccagagatccttatctgcccccaccagtcgtccttatctgcccccaccaggactccttatctgcccccaccagctatccttatctgcccccaccagactggcgcgccatgcttcatcagactct

SEQ ID NO: 6667 - DNA, 186 bp, Artificial Sequence; identical to SEQ ID NO: 6666
  Synthetic polynucleotide

SEQ ID NO: 6668 - DNA, 185 bp, Artificial Sequence
  Synthetic polynucleotide
atcatctcaccttgcctcctgacttgagagatccgcatcctgcaggaaattttattaccgttagaaaattttattaccgtttcgaaattttattaccgttgacaaattttattaccgttctaaaattttattaccgttactaaattttattaccgtttgcggcgcgccatgcttcatcagactct

SEQ ID NO: 6669 - DNA, 185 bp, Artificial Sequence; identical to SEQ ID NO: 6668
  Synthetic polynucleotide

SEQ ID NO: 6670 - DNA, 196 bp, Artificial Sequence
  Synthetic polynucleotide
atcatctcaccttgcctcctgatttgagaaggtgtttccctgcaggatatcaaggtcatagaatatcaaggtcattcgatatcaaggtcatgacatatcaaggtcatctaatatcaaggtcatactatatcaaggtcattgcatatcaaggtcatgtaatatcaaggtcatggcgcgccatgcttcatcagactct

SEQ ID NO: 6671 - DNA, 196 bp, Artificial Sequence; identical to SEQ ID NO: 6670
  Synthetic polynucleotide

SEQ ID NO: 6672 - DNA, 190 bp, Artificial Sequence
  Synthetic polynucleotide
atcatctcaccttgcctcctggaaaggagatggagcgtcctgcaggagccttggggagggagaagccttggggagggtcgagccttggggaggggacagccttggggagggctaagccttggggagggactagccttggggagggtgcagccttggggaggggtaggcgcgccatgcttcatcagactct

SEQ ID NO: 6673 - DNA, 190 bp, Artificial Sequence; identical to SEQ ID NO: 6672
  Synthetic polynucleotide

SEQ ID NO: 6674 - DNA, 156 bp, Artificial Sequence
  Synthetic polynucleotide
atcatctcaccttgcctcctgctgtcctacttcccaaacctgcaggttaattatagattaattattcgttaattatgacttaattatctattaattatactttaattattgcttaattatgtattaattatggcgcgccatgcttcatcagactct

SEQ ID NO: 6675 - DNA, 156 bp, Artificial Sequence; identical to SEQ ID NO: 6674
  Synthetic polynucleotide

SEQ ID NO: 6676 - DNA, 156 bp, Artificial Sequence
  Synthetic polynucleotide
atcatctcaccttgcctcctgacatacggtcctgggagcctgcaggcgccccttagacgcccctttcgcgccccttgaccgccccttctacgccccttactcgcccctttgccgccccttgtacgccccttggcgcgccatgcttcatcagactct

SEQ ID NO: 6677 - DNA, 156 bp, Artificial Sequence; identical to SEQ ID NO: 6676
  Synthetic polynucleotide

SEQ ID NO: 6678 - DNA, 156 bp, Artificial Sequence
  Synthetic polynucleotide
atcatctcaccttgcctcctgtcatacttaatggccgtcctgcaggaccggaagagaaccggaagtcgaccggaaggacaccggaagctaaccggaagactaccggaagtgcaccggaaggtaaccggaagggcgcgccatgcttcatcagactct

SEQ ID NO: 6679 - DNA, 156 bp, Artificial Sequence; identical to SEQ ID NO: 6678
  Synthetic polynucleotide

SEQ ID NO: 6680 - DNA, 164 bp, Artificial Sequence
  Synthetic polynucleotide
atcatctcaccttgcctcctgttctaaaccatgcgttccctgcaggatgacgcaaagaatgacgcaatcgatgacgcaagacatgacgcaactaatgacgcaaactatgacgcaatgcatgacgcaagtaatgacgcaaggcgcgccatgcttcatcagactct

SEQ ID NO: 6681 - DNA, 164 bp, Artificial Sequence; identical to SEQ ID NO: 6680
  Synthetic polynucleotide

SEQ ID NO: 6682 - DNA, 180 bp, Artificial Sequence
  Synthetic polynucleotide
atcatctcaccttgcctcctgttacctcataggtataccctgcaggggtgactcagaagaggtgactcagatcgggtgactcagagacggtgactcagactaggtgactcagaactggtgactcagatgcggtgactcagagtaggtgactcagaggcgcgccatgcttcatcagactct

SEQ ID NO: 6683 - DNA, 180 bp, Artificial Sequence; identical to SEQ ID NO: 6682
  Synthetic polynucleotide

SEQ ID NO: 6684 - DNA, 156 bp, Artificial Sequence
  Synthetic polynucleotide
atcatctcaccttgcctcctgatcggtgacctgatggccctgcaggtgttattgagatgttattgtcgtgttattggactgttattgctatgttattgacttgttattgtgctgttattggtatgttattgggcgcgccatgcttcatcagactct

SEQ ID NO: 6685 - DNA, 156 bp, Artificial Sequence; identical to SEQ ID NO: 6684
  Synthetic polynucleotide

SEQ ID NO: 6686 - DNA, 180 bp, Artificial Sequence
  Synthetic polynucleotide
atcatctcaccttgcctcctgcaggaagggcttcacagcctgcaggtgacctttaaaagatgacctttaaatcgtgacctttaaagactgacctttaaactatgacctttaaaacttgacctttaaatgctgacctttaaagtatgacctttaaaggcgcgccatgcttcatcagactct

SEQ ID NO: 6687 - DNA, 180 bp, Artificial Sequence; identical to SEQ ID NO: 6686
  Synthetic polynucleotide

SEQ ID NO: 6688 - DNA, 164 bp, Artificial Sequence
  Synthetic polynucleotide
atcatctcaccttgcctcctgttcccttcgggtaagtacctgcaggctaattagtagactaattagttcgctaattagtgacctaattagtctactaattagtactctaattagttgcctaattagtgtactaattagtggcgcgccatgcttcatcagactct

SEQ ID NO: 6689 - DNA, 164 bp, Artificial Sequence; identical to SEQ ID NO: 6688
  Synthetic polynucleotide

SEQ ID NO: 6690 - DNA, 172 bp, Artificial Sequence
  Synthetic polynucleotide
atcatctcaccttgcctcctgttgcgtcagctgtggagcctgcagggccttatctgagagccttatctgtcggccttatctggacgccttatctgctagccttatctgactgccttatctgtgcgccttatctggtagccttatctgggcgcgccatgcttcatcagactct

SEQ ID NO: 6691 - DNA, 172 bp, Artificial Sequence; identical to SEQ ID NO: 6690
  Synthetic polynucleotide

SEQ ID NO: 6692 - DNA, 188 bp, Artificial Sequence
  Synthetic polynucleotide
atcatctcaccttgcctcctggtcgaggtctttgatggcctgcagggattacgtaaccagagattacgtaacctcggattacgtaaccgacgattacgtaaccctagattacgtaaccactgattacgtaacctgcgattacgtaaccgtagattacgtaaccggcgcgccatgcttcatcagactct

SEQ ID NO: 6693 - DNA, 188 bp, Artificial Sequence; identical to SEQ ID NO: 6692
  Synthetic polynucleotide

SEQ ID NO: 6694 - DNA, 197 bp, Artificial Sequence
  Synthetic polynucleotide
atcatctcaccttgcctcctgaacagcgaagtgacatacctgcaggttcagcaccatggacagattcagcaccatggactcgttcagcaccatggacgacttcagcaccatggacctattcagcaccatggacactttcagcaccatggactgcttcagcaccatggacgtaggcgcgccatgcttcatcagactct

SEQ ID NO: 6695 - DNA, 197 bp, Artificial Sequence; identical to SEQ ID NO: 6694
  Synthetic polynucleotide

SEQ ID NO: 6696 - DNA, 190 bp, Artificial Sequence
  Synthetic polynucleotide
atcatctcaccttgcctcctgctgtgcatccgaagtcccctgcagggtaaacatgtttacagagtaaacatgtttactcggtaaacatgtttacgacgtaaacatgtttacctagtaaacatgtttacactgtaaacatgtttactgcgtaaacatgtttacgtaggcgcgccatgcttcatcagactct

SEQ ID NO: 6697 - DNA, 190 bp, Artificial Sequence; identical to SEQ ID NO: 6696
  Synthetic polynucleotide

SEQ ID NO: 6698 - DNA, 156 bp, Artificial Sequence
  Synthetic polynucleotide
atcatctcaccttgcctcctggtcttcaaggccatactcctgcaggttaattagagattaattagtcgttaattaggacttaattagctattaattagactttaattagtgcttaattaggtattaattagggcgcgccatgcttcatcagactct

SEQ ID NO: 6699 - DNA, 156 bp, Artificial Sequence; identical to SEQ ID NO: 6698
  Synthetic polynucleotide

SEQ ID NO: 6700 - DNA, 191 bp, Artificial Sequence
  Synthetic polynucleotide
atcatctcaccttgcctcctgcgtggacatctgaagttcctgcaggtagtcctttgttcttctagatagtcctttgttcttcttcgtagtcctttgttcttctgactagtcctttgttcttctctatagtcctttgttcttctacttagtcctttgttcttcttgcggcgcgccatgcttcatcagactct

SEQ ID NO: 6701 - DNA, 191 bp, Artificial Sequence; identical to SEQ ID NO: 6700
  Synthetic polynucleotide

SEQ ID NO: 6702 - DNA, 156 bp, Artificial Sequence
  Synthetic polynucleotide
atcatctcaccttgcctcctgcacggatgtcaagtgcgcctgcaggttaattaaagattaattaatcgttaattaagacttaattaactattaattaaactttaattaatgcttaattaagtattaattaaggcgcgccatgcttcatcagactct

SEQ ID NO: 6703 - DNA, 156 bp, Artificial Sequence; identical to SEQ ID NO: 6702
  Synthetic polynucleotide

SEQ ID NO: 6704 - DNA, 180 bp, Artificial Sequence
  Synthetic polynucleotide
atcatctcaccttgcctcctgcctgtcagaggttaacacctgcagggccacgtgaccagagccacgtgacctcggccacgtgaccgacgccacgtgaccctagccacgtgaccactgccacgtgacctgcgccacgtgaccgtagccacgtgaccggcgcgccatgcttcatcagactct

SEQ ID NO: 6705 - DNA, 180 bp, Artificial Sequence; identical to SEQ ID NO: 6704
  Synthetic polynucleotide

SEQ ID NO: 6706 - DNA, 191 bp, Artificial Sequence
  Synthetic polynucleotide
atcatctcaccttgcctcctggtcgttcgtcataagtacctgcaggaattaattaattaattcagaaattaattaattaattctcgaattaattaattaattcgacaattaattaattaattcctaaattaattaattaattcactaattaattaattaattctgcggcgcgccatgcttcatcagactct

SEQ ID NO: 6707 - DNA, 191 bp, Artificial Sequence; identical to SEQ ID NO: 6706
  Synthetic polynucleotide

SEQ ID NO: 6708 - DNA, 191 bp, Artificial Sequence
  Synthetic polynucleotide
atcatctcaccttgcctcctgcgacactgcagtacaggcctgcagggatagatcaaagggattagagatagatcaaagggatttcggatagatcaaagggattgacgatagatcaaagggattctagatagatcaaagggattactgatagatcaaagggatttgcggcgcgccatgcttcatcagactct

SEQ ID NO: 6709 - DNA, 191 bp, Artificial Sequence; identical to SEQ ID NO: 6708
  Synthetic polynucleotide

SEQ ID NO: 6710 - DNA, 156 bp, Artificial Sequence
  Synthetic polynucleotide
atcatctcaccttgcctcctgctagcttccagatggcacctgcaggttaattacagattaattactcgttaattacgacttaattacctattaattacactttaattactgcttaattacgtattaattacggcgcgccatgcttcatcagactct

SEQ ID NO: 6711 - DNA, 156 bp, Artificial Sequence; identical to SEQ ID NO: 6710
  Synthetic polynucleotide

SEQ ID NO: 6712 - DNA, 185 bp, Artificial Sequence
  Synthetic polynucleotide
atcatctcaccttgcctcctgccgaacgtacaaagtagcctgcaggaggtgtgaaggtgtgaagaaggtgtgaaggtgtgatcgaggtgtgaaggtgtgagacaggtgtgaaggtgtgactaaggtgtgaaggtgtgaactaggtgtgaaggtgtgatgcggcgcgccatgcttcatcagactct

SEQ ID NO: 6713 - DNA, 185 bp, Artificial Sequence; identical to SEQ ID NO: 6712
  Synthetic polynucleotide

SEQ ID NO: 6714 - DNA, 197 bp, Artificial Sequence
  Synthetic polynucleotide
atcatctcaccttgcctcctggggtagtgcttacgtaccctgcaggtggtgactcatcctcagatggtgactcatcctctcgtggtgactcatcctcgactggtgactcatcctcctatggtgactcatcctcacttggtgactcatcctctgctggtgactcatcctcgtaggcgcgccatgcttcatcagactct

SEQ ID NO: 6715 - DNA, 197 bp, Artificial Sequence; identical to SEQ ID NO: 6714
  Synthetic polynucleotide

SEQ ID NO: 6716 - DNA, 172 bp, Artificial Sequence
  Synthetic polynucleotide
atcatctcaccttgcctcctgtacaatgtggtagacgacctgcaggctacttcctgagactacttcctgtcgctacttcctggacctacttcctgctactacttcctgactctacttcctgtgcctacttcctggtactacttcctgggcgcgccatgcttcatcagactct

SEQ ID NO: 6717 - DNA, 172 bp, Artificial Sequence; identical to SEQ ID NO: 6716
  Synthetic polynucleotide

SEQ ID NO: 6718 - DNA, 180 bp, Artificial Sequence
  Synthetic polynucleotide
atcatctcaccttgcctcctgtctatgcgcgaaccaatcctgcaggcctttgatgttagacctttgatgtttcgcctttgatgttgaccctttgatgttctacctttgatgttactcctttgatgtttgccctttgatgttgtacctttgatgttggcgcgccatgcttcatcagactct

SEQ ID NO: 6719 - DNA, 180 bp, Artificial Sequence; identical to SEQ ID NO: 6718
  Synthetic polynucleotide

SEQ ID NO: 6720 - DNA, 172 bp, Artificial Sequence
  Synthetic polynucleotide
atcatctcaccttgcctcctgatgctttgttagaacaccctgcaggactcaagtgtagaactcaagtgttcgactcaagtgtgacactcaagtgtctaactcaagtgtactactcaagtgttgcactcaagtgtgtaactcaagtgtggcgcgccatgcttcatcagactct

SEQ ID NO: 6721 - DNA, 172 bp, Artificial Sequence; identical to SEQ ID NO: 6720
  Synthetic polynucleotide

SEQ ID NO: 6722 - DNA, 190 bp, Artificial Sequence
  Synthetic polynucleotide
atcatctcaccttgcctcctgcctcttcctcgagggaacctgcaggcatgcatatgcaaaagacatgcatatgcaaatcgcatgcatatgcaaagaccatgcatatgcaaactacatgcatatgcaaaactcatgcatatgcaaatgccatgcatatgcaaagtaggcgcgccatgcttcatcagactct

SEQ ID NO: 6723 - DNA, 190 bp, Artificial Sequence; identical to SEQ ID NO: 6722
  Synthetic polynucleotide

SEQ ID NO: 6724 - DNA, 196 bp, Artificial Sequence
  Synthetic polynucleotide
atcatctcaccttgcctcctgattaggtatgtagtgctcctgcaggtgcagctgtccctagatgcagctgtcccttcgtgcagctgtccctgactgcagctgtccctctatgcagctgtccctacttgcagctgtcccttgctgcagctgtccctgtatgcagctgtccctggcgcgccatgcttcatcagactct

SEQ ID NO: 6725 - DNA, 196 bp, Artificial Sequence; identical to SEQ ID NO: 6724
  Synthetic polynucleotide

SEQ ID NO: 6726 - DNA, 164 bp, Artificial Sequence
  Synthetic polynucleotide
atcatctcaccttgcctcctgtccagatgaatgcacgtcctgcaggtgacgtacaagatgacgtacatcgtgacgtacagactgacgtacactatgacgtacaacttgacgtacatgctgacgtacagtatgacgtacaggcgcgccatgcttcatcagactct

SEQ ID NO: 6727 - DNA, 164 bp, Artificial Sequence; identical to SEQ ID NO: 6726
  Synthetic polynucleotide

SEQ ID NO: 6728 - DNA, 164 bp, Artificial Sequence
  Synthetic polynucleotide
atcatctcaccttgcctcctgtgttggcgagtttcgatcctgcaggctaattagcagactaattagctcgctaattagcgacctaattagcctactaattagcactctaattagctgcctaattagcgtactaattagcggcgcgccatgcttcatcagactct

SEQ ID NO: 6729 - DNA, 164 bp, Artificial Sequence; identical to SEQ ID NO: 6728
  Synthetic polynucleotide

SEQ ID NO: 6730 - DNA, 190 bp, Artificial Sequence
  Synthetic polynucleotide
atcatctcaccttgcctcctgcacgatcgcacctcaaacctgcagggggcatcaatcaaaagagggcatcaatcaaatcggggcatcaatcaaagacgggcatcaatcaaactagggcatcaatcaaaactgggcatcaatcaaatgcgggcatcaatcaaagtaggcgcgccatgcttcatcagactct

SEQ ID NO: 6731 - DNA, 190 bp, Artificial Sequence; identical to SEQ ID NO: 6730
  Synthetic polynucleotide

SEQ ID NO: 6732 - DNA, 191 bp, Artificial Sequence
  Synthetic polynucleotide
atcatctcaccttgcctcctgctctgctgttgctttaacctgcaggataagtgataccctatcagaataagtgataccctatctcgataagtgataccctatcgacataagtgataccctatcctaataagtgataccctatcactataagtgataccctatctgcggcgcgccatgcttcatcagactct

SEQ ID NO: 6733 - DNA, 191 bp, Artificial Sequence; identical to SEQ ID NO: 6732
  Synthetic polynucleotide

SEQ ID NO: 6734 - DNA, 191 bp, Artificial Sequence
  Synthetic polynucleotide
atcatctcaccttgcctcctgacccaatcggctgtctacctgcagggaagaccaattagcgctagagaagaccaattagcgcttcggaagaccaattagcgctgacgaagaccaattagcgctctagaagaccaattagcgctactgaagaccaattagcgcttgcggcgcgccatgcttcatcagactct

SEQ ID NO: 6735 - DNA, 191 bp, Artificial Sequence; identical to SEQ ID NO: 6734
  Synthetic polynucleotide

SEQ ID NO: 6736 - DNA, 164 bp, Artificial Sequence
  Synthetic polynucleotide
atcatctcaccttgcctcctgcacgacatggaccagtacctgcaggtgacgtacgagatgacgtacgtcgtgacgtacggactgacgtacgctatgacgtacgacttgacgtacgtgctgacgtacggtatgacgtacgggcgcgccatgcttcatcagactct

SEQ ID NO: 6737 - DNA, 164 bp, Artificial Sequence; identical to SEQ ID NO: 6736
  Synthetic polynucleotide

SEQ ID NO: 6738 - DNA, 197 bp, Artificial Sequence
  Synthetic polynucleotide
atcatctcaccttgcctcctgcacttatggtcacagggcctgcagggtgatttgcatatttagagtgatttgcatattttcggtgatttgcatatttgacgtgatttgcatatttctagtgatttgcatatttactgtgatttgcatattttgcgtgatttgcatatttgtaggcgcgccatgcttcatcagactct

SEQ ID NO: 6739 - DNA, 197 bp, Artificial Sequence; identical to SEQ ID NO: 6738
  Synthetic polynucleotide

SEQ ID NO: 6740 - DNA, 172 bp, Artificial Sequence
  Synthetic polynucleotide
atcatctcaccttgcctcctgccaactccactatggaacctgcaggcacacacctgagacacacacctgtcgcacacacctggaccacacacctgctacacacacctgactcacacacctgtgccacacacctggtacacacacctgggcgcgccatgcttcatcagactct

SEQ ID NO: 6741 - DNA, 172 bp, Artificial Sequence; identical to SEQ ID NO: 6740
  Synthetic polynucleotide

SEQ ID NO: 6742 - DNA, 191 bp, Artificial Sequence
  Synthetic polynucleotide
atcatctcaccttgcctcctgtgtctacagcgcactttcctgcaggagtattacatgtattttagaagtattacatgtatttttcgagtattacatgtattttgacagtattacatgtattttctaagtattacatgtattttactagtattacatgtatttttgcggcgcgccatgcttcatcagactct

SEQ ID NO: 6743 - DNA, 191 bp, Artificial Sequence; identical to SEQ ID NO: 6742
  Synthetic polynucleotide

SEQ ID NO: 6744 - DNA, 164 bp, Artificial Sequence
  Synthetic polynucleotide
atcatctcaccttgcctcctgaatcgtcggactcgcaccctgcaggtttttccggagatttttccggtcgtttttccgggactttttccggctatttttccggacttttttccggtgctttttccgggtatttttccggggcgcgccatgcttcatcagactct

SEQ ID NO: 6745 - DNA, 164 bp, Artificial Sequence; identical to SEQ ID NO: 6744
  Synthetic polynucleotide

SEQ ID NO: 6746 - DNA, 172 bp, Artificial Sequence
  Synthetic polynucleotide
atcatctcaccttgcctcctggagcaagctttgcatcacctgcaggggtgacgtgaagaggtgacgtgatcgggtgacgtgagacggtgacgtgactaggtgacgtgaactggtgacgtgatgcggtgacgtgagtaggtgacgtgaggcgcgccatgcttcatcagactct

SEQ ID NO: 6747 - DNA, 172 bp, Artificial Sequence; identical to SEQ ID NO: 6746
  Synthetic polynucleotide

SEQ ID NO: 6748 - DNA, 188 bp, Artificial Sequence
  Synthetic polynucleotide
atcatctcaccttgcctcctgccgtgaccttaacagcgcctgcaggttgcgcaatcttagattgcgcaatctttcgttgcgcaatcttgacttgcgcaatcttctattgcgcaatcttactttgcgcaatctttgcttgcgcaatcttgtattgcgcaatcttggcgcgccatgcttcatcagactct

SEQ ID NO: 6749 - DNA, 188 bp, Artificial Sequence; identical to SEQ ID NO: 6748
  Synthetic polynucleotide

SEQ ID NO: 6750 - DNA, 180 bp, Artificial Sequence
  Synthetic polynucleotide
atcatctcaccttgcctcctgatggtcccgaatacagacctgcaggcgccggaagtgagacgccggaagtgtcgcgccggaagtggaccgccggaagtgctacgccggaagtgactcgccggaagtgtgccgccggaagtggtacgccggaagtgggcgcgccatgcttcatcagactct

SEQ ID NO: 6751 - DNA, 180 bp, Artificial Sequence; identical to SEQ ID NO: 6750
  Synthetic polynucleotide

SEQ ID NO: 6752 - DNA, 197 bp, Artificial Sequence
  Synthetic polynucleotide
atcatctcaccttgcctcctgatgttccctcgtctcctcctgcagggtagggcaaaggtcaagagtagggcaaaggtcatcggtagggcaaaggtcagacgtagggcaaaggtcactagtagggcaaaggtcaactgtagggcaaaggtcatgcgtagggcaaaggtcagtaggcgcgccatgcttcatcagactct

SEQ ID NO: 6753 - DNA, 197 bp, Artificial Sequence; identical to SEQ ID NO: 6752
  Synthetic polynucleotide

SEQ ID NO: 6754 - DNA, 156 bp, Artificial Sequence
  Synthetic polynucleotide
atcatctcaccttgcctcctgggaagccgggattagaccctgcaggtgttatttagatgttattttcgtgttatttgactgttatttctatgttatttacttgttattttgctgttatttgtatgttatttggcgcgccatgcttcatcagactct

SEQ ID NO: 6755 - DNA, 156 bp, Artificial Sequence; identical to SEQ ID NO: 6754
  Synthetic polynucleotide

SEQ ID NO: 6756 - DNA, 191 bp, Artificial Sequence
  Synthetic polynucleotide
atcatctcaccttgcctcctgcccttgtatacacgtcacctgcaggccagatggcacggacacaacaagaccagatggcacggacacaacatcgccagatggcacggacacaacagacccagatggcacggacacaacactaccagatggcacggacacaacaactggcgcgccatgcttcatcagactct

SEQ ID NO: 6757 - DNA, 191 bp, Artificial Sequence; identical to SEQ ID NO: 6756
  Synthetic polynucleotide

SEQ ID NO: 6758 - DNA, 188 bp, Artificial Sequence
  Synthetic polynucleotide
atcatctcaccttgcctcctggggtcagcaaatgagggcctgcaggattggcgccaaaagaattggcgccaaatcgattggcgccaaagacattggcgccaaactaattggcgccaaaactattggcgccaaatgcattggcgccaaagtaattggcgccaaaggcgcgccatgcttcatcagactct

SEQ ID NO: 6759 - DNA, 188 bp, Artificial Sequence; identical to SEQ ID NO: 6758
  Synthetic polynucleotide

SEQ ID NO: 6760 - DNA, 196 bp, Artificial Sequence
  Synthetic polynucleotide
atcatctcaccttgcctcctgagtgaaacaccgagtaccctgcaggtgccctcagggcaagatgccctcagggcatcgtgccctcagggcagactgccctcagggcactatgccctcagggcaacttgccctcagggcatgctgccctcagggcagtatgccctcagggcaggcgcgccatgcttcatcagactct

SEQ ID NO: 6761 - DNA, 196 bp, Artificial Sequence; identical to SEQ ID NO: 6760
  Synthetic polynucleotide

SEQ ID NO: 6762 - DNA, 191 bp, Artificial Sequence
  Synthetic polynucleotide
atcatctcaccttgcctcctgactcgggatcgacacttcctgcaggaaaataacggtttccatagaaaaataacggtttccattcgaaaataacggtttccatgacaaaataacggtttccatctaaaaataacggtttccatactaaaataacggtttccattgcggcgcgccatgcttcatcagactct

SEQ ID NO: 6763 - DNA, 191 bp, Artificial Sequence; identical to SEQ ID NO: 6762
  Synthetic polynucleotide

SEQ ID NO: 6764 - DNA, 191 bp, Artificial Sequence
  Synthetic polynucleotide
atcatctcaccttgcctcctggagaccctttacggacccctgcaggaattttcaagtggttaaagaaattttcaagtggttaatcgaattttcaagtggttaagacaattttcaagtggttaactaaattttcaagtggttaaactaattttcaagtggttaatgcggcgcgccatgcttcatcagactct

SEQ ID NO: 6765 - DNA, 191 bp, Artificial Sequence; identical to SEQ ID NO: 6764
  Synthetic polynucleotide

SEQ ID NO: 6766 - DNA, 197 bp, Artificial Sequence
  Synthetic polynucleotide
atcatctcaccttgcctcctgtccgtgtgcatttcgcccctgcagggccaccagagggcgcagagccaccagagggcgctcggccaccagagggcgcgacgccaccagagggcgcctagccaccagagggcgcactgccaccagagggcgctgcgccaccagagggcgcgtaggcgcgccatgcttcatcagactct

SEQ ID NO: 6767 - DNA, 197 bp, Artificial Sequence; identical to SEQ ID NO: 6766
  Synthetic polynucleotide

SEQ ID NO: 6768 - DNA, 156 bp, Artificial Sequence
  Synthetic polynucleotide
atcatctcaccttgcctcctgagacaatggaatcacttcctgcaggaaaaaacaagaaaaaaacatcgaaaaaacagacaaaaaacactaaaaaaacaactaaaaaacatgcaaaaaacagtaaaaaaacaggcgcgccatgcttcatcagactct

SEQ ID NO: 6769 - DNA, 156 bp, Artificial Sequence; identical to SEQ ID NO: 6768
  Synthetic polynucleotide

SEQ ID NO: 6770 - DNA, 186 bp, Artificial Sequence
  Synthetic polynucleotide
atcatctcaccttgcctcctgaggagccatcccattgacctgcaggataaaaaacaacacaaataaagaataaaaaacaacacaaataatcgataaaaaacaacacaaataagacataaaaaacaacacaaataactaataaaaaacaacacaaataaactggcgcgccatgcttcatcagactct

SEQ ID NO: 6771 - DNA, 186 bp, Artificial Sequence; identical to SEQ ID NO: 6770
  Synthetic polynucleotide

SEQ ID NO: 6772 - DNA, 172 bp, Artificial Sequence
  Synthetic polynucleotide
atcatctcaccttgcctcctggacagtttgagctgtcccctgcaggacccggaagtagaacccggaagttcgacccggaagtgacacccggaagtctaacccggaagtactacccggaagttgcacccggaagtgtaacccggaagtggcgcgccatgcttcatcagactct

SEQ ID NO: 6773 - DNA, 172 bp, Artificial Sequence; identical to SEQ ID NO: 6772
  Synthetic polynucleotide

SEQ ID NO: 6774 - DNA, 185 bp, Artificial Sequence
  Synthetic polynucleotide
atcatctcaccttgcctcctgtgaataggataactagccctgcagggaggtaattacctcagagagaggtaattacctcagtcggaggtaattacctcaggacgaggtaattacctcagctagaggtaattacctcagactgaggtaattacctcagtgcggcgcgccatgcttcatcagactct

SEQ ID NO: 6775 - DNA, 185 bp, Artificial Sequence; identical to SEQ ID NO: 6774
  Synthetic polynucleotide

SEQ ID NO: 6776 - DNA, 156 bp, Artificial Sequence
  Synthetic polynucleotide
atcatctcaccttgcctcctggtatgcactcaaagggtcctgcagggatcaaagagagatcaaagtcggatcaaaggacgatcaaagctagatcaaagactgatcaaagtgcgatcaaaggtagatcaaagggcgcgccatgcttcatcagactct

SEQ ID NO: 6777 - DNA, 156 bp, Artificial Sequence; identical to SEQ ID NO: 6776
  Synthetic polynucleotide

SEQ ID NO: 6778 - DNA, 197 bp, Artificial Sequence
  Synthetic polynucleotide
atcatctcaccttgcctcctgtataagatgtgcctttgcctgcaggtctgtggggggtctgagatctgtggggggtctgtcgtctgtggggggtctggactctgtggggggtctgctatctgtggggggtctgacttctgtggggggtctgtgctctgtggggggtctggtaggcgcgccatgcttcatcagactct

SEQ ID NO: 6779 - DNA, 197 bp, Artificial Sequence; identical to SEQ ID NO: 6778
  Synthetic polynucleotide

SEQ ID NO: 6780 - DNA, 164 bp, Artificial Sequence
  Synthetic polynucleotide
atcatctcaccttgcctcctggtcagttaatacactcgcctgcaggtttgatgggagatttgatgggtcgtttgatggggactttgatgggctatttgatgggacttttgatgggtgctttgatggggtatttgatgggggcgcgccatgcttcatcagactct

SEQ ID NO: 6781 - DNA, 164 bp, Artificial Sequence; identical to SEQ ID NO: 6780
  Synthetic polynucleotide

SEQ ID NO: 6782 - DNA, 197 bp, Artificial Sequence
  Synthetic polynucleotide
atcatctcaccttgcctcctgcacacgcttcactgacacctgcaggaccaaaatggcggccagaaccaaaatggcggcctcgaccaaaatggcggccgacaccaaaatggcggccctaaccaaaatggcggccactaccaaaatggcggcctgcaccaaaatggcggccgtaggcgcgccatgcttcatcagactct

SEQ ID NO: 6783 - DNA, 197 bp, Artificial Sequence; identical to SEQ ID NO: 6782
  Synthetic polynucleotide

SEQ ID NO: 6784 - DNA, 164 bp, Artificial Sequence
  Synthetic polynucleotide
atcatctcaccttgcctcctgactactccgctgcggttcctgcaggggtttctctagaggtttctcttcgggtttctctgacggtttctctctaggtttctctactggtttctcttgcggtttctctgtaggtttctctggcgcgccatgcttcatcagactct

SEQ ID NO: 6785 - DNA, 164 bp, Artificial Sequence; identical to SEQ ID NO: 6784
  Synthetic polynucleotide

SEQ ID NO: 6786 - DNA, 180 bp, Artificial Sequence
  Synthetic polynucleotide
atcatctcaccttgcctcctggcggttaaaccggttgtcctgcaggtgtttacttagagatgtttacttagtcgtgtttacttaggactgtttacttagctatgtttacttagacttgtttacttagtgctgtttacttaggtatgtttacttagggcgcgccatgcttcatcagactct

SEQ ID NO: 6787 - DNA, 180 bp, Artificial Sequence; identical to SEQ ID NO: 6786
  Synthetic polynucleotide

SEQ ID NO: 6788 - DNA, 186 bp, Artificial Sequence
  Synthetic polynucleotide
atcatctcaccttgcctcctggaattacgaatgtgacacctgcaggcggttacgcttcagtgctctagacggttacgcttcagtgctcttcgcggttacgcttcagtgctctgaccggttacgcttcagtgctctctacggttacgcttcagtgctctactggcgcgccatgcttcatcagactct

SEQ ID NO: 6789 - DNA, 186 bp, Artificial Sequence; identical to SEQ ID NO: 6788
  Synthetic polynucleotide

SEQ ID NO: 6790 - DNA, 185 bp, Artificial Sequence
  Synthetic polynucleotide
atcatctcaccttgcctcctgagttgctaaagtcaaggcctgcaggaaaagctttctaggaaagaaaaagctttctaggaatcgaaaagctttctaggaagacaaaagctttctaggaactaaaaagctttctaggaaactaaaagctttctaggaatgcggcgcgccatgcttcatcagactct

SEQ ID NO: 6791 - DNA, 185 bp, Artificial Sequence; identical to SEQ ID NO: 6790
  Synthetic polynucleotide

SEQ ID NO: 6792 - DNA, 197 bp, Artificial Sequence
  Synthetic polynucleotide
atcatctcaccttgcctcctgcttgtcatctgtcatgccctgcaggtgtcacgcatgactgaacagatgtcacgcatgactgaactcgtgtcacgcatgactgaacgactgtcacgcatgactgaacctatgtcacgcatgactgaacacttgtcacgcatgactgaactgcggcgcgccatgcttcatcagactct

SEQ ID NO: 6793 - DNA, 197 bp, Artificial Sequence; identical to SEQ ID NO: 6792
  Synthetic polynucleotide

SEQ ID NO: 6794 - DNA, 197 bp, Artificial Sequence
  Synthetic polynucleotide
atcatctcaccttgcctcctgccataaagagccatccacctgcaggccgagacccctgcccagaccgagacccctgccctcgccgagacccctgcccgacccgagacccctgcccctaccgagacccctgcccactccgagacccctgccctgcccgagacccctgcccgtaggcgcgccatgcttcatcagactct

SEQ ID NO: 6795 - DNA, 197 bp, Artificial Sequence; identical to SEQ ID NO: 6794
  Synthetic polynucleotide

SEQ ID NO: 6796 - DNA, 172 bp, Artificial Sequence
  Synthetic polynucleotide
atcatctcaccttgcctcctgtaactaagcgtcctagtcctgcaggggtgacgtcaagaggtgacgtcatcgggtgacgtcagacggtgacgtcactaggtgacgtcaactggtgacgtcatgcggtgacgtcagtaggtgacgtcaggcgcgccatgcttcatcagactct

SEQ ID NO: 6797 - DNA, 172 bp, Artificial Sequence; identical to SEQ ID NO: 6796
  Synthetic polynucleotide

SEQ ID NO: 6798 - DNA, 164 bp, Artificial Sequence
  Synthetic polynucleotide
atcatctcaccttgcctcctgtgcggtatttaagtggacctgcaggtggcaacagagatggcaacagtcgtggcaacaggactggcaacagctatggcaacagacttggcaacagtgctggcaacaggtatggcaacagggcgcgccatgcttcatcagactct

SEQ ID NO: 6799 - DNA, 164 bp, Artificial Sequence; identical to SEQ ID NO: 6798
  Synthetic polynucleotide

SEQ ID NO: 6800 - DNA, 140 bp, Artificial Sequence
  Synthetic polynucleotide
atcatctcaccttgcctcctgtcgaacctgcgtattatcctgcaggtgcgtgagatgcgtgtcgtgcgtggactgcgtgctatgcgtgacttgcgtgtgctgcgtggtatgcgtgggcgcgccatgcttcatcagactct

SEQ ID NO: 6801 - DNA, 140 bp, Artificial Sequence; identical to SEQ ID NO: 6800
  Synthetic polynucleotide

SEQ ID NO: 6802 - DNA, 190 bp, Artificial Sequence
  Synthetic polynucleotide
atcatctcaccttgcctcctgactgtcagtatgttgcgcctgcagggttgtaaacaacacagagttgtaaacaacactcggttgtaaacaacacgacgttgtaaacaacacctagttgtaaacaacacactgttgtaaacaacactgcgttgtaaacaacacgtaggcgcgccatgcttcatcagactct

SEQ ID NO: 6803 - DNA, 190 bp, Artificial Sequence; identical to SEQ ID NO: 6802
  Synthetic polynucleotide

SEQ ID NO: 6804 - DNA, 196 bp, Artificial Sequence
  Synthetic polynucleotide
atcatctcaccttgcctcctgatagcctgagagcccatcctgcaggttgttctatttttagaaccacaagattgttctatttttagaaccacatcgttgttctatttttagaaccacagacttgttctatttttagaaccacactattgttctatttttagaaccacaactggcgcgccatgcttcatcagactct

SEQ ID NO: 6805 - DNA, 196 bp, Artificial Sequence; identical to SEQ ID NO: 6804
  Synthetic polynucleotide

SEQ ID NO: 6806 - DNA, 180 bp, Artificial Sequence
  Synthetic polynucleotide
atcatctcaccttgcctcctgtgaccggctatcttcgccctgcagggccacacccacagagccacacccactcggccacacccacgacgccacacccacctagccacacccacactgccacacccactgcgccacacccacgtagccacacccacggcgcgccatgcttcatcagactct

SEQ ID NO: 6807 - DNA, 180 bp, Artificial Sequence; identical to SEQ ID NO: 6806
  Synthetic polynucleotide

SEQ ID NO: 6808 - DNA, 191 bp, Artificial Sequence
  Synthetic polynucleotide
atcatctcaccttgcctcctggtgtaacaggctattaacctgcaggtagtcctttgttcttatagatagtcctttgttcttattcgtagtcctttgttcttatgactagtcctttgttcttatctatagtcctttgttcttatacttagtcctttgttcttattgcggcgcgccatgcttcatcagactct

SEQ ID NO: 6809 - DNA, 191 bp, Artificial Sequence; identical to SEQ ID NO: 6808
  Synthetic polynucleotide

SEQ ID NO: 6810 - DNA, 180 bp, Artificial Sequence
  Synthetic polynucleotide
atcatctcaccttgcctcctgtggcacaggttcatgggcctgcaggtccctggggacagatccctggggactcgtccctggggacgactccctggggacctatccctggggacacttccctggggactgctccctggggacgtatccctggggacggcgcgccatgcttcatcagactct

SEQ ID NO: 6811 - DNA, 180 bp, Artificial Sequence; identical to SEQ ID NO: 6810
  Synthetic polynucleotide

SEQ ID NO: 6812 - DNA, 156 bp, Artificial Sequence
  Synthetic polynucleotide
atcatctcaccttgcctcctgggttatcgcagctctagcctgcaggtttgattaagatttgattatcgtttgattagactttgattactatttgattaacttttgattatgctttgattagtatttgattaggcgcgccatgcttcatcagactct

SEQ ID NO: 6813 - DNA, 156 bp, Artificial Sequence; identical to SEQ ID NO: 6812
  Synthetic polynucleotide

SEQ ID NO: 6814 - DNA, 196 bp, Artificial Sequence
  Synthetic polynucleotide
atcatctcaccttgcctcctggccaactcctacagtagcctgcaggatgtgtttgtttaagaatgtgtttgtttatcgatgtgtttgtttagacatgtgtttgtttactaatgtgtttgtttaactatgtgtttgtttatgcatgtgtttgtttagtaatgtgtttgtttaggcgcgccatgcttcatcagactct

SEQ ID NO: 6815 - DNA, 196 bp, Artificial Sequence; identical to SEQ ID NO: 6814
  Synthetic polynucleotide

SEQ ID NO: 6816 - DNA, 164 bp, Artificial Sequence
  Synthetic polynucleotide
atcatctcaccttgcctcctgatcagccattgcgtcgtcctgcagggtgacgccaagagtgacgccatcggtgacgccagacgtgacgccactagtgacgccaactgtgacgccatgcgtgacgccagtagtgacgccaggcgcgccatgcttcatcagactct

SEQ ID NO: 6817 - DNA, 164 bp, Artificial Sequence; identical to SEQ ID NO: 6816
  Synthetic polynucleotide

SEQ ID NO: 6818 - DNA, 197 bp, Artificial Sequence
  Synthetic polynucleotide
atcatctcaccttgcctcctgtggttagtcaacaccatcctgcagggggtcaagggggtgaagagggtcaagggggtgatcggggtcaagggggtgagacgggtcaagggggtgactagggtcaagggggtgaactgggtcaagggggtgatgcgggtcaagggggtgagtaggcgcgccatgcttcatcagactct

SEQ ID NO: 6819 - DNA, 197 bp, Artificial Sequence; identical to SEQ ID NO: 6818
  Synthetic polynucleotide

SEQ ID NO: 6820 - DNA, 190 bp, Artificial Sequence
  Synthetic polynucleotide
atcatctcaccttgcctcctgtgatcacgaagatacgacctgcaggaacgtgactcagcaagaaacgtgactcagcatcgaacgtgactcagcagacaacgtgactcagcactaaacgtgactcagcaactaacgtgactcagcatgcaacgtgactcagcagtaggcgcgccatgcttcatcagactct

SEQ ID NO: 6821 - DNA, 190 bp, Artificial Sequence; identical to SEQ ID NO: 6820
  Synthetic polynucleotide

SEQ ID NO: 6822 - DNA, 164 bp, Artificial Sequence
  Synthetic polynucleotide
atcatctcaccttgcctcctgggcgagcaagaaccttgcctgcaggtgacgtaagagatgacgtaagtcgtgacgtaaggactgacgtaagctatgacgtaagacttgacgtaagtgctgacgtaaggtatgacgtaagggcgcgccatgcttcatcagactct

SEQ ID NO: 6823 - DNA, 164 bp, Artificial Sequence; identical to SEQ ID NO: 6822
  Synthetic polynucleotide

SEQ ID NO: 6824 - DNA, 156 bp, Artificial Sequence
  Synthetic polynucleotide
atcatctcaccttgcctcctgccgtaccacgcgatttccctgcaggttaatccgagattaatccgtcgttaatccggacttaatccgctattaatccgactttaatccgtgcttaatccggtattaatccgggcgcgccatgcttcatcagactct

SEQ ID NO: 6825 - DNA, 156 bp, Artificial Sequence; identical to SEQ ID NO: 6824
  Synthetic polynucleotide

SEQ ID NO: 6826 - DNA, 188 bp, Artificial Sequence
  Synthetic polynucleotide
atcatctcaccttgcctcctgttgcgctcataagcgagcctgcaggtttccaggaattagatttccaggaatttcgtttccaggaattgactttccaggaattctatttccaggaattacttttccaggaatttgctttccaggaattgtatttccaggaattggcgcgccatgcttcatcagactct

SEQ ID NO: 6827 - DNA, 188 bp, Artificial Sequence; identical to SEQ ID NO: 6826
  Synthetic polynucleotide

SEQ ID NO: 6828 - DNA, 197 bp, Artificial Sequence
  Synthetic polynucleotide
atcatctcaccttgcctcctgcggagagctacatttcgcctgcaggatttgcataacaatgagaatttgcataacaatgtcgatttgcataacaatggacatttgcataacaatgctaatttgcataacaatgactatttgcataacaatgtgcatttgcataacaatggtaggcgcgccatgcttcatcagactct

SEQ ID NO: 6829 - DNA, 197 bp, Artificial Sequence; identical to SEQ ID NO: 6828
  Synthetic polynucleotide

SEQ ID NO: 6830 - DNA, 164 bp, Artificial Sequence
  Synthetic polynucleotide
atcatctcaccttgcctcctggagcacgagtagaatcgcctgcaggaaaagtcaaagaaaaagtcaatcgaaaagtcaagacaaaagtcaactaaaaagtcaaactaaaagtcaatgcaaaagtcaagtaaaaagtcaaggcgcgccatgcttcatcagactct

SEQ ID NO: 6831 - DNA, 164 bp, Artificial Sequence; identical to SEQ ID NO: 6830
  Synthetic polynucleotide

SEQ ID NO: 6832 - DNA, 180 bp, Artificial Sequence
  Synthetic polynucleotide
atcatctcaccttgcctcctggcccatataaatatctccctgcaggctcgcgggaccagactcgcgggacctcgctcgcgggaccgacctcgcgggaccctactcgcgggaccactctcgcgggacctgcctcgcgggaccgtactcgcgggaccggcgcgccatgcttcatcagactct

SEQ ID NO: 6833 - DNA, 180 bp, Artificial Sequence; identical to SEQ ID NO: 6832
  Synthetic polynucleotide

SEQ ID NO: 6834 - DNA, 185 bp, Artificial Sequence
  Synthetic polynucleotide
atcatctcaccttgcctcctgcagaagaggatcacctccctgcaggcagaacagattgtaccagacagaacagattgtacctcgcagaacagattgtaccgaccagaacagattgtaccctacagaacagattgtaccactcagaacagattgtacctgcggcgcgccatgcttcatcagactct

SEQ ID NO: 6835 - DNA, 185 bp, Artificial Sequence; identical to SEQ ID NO: 6834
  Synthetic polynucleotide

SEQ ID NO: 6836 - DNA, 191 bp, Artificial Sequence
  Synthetic polynucleotide
atcatctcaccttgcctcctgcttagattagtaacccgcctgcaggcaaactaattaattatcagacaaactaattaattatctcgcaaactaattaattatcgaccaaactaattaattatcctacaaactaattaattatcactcaaactaattaattatctgcggcgcgccatgcttcatcagactct

SEQ ID NO: 6837 - DNA, 191 bp, Artificial Sequence; identical to SEQ ID NO: 6836
  Synthetic polynucleotide

SEQ ID NO: 6838 - DNA, 188 bp, Artificial Sequence
  Synthetic polynucleotide
atcatctcaccttgcctcctggctattaacttctgaggcctgcaggtattgtttatttagatattgtttattttcgtattgtttatttgactattgtttatttctatattgtttatttacttattgtttattttgctattgtttatttgtatattgtttatttggcgcgccatgcttcatcagactct

SEQ ID NO: 6839 - DNA, 188 bp, Artificial Sequence; identical to SEQ ID NO: 6838
  Synthetic polynucleotide

SEQ ID NO: 6840 - DNA, 191 bp, Artificial Sequence
  Synthetic polynucleotide
atcatctcaccttgcctcctgactaaatcttcgcactacctgcaggctaaggttctagatcacagactaaggttctagatcactcgctaaggttctagatcacgacctaaggttctagatcacctactaaggttctagatcacactctaaggttctagatcactgcggcgcgccatgcttcatcagactct

SEQ ID NO: 6841 - DNA, 191 bp, Artificial Sequence; identical to SEQ ID NO: 6840
  Synthetic polynucleotide

SEQ ID NO: 6842 - DNA, 140 bp, Artificial Sequence
  Synthetic polynucleotide
atcatctcaccttgcctcctggttacgccgatgtcattcctgcaggattaaaagaattaaatcgattaaagacattaaactaattaaaactattaaatgcattaaagtaattaaaggcgcgccatgcttcatcagactct

SEQ ID NO: 6843 - DNA, 140 bp, Artificial Sequence; identical to SEQ ID NO: 6842
  Synthetic polynucleotide

SEQ ID NO: 6844 - DNA, 191 bp, Artificial Sequence
  Synthetic polynucleotide
atcatctcaccttgcctcctgggctggaaacaatggtccctgcaggtcctcctccccctcctcctccagatcctcctccccctcctcctcctcgtcctcctccccctcctcctccgactcctcctccccctcctcctccctatcctcctccccctcctcctccactggcgcgccatgcttcatcagactct

SEQ ID NO: 6845 - DNA, 191 bp, Artificial Sequence; identical to SEQ ID NO: 6844
  Synthetic polynucleotide

SEQ ID NO: 6846 - DNA, 148 bp, Artificial Sequence
  Synthetic polynucleotide
atcatctcaccttgcctcctgttcgacccaggaggaatcctgcaggcagttggagacagttggtcgcagttgggaccagttggctacagttggactcagttggtgccagttgggtacagttggggcgcgccatgcttcatcagactct

SEQ ID NO: 6847 - DNA, 148 bp, Artificial Sequence; identical to SEQ ID NO: 6846
  Synthetic polynucleotide

SEQ ID NO: 6848 - DNA, 180 bp, Artificial Sequence
  Synthetic polynucleotide
atcatctcaccttgcctcctggttgtctaggtacatgtcctgcaggtgtttactcagagatgtttactcagtcgtgtttactcaggactgtttactcagctatgtttactcagacttgtttactcagtgctgtttactcaggtatgtttactcagggcgcgccatgcttcatcagactct

SEQ ID NO: 6849 - DNA, 180 bp, Artificial Sequence; identical to SEQ ID NO: 6848
  Synthetic polynucleotide

SEQ ID NO: 6850 - DNA, 196 bp, Artificial Sequence
  Synthetic polynucleotide
atcatctcaccttgcctcctgacgacagcgctattaggcctgcaggattaattaattttagaattaattaatttttcgattaattaattttgacattaattaattttctaattaattaattttactattaattaatttttgcattaattaattttgtaattaattaattttggcgcgccatgcttcatcagactct

SEQ ID NO: 6851 - DNA, 196 bp, Artificial Sequence; identical to SEQ ID NO: 6850
  Synthetic polynucleotide

SEQ ID NO: 6852 - DNA, 180 bp, Artificial Sequence
  Synthetic polynucleotide
atcatctcaccttgcctcctggtgcaccataaaccgggcctgcaggggtgactcagtagaggtgactcagttcgggtgactcagtgacggtgactcagtctaggtgactcagtactggtgactcagttgcggtgactcagtgtaggtgactcagtggcgcgccatgcttcatcagactct

SEQ ID NO: 6853 - DNA, 180 bp, Artificial Sequence; identical to SEQ ID NO: 6852
  Synthetic polynucleotide

SEQ ID NO: 6854 - DNA, 172 bp, Artificial Sequence
  Synthetic polynucleotide
atcatctcaccttgcctcctgaccatctggtaactcagcctgcagggtcataaaaaagagtcataaaaatcggtcataaaaagacgtcataaaaactagtcataaaaaactgtcataaaaatgcgtcataaaaagtagtcataaaaaggcgcgccatgcttcatcagactct

SEQ ID NO: 6855 - DNA, 172 bp, Artificial Sequence; identical to SEQ ID NO: 6854
  Synthetic polynucleotide

SEQ ID NO: 6856 - DNA, 156 bp, Artificial Sequence
  Synthetic polynucleotide
atcatctcaccttgcctcctgtgagactctaaccataacctgcaggttaatcccagattaatccctcgttaatcccgacttaatcccctattaatcccactttaatccctgcttaatcccgtattaatcccggcgcgccatgcttcatcagactct

SEQ ID NO: 6857 - DNA, 156 bp, Artificial Sequence; identical to SEQ ID NO: 6856
  Synthetic polynucleotide

SEQ ID NO: 6858 - DNA, 172 bp, Artificial Sequence
  Synthetic polynucleotide
atcatctcaccttgcctcctgtccctctgcatggtacgcctgcaggcctgaggcgaagacctgaggcgatcgcctgaggcgagaccctgaggcgactacctgaggcgaactcctgaggcgatgccctgaggcgagtacctgaggcgaggcgcgccatgcttcatcagactct

SEQ ID NO: 6859 - DNA, 172 bp, Artificial Sequence; identical to SEQ ID NO: 6858
  Synthetic polynucleotide

SEQ ID NO: 6860 - DNA, 196 bp, Artificial Sequence
  Synthetic polynucleotide
atcatctcaccttgcctcctgggtcgatcaattgaggccctgcaggagagggggccctaagaagagggggccctatcgagagggggccctagacagagggggccctactaagagggggccctaactagagggggccctatgcagagggggccctagtaagagggggccctaggcgcgccatgcttcatcagactct

SEQ ID NO: 6861 - DNA, 196 bp, Artificial Sequence; identical to SEQ ID NO: 6860
  Synthetic polynucleotide

SEQ ID NO: 6862 - DNA, 164 bp, Artificial Sequence
  Synthetic polynucleotide
atcatctcaccttgcctcctgctactaagctgacggagcctgcaggatatatataagaatatatatatcgatatatatagacatatatatactaatatatataactatatatatatgcatatatatagtaatatatataggcgcgccatgcttcatcagactct

SEQ ID NO: 6863 - DNA, 164 bp, Artificial Sequence; identical to SEQ ID NO: 6862
  Synthetic polynucleotide

SEQ ID NO: 6864 - DNA, 191 bp, Artificial Sequence
  Synthetic polynucleotide
atcatctcaccttgcctcctggagaatgcgtcaaacggcctgcaggcaaagtaattaattatcagacaaagtaattaattatctcgcaaagtaattaattatcgaccaaagtaattaattatcctacaaagtaattaattatcactcaaagtaattaattatctgcggcgcgccatgcttcatcagactct

SEQ ID NO: 6865 - DNA, 191 bp, Artificial Sequence; identical to SEQ ID NO: 6864
  Synthetic polynucleotide

SEQ ID NO: 6866 - DNA, 190 bp, Artificial Sequence
  Synthetic polynucleotide
atcatctcaccttgcctcctgatcgaatatcgcctgatcctgcaggagggtcaatgacctagaagggtcaatgaccttcgagggtcaatgacctgacagggtcaatgacctctaagggtcaatgacctactagggtcaatgaccttgcagggtcaatgacctgtaggcgcgccatgcttcatcagactct

SEQ ID NO: 6867 - DNA, 190 bp, Artificial Sequence; identical to SEQ ID NO: 6866
  Synthetic polynucleotide

SEQ ID NO: 6868 - DNA, 164 bp, Artificial Sequence
  Synthetic polynucleotide
atcatctcaccttgcctcctgagcgagttagatcgtgccctgcaggctaattaccagactaattacctcgctaattaccgacctaattaccctactaattaccactctaattacctgcctaattaccgtactaattaccggcgcgccatgcttcatcagactct

SEQ ID NO: 6869 - DNA, 164 bp, Artificial Sequence; identical to SEQ ID NO: 6868
  Synthetic polynucleotide

SEQ ID NO: 6870 - DNA, 191 bp, Artificial Sequence
  Synthetic polynucleotide
atcatctcaccttgcctcctgattgctggaacagtacacctgcaggcgaattaattaattactagacgaattaattaattacttcgcgaattaattaattactgaccgaattaattaattactctacgaattaattaattactactcgaattaattaattacttgcggcgcgccatgcttcatcagactct

SEQ ID NO: 6871 - DNA, 191 bp, Artificial Sequence; identical to SEQ ID NO: 6870
  Synthetic polynucleotide

SEQ ID NO: 6872 - DNA, 172 bp, Artificial Sequence
  Synthetic polynucleotide
atcatctcaccttgcctcctgagtctgccctatataaacctgcaggtacacctgtcagatacacctgtctcgtacacctgtcgactacacctgtcctatacacctgtcacttacacctgtctgctacacctgtcgtatacacctgtcggcgcgccatgcttcatcagactct

SEQ ID NO: 6873 - DNA, 172 bp, Artificial Sequence; identical to SEQ ID NO: 6872
  Synthetic polynucleotide

SEQ ID NO: 6874 - DNA, 172 bp, Artificial Sequence
  Synthetic polynucleotide
atcatctcaccttgcctcctggggtgacactggtccaacctgcaggttaattggttagattaattggtttcgttaattggttgacttaattggttctattaattggttactttaattggtttgcttaattggttgtattaattggttggcgcgccatgcttcatcagactct

SEQ ID NO: 6875 - DNA, 172 bp, Artificial Sequence; identical to SEQ ID NO: 6874
  Synthetic polynucleotide

SEQ ID NO: 6876 - DNA, 191 bp, Artificial Sequence
  Synthetic polynucleotide
atcatctcaccttgcctcctgggagagtttcgtgtttccctgcaggaaccggtttaaccggttagaaaccggtttaaccggtttcgaaccggtttaaccggttgacaaccggtttaaccggttctaaaccggtttaaccggttactaaccggtttaaccggtttgcggcgcgccatgcttcatcagactct

SEQ ID NO: 6877 - DNA, 191 bp, Artificial Sequence; identical to SEQ ID NO: 6876
  Synthetic polynucleotide

SEQ ID NO: 6878 - DNA, 188 bp, Artificial Sequence
  Synthetic polynucleotide
atcatctcaccttgcctcctgttagcagcggtcgagtccctgcagggagctgtcatttagagagctgtcattttcggagctgtcatttgacgagctgtcatttctagagctgtcatttactgagctgtcattttgcgagctgtcatttgtagagctgtcatttggcgcgccatgcttcatcagactct

SEQ ID NO: 6879 - DNA, 188 bp, Artificial Sequence; identical to SEQ ID NO: 6878
  Synthetic polynucleotide

SEQ ID NO: 6880 - DNA, 180 bp, Artificial Sequence
  Synthetic polynucleotide
atcatctcaccttgcctcctgtgggagagcgtgtatggcctgcaggggtggggtgagagaggtggggtgagtcgggtggggtgaggacggtggggtgagctaggtggggtgagactggtggggtgagtgcggtggggtgaggtaggtggggtgagggcgcgccatgcttcatcagactct

SEQ ID NO: 6881 - DNA, 180 bp, Artificial Sequence; identical to SEQ ID NO: 6880
  Synthetic polynucleotide

SEQ ID NO: 6882 - DNA, 172 bp, Artificial Sequence
  Synthetic polynucleotide
atcatctcaccttgcctcctgcacatgcagggaacatacctgcaggtttttatgacagatttttatgactcgtttttatgacgactttttatgacctatttttatgacacttttttatgactgctttttatgacgtatttttatgacggcgcgccatgcttcatcagactct

SEQ ID NO: 6883 - DNA, 172 bp, Artificial Sequence; identical to SEQ ID NO: 6882
  Synthetic polynucleotide

SEQ ID NO: 6884 - DNA, 191 bp, Artificial Sequence
  Synthetic polynucleotide
atcatctcaccttgcctcctgcgagatagttaagtctgcctgcagggcctgctgggagttgtagtccagagcctgctgggagttgtagtcctcggcctgctgggagttgtagtccgacgcctgctgggagttgtagtccctagcctgctgggagttgtagtccactggcgcgccatgcttcatcagactct

SEQ ID NO: 6885 - DNA, 191 bp, Artificial Sequence; identical to SEQ ID NO: 6884
  Synthetic polynucleotide

SEQ ID NO: 6886 - DNA, 191 bp, Artificial Sequence
  Synthetic polynucleotide
atcatctcaccttgcctcctgaagcattaaggcatatgcctgcaggaggtacacggtgtacccagaaggtacacggtgtaccctcgaggtacacggtgtacccgacaggtacacggtgtacccctaaggtacacggtgtacccactaggtacacggtgtaccctgcggcgcgccatgcttcatcagactct

SEQ ID NO: 6887 - DNA, 191 bp, Artificial Sequence; identical to SEQ ID NO: 6886
  Synthetic polynucleotide

SEQ ID NO: 6888 - DNA, 156 bp, Artificial Sequence
  Synthetic polynucleotide
atcatctcaccttgcctcctgtctgcaacggctaaccacctgcaggggtatcatagaggtatcattcgggtatcatgacggtatcatctaggtatcatactggtatcattgcggtatcatgtaggtatcatggcgcgccatgcttcatcagactct

SEQ ID NO: 6889 - DNA, 156 bp, Artificial Sequence; identical to SEQ ID NO: 6888
  Synthetic polynucleotide

SEQ ID NO: 6890 - DNA, 190 bp, Artificial Sequence
  Synthetic polynucleotide
atcatctcaccttgcctcctggcccagcgaacatcacacctgcaggagcatgactcagcaagaagcatgactcagcatcgagcatgactcagcagacagcatgactcagcactaagcatgactcagcaactagcatgactcagcatgcagcatgactcagcagtaggcgcgccatgcttcatcagactct

SEQ ID NO: 6891 - DNA, 190 bp, Artificial Sequence; identical to SEQ ID NO: 6890
  Synthetic polynucleotide

SEQ ID NO: 6892 - DNA, 197 bp, Artificial Sequence
  Synthetic polynucleotide
atcatctcaccttgcctcctgttcttgacgttatgtgtcctgcaggatattcgcgattattagaatattcgcgattatttcgatattcgcgattattgacatattcgcgattattctaatattcgcgattattactatattcgcgattatttgcatattcgcgattattgtaggcgcgccatgcttcatcagactct

SEQ ID NO: 6893 - DNA, 197 bp, Artificial Sequence; identical to SEQ ID NO: 6892
  Synthetic polynucleotide

SEQ ID NO: 6894 - DNA, 164 bp, Artificial Sequence
  Synthetic polynucleotide
atcatctcaccttgcctcctggatacgacaagcgttaccctgcagggtgacgtcaagagtgacgtcatcggtgacgtcagacgtgacgtcactagtgacgtcaactgtgacgtcatgcgtgacgtcagtagtgacgtcaggcgcgccatgcttcatcagactct

SEQ ID NO: 6895 - DNA, 164 bp, Artificial Sequence; identical to SEQ ID NO: 6894
  Synthetic polynucleotide

SEQ ID NO: 6896 - DNA, 185 bp, Artificial Sequence
  Synthetic polynucleotide
atcatctcaccttgcctcctgtgttgtttcattagggtcctgcagggttgccatggcgacggagagttgccatggcgacggtcggttgccatggcgacgggacgttgccatggcgacggctagttgccatggcgacggactgttgccatggcgacggtgcggcgcgccatgcttcatcagactct

SEQ ID NO: 6897 - DNA, 185 bp, Artificial Sequence; identical to SEQ ID NO: 6896
  Synthetic polynucleotide

SEQ ID NO: 6898 - DNA, 156 bp, Artificial Sequence
  Synthetic polynucleotide
atcatctcaccttgcctcctgtaaactcattaggcccgcctgcaggttaatcctagattaatccttcgttaatcctgacttaatcctctattaatcctactttaatccttgcttaatcctgtattaatcctggcgcgccatgcttcatcagactct

SEQ ID NO: 6899 - DNA, 156 bp, Artificial Sequence; identical to SEQ ID NO: 6898
  Synthetic polynucleotide

SEQ ID NO: 6900 - DNA, 172 bp, Artificial Sequence
  Synthetic polynucleotide
atcatctcaccttgcctcctgaggaacatcagaatacacctgcagggcatattcatagagcatattcattcggcatattcatgacgcatattcatctagcatattcatactgcatattcattgcgcatattcatgtagcatattcatggcgcgccatgcttcatcagactct

SEQ ID NO: 6901 - DNA, 172 bp, Artificial Sequence; identical to SEQ ID NO: 6900
  Synthetic polynucleotide

SEQ ID NO: 6902 - DNA, 197 bp, Artificial Sequence
  Synthetic polynucleotide
atcatctcaccttgcctcctgcccagttggttcaggcacctgcaggtctgcgtcaacccccagatctgcgtcaaccccctcgtctgcgtcaacccccgactctgcgtcaacccccctatctgcgtcaacccccacttctgcgtcaaccccctgctctgcgtcaacccccgtaggcgcgccatgcttcatcagactct

SEQ ID NO: 6903 - DNA, 197 bp, Artificial Sequence; identical to SEQ ID NO: 6902
  Synthetic polynucleotide

SEQ ID NO: 6904 - DNA, 196 bp, Artificial Sequence
  Synthetic polynucleotide
atcatctcaccttgcctcctggaggttcgagcaatccccctgcaggaacccggaagtaaagaaacccggaagtaatcgaacccggaagtaagacaacccggaagtaactaaacccggaagtaaactaacccggaagtaatgcaacccggaagtaagtaaacccggaagtaaggcgcgccatgcttcatcagactct

SEQ ID NO: 6905 - DNA, 196 bp, Artificial Sequence; identical to SEQ ID NO: 6904
  Synthetic polynucleotide

SEQ ID NO: 6906 - DNA, 190 bp, Artificial Sequence
  Synthetic polynucleotide
atcatctcaccttgcctcctgacaatcttgcccatgtccctgcaggaccatgactcagcaagaaccatgactcagcatcgaccatgactcagcagacaccatgactcagcactaaccatgactcagcaactaccatgactcagcatgcaccatgactcagcagtaggcgcgccatgcttcatcagactct

SEQ ID NO: 6907 - DNA, 190 bp, Artificial Sequence; identical to SEQ ID NO: 6906
  Synthetic polynucleotide

SEQ ID NO: 6908 - DNA, 164 bp, Artificial Sequence
  Synthetic polynucleotide
atcatctcaccttgcctcctgaaatttgcttcctcactcctgcaggtcattaacgagatcattaacgtcgtcattaacggactcattaacgctatcattaacgacttcattaacgtgctcattaacggtatcattaacgggcgcgccatgcttcatcagactct

SEQ ID NO: 6909 - DNA, 164 bp, Artificial Sequence; identical to SEQ ID NO: 6908
  Synthetic polynucleotide

SEQ ID NO: 6910 - DNA, 191 bp, Artificial Sequence
  Synthetic polynucleotide
atcatctcaccttgcctcctggtaccacggagtacatgcctgcaggcctagatggcaggtgggagacctagatggcaggtgggtcgcctagatggcaggtggggaccctagatggcaggtgggctacctagatggcaggtgggactcctagatggcaggtgggtgcggcgcgccatgcttcatcagactct

SEQ ID NO: 6911 - DNA, 191 bp, Artificial Sequence; identical to SEQ ID NO: 6910
  Synthetic polynucleotide

SEQ ID NO: 6912 - DNA, 164 bp, Artificial Sequence
  Synthetic polynucleotide
atcatctcaccttgcctcctgcgttccctgttgtggtgcctgcaggataattgccagaataattgcctcgataattgccgacataattgccctaataattgccactataattgcctgcataattgccgtaataattgccggcgcgccatgcttcatcagactct

SEQ ID NO: 6913 - DNA, 164 bp, Artificial Sequence; identical to SEQ ID NO: 6912
  Synthetic polynucleotide

SEQ ID NO: 6914 - DNA, 191 bp, Artificial Sequence
  Synthetic polynucleotide
atcatctcaccttgcctcctggtgaatccgcgtggagacctgcagggcagccgctgggagcggagagcagccgctgggagcggtcggcagccgctgggagcgggacgcagccgctgggagcggctagcagccgctgggagcggactgcagccgctgggagcggtgcggcgcgccatgcttcatcagactct

SEQ ID NO: 6915 - DNA, 191 bp, Artificial Sequence; identical to SEQ ID NO: 6914
  Synthetic polynucleotide

SEQ ID NO: 6916 - DNA, 190 bp, Artificial Sequence
  Synthetic polynucleotide
atcatctcaccttgcctcctgtgagctttaaatcgtcccctgcaggtgctttcactttccagatgctttcactttcctcgtgctttcactttccgactgctttcactttccctatgctttcactttccacttgctttcactttcctgctgctttcactttccgtaggcgcgccatgcttcatcagactct

SEQ ID NO: 6917 - DNA, 190 bp, Artificial Sequence; identical to SEQ ID NO: 6916
  Synthetic polynucleotide

SEQ ID NO: 6918 - DNA, 185 bp, Artificial Sequence
  Synthetic polynucleotide
atcatctcaccttgcctcctgcgtgttgagagtcaccccctgcagggagtgctgtgatttatagagagtgctgtgatttattcggagtgctgtgatttatgacgagtgctgtgatttatctagagtgctgtgatttatactgagtgctgtgatttattgcggcgcgccatgcttcatcagactct

SEQ ID NO: 6919 - DNA, 185 bp, Artificial Sequence; identical to SEQ ID NO: 6918
  Synthetic polynucleotide

SEQ ID NO: 6920 - DNA, 172 bp, Artificial Sequence
  Synthetic polynucleotide
atcatctcaccttgcctcctgctagagcaagctgcatgcctgcaggcaaatcactgagacaaatcactgtcgcaaatcactggaccaaatcactgctacaaatcactgactcaaatcactgtgccaaatcactggtacaaatcactgggcgcgccatgcttcatcagactct

SEQ ID NO: 6921 - DNA, 172 bp, Artificial Sequence; identical to SEQ ID NO: 6920
  Synthetic polynucleotide

SEQ ID NO: 6922 - DNA, 186 bp, Artificial Sequence
  Synthetic polynucleotide
atcatctcaccttgcctcctgtggtgaacgacggataccctgcaggagcagccaagatggccgcggagaagcagccaagatggccgcggtcgagcagccaagatggccgcgggacagcagccaagatggccgcggctaagcagccaagatggccgcggactggcgcgccatgcttcatcagactct

SEQ ID NO: 6923 - DNA, 186 bp, Artificial Sequence; identical to SEQ ID NO: 6922
  Synthetic polynucleotide

SEQ ID NO: 6924 - DNA, 156 bp, Artificial Sequence
  Synthetic polynucleotide
atcatctcaccttgcctcctgcgtgaccacgcttacaccctgcaggccaattatagaccaattattcgccaattatgacccaattatctaccaattatactccaattattgcccaattatgtaccaattatggcgcgccatgcttcatcagactct

SEQ ID NO: 6925 - DNA, 156 bp, Artificial Sequence; identical to SEQ ID NO: 6924
  Synthetic polynucleotide

SEQ ID NO: 6926 - DNA, 190 bp, Artificial Sequence
  Synthetic polynucleotide
atcatctcaccttgcctcctgcacgaagggctgacttacctgcaggtttgcctagtaactagatttgcctagtaacttcgtttgcctagtaactgactttgcctagtaactctatttgcctagtaactacttttgcctagtaacttgctttgcctagtaactgtaggcgcgccatgcttcatcagactct

SEQ ID NO: 6927 - DNA, 190 bp, Artificial Sequence; identical to SEQ ID NO: 6926
  Synthetic polynucleotide

SEQ ID NO: 6928 - DNA, 196 bp, Artificial Sequence
  Synthetic polynucleotide
atcatctcaccttgcctcctgtatcgctgccagccaatcctgcaggaccacctgttgcaagaaccacctgttgcatcgaccacctgttgcagacaccacctgttgcactaaccacctgttgcaactaccacctgttgcatgcaccacctgttgcagtaaccacctgttgcaggcgcgccatgcttcatcagactct

SEQ ID NO: 6929 - DNA, 196 bp, Artificial Sequence; identical to SEQ ID NO: 6928
  Synthetic polynucleotide

SEQ ID NO: 6930 - DNA, 191 bp, Artificial Sequence
  Synthetic polynucleotide
atcatctcaccttgcctcctgaacttgctagggcccgacctgcaggtacatgtgcacataaaaagatacatgtgcacataaaatcgtacatgtgcacataaaagactacatgtgcacataaaactatacatgtgcacataaaaacttacatgtgcacataaaatgcggcgcgccatgcttcatcagactct

SEQ ID NO: 6931 - DNA, 191 bp, Artificial Sequence; identical to SEQ ID NO: 6930
  Synthetic polynucleotide

SEQ ID NO: 6932 - DNA, 172 bp, Artificial Sequence
  Synthetic polynucleotide
atcatctcaccttgcctcctgtagtcgagcctatcgaacctgcaggattgcgcaatagaattgcgcaattcgattgcgcaatgacattgcgcaatctaattgcgcaatactattgcgcaattgcattgcgcaatgtaattgcgcaatggcgcgccatgcttcatcagactct

SEQ ID NO: 6933 - DNA, 172 bp, Artificial Sequence; identical to SEQ ID NO: 6932
  Synthetic polynucleotide

SEQ ID NO: 6934 - DNA, 156 bp, Artificial Sequence
  Synthetic polynucleotide
atcatctcaccttgcctcctggtgaccctgtgtgcatccctgcaggttaattgcagattaattgctcgttaattgcgacttaattgcctattaattgcactttaattgctgcttaattgcgtattaattgcggcgcgccatgcttcatcagactct

SEQ ID NO: 6935 - DNA, 156 bp, Artificial Sequence; identical to SEQ ID NO: 6934
  Synthetic polynucleotide

SEQ ID NO: 6936 - DNA, 196 bp, Artificial Sequence
  Synthetic polynucleotide
atcatctcaccttgcctcctggtaggagggcagaagatcctgcaggtgacagctgctgcagatgacagctgctgctcgtgacagctgctgcgactgacagctgctgcctatgacagctgctgcacttgacagctgctgctgctgacagctgctgcgtatgacagctgctgcggcgcgccatgcttcatcagactct

SEQ ID NO: 6937 - DNA, 196 bp, Artificial Sequence; identical to SEQ ID NO: 6936
  Synthetic polynucleotide

SEQ ID NO: 6938 - DNA, 195 bp, Artificial Sequence
  Synthetic polynucleotide
atcatctcaccttgcctcctgaatcaatcggtcgtggacctgcaggtcgaggcgcaatgatgcgtagccgccccagatcgaggcgcaatgatgcgtagccgcccctcgtcgaggcgcaatgatgcgtagccgccccgactcgaggcgcaatgatgcgtagccgccccctaggcgcgccatgcttcatcagactct

SEQ ID NO: 6939 - DNA, 195 bp, Artificial Sequence; identical to SEQ ID NO: 6938
  Synthetic polynucleotide

SEQ ID NO: 6940 - DNA, 196 bp, Artificial Sequence
  Synthetic polynucleotide
atcatctcaccttgcctcctgtgtggacagaagtacctcctgcagggaaaagtgaaaccagagaaaagtgaaacctcggaaaagtgaaaccgacgaaaagtgaaaccctagaaaagtgaaaccactgaaaagtgaaacctgcgaaaagtgaaaccgtagaaaagtgaaaccggcgcgccatgcttcatcagactct

SEQ ID NO: 6941 - DNA, 196 bp, Artificial Sequence; identical to SEQ ID NO: 6940
  Synthetic polynucleotide

SEQ ID NO: 6942 - DNA, 197 bp, Artificial Sequence
  Synthetic polynucleotide
atcatctcaccttgcctcctggttacatgtgacggacccctgcagggccatctccttatatgggagagccatctccttatatgggtcggccatctccttatatggggacgccatctccttatatgggctagccatctccttatatgggactgccatctccttatatgggtgcggcgcgccatgcttcatcagactct

SEQ ID NO: 6943 - DNA, 197 bp, Artificial Sequence; identical to SEQ ID NO: 6942
  Synthetic polynucleotide

SEQ ID NO: 6944 - DNA, 185 bp, Artificial Sequence
  Synthetic polynucleotide
atcatctcaccttgcctcctgactggtgttagaacgaacctgcaggttacctgattaggaaaagattacctgattaggaaatcgttacctgattaggaaagacttacctgattaggaaactattacctgattaggaaaactttacctgattaggaaatgcggcgcgccatgcttcatcagactct

SEQ ID NO: 6945 - DNA, 185 bp, Artificial Sequence; identical to SEQ ID NO: 6944
  Synthetic polynucleotide

SEQ ID NO: 6946 - DNA, 180 bp, Artificial Sequence
  Synthetic polynucleotide
atcatctcaccttgcctcctgtcctttgataccaccgtcctgcaggattgtgtccgtagaattgtgtccgttcgattgtgtccgtgacattgtgtccgtctaattgtgtccgtactattgtgtccgttgcattgtgtccgtgtaattgtgtccgtggcgcgccatgcttcatcagactct

SEQ ID NO: 6947 - DNA, 180 bp, Artificial Sequence; identical to SEQ ID NO: 6946
  Synthetic polynucleotide

SEQ ID NO: 6948 - DNA, 156 bp, Artificial Sequence
  Synthetic polynucleotide
atcatctcaccttgcctcctgctattgcctcgatatgacctgcaggttaattgaagattaattgatcgttaattgagacttaattgactattaattgaactttaattgatgcttaattgagtattaattgaggcgcgccatgcttcatcagactct

SEQ ID NO: 6949 - DNA, 156 bp, Artificial Sequence; identical to SEQ ID NO: 6948
  Synthetic polynucleotide

SEQ ID NO: 6950 - DNA, 156 bp, Artificial Sequence
  Synthetic polynucleotide
atcatctcaccttgcctcctggcaaggtgcctcaactacctgcaggccaattagagaccaattagtcgccaattaggacccaattagctaccaattagactccaattagtgcccaattaggtaccaattagggcgcgccatgcttcatcagactct

SEQ ID NO: 6951 - DNA, 156 bp, Artificial Sequence; identical to SEQ ID NO: 6950
  Synthetic polynucleotide

SEQ ID NO: 6952 - DNA, 190 bp, Artificial Sequence
  Synthetic polynucleotide
atcatctcaccttgcctcctgcgttgtttgggagcttgcctgcagggcgtttatggcgacagagcgtttatggcgactcggcgtttatggcgacgacgcgtttatggcgacctagcgtttatggcgacactgcgtttatggcgactgcgcgtttatggcgacgtaggcgcgccatgcttcatcagactct

SEQ ID NO: 6953 - DNA, 190 bp, Artificial Sequence; identical to SEQ ID NO: 6952
  Synthetic polynucleotide

SEQ ID NO: 6954 - DNA, 164 bp, Artificial Sequence
  Synthetic polynucleotide
atcatctcaccttgcctcctggctctattgctcagtatcctgcaggctaattaatagactaattaattcgctaattaatgacctaattaatctactaattaatactctaattaattgcctaattaatgtactaattaatggcgcgccatgcttcatcagactct

SEQ ID NO: 6955 - DNA, 164 bp, Artificial Sequence; identical to SEQ ID NO: 6954
  Synthetic polynucleotide

SEQ ID NO: 6956 - DNA, 197 bp, Artificial Sequence
  Synthetic polynucleotide
atcatctcaccttgcctcctgcttaggtaacaggttggcctgcaggttgatacattgttgcagattgatacattgttgctcgttgatacattgttgcgacttgatacattgttgcctattgatacattgttgcactttgatacattgttgctgcttgatacattgttgcgtaggcgcgccatgcttcatcagactct

SEQ ID NO: 6957 - DNA, 197 bp, Artificial Sequence; identical to SEQ ID NO: 6956
  Synthetic polynucleotide

SEQ ID NO: 6958 - DNA, 180 bp, Artificial Sequence
  Synthetic polynucleotide
atcatctcaccttgcctcctgaaatgagggagatcgtccctgcaggaacacctgttgagaaacacctgttgtcgaacacctgttggacaacacctgttgctaaacacctgttgactaacacctgttgtgcaacacctgttggtaaacacctgttgggcgcgccatgcttcatcagactct

SEQ ID NO: 6959 - DNA, 180 bp, Artificial Sequence; identical to SEQ ID NO: 6958
  Synthetic polynucleotide

SEQ ID NO: 6960 - DNA, 191 bp, Artificial Sequence
  Synthetic polynucleotide
atcatctcaccttgcctcctggactgctagttaagatccctgcaggcggccaccagggggcgccgggagacggccaccagggggcgccgggtcgcggccaccagggggcgccggggaccggccaccagggggcgccgggctacggccaccagggggcgccgggactggcgcgccatgcttcatcagactct

SEQ ID NO: 6961 - DNA, 191 bp, Artificial Sequence; identical to SEQ ID NO: 6960
  Synthetic polynucleotide

SEQ ID NO: 6962 - DNA, 191 bp, Artificial Sequence
  Synthetic polynucleotide
atcatctcaccttgcctcctgcagagctggcactaaggcctgcaggcggccaccagggggcgccggaagacggccaccagggggcgccggatcgcggccaccagggggcgccggagaccggccaccagggggcgccggactacggccaccagggggcgccggaactggcgcgccatgcttcatcagactct

SEQ ID NO: 6963 - DNA, 191 bp, Artificial Sequence; identical to SEQ ID NO: 6962
  Synthetic polynucleotide

SEQ ID NO: 6964 - DNA, 156 bp, Artificial Sequence
  Synthetic polynucleotide
atcatctcaccttgcctcctgcgagaacggcgaatcctcctgcaggccaattacagaccaattactcgccaattacgacccaattacctaccaattacactccaattactgcccaattacgtaccaattacggcgcgccatgcttcatcagactct

SEQ ID NO: 6965 - DNA, 156 bp, Artificial Sequence; identical to SEQ ID NO: 6964
  Synthetic polynucleotide

SEQ ID NO: 6966 - DNA, 156 bp, Artificial Sequence
  Synthetic polynucleotide
atcatctcaccttgcctcctgcctctgacacaaagacccctgcaggccaattaaagaccaattaatcgccaattaagacccaattaactaccaattaaactccaattaatgcccaattaagtaccaattaaggcgcgccatgcttcatcagactct

SEQ ID NO: 6967 - DNA, 156 bp, Artificial Sequence; identical to SEQ ID NO: 6966
  Synthetic polynucleotide

SEQ ID NO: 6968 - DNA, 186 bp, Artificial Sequence
  Synthetic polynucleotide
atcatctcaccttgcctcctggtttcagccatttcctccctgcaggtggccaccagggggcgctatagatggccaccagggggcgctattcgtggccaccagggggcgctatgactggccaccagggggcgctatctatggccaccagggggcgctatactggcgcgccatgcttcatcagactct

SEQ ID NO: 6969 - DNA, 186 bp, Artificial Sequence; identical to SEQ ID NO: 6968
  Synthetic polynucleotide

SEQ ID NO: 6970 - DNA, 156 bp, Artificial Sequence
  Synthetic polynucleotide
atcatctcaccttgcctcctgctgttaggagtgtaaagcctgcagggacaggtgagagacaggtgtcggacaggtggacgacaggtgctagacaggtgactgacaggtgtgcgacaggtggtagacaggtgggcgcgccatgcttcatcagactct

SEQ ID NO: 6971 - DNA, 156 bp, Artificial Sequence; identical to SEQ ID NO: 6970
  Synthetic polynucleotide

SEQ ID NO: 6972 - DNA, 197 bp, Artificial Sequence
  Synthetic polynucleotide
atcatctcaccttgcctcctgaattgagacctacttctcctgcaggggtgaacttgaacttgagagaggtgaacttgaacttgagtcgggtgaacttgaacttgaggacggtgaacttgaacttgagctaggtgaacttgaacttgagactggtgaacttgaacttgagtgcggcgcgccatgcttcatcagactct

SEQ ID NO: 6973 - DNA, 197 bp, Artificial Sequence; identical to SEQ ID NO: 6972
  Synthetic polynucleotide

SEQ ID NO: 6974 - DNA, 172 bp, Artificial Sequence
  Synthetic polynucleotide
atcatctcaccttgcctcctgggtagtggactacgaagcctgcagggggaattgtaagagggaattgtatcggggaattgtagacgggaattgtactagggaattgtaactgggaattgtatgcgggaattgtagtagggaattgtaggcgcgccatgcttcatcagactct

SEQ ID NO: 6975 - DNA, 172 bp, Artificial Sequence; identical to SEQ ID NO: 6974
  Synthetic polynucleotide

SEQ ID NO: 6976 - DNA, 180 bp, Artificial Sequence
  Synthetic polynucleotide
atcatctcaccttgcctcctgaaagatgaccagtttgtcctgcaggccccccgcctcagaccccccgcctctcgccccccgcctcgacccccccgcctcctaccccccgcctcactccccccgcctctgcccccccgcctcgtaccccccgcctcggcgcgccatgcttcatcagactct

SEQ ID NO: 6977 - DNA, 180 bp, Artificial Sequence; identical to SEQ ID NO: 6976
  Synthetic polynucleotide

SEQ ID NO: 6978 - DNA, 164 bp, Artificial Sequence
  Synthetic polynucleotide
atcatctcaccttgcctcctgttgcaggtgcgtttgaacctgcaggttaatcgctagattaatcgcttcgttaatcgctgacttaatcgctctattaatcgctactttaatcgcttgcttaatcgctgtattaatcgctggcgcgccatgcttcatcagactct

SEQ ID NO: 6979 - DNA, 164 bp, Artificial Sequence; identical to SEQ ID NO: 6978
  Synthetic polynucleotide

SEQ ID NO: 6980 - DNA, 172 bp, Artificial Sequence
  Synthetic polynucleotide
atcatctcaccttgcctcctggtgaaggctaaatactgcctgcagggatgacgtcaagagatgacgtcatcggatgacgtcagacgatgacgtcactagatgacgtcaactgatgacgtcatgcgatgacgtcagtagatgacgtcaggcgcgccatgcttcatcagactct

SEQ ID NO: 6981 - DNA, 172 bp, Artificial Sequence; identical to SEQ ID NO: 6980
  Synthetic polynucleotide

SEQ ID NO: 6982 - DNA, 156 bp, Artificial Sequence
  Synthetic polynucleotide
atcatctcaccttgcctcctgttctcgagccaatgaagcctgcaggcattgttaagacattgttatcgcattgttagaccattgttactacattgttaactcattgttatgccattgttagtacattgttaggcgcgccatgcttcatcagactct

SEQ ID NO: 6983 - DNA, 156 bp, Artificial Sequence; identical to SEQ ID NO: 6982
  Synthetic polynucleotide

SEQ ID NO: 6984 - DNA, 156 bp, Artificial Sequence
  Synthetic polynucleotide
atcatctcaccttgcctcctgcactaagttatctgctgcctgcaggcattgttcagacattgttctcgcattgttcgaccattgttcctacattgttcactcattgttctgccattgttcgtacattgttcggcgcgccatgcttcatcagactct

SEQ ID NO: 6985 - DNA, 156 bp, Artificial Sequence; identical to SEQ ID NO: 6984
  Synthetic polynucleotide

SEQ ID NO: 6986 - DNA, 190 bp, Artificial Sequence
  Synthetic polynucleotide
atcatctcaccttgcctcctgttccttcggcagatatgcctgcaggagatcaaggtcataagaagatcaaggtcatatcgagatcaaggtcatagacagatcaaggtcatactaagatcaaggtcataactagatcaaggtcatatgcagatcaaggtcatagtaggcgcgccatgcttcatcagactct

SEQ ID NO: 6987 - DNA, 190 bp, Artificial Sequence; identical to SEQ ID NO: 6986
  Synthetic polynucleotide

SEQ ID NO: 6988 - DNA, 197 bp, Artificial Sequence
  Synthetic polynucleotide
atcatctcaccttgcctcctgccagtatttccaccgatcctgcaggcggctgataccctggagacggctgataccctggtcgcggctgataccctgggaccggctgataccctggctacggctgataccctggactcggctgataccctggtgccggctgataccctgggtaggcgcgccatgcttcatcagactct

SEQ ID NO: 6989 - DNA, 197 bp, Artificial Sequence; identical to SEQ ID NO: 6988
  Synthetic polynucleotide

SEQ ID NO: 6990 - DNA, 188 bp, Artificial Sequence
  Synthetic polynucleotide
atcatctcaccttgcctcctgcttatggaaccagcgggcctgcagggggttcaccgggagagggttcaccgggtcggggttcaccggggacgggttcaccgggctagggttcaccgggactgggttcaccgggtgcgggttcaccggggtagggttcaccgggggcgcgccatgcttcatcagactct

SEQ ID NO: 6991 - DNA, 188 bp, Artificial Sequence; identical to SEQ ID NO: 6990
  Synthetic polynucleotide

SEQ ID NO: 6992 - DNA, 172 bp, Artificial Sequence
  Synthetic polynucleotide
atcatctcaccttgcctcctggcagagcatatgacgcacctgcaggggattcgaacagaggattcgaactcgggattcgaacgacggattcgaacctaggattcgaacactggattcgaactgcggattcgaacgtaggattcgaacggcgcgccatgcttcatcagactct

SEQ ID NO: 6993 - DNA, 172 bp, Artificial Sequence; identical to SEQ ID NO: 6992
  Synthetic polynucleotide

SEQ ID NO: 6994 - DNA, 172 bp, Artificial Sequence
  Synthetic polynucleotide
atcatctcaccttgcctcctgtagggtaatgctgtgtgcctgcaggctatttatagagactatttatagtcgctatttataggacctatttatagctactatttatagactctatttatagtgcctatttataggtactatttatagggcgcgccatgcttcatcagactct

SEQ ID NO: 6995 - DNA, 172 bp, Artificial Sequence; identical to SEQ ID NO: 6994
  Synthetic polynucleotide

SEQ ID NO: 6996 - DNA, 172 bp, Artificial Sequence
  Synthetic polynucleotide
atcatctcaccttgcctcctggccgttcaaggacagagcctgcagggctaattagtagagctaattagttcggctaattagtgacgctaattagtctagctaattagtactgctaattagttgcgctaattagtgtagctaattagtggcgcgccatgcttcatcagactct

SEQ ID NO: 6997 - DNA, 172 bp, Artificial Sequence; identical to SEQ ID NO: 6996
  Synthetic polynucleotide

SEQ ID NO: 6998 - DNA, 190 bp, Artificial Sequence
  Synthetic polynucleotide
atcatctcaccttgcctcctgtggtcacgcttactaggcctgcaggtatgaatattcatgagatatgaatattcatgtcgtatgaatattcatggactatgaatattcatgctatatgaatattcatgacttatgaatattcatgtgctatgaatattcatggtaggcgcgccatgcttcatcagactct

SEQ ID NO: 6999 - DNA, 190 bp, Artificial Sequence; identical to SEQ ID NO: 6998
  Synthetic polynucleotide

SEQ ID NO: 7000 - DNA, 156 bp, Artificial Sequence
  Synthetic polynucleotide
atcatctcaccttgcctcctgcacaagtaggcccacatcctgcaggacgtcatcagaacgtcatctcgacgtcatcgacacgtcatcctaacgtcatcactacgtcatctgcacgtcatcgtaacgtcatcggcgcgccatgcttcatcagactct

SEQ ID NO: 7001 - DNA, 156 bp, Artificial Sequence; identical to SEQ ID NO: 7000
  Synthetic polynucleotide

SEQ ID NO: 7002 - DNA, 180 bp, Artificial Sequence
  Synthetic polynucleotide
atcatctcaccttgcctcctgcaaagttcggtaaaggacctgcaggtccaatccacaagatccaatccacatcgtccaatccacagactccaatccacactatccaatccacaacttccaatccacatgctccaatccacagtatccaatccacaggcgcgccatgcttcatcagactct

SEQ ID NO: 7003 - DNA, 180 bp, Artificial Sequence; identical to SEQ ID NO: 7002
  Synthetic polynucleotide

SEQ ID NO: 7004 - DNA, 191 bp, Artificial Sequence
  Synthetic polynucleotide
atcatctcaccttgcctcctggcctgtctacgagaacacctgcaggtaattaattaatggctaagataattaattaatggctatcgtaattaattaatggctagactaattaattaatggctactataattaattaatggctaacttaattaattaatggctatgcggcgcgccatgcttcatcagactct

SEQ ID NO: 7005 - DNA, 191 bp, Artificial Sequence; identical to SEQ ID NO: 7004
  Synthetic polynucleotide

SEQ ID NO: 7006 - DNA, 172 bp, Artificial Sequence
  Synthetic polynucleotide
atcatctcaccttgcctcctgccttggttgcaatcctccctgcaggattgacagctagaattgacagcttcgattgacagctgacattgacagctctaattgacagctactattgacagcttgcattgacagctgtaattgacagctggcgcgccatgcttcatcagactct

SEQ ID NO: 7007 - DNA, 172 bp, Artificial Sequence; identical to SEQ ID NO: 7006
  Synthetic polynucleotide

SEQ ID NO: 7008 - DNA, 191 bp, Artificial Sequence
  Synthetic polynucleotide
atcatctcaccttgcctcctgcaatgcctttcctgaagcctgcaggatcgaatatatatatctagtcagaatcgaatatatatatctagtctcgatcgaatatatatatctagtcgacatcgaatatatatatctagtcctaatcgaatatatatatctagtcactggcgcgccatgcttcatcagactct

SEQ ID NO: 7009 - DNA, 191 bp, Artificial Sequence; identical to SEQ ID NO: 7008
  Synthetic polynucleotide

SEQ ID NO: 7010 - DNA, 197 bp, Artificial Sequence
  Synthetic polynucleotide
atcatctcaccttgcctcctgtattcagacgctctcgtcctgcaggagcctcagggcatggagaagcctcagggcatggtcgagcctcagggcatgggacagcctcagggcatggctaagcctcagggcatggactagcctcagggcatggtgcagcctcagggcatgggtaggcgcgccatgcttcatcagactct

SEQ ID NO: 7011 - DNA, 197 bp, Artificial Sequence; identical to SEQ ID NO: 7010
  Synthetic polynucleotide

SEQ ID NO: 7012 - DNA, 197 bp, Artificial Sequence
  Synthetic polynucleotide
atcatctcaccttgcctcctgtcaggctgaagcttgaacctgcaggaggacaaagttcacttgaagaaggacaaagttcacttgatcgaggacaaagttcacttgagacaggacaaagttcacttgactaaggacaaagttcacttgaactaggacaaagttcacttgatgcggcgcgccatgcttcatcagactct

SEQ ID NO: 7013 - DNA, 197 bp, Artificial Sequence; identical to SEQ ID NO: 7012
  Synthetic polynucleotide

SEQ ID NO: 7014 - DNA, 172 bp, Artificial Sequence
  Synthetic polynucleotide
atcatctcaccttgcctcctgctgccctatcgcaatcgcctgcagggctaattagaagagctaattagatcggctaattagagacgctaattagactagctaattagaactgctaattagatgcgctaattagagtagctaattagaggcgcgccatgcttcatcagactct

SEQ ID NO: 7015 - DNA, 172 bp, Artificial Sequence; identical to SEQ ID NO: 7014
  Synthetic polynucleotide

SEQ ID NO: 7016 - DNA, 172 bp, Artificial Sequence
  Synthetic polynucleotide
atcatctcaccttgcctcctgaatactgactcaatccacctgcagggctaattagcagagctaattagctcggctaattagcgacgctaattagcctagctaattagcactgctaattagctgcgctaattagcgtagctaattagcggcgcgccatgcttcatcagactct

SEQ ID NO: 7017 - DNA, 172 bp, Artificial Sequence; identical to SEQ ID NO: 7016
  Synthetic polynucleotide

SEQ ID NO: 7018 - DNA, 156 bp, Artificial Sequence
  Synthetic polynucleotide
atcatctcaccttgcctcctgacccagagtccttaggtcctgcaggttaattggagattaattggtcgttaattgggacttaattggctattaattggactttaattggtgcttaattgggtattaattggggcgcgccatgcttcatcagactct

SEQ ID NO: 7019 - DNA, 156 bp, Artificial Sequence; identical to SEQ ID NO: 7018
  Synthetic polynucleotide

SEQ ID NO: 7020 - DNA, 172 bp, Artificial Sequence
  Synthetic polynucleotide
atcatctcaccttgcctcctgtcggctgcgctatgttgcctgcaggaacatctggtagaaacatctggttcgaacatctggtgacaacatctggtctaaacatctggtactaacatctggttgcaacatctggtgtaaacatctggtggcgcgccatgcttcatcagactct

SEQ ID NO: 7021 - DNA, 172 bp, Artificial Sequence; identical to SEQ ID NO: 7020
  Synthetic polynucleotide

SEQ ID NO: 7022 - DNA, 172 bp, Artificial Sequence
  Synthetic polynucleotide
atcatctcaccttgcctcctgcttatgaggtcgggttacctgcaggcgtgggggggagacgtgggggggtcgcgtggggggggaccgtgggggggctacgtgggggggactcgtgggggggtgccgtggggggggtacgtgggggggggcgcgccatgcttcatcagactct

SEQ ID NO: 7023 - DNA, 172 bp, Artificial Sequence; identical to SEQ ID NO: 7022
  Synthetic polynucleotide

SEQ ID NO: 7024 - DNA, 172 bp, Artificial Sequence
  Synthetic polynucleotide
atcatctcaccttgcctcctgaactgctctagccacgtcctgcaggcgcttgactgagacgcttgactgtcgcgcttgactggaccgcttgactgctacgcttgactgactcgcttgactgtgccgcttgactggtacgcttgactgggcgcgccatgcttcatcagactct

SEQ ID NO: 7025 - DNA, 172 bp, Artificial Sequence; identical to SEQ ID NO: 7024
  Synthetic polynucleotide

SEQ ID NO: 7026 - DNA, 172 bp, Artificial Sequence
  Synthetic polynucleotide
atcatctcaccttgcctcctgtctcaacacagccacggcctgcaggtggcagttggagatggcagttggtcgtggcagttgggactggcagttggctatggcagttggacttggcagttggtgctggcagttgggtatggcagttggggcgcgccatgcttcatcagactct

SEQ ID NO: 7027 - DNA, 172 bp, Artificial Sequence; identical to SEQ ID NO: 7026
  Synthetic polynucleotide

SEQ ID NO: 7028 - DNA, 190 bp, Artificial Sequence
  Synthetic polynucleotide
atcatctcaccttgcctcctggaatacaccgtgacctacctgcaggggtgggggaggggcagaggtgggggaggggctcgggtgggggaggggcgacggtgggggaggggcctaggtgggggaggggcactggtgggggaggggctgcggtgggggaggggcgtaggcgcgccatgcttcatcagactct

SEQ ID NO: 7029 - DNA, 190 bp, Artificial Sequence; identical to SEQ ID NO: 7028
  Synthetic polynucleotide

SEQ ID NO: 7030 - DNA, 164 bp, Artificial Sequence
  Synthetic polynucleotide
atcatctcaccttgcctcctgcggatggtttaggtaaccctgcagggcacttaaaagagcacttaaatcggcacttaaagacgcacttaaactagcacttaaaactgcacttaaatgcgcacttaaagtagcacttaaaggcgcgccatgcttcatcagactct

SEQ ID NO: 7031 - DNA, 164 bp, Artificial Sequence; identical to SEQ ID NO: 7030
  Synthetic polynucleotide

SEQ ID NO: 7032 - DNA, 188 bp, Artificial Sequence
  Synthetic polynucleotide
atcatctcaccttgcctcctgctagtatctagtaacgccctgcaggagatgcaatcccagaagatgcaatccctcgagatgcaatcccgacagatgcaatcccctaagatgcaatcccactagatgcaatccctgcagatgcaatcccgtaagatgcaatcccggcgcgccatgcttcatcagactct

SEQ ID NO: 7033 - DNA, 188 bp, Artificial Sequence; identical to SEQ ID NO: 7032
  Synthetic polynucleotide

SEQ ID NO: 7034 - DNA, 180 bp, Artificial Sequence
  Synthetic polynucleotide
atcatctcaccttgcctcctgcgggtcgacatgagaagcctgcagggataatattgaagagataatattgatcggataatattgagacgataatattgactagataatattgaactgataatattgatgcgataatattgagtagataatattgaggcgcgccatgcttcatcagactct

SEQ ID NO: 7035 - DNA, 180 bp, Artificial Sequence; identical to SEQ ID NO: 7034
  Synthetic polynucleotide

SEQ ID NO: 7036 - DNA, 172 bp, Artificial Sequence
  Synthetic polynucleotide
atcatctcaccttgcctcctgagtcaagtgacgctcgacctgcaggtattaatcgaagatattaatcgatcgtattaatcgagactattaatcgactatattaatcgaacttattaatcgatgctattaatcgagtatattaatcgaggcgcgccatgcttcatcagactct

SEQ ID NO: 7037 - DNA, 172 bp, Artificial Sequence; identical to SEQ ID NO: 7036
  Synthetic polynucleotide

SEQ ID NO: 7038 - DNA, 164 bp, Artificial Sequence
  Synthetic polynucleotide
atcatctcaccttgcctcctgacttaccttgatgagcccctgcaggcattgttctagacattgttcttcgcattgttctgaccattgttctctacattgttctactcattgttcttgccattgttctgtacattgttctggcgcgccatgcttcatcagactct

SEQ ID NO: 7039 - DNA, 164 bp, Artificial Sequence; identical to SEQ ID NO: 7038
  Synthetic polynucleotide

SEQ ID NO: 7040 - DNA, 172 bp, Artificial Sequence
  Synthetic polynucleotide
atcatctcaccttgcctcctgccactcgtaacctggaccctgcaggattgttctgcagaattgttctgctcgattgttctgcgacattgttctgcctaattgttctgcactattgttctgctgcattgttctgcgtaattgttctgcggcgcgccatgcttcatcagactct

SEQ ID NO: 7041 - DNA, 172 bp, Artificial Sequence; identical to SEQ ID NO: 7040
  Synthetic polynucleotide

SEQ ID NO: 7042 - DNA, 156 bp, Artificial Sequence
  Synthetic polynucleotide
atcatctcaccttgcctcctgatcgttggtcgcgtttgcctgcagggccattaaagagccattaatcggccattaagacgccattaactagccattaaactgccattaatgcgccattaagtagccattaaggcgcgccatgcttcatcagactct

SEQ ID NO: 7043 - DNA, 156 bp, Artificial Sequence; identical to SEQ ID NO: 7042
  Synthetic polynucleotide

SEQ ID NO: 7044 - DNA, 148 bp, Artificial Sequence
  Synthetic polynucleotide
atcatctcaccttgcctcctgatttgtttcgtcgctgacctgcagggcggcggagagcggcggtcggcggcgggacgcggcggctagcggcggactgcggcggtgcgcggcgggtagcggcggggcgcgccatgcttcatcagactct

SEQ ID NO: 7045 - DNA, 148 bp, Artificial Sequence; identical to SEQ ID NO: 7044
  Synthetic polynucleotide

SEQ ID NO: 7046 - DNA, 156 bp, Artificial Sequence
  Synthetic polynucleotide
atcatctcaccttgcctcctggctcgtctcttagaggccctgcaggtgtatcaaagatgtatcaatcgtgtatcaagactgtatcaactatgtatcaaacttgtatcaatgctgtatcaagtatgtatcaaggcgcgccatgcttcatcagactct

SEQ ID NO: 7047 - DNA, 156 bp, Artificial Sequence; identical to SEQ ID NO: 7046
  Synthetic polynucleotide

SEQ ID NO: 7048 - DNA, 190 bp, Artificial Sequence
  Synthetic polynucleotide
atcatctcaccttgcctcctggcggtgcaatgcaagcacctgcaggttccatatatggaaagattccatatatggaatcgttccatatatggaagacttccatatatggaactattccatatatggaaactttccatatatggaatgcttccatatatggaagtaggcgcgccatgcttcatcagactct

SEQ ID NO: 7049 - DNA, 190 bp, Artificial Sequence; identical to SEQ ID NO: 7048
  Synthetic polynucleotide

SEQ ID NO: 7050 - DNA, 172 bp, Artificial Sequence
  Synthetic polynucleotide
atcatctcaccttgcctcctggcagcgcataccagaagcctgcaggcagtgatttgagacagtgatttgtcgcagtgatttggaccagtgatttgctacagtgatttgactcagtgatttgtgccagtgatttggtacagtgatttgggcgcgccatgcttcatcagactct

SEQ ID NO: 7051 - DNA, 172 bp, Artificial Sequence; identical to SEQ ID NO: 7050
  Synthetic polynucleotide

SEQ ID NO: 7052 - DNA, 148 bp, Artificial Sequence
  Synthetic polynucleotide
atcatctcaccttgcctcctgcagttagtaagtacggccctgcaggaaaatacagaaaaatactcgaaaatacgacaaaatacctaaaaatacactaaaatactgcaaaatacgtaaaaatacggcgcgccatgcttcatcagactct

SEQ ID NO: 7053 - DNA, 148 bp, Artificial Sequence; identical to SEQ ID NO: 7052
  Synthetic polynucleotide

SEQ ID NO: 7054 - DNA, 164 bp, Artificial Sequence
  Synthetic polynucleotide
atcatctcaccttgcctcctgtcgcaaatgatgtatagcctgcaggtttgatgttagatttgatgtttcgtttgatgttgactttgatgttctatttgatgttacttttgatgtttgctttgatgttgtatttgatgttggcgcgccatgcttcatcagactct

SEQ ID NO: 7055 - DNA, 164 bp, Artificial Sequence; identical to SEQ ID NO: 7054
  Synthetic polynucleotide

SEQ ID NO: 7056 - DNA, 148 bp, Artificial Sequence
  Synthetic polynucleotide
atcatctcaccttgcctcctgtgcagactacctccatgcctgcaggtaattaaagataattaatcgtaattaagactaattaactataattaaacttaattaatgctaattaagtataattaaggcgcgccatgcttcatcagactct

SEQ ID NO: 7057 - DNA, 148 bp, Artificial Sequence; identical to SEQ ID NO: 7056
  Synthetic polynucleotide

SEQ ID NO: 7058 - DNA, 156 bp, Artificial Sequence
  Synthetic polynucleotide
atcatctcaccttgcctcctgtcgcatgtaaacattagcctgcagggccattagagagccattagtcggccattaggacgccattagctagccattagactgccattagtgcgccattaggtagccattagggcgcgccatgcttcatcagactct

SEQ ID NO: 7059 - DNA, 156 bp, Artificial Sequence; identical to SEQ ID NO: 7058
  Synthetic polynucleotide

SEQ ID NO: 7060 - DNA, 148 bp, Artificial Sequence
  Synthetic polynucleotide
atcatctcaccttgcctcctggggatattgcgtaaattcctgcaggtaattacagataattactcgtaattacgactaattacctataattacacttaattactgctaattacgtataattacggcgcgccatgcttcatcagactct

SEQ ID NO: 7061 - DNA, 148 bp, Artificial Sequence; identical to SEQ ID NO: 7060
  Synthetic polynucleotide

SEQ ID NO: 7062 - DNA, 156 bp, Artificial Sequence
  Synthetic polynucleotide
atcatctcaccttgcctcctgactaggcacgagtgtgccctgcagggaggtcaaagagaggtcaatcggaggtcaagacgaggtcaactagaggtcaaactgaggtcaatgcgaggtcaagtagaggtcaaggcgcgccatgcttcatcagactct

SEQ ID NO: 7063 - DNA, 156 bp, Artificial Sequence; identical to SEQ ID NO: 7062
  Synthetic polynucleotide

SEQ ID NO: 7064 - DNA, 156 bp, Artificial Sequence
  Synthetic polynucleotide
atcatctcaccttgcctcctgaacaacctttgtcacagcctgcagggaggtcacagagaggtcactcggaggtcacgacgaggtcacctagaggtcacactgaggtcactgcgaggtcacgtagaggtcacggcgcgccatgcttcatcagactct

SEQ ID NO: 7065 - DNA, 156 bp, Artificial Sequence; identical to SEQ ID NO: 7064
  Synthetic polynucleotide

SEQ ID NO: 7066 - DNA, 148 bp, Artificial Sequence
  Synthetic polynucleotide
atcatctcaccttgcctcctgttagtccctagatctaccctgcaggtaattagagataattagtcgtaattaggactaattagctataattagacttaattagtgctaattaggtataattagggcgcgccatgcttcatcagactct

SEQ ID NO: 7067 - DNA, 148 bp, Artificial Sequence; identical to SEQ ID NO: 7066
  Synthetic polynucleotide

SEQ ID NO: 7068 - DNA, 164 bp, Artificial Sequence
  Synthetic polynucleotide
atcatctcaccttgcctcctgctcggcttgctaattgccctgcaggggttggcatagaggttggcattcgggttggcatgacggttggcatctaggttggcatactggttggcattgcggttggcatgtaggttggcatggcgcgccatgcttcatcagactct

SEQ ID NO: 7069 - DNA, 164 bp, Artificial Sequence; identical to SEQ ID NO: 7068
  Synthetic polynucleotide

SEQ ID NO: 7070 - DNA, 156 bp, Artificial Sequence
  Synthetic polynucleotide
atcatctcaccttgcctcctgggtacgagcaatattaccctgcaggatgcgggtagaatgcgggttcgatgcgggtgacatgcgggtctaatgcgggtactatgcgggttgcatgcgggtgtaatgcgggtggcgcgccatgcttcatcagactct

SEQ ID NO: 7071 - DNA, 156 bp, Artificial Sequence; identical to SEQ ID NO: 7070
  Synthetic polynucleotide

SEQ ID NO: 7072 - DNA, 164 bp, Artificial Sequence
  Synthetic polynucleotide
atcatctcaccttgcctcctggtattagacctcacatccctgcaggcccgcccccagacccgccccctcgcccgcccccgaccccgcccccctacccgcccccactcccgccccctgccccgcccccgtacccgcccccggcgcgccatgcttcatcagactct

SEQ ID NO: 7073 - DNA, 164 bp, Artificial Sequence; identical to SEQ ID NO: 7072
  Synthetic polynucleotide

SEQ ID NO: 7074 - DNA, 180 bp, Artificial Sequence
  Synthetic polynucleotide
atcatctcaccttgcctcctggcacaattagtacagatcctgcaggaaaaccgttaaagaaaaaccgttaatcgaaaaccgttaagacaaaaccgttaactaaaaaccgttaaactaaaaccgttaatgcaaaaccgttaagtaaaaaccgttaaggcgcgccatgcttcatcagactct

SEQ ID NO: 7075 - DNA, 180 bp, Artificial Sequence; identical to SEQ ID NO: 7074
  Synthetic polynucleotide

SEQ ID NO: 7076 - DNA, 148 bp, Artificial Sequence
  Synthetic polynucleotide
atcatctcaccttgcctcctgctcatacgcacttcgttcctgcagggtaattaagagtaattatcggtaattagacgtaattactagtaattaactgtaattatgcgtaattagtagtaattaggcgcgccatgcttcatcagactct

SEQ ID NO: 7077 - DNA, 148 bp, Artificial Sequence; identical to SEQ ID NO: 7076
  Synthetic polynucleotide

SEQ ID NO: 7078 - DNA, 180 bp, Artificial Sequence
  Synthetic polynucleotide
atcatctcaccttgcctcctgggctaatgctctgccgacctgcaggggtcacatgacagaggtcacatgactcgggtcacatgacgacggtcacatgacctaggtcacatgacactggtcacatgactgcggtcacatgacgtaggtcacatgacggcgcgccatgcttcatcagactct

SEQ ID NO: 7079 - DNA, 180 bp, Artificial Sequence; identical to SEQ ID NO: 7078
  Synthetic polynucleotide

SEQ ID NO: 7080 - DNA, 197 bp, Artificial Sequence
  Synthetic polynucleotide
atcatctcaccttgcctcctgaccagattgcacccacgcctgcaggcgttgtttacttaagagacgttgtttacttaagtcgcgttgtttacttaaggaccgttgtttacttaagctacgttgtttacttaagactcgttgtttacttaagtgccgttgtttacttaaggtaggcgcgccatgcttcatcagactct

SEQ ID NO: 7081 - DNA, 197 bp, Artificial Sequence; identical to SEQ ID NO: 7080
  Synthetic polynucleotide

SEQ ID NO: 7082 - DNA, 188 bp, Artificial Sequence
  Synthetic polynucleotide
atcatctcaccttgcctcctgggctaatttaggtgaagcctgcaggatcgattattggagaatcgattattggtcgatcgattattgggacatcgattattggctaatcgattattggactatcgattattggtgcatcgattattgggtaatcgattattggggcgcgccatgcttcatcagactct

SEQ ID NO: 7083 - DNA, 188 bp, Artificial Sequence; identical to SEQ ID NO: 7082
  Synthetic polynucleotide

SEQ ID NO: 7084 - DNA, 196 bp, Artificial Sequence
  Synthetic polynucleotide
atcatctcaccttgcctcctgtgtcgcggttgcaatttcctgcaggggttagtattgtgagaggttagtattgtgtcgggttagtattgtggacggttagtattgtgctaggttagtattgtgactggttagtattgtgtgcggttagtattgtggtaggttagtattgtgggcgcgccatgcttcatcagactct

SEQ ID NO: 7085 - DNA, 196 bp, Artificial Sequence; identical to SEQ ID NO: 7084
  Synthetic polynucleotide

SEQ ID NO: 7086 - DNA, 191 bp, Artificial Sequence
  Synthetic polynucleotide
atcatctcaccttgcctcctgattgctgattctacactcctgcaggaaggtcacgaaaggtcaagaaaggtcacgaaaggtcatcgaaggtcacgaaaggtcagacaaggtcacgaaaggtcactaaaggtcacgaaaggtcaactaaggtcacgaaaggtcatgcggcgcgccatgcttcatcagactct

SEQ ID NO: 7087 - DNA, 191 bp, Artificial Sequence; identical to SEQ ID NO: 7086
  Synthetic polynucleotide

SEQ ID NO: 7088 - DNA, 140 bp, Artificial Sequence
  Synthetic polynucleotide
atcatctcaccttgcctcctgctcaaggtgtctagaaacctgcaggcacctgagacacctgtcgcacctggaccacctgctacacctgactcacctgtgccacctggtacacctgggcgcgccatgcttcatcagactct

SEQ ID NO: 7089 - DNA, 140 bp, Artificial Sequence; identical to SEQ ID NO: 7088
  Synthetic polynucleotide

SEQ ID NO: 7090 - DNA, 185 bp, Artificial Sequence
  Synthetic polynucleotide
atcatctcaccttgcctcctgatccacgattcgatttgcctgcagggagaccatctgttcccagagagaccatctgttccctcggagaccatctgttcccgacgagaccatctgttcccctagagaccatctgttcccactgagaccatctgttccctgcggcgcgccatgcttcatcagactct

SEQ ID NO: 7091 - DNA, 185 bp, Artificial Sequence; identical to SEQ ID NO: 7090
  Synthetic polynucleotide

SEQ ID NO: 7092 - DNA, 148 bp, Artificial Sequence
  Synthetic polynucleotide
atcatctcaccttgcctcctgtgcgagctatcctaatgcctgcaggcagattaagacagattatcgcagattagaccagattactacagattaactcagattatgccagattagtacagattaggcgcgccatgcttcatcagactct

SEQ ID NO: 7093 - DNA, 148 bp, Artificial Sequence; identical to SEQ ID NO: 7092
  Synthetic polynucleotide

SEQ ID NO: 7094 - DNA, 156 bp, Artificial Sequence
  Synthetic polynucleotide
atcatctcaccttgcctcctggggatataagagatcaccctgcagggaggtcatagagaggtcattcggaggtcatgacgaggtcatctagaggtcatactgaggtcattgcgaggtcatgtagaggtcatggcgcgccatgcttcatcagactct

SEQ ID NO: 7095 - DNA, 156 bp, Artificial Sequence; identical to SEQ ID NO: 7094
  Synthetic polynucleotide

SEQ ID NO: 7096 - DNA, 148 bp, Artificial Sequence
  Synthetic polynucleotide
atcatctcaccttgcctcctgactagttgtagagagagcctgcagggtaattgagagtaattgtcggtaattggacgtaattgctagtaattgactgtaattgtgcgtaattggtagtaattgggcgcgccatgcttcatcagactct

SEQ ID NO: 7097 - DNA, 148 bp, Artificial Sequence; identical to SEQ ID NO: 7096
  Synthetic polynucleotide

SEQ ID NO: 7098 - DNA, 172 bp, Artificial Sequence
  Synthetic polynucleotide
atcatctcaccttgcctcctgctcttatgtaagggccgcctgcagggccctcttgtagagccctcttgttcggccctcttgtgacgccctcttgtctagccctcttgtactgccctcttgttgcgccctcttgtgtagccctcttgtggcgcgccatgcttcatcagactct

SEQ ID NO: 7099 - DNA, 172 bp, Artificial Sequence; identical to SEQ ID NO: 7098
  Synthetic polynucleotide

SEQ ID NO: 7100 - DNA, 156 bp, Artificial Sequence
  Synthetic polynucleotide
atcatctcaccttgcctcctgccaactggtttcccaatcctgcaggttttgacaagattttgacatcgttttgacagacttttgacactattttgacaactttttgacatgcttttgacagtattttgacaggcgcgccatgcttcatcagactct

SEQ ID NO: 7101 - DNA, 156 bp, Artificial Sequence; identical to SEQ ID NO: 7100
  Synthetic polynucleotide

SEQ ID NO: 7102 - DNA, 156 bp, Artificial Sequence
  Synthetic polynucleotide
atcatctcaccttgcctcctgcctccggtttgcgttgtcctgcaggtcacatgaagatcacatgatcgtcacatgagactcacatgactatcacatgaacttcacatgatgctcacatgagtatcacatgaggcgcgccatgcttcatcagactct

SEQ ID NO: 7103 - DNA, 156 bp, Artificial Sequence; identical to SEQ ID NO: 7102
  Synthetic polynucleotide

SEQ ID NO: 7104 - DNA, 190 bp, Artificial Sequence
  Synthetic polynucleotide
atcatctcaccttgcctcctgtatgaggtaggtggtaacctgcaggacccacaacacataagaacccacaacacatatcgacccacaacacatagacacccacaacacatactaacccacaacacataactacccacaacacatatgcacccacaacacatagtaggcgcgccatgcttcatcagactct

SEQ ID NO: 7105 - DNA, 190 bp, Artificial Sequence; identical to SEQ ID NO: 7104
  Synthetic polynucleotide

SEQ ID NO: 7106 - DNA, 185 bp, Artificial Sequence
  Synthetic polynucleotide
atcatctcaccttgcctcctgtcctaggttgctgttagcctgcagggcccactagagggcacagagcccactagagggcactcggcccactagagggcacgacgcccactagagggcacctagcccactagagggcacactgcccactagagggcactgcggcgcgccatgcttcatcagactct

SEQ ID NO: 7107 - DNA, 185 bp, Artificial Sequence; identical to SEQ ID NO: 7106
  Synthetic polynucleotide

SEQ ID NO: 7108 - DNA, 190 bp, Artificial Sequence
  Synthetic polynucleotide
atcatctcaccttgcctcctgcggtttgcgtacatgagcctgcagggcacccttgggtgcagagcacccttgggtgctcggcacccttgggtgcgacgcacccttgggtgcctagcacccttgggtgcactgcacccttgggtgctgcgcacccttgggtgcgtaggcgcgccatgcttcatcagactct

SEQ ID NO: 7109 - DNA, 190 bp, Artificial Sequence; identical to SEQ ID NO: 7108
  Synthetic polynucleotide

SEQ ID NO: 7110 - DNA, 180 bp, Artificial Sequence
  Synthetic polynucleotide
atcatctcaccttgcctcctgttaggaataaggcaggtcctgcaggttcaaggtcatagattcaaggtcattcgttcaaggtcatgacttcaaggtcatctattcaaggtcatactttcaaggtcattgcttcaaggtcatgtattcaaggtcatggcgcgccatgcttcatcagactct

SEQ ID NO: 7111 - DNA, 180 bp, Artificial Sequence; identical to SEQ ID NO: 7110
  Synthetic polynucleotide

SEQ ID NO: 7112 - DNA, 172 bp, Artificial Sequence
  Synthetic polynucleotide
atcatctcaccttgcctcctgcgggcatttcttgctgacctgcagggcagataacaagagcagataacatcggcagataacagacgcagataacactagcagataacaactgcagataacatgcgcagataacagtagcagataacaggcgcgccatgcttcatcagactct

SEQ ID NO: 7113 - DNA, 172 bp, Artificial Sequence; identical to SEQ ID NO: 7112
  Synthetic polynucleotide

SEQ ID NO: 7114 - DNA, 188 bp, Artificial Sequence
  Synthetic polynucleotide
atcatctcaccttgcctcctgttgaagaccctcacagccctgcaggcgttaattatttagacgttaattattttcgcgttaattatttgaccgttaattatttctacgttaattatttactcgttaattattttgccgttaattatttgtacgttaattatttggcgcgccatgcttcatcagactct

SEQ ID NO: 7115 - DNA, 188 bp, Artificial Sequence; identical to SEQ ID NO: 7114
  Synthetic polynucleotide

SEQ ID NO: 7116 - DNA, 196 bp, Artificial Sequence
  Synthetic polynucleotide
atcatctcaccttgcctcctggataagtcacgggtcgacctgcaggcctgagaataatcagacctgagaataatctcgcctgagaataatcgaccctgagaataatcctacctgagaataatcactcctgagaataatctgccctgagaataatcgtacctgagaataatcggcgcgccatgcttcatcagactct

SEQ ID NO: 7117 - DNA, 196 bp, Artificial Sequence; identical to SEQ ID NO: 7116
  Synthetic polynucleotide

SEQ ID NO: 7118 - DNA, 191 bp, Artificial Sequence
  Synthetic polynucleotide
atcatctcaccttgcctcctgcgggttaggtaacaggccctgcaggcatgactgaaattcatcagacatgactgaaattcatctcgcatgactgaaattcatcgaccatgactgaaattcatcctacatgactgaaattcatcactcatgactgaaattcatctgcggcgcgccatgcttcatcagactct

SEQ ID NO: 7119 - DNA, 191 bp, Artificial Sequence; identical to SEQ ID NO: 7118
  Synthetic polynucleotide

SEQ ID NO: 7120 - DNA, 197 bp, Artificial Sequence
  Synthetic polynucleotide
atcatctcaccttgcctcctgccagctgcgtgcaaactcctgcagggccggccaatcagagagagccggccaatcagagtcggccggccaatcagaggacgccggccaatcagagctagccggccaatcagagactgccggccaatcagagtgcgccggccaatcagaggtaggcgcgccatgcttcatcagactct

SEQ ID NO: 7121 - DNA, 197 bp, Artificial Sequence; identical to SEQ ID NO: 7120
  Synthetic polynucleotide

SEQ ID NO: 7122 - DNA, 180 bp, Artificial Sequence
  Synthetic polynucleotide
atcatctcaccttgcctcctgtagccggaagattgccccctgcaggccagggggcagagaccagggggcagtcgccagggggcaggacccagggggcagctaccagggggcagactccagggggcagtgcccagggggcaggtaccagggggcagggcgcgccatgcttcatcagactct

SEQ ID NO: 7123 - DNA, 180 bp, Artificial Sequence; identical to SEQ ID NO: 7122
  Synthetic polynucleotide

SEQ ID NO: 7124 - DNA, 190 bp, Artificial Sequence
  Synthetic polynucleotide
atcatctcaccttgcctcctgatggcaacataagtacgcctgcaggcccgcttcagtgacagacccgcttcagtgactcgcccgcttcagtgacgaccccgcttcagtgacctacccgcttcagtgacactcccgcttcagtgactgccccgcttcagtgacgtaggcgcgccatgcttcatcagactct

SEQ ID NO: 7125 - DNA, 190 bp, Artificial Sequence; identical to SEQ ID NO: 7124
  Synthetic polynucleotide

SEQ ID NO: 7126 - DNA, 190 bp, Artificial Sequence
  Synthetic polynucleotide
atcatctcaccttgcctcctggttctacgttggcgcgacctgcaggaagggggcgtggccagaaagggggcgtggcctcgaagggggcgtggccgacaagggggcgtggccctaaagggggcgtggccactaagggggcgtggcctgcaagggggcgtggccgtaggcgcgccatgcttcatcagactct

SEQ ID NO: 7127 - DNA, 190 bp, Artificial Sequence; identical to SEQ ID NO: 7126
  Synthetic polynucleotide

SEQ ID NO: 7128 - DNA, 190 bp, Artificial Sequence
  Synthetic polynucleotide
atcatctcaccttgcctcctgtgtaactcgcggtgtaacctgcagggccacttccggttcagagccacttccggttctcggccacttccggttcgacgccacttccggttcctagccacttccggttcactgccacttccggttctgcgccacttccggttcgtaggcgcgccatgcttcatcagactct

SEQ ID NO: 7129 - DNA, 190 bp, Artificial Sequence; identical to SEQ ID NO: 7128
  Synthetic polynucleotide

SEQ ID NO: 7130 - DNA, 185 bp, Artificial Sequence
  Synthetic polynucleotide
atcatctcaccttgcctcctgtgtggtgctcctcctaacctgcaggcaaaatcaattaatttagacaaaatcaattaattttcgcaaaatcaattaatttgaccaaaatcaattaatttctacaaaatcaattaatttactcaaaatcaattaattttgcggcgcgccatgcttcatcagactct

SEQ ID NO: 7131 - DNA, 185 bp, Artificial Sequence; identical to SEQ ID NO: 7130
  Synthetic polynucleotide

SEQ ID NO: 7132 - DNA, 172 bp, Artificial Sequence
  Synthetic polynucleotide
atcatctcaccttgcctcctgaatgcgtggtcttctgtcctgcaggccacttgaaaagaccacttgaaatcgccacttgaaagacccacttgaaactaccacttgaaaactccacttgaaatgcccacttgaaagtaccacttgaaaggcgcgccatgcttcatcagactct

SEQ ID NO: 7133 - DNA, 172 bp, Artificial Sequence; identical to SEQ ID NO: 7132
  Synthetic polynucleotide

SEQ ID NO: 7134 - DNA, 191 bp, Artificial Sequence
  Synthetic polynucleotide
atcatctcaccttgcctcctgaaccgcaacggctcacacctgcaggtcccactaattagcgcaagatcccactaattagcgcatcgtcccactaattagcgcagactcccactaattagcgcactatcccactaattagcgcaacttcccactaattagcgcatgcggcgcgccatgcttcatcagactct

SEQ ID NO: 7135 - DNA, 191 bp, Artificial Sequence; identical to SEQ ID NO: 7134
  Synthetic polynucleotide

SEQ ID NO: 7136 - DNA, 148 bp, Artificial Sequence
  Synthetic polynucleotide
atcatctcaccttgcctcctgggcaaggtatagcctagcctgcagggcaggtgagagcaggtgtcggcaggtggacgcaggtgctagcaggtgactgcaggtgtgcgcaggtggtagcaggtgggcgcgccatgcttcatcagactct

SEQ ID NO: 7137 - DNA, 148 bp, Artificial Sequence; identical to SEQ ID NO: 7136
  Synthetic polynucleotide

SEQ ID NO: 7138 - DNA, 164 bp, Artificial Sequence
  Synthetic polynucleotide
atcatctcaccttgcctcctgccactagtagaccctttcctgcaggttcccggaaagattcccggaatcgttcccggaagacttcccggaactattcccggaaactttcccggaatgcttcccggaagtattcccggaaggcgcgccatgcttcatcagactct

SEQ ID NO: 7139 - DNA, 164 bp, Artificial Sequence; identical to SEQ ID NO: 7138
  Synthetic polynucleotide

SEQ ID NO: 7140 - DNA, 191 bp, Artificial Sequence
  Synthetic polynucleotide
atcatctcaccttgcctcctgcgtgaattgcgtccgatcctgcaggattaattttatggccgtagaattaattttatggccgttcgattaattttatggccgtgacattaattttatggccgtctaattaattttatggccgtactattaattttatggccgttgcggcgcgccatgcttcatcagactct

SEQ ID NO: 7141 - DNA, 191 bp, Artificial Sequence; identical to SEQ ID NO: 7140
  Synthetic polynucleotide

SEQ ID NO: 7142 - DNA, 156 bp, Artificial Sequence
  Synthetic polynucleotide
atcatctcaccttgcctcctgaaagatagtgccgagggcctgcaggctcacctgagactcacctgtcgctcacctggacctcacctgctactcacctgactctcacctgtgcctcacctggtactcacctgggcgcgccatgcttcatcagactct

SEQ ID NO: 7143 - DNA, 156 bp, Artificial Sequence; identical to SEQ ID NO: 7142
  Synthetic polynucleotide

SEQ ID NO: 7144 - DNA, 172 bp, Artificial Sequence
  Synthetic polynucleotide
atcatctcaccttgcctcctgcacctacttagagacttcctgcaggccaataaaaaagaccaataaaaatcgccaataaaaagacccaataaaaactaccaataaaaaactccaataaaaatgcccaataaaaagtaccaataaaaaggcgcgccatgcttcatcagactct

SEQ ID NO: 7145 - DNA, 172 bp, Artificial Sequence; identical to SEQ ID NO: 7144
  Synthetic polynucleotide

SEQ ID NO: 7146 - DNA, 172 bp, Artificial Sequence
  Synthetic polynucleotide
atcatctcaccttgcctcctgacagctagagtactccccctgcaggccaataaaacagaccaataaaactcgccaataaaacgacccaataaaacctaccaataaaacactccaataaaactgcccaataaaacgtaccaataaaacggcgcgccatgcttcatcagactct

SEQ ID NO: 7147 - DNA, 172 bp, Artificial Sequence; identical to SEQ ID NO: 7146
  Synthetic polynucleotide

SEQ ID NO: 7148 - DNA, 191 bp, Artificial Sequence
  Synthetic polynucleotide
atcatctcaccttgcctcctgacactcgaatcagcttgcctgcaggggggtggggacatggtgttcttcgtggagaggggtggggacatggtgttcttcgtggtcgggggtggggacatggtgttcttcgtgggacggggtggggacatggtgttcttcgtggctaggcgcgccatgcttcatcagactct

SEQ ID NO: 7149 - DNA, 191 bp, Artificial Sequence; identical to SEQ ID NO: 7148
  Synthetic polynucleotide

SEQ ID NO: 7150 - DNA, 200 bp, Artificial Sequence
  Synthetic polynucleotide
atcatctcaccttgcctcctggatagagcagaacagttcctgcaggggacatgcccaggcatgccagaggacatgcccaggcatgcctcgggacatgcccaggcatgccgacggacatgcccaggcatgccctaggacatgcccaggcatgccactggacatgcccaggcatgccggcgcgccatgcttcatcagactct

SEQ ID NO: 7151 - DNA, 200 bp, Artificial Sequence; identical to SEQ ID NO: 7150
  Synthetic polynucleotide

SEQ ID NO: 7152 - DNA, 164 bp, Artificial Sequence
  Synthetic polynucleotide
atcatctcaccttgcctcctgttacagcgttggcgctgcctgcaggagcaattaaagaagcaattaatcgagcaattaagacagcaattaactaagcaattaaactagcaattaatgcagcaattaagtaagcaattaaggcgcgccatgcttcatcagactct

SEQ ID NO: 7153 - DNA, 164 bp, Artificial Sequence; identical to SEQ ID NO: 7152
  Synthetic polynucleotide

SEQ ID NO: 7154 - DNA, 156 bp, Artificial Sequence
  Synthetic polynucleotide
atcatctcaccttgcctcctgggtctttggacggcacacctgcaggtgttttttagatgtttttttcgtgttttttgactgttttttctatgttttttacttgtttttttgctgttttttgtatgttttttggcgcgccatgcttcatcagactct

SEQ ID NO: 7155 - DNA, 156 bp, Artificial Sequence; identical to SEQ ID NO: 7154
  Synthetic polynucleotide

SEQ ID NO: 7156 - DNA, 191 bp, Artificial Sequence
  Synthetic polynucleotide
atcatctcaccttgcctcctgcacccttagtaagaccgcctgcaggttgaaaaccgttaatttagattgaaaaccgttaattttcgttgaaaaccgttaatttgacttgaaaaccgttaatttctattgaaaaccgttaatttactttgaaaaccgttaattttgcggcgcgccatgcttcatcagactct

SEQ ID NO: 7157 - DNA, 191 bp, Artificial Sequence; identical to SEQ ID NO: 7156
  Synthetic polynucleotide

SEQ ID NO: 7158 - DNA, 190 bp, Artificial Sequence
  Synthetic polynucleotide
atcatctcaccttgcctcctggtatacttggatacgagcctgcaggagtttcggtttcggagaagtttcggtttcggtcgagtttcggtttcgggacagtttcggtttcggctaagtttcggtttcggactagtttcggtttcggtgcagtttcggtttcgggtaggcgcgccatgcttcatcagactct

SEQ ID NO: 7159 - DNA, 190 bp, Artificial Sequence; identical to SEQ ID NO: 7158
  Synthetic polynucleotide

SEQ ID NO: 7160 - DNA, 164 bp, Artificial Sequence
  Synthetic polynucleotide
atcatctcaccttgcctcctggcgcacagtcgaatagacctgcaggttcctgcctagattcctgccttcgttcctgcctgacttcctgcctctattcctgcctactttcctgccttgcttcctgcctgtattcctgcctggcgcgccatgcttcatcagactct

SEQ ID NO: 7161 - DNA, 164 bp, Artificial Sequence; identical to SEQ ID NO: 7160
  Synthetic polynucleotide

SEQ ID NO: 7162 - DNA, 196 bp, Artificial Sequence
  Synthetic polynucleotide
atcatctcaccttgcctcctgccgcgagtttgcagaatcctgcaggctgttacgtaatcagactgttacgtaatctcgctgttacgtaatcgacctgttacgtaatcctactgttacgtaatcactctgttacgtaatctgcctgttacgtaatcgtactgttacgtaatcggcgcgccatgcttcatcagactct

SEQ ID NO: 7163 - DNA, 196 bp, Artificial Sequence; identical to SEQ ID NO: 7162
  Synthetic polynucleotide

SEQ ID NO: 7164 - DNA, 180 bp, Artificial Sequence
  Synthetic polynucleotide
atcatctcaccttgcctcctgccgctgtccgaattgatcctgcaggaaacatgtactagaaaacatgtacttcgaaacatgtactgacaaacatgtactctaaaacatgtactactaaacatgtacttgcaaacatgtactgtaaaacatgtactggcgcgccatgcttcatcagactct

SEQ ID NO: 7165 - DNA, 180 bp, Artificial Sequence; identical to SEQ ID NO: 7164
  Synthetic polynucleotide

SEQ ID NO: 7166 - DNA, 197 bp, Artificial Sequence
  Synthetic polynucleotide
atcatctcaccttgcctcctgctgccgcatacggtgaacctgcagggaatatgcaaatcagagagaatatgcaaatcagtcggaatatgcaaatcaggacgaatatgcaaatcagctagaatatgcaaatcagactgaatatgcaaatcagtgcgaatatgcaaatcaggtaggcgcgccatgcttcatcagactct

SEQ ID NO: 7167 - DNA, 197 bp, Artificial Sequence; identical to SEQ ID NO: 7166
  Synthetic polynucleotide

SEQ ID NO: 7168 - DNA, 188 bp, Artificial Sequence
  Synthetic polynucleotide
atcatctcaccttgcctcctgtgcaggaaccttcattccctgcagggccgccattttgagagccgccattttgtcggccgccattttggacgccgccattttgctagccgccattttgactgccgccattttgtgcgccgccattttggtagccgccattttgggcgcgccatgcttcatcagactct

SEQ ID NO: 7169 - DNA, 188 bp, Artificial Sequence; identical to SEQ ID NO: 7168
  Synthetic polynucleotide

SEQ ID NO: 7170 - DNA, 180 bp, Artificial Sequence
  Synthetic polynucleotide
atcatctcaccttgcctcctgtttcaggcttcctagcccctgcaggttcaaggtcaaagattcaaggtcaatcgttcaaggtcaagacttcaaggtcaactattcaaggtcaaactttcaaggtcaatgcttcaaggtcaagtattcaaggtcaaggcgcgccatgcttcatcagactct

SEQ ID NO: 7171 - DNA, 180 bp, Artificial Sequence; identical to SEQ ID NO: 7170
  Synthetic polynucleotide

SEQ ID NO: 7172 - DNA, 172 bp, Artificial Sequence
  Synthetic polynucleotide
atcatctcaccttgcctcctgtccggaatcaagtggtgcctgcaggaaatcacggcagaaaatcacggctcgaaatcacggcgacaaatcacggcctaaaatcacggcactaaatcacggctgcaaatcacggcgtaaaatcacggcggcgcgccatgcttcatcagactct

SEQ ID NO: 7173 - DNA, 172 bp, Artificial Sequence; identical to SEQ ID NO: 7172
  Synthetic polynucleotide

SEQ ID NO: 7174 - DNA, 196 bp, Artificial Sequence
  Synthetic polynucleotide
atcatctcaccttgcctcctggtttctttcgatttggccctgcaggctaatctaattaaagactaatctaattaatcgctaatctaattaagacctaatctaattaactactaatctaattaaactctaatctaattaatgcctaatctaattaagtactaatctaattaaggcgcgccatgcttcatcagactct

SEQ ID NO: 7175 - DNA, 196 bp, Artificial Sequence; identical to SEQ ID NO: 7174
  Synthetic polynucleotide

SEQ ID NO: 7176 - DNA, 172 bp, Artificial Sequence
  Synthetic polynucleotide
atcatctcaccttgcctcctggcacgggacctaaatgacctgcaggcgcgccaaacagacgcgccaaactcgcgcgccaaacgaccgcgccaaacctacgcgccaaacactcgcgccaaactgccgcgccaaacgtacgcgccaaacggcgcgccatgcttcatcagactct

SEQ ID NO: 7177 - DNA, 172 bp, Artificial Sequence; identical to SEQ ID NO: 7176
  Synthetic polynucleotide

SEQ ID NO: 7178 - DNA, 197 bp, Artificial Sequence
  Synthetic polynucleotide
atcatctcaccttgcctcctggagtgggtttcggaactcctgcaggaaaggtcaccagaggtcaagaaaaggtcaccagaggtcatcgaaaggtcaccagaggtcagacaaaggtcaccagaggtcactaaaaggtcaccagaggtcaactaaaggtcaccagaggtcatgcggcgcgccatgcttcatcagactct

SEQ ID NO: 7179 - DNA, 197 bp, Artificial Sequence; identical to SEQ ID NO: 7178
  Synthetic polynucleotide

SEQ ID NO: 7180 - DNA, 185 bp, Artificial Sequence
  Synthetic polynucleotide
atcatctcaccttgcctcctggctgttgactcccttagcctgcaggaagcacctgtcaatatagaaagcacctgtcaatattcgaagcacctgtcaatatgacaagcacctgtcaatatctaaagcacctgtcaatatactaagcacctgtcaatattgcggcgcgccatgcttcatcagactct

SEQ ID NO: 7181 - DNA, 185 bp, Artificial Sequence; identical to SEQ ID NO: 7180
  Synthetic polynucleotide

SEQ ID NO: 7182 - DNA, 180 bp, Artificial Sequence
  Synthetic polynucleotide
atcatctcaccttgcctcctgattaccctgtcatagtgcctgcaggggccaatccccagaggccaatcccctcgggccaatccccgacggccaatccccctaggccaatccccactggccaatcccctgcggccaatccccgtaggccaatccccggcgcgccatgcttcatcagactct

SEQ ID NO: 7183 - DNA, 180 bp, Artificial Sequence; identical to SEQ ID NO: 7182
  Synthetic polynucleotide

SEQ ID NO: 7184 - DNA, 164 bp, Artificial Sequence
  Synthetic polynucleotide
atcatctcaccttgcctcctgcaacattaatctcacaccctgcaggccttatctgagaccttatctgtcgccttatctggacccttatctgctaccttatctgactccttatctgtgcccttatctggtaccttatctgggcgcgccatgcttcatcagactct

SEQ ID NO: 7185 - DNA, 164 bp, Artificial Sequence; identical to SEQ ID NO: 7184
  Synthetic polynucleotide

SEQ ID NO: 7186 - DNA, 156 bp, Artificial Sequence
  Synthetic polynucleotide
atcatctcaccttgcctcctggacagacacgtcgccaacctgcaggcacatcaaagacacatcaatcgcacatcaagaccacatcaactacacatcaaactcacatcaatgccacatcaagtacacatcaaggcgcgccatgcttcatcagactct

SEQ ID NO: 7187 - DNA, 156 bp, Artificial Sequence; identical to SEQ ID NO: 7186
  Synthetic polynucleotide

SEQ ID NO: 7188 - DNA, 190 bp, Artificial Sequence
  Synthetic polynucleotide
atcatctcaccttgcctcctggagcattaatagaccaccctgcaggagtttcggtttcgtagaagtttcggtttcgttcgagtttcggtttcgtgacagtttcggtttcgtctaagtttcggtttcgtactagtttcggtttcgttgcagtttcggtttcgtgtaggcgcgccatgcttcatcagactct

SEQ ID NO: 7189 - DNA, 190 bp, Artificial Sequence; identical to SEQ ID NO: 7188
  Synthetic polynucleotide

SEQ ID NO: 7190 - DNA, 188 bp, Artificial Sequence
  Synthetic polynucleotide
atcatctcaccttgcctcctgtttggtgggcggaaagtcctgcagggcgggggcggcgagagcgggggcggcgtcggcgggggcggcggacgcgggggcggcgctagcgggggcggcgactgcgggggcggcgtgcgcgggggcggcggtagcgggggcggcgggcgcgccatgcttcatcagactct

SEQ ID NO: 7191 - DNA, 188 bp, Artificial Sequence; identical to SEQ ID NO: 7190
  Synthetic polynucleotide

SEQ ID NO: 7192 - DNA, 172 bp, Artificial Sequence
  Synthetic polynucleotide
atcatctcaccttgcctcctgttcgaaattactggtagcctgcaggggcggcggcgagaggcggcggcgtcgggcggcggcggacggcggcggcgctaggcggcggcgactggcggcggcgtgcggcggcggcggtaggcggcggcgggcgcgccatgcttcatcagactct

SEQ ID NO: 7193 - DNA, 172 bp, Artificial Sequence; identical to SEQ ID NO: 7192
  Synthetic polynucleotide

SEQ ID NO: 7194 - DNA, 156 bp, Artificial Sequence
  Synthetic polynucleotide
atcatctcaccttgcctcctgacttgtcagcccaggatcctgcaggagtcagctagaagtcagcttcgagtcagctgacagtcagctctaagtcagctactagtcagcttgcagtcagctgtaagtcagctggcgcgccatgcttcatcagactct

SEQ ID NO: 7195 - DNA, 156 bp, Artificial Sequence; identical to SEQ ID NO: 7194
  Synthetic polynucleotide

SEQ ID NO: 7196 - DNA, 156 bp, Artificial Sequence
  Synthetic polynucleotide
atcatctcaccttgcctcctgatagtgccacaacgcctcctgcaggtgataaggagatgataaggtcgtgataagggactgataaggctatgataaggacttgataaggtgctgataagggtatgataaggggcgcgccatgcttcatcagactct

SEQ ID NO: 7197 - DNA, 156 bp, Artificial Sequence; identical to SEQ ID NO: 7196
  Synthetic polynucleotide

SEQ ID NO: 7198 - DNA, 172 bp, Artificial Sequence
  Synthetic polynucleotide
atcatctcaccttgcctcctgcaagcactagggttgcccctgcaggcgtcagctggagacgtcagctggtcgcgtcagctgggaccgtcagctggctacgtcagctggactcgtcagctggtgccgtcagctgggtacgtcagctggggcgcgccatgcttcatcagactct

SEQ ID NO: 7199 - DNA, 172 bp, Artificial Sequence; identical to SEQ ID NO: 7198
  Synthetic polynucleotide

SEQ ID NO: 7200 - DNA, 164 bp, Artificial Sequence
  Synthetic polynucleotide
atcatctcaccttgcctcctgttatagtggcctgcattcctgcaggtttattaccagatttattacctcgtttattaccgactttattaccctatttattaccacttttattacctgctttattaccgtatttattaccggcgcgccatgcttcatcagactct

SEQ ID NO: 7201 - DNA, 164 bp, Artificial Sequence; identical to SEQ ID NO: 7200
  Synthetic polynucleotide

SEQ ID NO: 7202 - DNA, 180 bp, Artificial Sequence
  Synthetic polynucleotide
atcatctcaccttgcctcctggtcatcagttgagctggcctgcaggattgtgcaataagaattgtgcaatatcgattgtgcaatagacattgtgcaatactaattgtgcaataactattgtgcaatatgcattgtgcaatagtaattgtgcaataggcgcgccatgcttcatcagactct

SEQ ID NO: 7203 - DNA, 180 bp, Artificial Sequence; identical to SEQ ID NO: 7202
  Synthetic polynucleotide

SEQ ID NO: 7204 - DNA, 185 bp, Artificial Sequence
  Synthetic polynucleotide
atcatctcaccttgcctcctggatactcccgtggctatcctgcaggggcggggaaattccccagaggcggggaaattcccctcgggcggggaaattccccgacggcggggaaattccccctaggcggggaaattccccactggcggggaaattcccctgcggcgcgccatgcttcatcagactct

SEQ ID NO: 7205 - DNA, 185 bp, Artificial Sequence; identical to SEQ ID NO: 7204
  Synthetic polynucleotide

SEQ ID NO: 7206 - DNA, 197 bp, Artificial Sequence
  Synthetic polynucleotide
atcatctcaccttgcctcctgcttcacgcgtaaacattcctgcaggaaaaattgctgactcagcagaaaaaattgctgactcagctcgaaaaattgctgactcagcgacaaaaattgctgactcagcctaaaaaattgctgactcagcactaaaaattgctgactcagctgcggcgcgccatgcttcatcagactct

SEQ ID NO: 7207 - DNA, 197 bp, Artificial Sequence; identical to SEQ ID NO: 7206
  Synthetic polynucleotide

SEQ ID NO: 7208 - DNA, 156 bp, Artificial Sequence
  Synthetic polynucleotide
atcatctcaccttgcctcctgcaggttatctgtattgacctgcaggtgataagaagatgataagatcgtgataagagactgataagactatgataagaacttgataagatgctgataagagtatgataagaggcgcgccatgcttcatcagactct

SEQ ID NO: 7209 - DNA, 156 bp, Artificial Sequence; identical to SEQ ID NO: 7208
  Synthetic polynucleotide

SEQ ID NO: 7210 - DNA, 156 bp, Artificial Sequence
  Synthetic polynucleotide
atcatctcaccttgcctcctgggaatggaggccgtctacctgcaggaatcaaaaagaaatcaaaatcgaatcaaaagacaatcaaaactaaatcaaaaactaatcaaaatgcaatcaaaagtaaatcaaaaggcgcgccatgcttcatcagactct

SEQ ID NO: 7211 - DNA, 156 bp, Artificial Sequence; identical to SEQ ID NO: 7210
  Synthetic polynucleotide

SEQ ID NO: 7212 - DNA, 191 bp, Artificial Sequence
  Synthetic polynucleotide
atcatctcaccttgcctcctgcgccgatattgatggcccctgcaggggcggggaggtgggggcagaggcggggaggtgggggctcgggcggggaggtgggggcgacggcggggaggtgggggcctaggcggggaggtgggggcactggcggggaggtgggggctgcggcgcgccatgcttcatcagactct

SEQ ID NO: 7213 - DNA, 191 bp, Artificial Sequence; identical to SEQ ID NO: 7212
  Synthetic polynucleotide

SEQ ID NO: 7214 - DNA, 188 bp, Artificial Sequence
  Synthetic polynucleotide
atcatctcaccttgcctcctgatcctgcgttgatgacccctgcaggcgtgtggggaaaagacgtgtggggaaatcgcgtgtggggaaagaccgtgtggggaaactacgtgtggggaaaactcgtgtggggaaatgccgtgtggggaaagtacgtgtggggaaaggcgcgccatgcttcatcagactct

SEQ ID NO: 7215 - DNA, 188 bp, Artificial Sequence; identical to SEQ ID NO: 7214
  Synthetic polynucleotide

SEQ ID NO: 7216 - DNA, 140 bp, Artificial Sequence
  Synthetic polynucleotide
atcatctcaccttgcctcctggacgccaaacctacgctcctgcagggatggcagagatggctcggatggcgacgatggcctagatggcactgatggctgcgatggcgtagatggcggcgcgccatgcttcatcagactct

SEQ ID NO: 7217 - DNA, 140 bp, Artificial Sequence; identical to SEQ ID NO: 7216
  Synthetic polynucleotide

SEQ ID NO: 7218 - DNA, 200 bp, Artificial Sequence
  Synthetic polynucleotide
atcatctcaccttgcctcctgcagtcagatagagcctccctgcagggaaaaatttccaatactccactccccccccagagaaaaatttccaatactccactcccccccctcggaaaaatttccaatactccactccccccccgacgaaaaatttccaatactccactccccccccggcgcgccatgcttcatcagactct

SEQ ID NO: 7219 - DNA, 200 bp, Artificial Sequence; identical to SEQ ID NO: 7218
  Synthetic polynucleotide

SEQ ID NO: 7220 - DNA, 172 bp, Artificial Sequence
  Synthetic polynucleotide
atcatctcaccttgcctcctgtactgacgctcagctggcctgcaggcctccgccgcagacctccgccgctcgcctccgccgcgaccctccgccgcctacctccgccgcactcctccgccgctgccctccgccgcgtacctccgccgcggcgcgccatgcttcatcagactct

SEQ ID NO: 7221 - DNA, 172 bp, Artificial Sequence; identical to SEQ ID NO: 7220
  Synthetic polynucleotide

SEQ ID NO: 7222 - DNA, 180 bp, Artificial Sequence
  Synthetic polynucleotide
atcatctcaccttgcctcctgggaaacgatagtacaaccctgcaggattgtgcaatcagaattgtgcaatctcgattgtgcaatcgacattgtgcaatcctaattgtgcaatcactattgtgcaatctgcattgtgcaatcgtaattgtgcaatcggcgcgccatgcttcatcagactct

SEQ ID NO: 7223 - DNA, 180 bp, Artificial Sequence; identical to SEQ ID NO: 7222
  Synthetic polynucleotide

SEQ ID NO: 7224 - DNA, 185 bp, Artificial Sequence
  Synthetic polynucleotide
atcatctcaccttgcctcctgttaccttgagatcccggcctgcaggtttaattataattaagagatttaattataattaagtcgtttaattataattaaggactttaattataattaagctatttaattataattaagacttttaattataattaagtgcggcgcgccatgcttcatcagactct

SEQ ID NO: 7225 - DNA, 185 bp, Artificial Sequence; identical to SEQ ID NO: 7224
  Synthetic polynucleotide

SEQ ID NO: 7226 - DNA, 190 bp, Artificial Sequence
  Synthetic polynucleotide
atcatctcaccttgcctcctgcgatccgattcacgcgacctgcaggtgcatgtcattttgagatgcatgtcattttgtcgtgcatgtcattttggactgcatgtcattttgctatgcatgtcattttgacttgcatgtcattttgtgctgcatgtcattttggtaggcgcgccatgcttcatcagactct

SEQ ID NO: 7227 - DNA, 190 bp, Artificial Sequence; identical to SEQ ID NO: 7226
  Synthetic polynucleotide

SEQ ID NO: 7228 - DNA, 180 bp, Artificial Sequence
  Synthetic polynucleotide
atcatctcaccttgcctcctgctgggaagacaacaggacctgcaggccacgtgatccagaccacgtgatcctcgccacgtgatccgacccacgtgatccctaccacgtgatccactccacgtgatcctgcccacgtgatccgtaccacgtgatccggcgcgccatgcttcatcagactct

SEQ ID NO: 7229 - DNA, 180 bp, Artificial Sequence; identical to SEQ ID NO: 7228
  Synthetic polynucleotide

SEQ ID NO: 7230 - DNA, 190 bp, Artificial Sequence
  Synthetic polynucleotide
atcatctcaccttgcctcctgtcaagcgataattgggacctgcagggcagctgtccgaggagagcagctgtccgaggtcggcagctgtccgagggacgcagctgtccgaggctagcagctgtccgaggactgcagctgtccgaggtgcgcagctgtccgagggtaggcgcgccatgcttcatcagactct

SEQ ID NO: 7231 - DNA, 190 bp, Artificial Sequence; identical to SEQ ID NO: 7230
  Synthetic polynucleotide

SEQ ID NO: 7232 - DNA, 164 bp, Artificial Sequence
  Synthetic polynucleotide
atcatctcaccttgcctcctgtgcacacggcgtgatcacctgcaggccacgtggtagaccacgtggttcgccacgtggtgacccacgtggtctaccacgtggtactccacgtggttgcccacgtggtgtaccacgtggtggcgcgccatgcttcatcagactct

SEQ ID NO: 7233 - DNA, 164 bp, Artificial Sequence; identical to SEQ ID NO: 7232
  Synthetic polynucleotide

SEQ ID NO: 7234 - DNA, 197 bp, Artificial Sequence
  Synthetic polynucleotide
atcatctcaccttgcctcctggctacgtagtcgagatgcctgcaggaaccacctgttgaccagaaaccacctgttgacctcgaaccacctgttgaccgacaaccacctgttgaccctaaaccacctgttgaccactaaccacctgttgacctgcaaccacctgttgaccgtaggcgcgccatgcttcatcagactct

SEQ ID NO: 7235 - DNA, 197 bp, Artificial Sequence; identical to SEQ ID NO: 7234
  Synthetic polynucleotide

SEQ ID NO: 7236 - DNA, 188 bp, Artificial Sequence
  Synthetic polynucleotide
atcatctcaccttgcctcctggataatgagggccgtatcctgcagggcgcagctgcgtagagcgcagctgcgttcggcgcagctgcgtgacgcgcagctgcgtctagcgcagctgcgtactgcgcagctgcgttgcgcgcagctgcgtgtagcgcagctgcgtggcgcgccatgcttcatcagactct

SEQ ID NO: 7237 - DNA, 188 bp, Artificial Sequence; identical to SEQ ID NO: 7236
  Synthetic polynucleotide

SEQ ID NO: 7238 - DNA, 185 bp, Artificial Sequence
  Synthetic polynucleotide
atcatctcaccttgcctcctgcaatgcacttgtgatatcctgcagggtagtaattaatgcaaagagtagtaattaatgcaatcggtagtaattaatgcaagacgtagtaattaatgcaactagtagtaattaatgcaaactgtagtaattaatgcaatgcggcgcgccatgcttcatcagactct

SEQ ID NO: 7239 - DNA, 185 bp, Artificial Sequence; identical to SEQ ID NO: 7238
  Synthetic polynucleotide

SEQ ID NO: 7240 - DNA, 196 bp, Artificial Sequence
  Synthetic polynucleotide
atcatctcaccttgcctcctgataacagcgggttcggccctgcaggtatttggtaaggcagatatttggtaaggctcgtatttggtaaggcgactatttggtaaggcctatatttggtaaggcacttatttggtaaggctgctatttggtaaggcgtatatttggtaaggcggcgcgccatgcttcatcagactct

SEQ ID NO: 7241 - DNA, 196 bp, Artificial Sequence; identical to SEQ ID NO: 7240
  Synthetic polynucleotide

SEQ ID NO: 7242 - DNA, 191 bp, Artificial Sequence
  Synthetic polynucleotide
atcatctcaccttgcctcctgggtagctaacttacaagcctgcaggggtcgcgcacgcatgaccgccagaggtcgcgcacgcatgaccgcctcgggtcgcgcacgcatgaccgccgacggtcgcgcacgcatgaccgccctaggtcgcgcacgcatgaccgccactggcgcgccatgcttcatcagactct

SEQ ID NO: 7243 - DNA, 191 bp, Artificial Sequence; identical to SEQ ID NO: 7242
  Synthetic polynucleotide

SEQ ID NO: 7244 - DNA, 164 bp, Artificial Sequence
  Synthetic polynucleotide
atcatctcaccttgcctcctgagtgaggctgtgcctagcctgcaggcaagatggcagacaagatggctcgcaagatggcgaccaagatggcctacaagatggcactcaagatggctgccaagatggcgtacaagatggcggcgcgccatgcttcatcagactct

SEQ ID NO: 7245 - DNA, 164 bp, Artificial Sequence; identical to SEQ ID NO: 7244
  Synthetic polynucleotide

SEQ ID NO: 7246 - DNA, 172 bp, Artificial Sequence
  Synthetic polynucleotide
atcatctcaccttgcctcctgaacaaggaaatcctggtcctgcaggattacatgatagaattacatgattcgattacatgatgacattacatgatctaattacatgatactattacatgattgcattacatgatgtaattacatgatggcgcgccatgcttcatcagactct

SEQ ID NO: 7247 - DNA, 172 bp, Artificial Sequence; identical to SEQ ID NO: 7246
  Synthetic polynucleotide

SEQ ID NO: 7248 - DNA, 196 bp, Artificial Sequence
  Synthetic polynucleotide
atcatctcaccttgcctcctgactctaataggtccgtccctgcaggtctgtttgtttatagatctgtttgtttattcgtctgtttgtttatgactctgtttgtttatctatctgtttgtttatacttctgtttgtttattgctctgtttgtttatgtatctgtttgtttatggcgcgccatgcttcatcagactct

SEQ ID NO: 7249 - DNA, 196 bp, Artificial Sequence; identical to SEQ ID NO: 7248
  Synthetic polynucleotide

SEQ ID NO: 7250 - DNA, 191 bp, Artificial Sequence
  Synthetic polynucleotide
atcatctcaccttgcctcctgctagttccgtgatcctccctgcaggctaatcgttttccgattagcgagactaatcgttttccgattagcgtcgctaatcgttttccgattagcggacctaatcgttttccgattagcgctactaatcgttttccgattagcgactggcgcgccatgcttcatcagactct

SEQ ID NO: 7251 - DNA, 191 bp, Artificial Sequence; identical to SEQ ID NO: 7250
  Synthetic polynucleotide

SEQ ID NO: 7252 - DNA, 186 bp, Artificial Sequence
  Synthetic polynucleotide
atcatctcaccttgcctcctgcggtcggagattcggttcctgcaggaccgggtcacgtgcagaagcagaaccgggtcacgtgcagaagctcgaccgggtcacgtgcagaagcgacaccgggtcacgtgcagaagcctaaccgggtcacgtgcagaagcactggcgcgccatgcttcatcagactct

SEQ ID NO: 7253 - DNA, 186 bp, Artificial Sequence; identical to SEQ ID NO: 7252
  Synthetic polynucleotide

SEQ ID NO: 7254 - DNA, 197 bp, Artificial Sequence
  Synthetic polynucleotide
atcatctcaccttgcctcctggagaacacatagcgatacctgcaggatcgcctcaggcaatagaatcgcctcaggcaattcgatcgcctcaggcaatgacatcgcctcaggcaatctaatcgcctcaggcaatactatcgcctcaggcaattgcatcgcctcaggcaatgtaggcgcgccatgcttcatcagactct

SEQ ID NO: 7255 - DNA, 197 bp, Artificial Sequence; identical to SEQ ID NO: 7254
  Synthetic polynucleotide

SEQ ID NO: 7256 - DNA, 191 bp, Artificial Sequence
  Synthetic polynucleotide
atcatctcaccttgcctcctgcatttctgcagcggttgcctgcaggacggccataaaattaatagaacggccataaaattaattcgacggccataaaattaatgacacggccataaaattaatctaacggccataaaattaatactacggccataaaattaattgcggcgcgccatgcttcatcagactct

SEQ ID NO: 7257 - DNA, 191 bp, Artificial Sequence; identical to SEQ ID NO: 7256
  Synthetic polynucleotide

SEQ ID NO: 7258 - DNA, 191 bp, Artificial Sequence
  Synthetic polynucleotide
atcatctcaccttgcctcctgttcaaggctgacctaatcctgcaggatagtgagcactgttcgagaatagtgagcactgttcgtcgatagtgagcactgttcggacatagtgagcactgttcgctaatagtgagcactgttcgactatagtgagcactgttcgtgcggcgcgccatgcttcatcagactct

SEQ ID NO: 7259 - DNA, 191 bp, Artificial Sequence; identical to SEQ ID NO: 7258
  Synthetic polynucleotide

SEQ ID NO: 7260 - DNA, 164 bp, Artificial Sequence
  Synthetic polynucleotide
atcatctcaccttgcctcctggatggttactccctagccctgcaggtcaaggtcaagatcaaggtcatcgtcaaggtcagactcaaggtcactatcaaggtcaacttcaaggtcatgctcaaggtcagtatcaaggtcaggcgcgccatgcttcatcagactct

SEQ ID NO: 7261 - DNA, 164 bp, Artificial Sequence; identical to SEQ ID NO: 7260
  Synthetic polynucleotide

SEQ ID NO: 7262 - DNA, 191 bp, Artificial Sequence
  Synthetic polynucleotide
atcatctcaccttgcctcctgatccctacaacgtgagccctgcagggaaatttaatccctctaagagaaatttaatccctctatcggaaatttaatccctctagacgaaatttaatccctctactagaaatttaatccctctaactgaaatttaatccctctatgcggcgcgccatgcttcatcagactct

SEQ ID NO: 7263 - DNA, 191 bp, Artificial Sequence; identical to SEQ ID NO: 7262
  Synthetic polynucleotide

SEQ ID NO: 7264 - DNA, 197 bp, Artificial Sequence
  Synthetic polynucleotide
atcatctcaccttgcctcctgtcgagaagctatacagccctgcaggaggtgttctgttaacactagaaggtgttctgttaacacttcgaggtgttctgttaacactgacaggtgttctgttaacactctaaggtgttctgttaacactactaggtgttctgttaacacttgcggcgcgccatgcttcatcagactct

SEQ ID NO: 7265 - DNA, 197 bp, Artificial Sequence; identical to SEQ ID NO: 7264
  Synthetic polynucleotide

SEQ ID NO: 7266 - DNA, 180 bp, Artificial Sequence
  Synthetic polynucleotide
atcatctcaccttgcctcctggagctatggtcttgaagcctgcaggctgggtagagcagactgggtagagctcgctgggtagagcgacctgggtagagcctactgggtagagcactctgggtagagctgcctgggtagagcgtactgggtagagcggcgcgccatgcttcatcagactct

SEQ ID NO: 7267 - DNA, 180 bp, Artificial Sequence; identical to SEQ ID NO: 7266
  Synthetic polynucleotide

SEQ ID NO: 7268 - DNA, 200 bp, Artificial Sequence
  Synthetic polynucleotide
atcatctcaccttgcctcctgccagctgccagttgtgtcctgcagggtgaccttaataaggtcacagagtgaccttaataaggtcactcggtgaccttaataaggtcacgacgtgaccttaataaggtcacctagtgaccttaataaggtcacactgtgaccttaataaggtcacggcgcgccatgcttcatcagactct

SEQ ID NO: 7269 - DNA, 200 bp, Artificial Sequence; identical to SEQ ID NO: 7268
  Synthetic polynucleotide

SEQ ID NO: 7270 - DNA, 172 bp, Artificial Sequence
  Synthetic polynucleotide
atcatctcaccttgcctcctgatgcagctgtgaacccacctgcaggattttacgacagaattttacgactcgattttacgacgacattttacgacctaattttacgacactattttacgactgcattttacgacgtaattttacgacggcgcgccatgcttcatcagactct

SEQ ID NO: 7271 - DNA, 172 bp, Artificial Sequence; identical to SEQ ID NO: 7270
  Synthetic polynucleotide

SEQ ID NO: 7272 - DNA, 172 bp, Artificial Sequence
  Synthetic polynucleotide
atcatctcaccttgcctcctgttcggagagcttagaggcctgcagggttgccagggagagttgccagggtcggttgccaggggacgttgccagggctagttgccagggactgttgccagggtgcgttgccaggggtagttgccagggggcgcgccatgcttcatcagactct

SEQ ID NO: 7273 - DNA, 172 bp, Artificial Sequence; identical to SEQ ID NO: 7272
  Synthetic polynucleotide

SEQ ID NO: 7274 - DNA, 172 bp, Artificial Sequence
  Synthetic polynucleotide
atcatctcaccttgcctcctgcccaacgtaatagacctcctgcaggagcacctgtcagaagcacctgtctcgagcacctgtcgacagcacctgtcctaagcacctgtcactagcacctgtctgcagcacctgtcgtaagcacctgtcggcgcgccatgcttcatcagactct

SEQ ID NO: 7275 - DNA, 172 bp, Artificial Sequence; identical to SEQ ID NO: 7274
  Synthetic polynucleotide

SEQ ID NO: 7276 - DNA, 156 bp, Artificial Sequence
  Synthetic polynucleotide
atcatctcaccttgcctcctgttcacccgtgcgtccaacctgcaggtcacacctagatcacaccttcgtcacacctgactcacacctctatcacacctacttcacaccttgctcacacctgtatcacacctggcgcgccatgcttcatcagactct

SEQ ID NO: 7277 - DNA, 156 bp, Artificial Sequence; identical to SEQ ID NO: 7276
  Synthetic polynucleotide

SEQ ID NO: 7278 - DNA, 180 bp, Artificial Sequence
  Synthetic polynucleotide
atcatctcaccttgcctcctggcacttgacagattctccctgcaggtatgtaaatatagatatgtaaatattcgtatgtaaatatgactatgtaaatatctatatgtaaatatacttatgtaaatattgctatgtaaatatgtatatgtaaatatggcgcgccatgcttcatcagactct

SEQ ID NO: 7279 - DNA, 180 bp, Artificial Sequence; identical to SEQ ID NO: 7278
  Synthetic polynucleotide

SEQ ID NO: 7280 - DNA, 140 bp, Artificial Sequence
  Synthetic polynucleotide
atcatctcaccttgcctcctgggtatccatctcggatccctgcaggcaggtgagacaggtgtcgcaggtggaccaggtgctacaggtgactcaggtgtgccaggtggtacaggtgggcgcgccatgcttcatcagactct

SEQ ID NO: 7281 - DNA, 140 bp, Artificial Sequence; identical to SEQ ID NO: 7280
  Synthetic polynucleotide

SEQ ID NO: 7282 - DNA, 197 bp, Artificial Sequence
  Synthetic polynucleotide
atcatctcaccttgcctcctgaagtttcagggcccacccctgcagggcgccagctgctggcagagcgccagctgctggctcggcgccagctgctggcgacgcgccagctgctggcctagcgccagctgctggcactgcgccagctgctggctgcgcgccagctgctggcgtaggcgcgccatgcttcatcagactct

SEQ ID NO: 7283 - DNA, 197 bp, Artificial Sequence; identical to SEQ ID NO: 7282
  Synthetic polynucleotide

SEQ ID NO: 7284 - DNA, 186 bp, Artificial Sequence
  Synthetic polynucleotide
atcatctcaccttgcctcctgaatctcaatcaagcttccctgcaggtcacaccttagaaggtgtgaagatcacaccttagaaggtgtgatcgtcacaccttagaaggtgtgagactcacaccttagaaggtgtgactatcacaccttagaaggtgtgaactggcgcgccatgcttcatcagactct

SEQ ID NO: 7285 - DNA, 186 bp, Artificial Sequence; identical to SEQ ID NO: 7284
  Synthetic polynucleotide

SEQ ID NO: 7286 - DNA, 188 bp, Artificial Sequence
  Synthetic polynucleotide
atcatctcaccttgcctcctgcaatacagaggtaagatcctgcaggtttgcagccctaagatttgcagccctatcgtttgcagccctagactttgcagccctactatttgcagccctaacttttgcagccctatgctttgcagccctagtatttgcagccctaggcgcgccatgcttcatcagactct

SEQ ID NO: 7287 - DNA, 188 bp, Artificial Sequence; identical to SEQ ID NO: 7286
  Synthetic polynucleotide

SEQ ID NO: 7288 - DNA, 164 bp, Artificial Sequence
  Synthetic polynucleotide
atcatctcaccttgcctcctgattagtagtatcgtggacctgcaggcttaattgaagacttaattgatcgcttaattgagaccttaattgactacttaattgaactcttaattgatgccttaattgagtacttaattgaggcgcgccatgcttcatcagactct

SEQ ID NO: 7289 - DNA, 164 bp, Artificial Sequence; identical to SEQ ID NO: 7288
  Synthetic polynucleotide

SEQ ID NO: 7290 - DNA, 191 bp, Artificial Sequence
  Synthetic polynucleotide
atcatctcaccttgcctcctgtgaaagcgatataaccacctgcaggggcgctgtccgtggtgctgaaagaggcgctgtccgtggtgctgaatcgggcgctgtccgtggtgctgaagacggcgctgtccgtggtgctgaactaggcgctgtccgtggtgctgaaactggcgcgccatgcttcatcagactct

SEQ ID NO: 7291 - DNA, 191 bp, Artificial Sequence; identical to SEQ ID NO: 7290
  Synthetic polynucleotide

SEQ ID NO: 7292 - DNA, 197 bp, Artificial Sequence
  Synthetic polynucleotide
atcatctcaccttgcctcctgaaccaaagagtttcacgcctgcaggtttgcataacaaaggagatttgcataacaaaggtcgtttgcataacaaagggactttgcataacaaaggctatttgcataacaaaggacttttgcataacaaaggtgctttgcataacaaagggtaggcgcgccatgcttcatcagactct

SEQ ID NO: 7293 - DNA, 197 bp, Artificial Sequence; identical to SEQ ID NO: 7292
  Synthetic polynucleotide

SEQ ID NO: 7294 - DNA, 156 bp, Artificial Sequence
  Synthetic polynucleotide
atcatctcaccttgcctcctggtcgttgagcatcttatcctgcaggatatcaaaagaatatcaaatcgatatcaaagacatatcaaactaatatcaaaactatatcaaatgcatatcaaagtaatatcaaaggcgcgccatgcttcatcagactct

SEQ ID NO: 7295 - DNA, 156 bp, Artificial Sequence; identical to SEQ ID NO: 7294
  Synthetic polynucleotide

SEQ ID NO: 7296 - DNA, 190 bp, Artificial Sequence
  Synthetic polynucleotide
atcatctcaccttgcctcctgaaggtttaacgggagcccctgcaggtcgtaaaactgtcaagatcgtaaaactgtcatcgtcgtaaaactgtcagactcgtaaaactgtcactatcgtaaaactgtcaacttcgtaaaactgtcatgctcgtaaaactgtcagtaggcgcgccatgcttcatcagactct

SEQ ID NO: 7297 - DNA, 190 bp, Artificial Sequence; identical to SEQ ID NO: 7296
  Synthetic polynucleotide

SEQ ID NO: 7298 - DNA, 190 bp, Artificial Sequence
  Synthetic polynucleotide
atcatctcaccttgcctcctggaccctttcgcattgcacctgcaggcgccccctggtggcagacgccccctggtggctcgcgccccctggtggcgaccgccccctggtggcctacgccccctggtggcactcgccccctggtggctgccgccccctggtggcgtaggcgcgccatgcttcatcagactct

SEQ ID NO: 7299 - DNA, 190 bp, Artificial Sequence; identical to SEQ ID NO: 7298
  Synthetic polynucleotide

SEQ ID NO: 7300 - DNA, 196 bp, Artificial Sequence
  Synthetic polynucleotide
atcatctcaccttgcctcctgatttcggcatgcggtaccctgcaggcacaactccccagggaggttgtagacacaactccccagggaggttgttcgcacaactccccagggaggttgtgaccacaactccccagggaggttgtctacacaactccccagggaggttgtactggcgcgccatgcttcatcagactct

SEQ ID NO: 7301 - DNA, 196 bp, Artificial Sequence; identical to SEQ ID NO: 7300
  Synthetic polynucleotide

SEQ ID NO: 7302 - DNA, 148 bp, Artificial Sequence
  Synthetic polynucleotide
atcatctcaccttgcctcctggtctgagtgcactaatacctgcaggtaattgtagataattgttcgtaattgtgactaattgtctataattgtacttaattgttgctaattgtgtataattgtggcgcgccatgcttcatcagactct

SEQ ID NO: 7303 - DNA, 148 bp, Artificial Sequence; identical to SEQ ID NO: 7302
  Synthetic polynucleotide

SEQ ID NO: 7304 - DNA, 185 bp, Artificial Sequence
  Synthetic polynucleotide
atcatctcaccttgcctcctgcaagaccaacgtgggaccctgcaggaatggactttgaccccagaaatggactttgacccctcgaatggactttgaccccgacaatggactttgaccccctaaatggactttgaccccactaatggactttgacccctgcggcgcgccatgcttcatcagactct

SEQ ID NO: 7305 - DNA, 185 bp, Artificial Sequence; identical to SEQ ID NO: 7304
  Synthetic polynucleotide

SEQ ID NO: 7306 - DNA, 191 bp, Artificial Sequence
  Synthetic polynucleotide
atcatctcaccttgcctcctgctttgtttggaggatatcctgcaggttagagggattaacaatagattagagggattaacaattcgttagagggattaacaatgacttagagggattaacaatctattagagggattaacaatactttagagggattaacaattgcggcgcgccatgcttcatcagactct

SEQ ID NO: 7307 - DNA, 191 bp, Artificial Sequence; identical to SEQ ID NO: 7306
  Synthetic polynucleotide

SEQ ID NO: 7308 - DNA, 197 bp, Artificial Sequence
  Synthetic polynucleotide
atcatctcaccttgcctcctgtacggaagtgtgaacgccctgcaggttcaaatttcccgccagattcaaatttcccgcctcgttcaaatttcccgccgacttcaaatttcccgccctattcaaatttcccgccactttcaaatttcccgcctgcttcaaatttcccgccgtaggcgcgccatgcttcatcagactct

SEQ ID NO: 7309 - DNA, 197 bp, Artificial Sequence; identical to SEQ ID NO: 7308
  Synthetic polynucleotide

SEQ ID NO: 7310 - DNA, 148 bp, Artificial Sequence
  Synthetic polynucleotide
atcatctcaccttgcctcctgcggaaccaagtataatgcctgcaggttgatttagattgattttcgttgatttgacttgatttctattgatttactttgattttgcttgatttgtattgatttggcgcgccatgcttcatcagactct

SEQ ID NO: 7311 - DNA, 148 bp, Artificial Sequence; identical to SEQ ID NO: 7310
  Synthetic polynucleotide

SEQ ID NO: 7312 - DNA, 185 bp, Artificial Sequence
  Synthetic polynucleotide
atcatctcaccttgcctcctggctcccgtgctaccatacctgcaggtatttatatataaagaagatatttatatataaagatcgtatttatatataaagagactatttatatataaagactatatttatatataaagaacttatttatatataaagatgcggcgcgccatgcttcatcagactct

SEQ ID NO: 7313 - DNA, 185 bp, Artificial Sequence; identical to SEQ ID NO: 7312
  Synthetic polynucleotide

SEQ ID NO: 7314 - DNA, 164 bp, Artificial Sequence
  Synthetic polynucleotide
atcatctcaccttgcctcctgtgcagtccatagggagccctgcaggagcaggtgtagaagcaggtgttcgagcaggtgtgacagcaggtgtctaagcaggtgtactagcaggtgttgcagcaggtgtgtaagcaggtgtggcgcgccatgcttcatcagactct

SEQ ID NO: 7315 - DNA, 164 bp, Artificial Sequence; identical to SEQ ID NO: 7314
  Synthetic polynucleotide

SEQ ID NO: 7316 - DNA, 140 bp, Artificial Sequence
  Synthetic polynucleotide
atcatctcaccttgcctcctgcagcatgttacccggcacctgcaggtgaactagatgaacttcgtgaactgactgaactctatgaactacttgaacttgctgaactgtatgaactggcgcgccatgcttcatcagactct

SEQ ID NO: 7317 - DNA, 140 bp, Artificial Sequence; identical to SEQ ID NO: 7316
  Synthetic polynucleotide

SEQ ID NO: 7318 - DNA, 140 bp, Artificial Sequence
  Synthetic polynucleotide
atcatctcaccttgcctcctgcgtcgtctcccttcacacctgcagggccatcagagccatctcggccatcgacgccatcctagccatcactgccatctgcgccatcgtagccatcggcgcgccatgcttcatcagactct

SEQ ID NO: 7319 - DNA, 140 bp, Artificial Sequence; identical to SEQ ID NO: 7318
  Synthetic polynucleotide

SEQ ID NO: 7320 - DNA, 190 bp, Artificial Sequence
  Synthetic polynucleotide
atcatctcaccttgcctcctggttgcactgataaggatcctgcaggatattgcaaaatcaagaatattgcaaaatcatcgatattgcaaaatcagacatattgcaaaatcactaatattgcaaaatcaactatattgcaaaatcatgcatattgcaaaatcagtaggcgcgccatgcttcatcagactct

SEQ ID NO: 7321 - DNA, 190 bp, Artificial Sequence; identical to SEQ ID NO: 7320
  Synthetic polynucleotide

SEQ ID NO: 7322 - DNA, 148 bp, Artificial Sequence
  Synthetic polynucleotide
atcatctcaccttgcctcctgcacccgtctgttcatgtcctgcaggtaattgcagataattgctcgtaattgcgactaattgcctataattgcacttaattgctgctaattgcgtataattgcggcgcgccatgcttcatcagactct

SEQ ID NO: 7323 - DNA, 148 bp, Artificial Sequence; identical to SEQ ID NO: 7322
  Synthetic polynucleotide

SEQ ID NO: 7324 - DNA, 197 bp, Artificial Sequence
  Synthetic polynucleotide
atcatctcaccttgcctcctgttgctagagatagggatcctgcaggcttcgccacctgcttcggagacttcgccacctgcttcggtcgcttcgccacctgcttcgggaccttcgccacctgcttcggctacttcgccacctgcttcggactcttcgccacctgcttcggtgcggcgcgccatgcttcatcagactct

SEQ ID NO: 7325 - DNA, 197 bp, Artificial Sequence; identical to SEQ ID NO: 7324
  Synthetic polynucleotide

SEQ ID NO: 7326 - DNA, 180 bp, Artificial Sequence
  Synthetic polynucleotide
atcatctcaccttgcctcctgagctatctacgatagttcctgcaggatgttacataaagaatgttacataatcgatgttacataagacatgttacataactaatgttacataaactatgttacataatgcatgttacataagtaatgttacataaggcgcgccatgcttcatcagactct

SEQ ID NO: 7327 - DNA, 180 bp, Artificial Sequence; identical to SEQ ID NO: 7326
  Synthetic polynucleotide

SEQ ID NO: 7328 - DNA, 148 bp, Artificial Sequence
  Synthetic polynucleotide
atcatctcaccttgcctcctgggacagccacctcctatcctgcaggtaattggagataattggtcgtaattgggactaattggctataattggacttaattggtgctaattgggtataattggggcgcgccatgcttcatcagactct

SEQ ID NO: 7329 - DNA, 148 bp, Artificial Sequence; identical to SEQ ID NO: 7328
  Synthetic polynucleotide

SEQ ID NO: 7330 - DNA, 191 bp, Artificial Sequence
  Synthetic polynucleotide
atcatctcaccttgcctcctgccattaggataatcacacctgcagggttgttaagtggttatgagagttgttaagtggttatgtcggttgttaagtggttatggacgttgttaagtggttatgctagttgttaagtggttatgactgttgttaagtggttatgtgcggcgcgccatgcttcatcagactct

SEQ ID NO: 7331 - DNA, 191 bp, Artificial Sequence; identical to SEQ ID NO: 7330
  Synthetic polynucleotide

SEQ ID NO: 7332 - DNA, 172 bp, Artificial Sequence
  Synthetic polynucleotide
atcatctcaccttgcctcctgaggtagtcagcagtttccctgcagggacaggtgctagagacaggtgcttcggacaggtgctgacgacaggtgctctagacaggtgctactgacaggtgcttgcgacaggtgctgtagacaggtgctggcgcgccatgcttcatcagactct

SEQ ID NO: 7333 - DNA, 172 bp, Artificial Sequence; identical to SEQ ID NO: 7332
  Synthetic polynucleotide

SEQ ID NO: 7334 - DNA, 172 bp, Artificial Sequence
  Synthetic polynucleotide
atcatctcaccttgcctcctgtaataaccgaaccacgacctgcagggggccacgtgagagggccacgtgtcggggccacgtggacgggccacgtgctagggccacgtgactgggccacgtgtgcgggccacgtggtagggccacgtgggcgcgccatgcttcatcagactct

SEQ ID NO: 7335 - DNA, 172 bp, Artificial Sequence; identical to SEQ ID NO: 7334
  Synthetic polynucleotide

SEQ ID NO: 7336 - DNA, 191 bp, Artificial Sequence
  Synthetic polynucleotide
atcatctcaccttgcctcctgccatcacttcgtataaccctgcagggggtacataatgttcccagagggtacataatgttccctcggggtacataatgttcccgacgggtacataatgttcccctagggtacataatgttcccactgggtacataatgttccctgcggcgcgccatgcttcatcagactct

SEQ ID NO: 7337 - DNA, 191 bp, Artificial Sequence; identical to SEQ ID NO: 7336
  Synthetic polynucleotide

SEQ ID NO: 7338 - DNA, 188 bp, Artificial Sequence
  Synthetic polynucleotide
atcatctcaccttgcctcctgttgtcaatatccaggttcctgcaggatctcgtttggaagaatctcgtttggatcgatctcgtttggagacatctcgtttggactaatctcgtttggaactatctcgtttggatgcatctcgtttggagtaatctcgtttggaggcgcgccatgcttcatcagactct

SEQ ID NO: 7339 - DNA, 188 bp, Artificial Sequence; identical to SEQ ID NO: 7338
  Synthetic polynucleotide

SEQ ID NO: 7340 - DNA, 156 bp, Artificial Sequence
  Synthetic polynucleotide
atcatctcaccttgcctcctggaataagggcgggaaatcctgcaggaaatgtaaagaaaatgtaatcgaaatgtaagacaaatgtaactaaaatgtaaactaaatgtaatgcaaatgtaagtaaaatgtaaggcgcgccatgcttcatcagactct

SEQ ID NO: 7341 - DNA, 156 bp, Artificial Sequence; identical to SEQ ID NO: 7340
  Synthetic polynucleotide

SEQ ID NO: 7342 - DNA, 197 bp, Artificial Sequence
  Synthetic polynucleotide
atcatctcaccttgcctcctgtcactgaaacgccagcacctgcagggaccacgcccttattagagaccacgcccttatttcggaccacgcccttattgacgaccacgcccttattctagaccacgcccttattactgaccacgcccttatttgcgaccacgcccttattgtaggcgcgccatgcttcatcagactct

SEQ ID NO: 7343 - DNA, 197 bp, Artificial Sequence; identical to SEQ ID NO: 7342
  Synthetic polynucleotide

SEQ ID NO: 7344 - DNA, 190 bp, Artificial Sequence
  Synthetic polynucleotide
atcatctcaccttgcctcctgtcagcaccgcgcatcttcctgcaggggcaaacaggaaatagaggcaaacaggaaattcgggcaaacaggaaatgacggcaaacaggaaatctaggcaaacaggaaatactggcaaacaggaaattgcggcaaacaggaaatgtaggcgcgccatgcttcatcagactct

SEQ ID NO: 7345 - DNA, 190 bp, Artificial Sequence; identical to SEQ ID NO: 7344
  Synthetic polynucleotide

SEQ ID NO: 7346 - DNA, 190 bp, Artificial Sequence
  Synthetic polynucleotide
atcatctcaccttgcctcctgttgtggtactgcacgcacctgcaggatgagtcatctcctagaatgagtcatctccttcgatgagtcatctcctgacatgagtcatctcctctaatgagtcatctcctactatgagtcatctccttgcatgagtcatctcctgtaggcgcgccatgcttcatcagactct

SEQ ID NO: 7347 - DNA, 190 bp, Artificial Sequence; identical to SEQ ID NO: 7346
  Synthetic polynucleotide

SEQ ID NO: 7348 - DNA, 156 bp, Artificial Sequence
  Synthetic polynucleotide
atcatctcaccttgcctcctgtgtagtgatagtagaagcctgcaggcacctgtcagacacctgtctcgcacctgtcgaccacctgtcctacacctgtcactcacctgtctgccacctgtcgtacacctgtcggcgcgccatgcttcatcagactct

SEQ ID NO: 7349 - DNA, 156 bp, Artificial Sequence; identical to SEQ ID NO: 7348
  Synthetic polynucleotide

SEQ ID NO: 7350 - DNA, 172 bp, Artificial Sequence
  Synthetic polynucleotide
atcatctcaccttgcctcctggatctcacgcttgaccccctgcagggatgacgtgtagagatgacgtgttcggatgacgtgtgacgatgacgtgtctagatgacgtgtactgatgacgtgttgcgatgacgtgtgtagatgacgtgtggcgcgccatgcttcatcagactct

SEQ ID NO: 7351 - DNA, 172 bp, Artificial Sequence; identical to SEQ ID NO: 7350
  Synthetic polynucleotide

SEQ ID NO: 7352 - DNA, 190 bp, Artificial Sequence
  Synthetic polynucleotide
atcatctcaccttgcctcctgggtgccagctaggaaaccctgcagggaacagaatgttccagagaacagaatgttcctcggaacagaatgttccgacgaacagaatgttccctagaacagaatgttccactgaacagaatgttcctgcgaacagaatgttccgtaggcgcgccatgcttcatcagactct

SEQ ID NO: 7353 - DNA, 190 bp, Artificial Sequence; identical to SEQ ID NO: 7352
  Synthetic polynucleotide

SEQ ID NO: 7354 - DNA, 185 bp, Artificial Sequence
  Synthetic polynucleotide
atcatctcaccttgcctcctgacacccacatcggtatgcctgcagggctatttgtcgtaaatagagctatttgtcgtaaattcggctatttgtcgtaaatgacgctatttgtcgtaaatctagctatttgtcgtaaatactgctatttgtcgtaaattgcggcgcgccatgcttcatcagactct

SEQ ID NO: 7355 - DNA, 185 bp, Artificial Sequence; identical to SEQ ID NO: 7354
  Synthetic polynucleotide

SEQ ID NO: 7356 - DNA, 164 bp, Artificial Sequence
  Synthetic polynucleotide
atcatctcaccttgcctcctgtatcccagtgatatacacctgcaggctcttatctagactcttatcttcgctcttatctgacctcttatctctactcttatctactctcttatcttgcctcttatctgtactcttatctggcgcgccatgcttcatcagactct

SEQ ID NO: 7357 - DNA, 164 bp, Artificial Sequence; identical to SEQ ID NO: 7356
  Synthetic polynucleotide

SEQ ID NO: 7358 - DNA, 180 bp, Artificial Sequence
  Synthetic polynucleotide
atcatctcaccttgcctcctgtaattccgcttgaacaccctgcaggtgacgtcagagagatgacgtcagagtcgtgacgtcagaggactgacgtcagagctatgacgtcagagacttgacgtcagagtgctgacgtcagaggtatgacgtcagagggcgcgccatgcttcatcagactct

SEQ ID NO: 7359 - DNA, 180 bp, Artificial Sequence; identical to SEQ ID NO: 7358
  Synthetic polynucleotide

SEQ ID NO: 7360 - DNA, 172 bp, Artificial Sequence
  Synthetic polynucleotide
atcatctcaccttgcctcctgggcagcacaaagattcgcctgcagggcggattaacagagcggattaactcggcggattaacgacgcggattaacctagcggattaacactgcggattaactgcgcggattaacgtagcggattaacggcgcgccatgcttcatcagactct

SEQ ID NO: 7361 - DNA, 172 bp, Artificial Sequence; identical to SEQ ID NO: 7360
  Synthetic polynucleotide

SEQ ID NO: 7362 - DNA, 196 bp, Artificial Sequence
  Synthetic polynucleotide
atcatctcaccttgcctcctggtctatacagttactcccctgcagggtcattttggaagagagtcattttggaagtcggtcattttggaaggacgtcattttggaagctagtcattttggaagactgtcattttggaagtgcgtcattttggaaggtagtcattttggaagggcgcgccatgcttcatcagactct

SEQ ID NO: 7363 - DNA, 196 bp, Artificial Sequence; identical to SEQ ID NO: 7362
  Synthetic polynucleotide

SEQ ID NO: 7364 - DNA, 140 bp, Artificial Sequence
  Synthetic polynucleotide
atcatctcaccttgcctcctgccctactccatgggctacctgcaggataattagaataatttcgataattgacataattctaataattactataatttgcataattgtaataattggcgcgccatgcttcatcagactct

SEQ ID NO: 7365 - DNA, 140 bp, Artificial Sequence; identical to SEQ ID NO: 7364
  Synthetic polynucleotide

SEQ ID NO: 7366 - DNA, 197 bp, Artificial Sequence
  Synthetic polynucleotide
atcatctcaccttgcctcctgacgttgtggtcctgagacctgcaggtcagcaccatggacaagatcagcaccatggacatcgtcagcaccatggacagactcagcaccatggacactatcagcaccatggacaacttcagcaccatggacatgctcagcaccatggacagtaggcgcgccatgcttcatcagactct

SEQ ID NO: 7367 - DNA, 197 bp, Artificial Sequence; identical to SEQ ID NO: 7366
  Synthetic polynucleotide

SEQ ID NO: 7368 - DNA, 191 bp, Artificial Sequence
  Synthetic polynucleotide
atcatctcaccttgcctcctgaaagcctacctaattcacctgcaggacaagcaattaaagaatagaacaagcaattaaagaattcgacaagcaattaaagaatgacacaagcaattaaagaatctaacaagcaattaaagaatactacaagcaattaaagaattgcggcgcgccatgcttcatcagactct

SEQ ID NO: 7369 - DNA, 191 bp, Artificial Sequence; identical to SEQ ID NO: 7368
  Synthetic polynucleotide

SEQ ID NO: 7370 - DNA, 172 bp, Artificial Sequence
  Synthetic polynucleotide
atcatctcaccttgcctcctgagacagggtaactcgttcctgcaggggtggtacggagaggtggtacggtcgggtggtacgggacggtggtacggctaggtggtacggactggtggtacggtgcggtggtacgggtaggtggtacggggcgcgccatgcttcatcagactct

SEQ ID NO: 7371 - DNA, 172 bp, Artificial Sequence; identical to SEQ ID NO: 7370
  Synthetic polynucleotide

SEQ ID NO: 7372 - DNA, 197 bp, Artificial Sequence
  Synthetic polynucleotide
atcatctcaccttgcctcctgagctaagctgcgctggacctgcaggcttctagaaggttctagacttctagaaggttcttcgcttctagaaggttctgaccttctagaaggttctctacttctagaaggttctactcttctagaaggttcttgccttctagaaggttctgtaggcgcgccatgcttcatcagactct

SEQ ID NO: 7373 - DNA, 197 bp, Artificial Sequence; identical to SEQ ID NO: 7372
  Synthetic polynucleotide

SEQ ID NO: 7374 - DNA, 188 bp, Artificial Sequence
  Synthetic polynucleotide
atcatctcaccttgcctcctgaatcacctgcgggaaggcctgcagggaccatctgttcagagaccatctgttctcggaccatctgttcgacgaccatctgttcctagaccatctgttcactgaccatctgttctgcgaccatctgttcgtagaccatctgttcggcgcgccatgcttcatcagactct

SEQ ID NO: 7375 - DNA, 188 bp, Artificial Sequence; identical to SEQ ID NO: 7374
  Synthetic polynucleotide

SEQ ID NO: 7376 - DNA, 156 bp, Artificial Sequence
  Synthetic polynucleotide
atcatctcaccttgcctcctgtctggcgttagacaatgcctgcaggcttaattgagacttaattgtcgcttaattggaccttaattgctacttaattgactcttaattgtgccttaattggtacttaattgggcgcgccatgcttcatcagactct

SEQ ID NO: 7377 - DNA, 156 bp, Artificial Sequence; identical to SEQ ID NO: 7376
  Synthetic polynucleotide

SEQ ID NO: 7378 - DNA, 172 bp, Artificial Sequence
  Synthetic polynucleotide
atcatctcaccttgcctcctgcgccattctggtagttacctgcaggtttaagtggcagatttaagtggctcgtttaagtggcgactttaagtggcctatttaagtggcacttttaagtggctgctttaagtggcgtatttaagtggcggcgcgccatgcttcatcagactct

SEQ ID NO: 7379 - DNA, 172 bp, Artificial Sequence; identical to SEQ ID NO: 7378
  Synthetic polynucleotide

SEQ ID NO: 7380 - DNA, 197 bp, Artificial Sequence
  Synthetic polynucleotide
atcatctcaccttgcctcctggatgttctcgacgacttcctgcaggtttgcataacaaaaaagatttgcataacaaaaatcgtttgcataacaaaaagactttgcataacaaaaactatttgcataacaaaaaacttttgcataacaaaaatgctttgcataacaaaaagtaggcgcgccatgcttcatcagactct

SEQ ID NO: 7381 - DNA, 197 bp, Artificial Sequence; identical to SEQ ID NO: 7380
  Synthetic polynucleotide

SEQ ID NO: 7382 - DNA, 156 bp, Artificial Sequence
  Synthetic polynucleotide
atcatctcaccttgcctcctgataaactctaggtgcgtcctgcaggtcagcaggagatcagcaggtcgtcagcagggactcagcaggctatcagcaggacttcagcaggtgctcagcagggtatcagcaggggcgcgccatgcttcatcagactct

SEQ ID NO: 7383 - DNA, 156 bp, Artificial Sequence; identical to SEQ ID NO: 7382
  Synthetic polynucleotide

SEQ ID NO: 7384 - DNA, 196 bp, Artificial Sequence
  Synthetic polynucleotide
atcatctcaccttgcctcctgttaggagtgactcgtgtcctgcaggataagaacaccctgtacccgccagaataagaacaccctgtacccgcctcgataagaacaccctgtacccgccgacataagaacaccctgtacccgccctaataagaacaccctgtacccgccactggcgcgccatgcttcatcagactct

SEQ ID NO: 7385 - DNA, 196 bp, Artificial Sequence; identical to SEQ ID NO: 7384
  Synthetic polynucleotide

SEQ ID NO: 7386 - DNA, 190 bp, Artificial Sequence
  Synthetic polynucleotide
atcatctcaccttgcctcctggctctgactatagccgacctgcagggtgttgtttacattagagtgttgtttacatttcggtgttgtttacattgacgtgttgtttacattctagtgttgtttacattactgtgttgtttacatttgcgtgttgtttacattgtaggcgcgccatgcttcatcagactct

SEQ ID NO: 7387 - DNA, 190 bp, Artificial Sequence; identical to SEQ ID NO: 7386
  Synthetic polynucleotide

SEQ ID NO: 7388 - DNA, 188 bp, Artificial Sequence
  Synthetic polynucleotide
atcatctcaccttgcctcctgagcgccttcagcaaaggcctgcaggtattacgtaacaagatattacgtaacatcgtattacgtaacagactattacgtaacactatattacgtaacaacttattacgtaacatgctattacgtaacagtatattacgtaacaggcgcgccatgcttcatcagactct

SEQ ID NO: 7389 - DNA, 188 bp, Artificial Sequence; identical to SEQ ID NO: 7388
  Synthetic polynucleotide

SEQ ID NO: 7390 - DNA, 190 bp, Artificial Sequence
  Synthetic polynucleotide
atcatctcaccttgcctcctgacatccaggcacacatccctgcaggaaaaaatcgataatagaaaaaaatcgataattcgaaaaaatcgataatgacaaaaaatcgataatctaaaaaaatcgataatactaaaaaatcgataattgcaaaaaatcgataatgtaggcgcgccatgcttcatcagactct

SEQ ID NO: 7391 - DNA, 190 bp, Artificial Sequence; identical to SEQ ID NO: 7390
  Synthetic polynucleotide

SEQ ID NO: 7392 - DNA, 156 bp, Artificial Sequence
  Synthetic polynucleotide
atcatctcaccttgcctcctggatcttcgcggtttaaacctgcagggtaattggagagtaattggtcggtaattgggacgtaattggctagtaattggactgtaattggtgcgtaattgggtagtaattggggcgcgccatgcttcatcagactct

SEQ ID NO: 7393 - DNA, 156 bp, Artificial Sequence; identical to SEQ ID NO: 7392
  Synthetic polynucleotide

SEQ ID NO: 7394 - DNA, 148 bp, Artificial Sequence
  Synthetic polynucleotide
atcatctcaccttgcctcctgaaagtagacataggcgtcctgcaggccaattaagaccaattatcgccaattagacccaattactaccaattaactccaattatgcccaattagtaccaattaggcgcgccatgcttcatcagactct

SEQ ID NO: 7395 - DNA, 148 bp, Artificial Sequence; identical to SEQ ID NO: 7394
  Synthetic polynucleotide

SEQ ID NO: 7396 - DNA, 164 bp, Artificial Sequence
  Synthetic polynucleotide
atcatctcaccttgcctcctgtgtcttcgtcccataaacctgcaggagggattaaagaagggattaatcgagggattaagacagggattaactaagggattaaactagggattaatgcagggattaagtaagggattaaggcgcgccatgcttcatcagactct

SEQ ID NO: 7397 - DNA, 164 bp, Artificial Sequence; identical to SEQ ID NO: 7396
  Synthetic polynucleotide

SEQ ID NO: 7398 - DNA, 191 bp, Artificial Sequence
  Synthetic polynucleotide
atcatctcaccttgcctcctgaccacgtggtccacctacctgcaggtctgatgtctggatttgagatctgatgtctggatttgtcgtctgatgtctggatttggactctgatgtctggatttgctatctgatgtctggatttgacttctgatgtctggatttgtgcggcgcgccatgcttcatcagactct

SEQ ID NO: 7399 - DNA, 191 bp, Artificial Sequence; identical to SEQ ID NO: 7398
  Synthetic polynucleotide

SEQ ID NO: 7400 - DNA, 156 bp, Artificial Sequence
  Synthetic polynucleotide
atcatctcaccttgcctcctgcgtgctggtagtaatagcctgcaggatgacgtaagaatgacgtatcgatgacgtagacatgacgtactaatgacgtaactatgacgtatgcatgacgtagtaatgacgtaggcgcgccatgcttcatcagactct

SEQ ID NO: 7401 - DNA, 156 bp, Artificial Sequence; identical to SEQ ID NO: 7400
  Synthetic polynucleotide

SEQ ID NO: 7402 - DNA, 164 bp, Artificial Sequence
  Synthetic polynucleotide
atcatctcaccttgcctcctgcgtctagagatccgtcccctgcaggagtgccaatagaagtgccaattcgagtgccaatgacagtgccaatctaagtgccaatactagtgccaattgcagtgccaatgtaagtgccaatggcgcgccatgcttcatcagactct

SEQ ID NO: 7403 - DNA, 164 bp, Artificial Sequence; identical to SEQ ID NO: 7402
  Synthetic polynucleotide

SEQ ID NO: 7404 - DNA, 164 bp, Artificial Sequence
  Synthetic polynucleotide
atcatctcaccttgcctcctgagcaatttacttgatcccctgcaggcttaatcccagacttaatccctcgcttaatcccgaccttaatcccctacttaatcccactcttaatccctgccttaatcccgtacttaatcccggcgcgccatgcttcatcagactct

SEQ ID NO: 7405 - DNA, 164 bp, Artificial Sequence; identical to SEQ ID NO: 7404
  Synthetic polynucleotide

SEQ ID NO: 7406 - DNA, 180 bp, Artificial Sequence
  Synthetic polynucleotide
atcatctcaccttgcctcctgatgcctataaatggccgcctgcaggcctccggcccgagacctccggcccgtcgcctccggcccggaccctccggcccgctacctccggcccgactcctccggcccgtgccctccggcccggtacctccggcccgggcgcgccatgcttcatcagactct

SEQ ID NO: 7407 - DNA, 180 bp, Artificial Sequence; identical to SEQ ID NO: 7406
  Synthetic polynucleotide

SEQ ID NO: 7408 - DNA, 191 bp, Artificial Sequence
  Synthetic polynucleotide
atcatctcaccttgcctcctggacctaagcgaagacctcctgcaggagttaattattaaccaaagaagttaattattaaccaatcgagttaattattaaccaagacagttaattattaaccaactaagttaattattaaccaaactagttaattattaaccaatgcggcgcgccatgcttcatcagactct

SEQ ID NO: 7409 - DNA, 191 bp, Artificial Sequence; identical to SEQ ID NO: 7408
  Synthetic polynucleotide

SEQ ID NO: 7410 - DNA, 172 bp, Artificial Sequence
  Synthetic polynucleotide
atcatctcaccttgcctcctgccagagagttaacggaacctgcaggtcacgtgactagatcacgtgacttcgtcacgtgactgactcacgtgactctatcacgtgactacttcacgtgacttgctcacgtgactgtatcacgtgactggcgcgccatgcttcatcagactct

SEQ ID NO: 7411 - DNA, 172 bp, Artificial Sequence; identical to SEQ ID NO: 7410
  Synthetic polynucleotide

SEQ ID NO: 7412 - DNA, 196 bp, Artificial Sequence
  Synthetic polynucleotide
atcatctcaccttgcctcctgcatagtgtttcgacaaacctgcaggccacctgttgcatagaccacctgttgcattcgccacctgttgcatgacccacctgttgcatctaccacctgttgcatactccacctgttgcattgcccacctgttgcatgtaccacctgttgcatggcgcgccatgcttcatcagactct

SEQ ID NO: 7413 - DNA, 196 bp, Artificial Sequence; identical to SEQ ID NO: 7412
  Synthetic polynucleotide

SEQ ID NO: 7414 - DNA, 185 bp, Artificial Sequence
  Synthetic polynucleotide
atcatctcaccttgcctcctggtgcagtgtatcacgaccctgcaggtggcgcgcgcgcctgaagatggcgcgcgcgcctgatcgtggcgcgcgcgcctgagactggcgcgcgcgcctgactatggcgcgcgcgcctgaacttggcgcgcgcgcctgatgcggcgcgccatgcttcatcagactct

SEQ ID NO: 7415 - DNA, 185 bp, Artificial Sequence; identical to SEQ ID NO: 7414
  Synthetic polynucleotide

SEQ ID NO: 7416 - DNA, 190 bp, Artificial Sequence
  Synthetic polynucleotide
atcatctcaccttgcctcctgtcgagtactcgtgcctccctgcaggcaggcctcggccccagacaggcctcggcccctcgcaggcctcggccccgaccaggcctcggccccctacaggcctcggccccactcaggcctcggcccctgccaggcctcggccccgtaggcgcgccatgcttcatcagactct

SEQ ID NO: 7417 - DNA, 190 bp, Artificial Sequence; identical to SEQ ID NO: 7416
  Synthetic polynucleotide

SEQ ID NO: 7418 - DNA, 148 bp, Artificial Sequence
  Synthetic polynucleotide
atcatctcaccttgcctcctgttcgacggcattgtctacctgcaggaagtgaaagaaagtgaatcgaagtgaagacaagtgaactaaagtgaaactaagtgaatgcaagtgaagtaaagtgaaggcgcgccatgcttcatcagactct

SEQ ID NO: 7419 - DNA, 148 bp, Artificial Sequence; identical to SEQ ID NO: 7418
  Synthetic polynucleotide

SEQ ID NO: 7420 - DNA, 196 bp, Artificial Sequence
  Synthetic polynucleotide
atcatctcaccttgcctcctgtgactctggtgctgggacctgcaggcccttgacctttgagacccttgacctttgtcgcccttgacctttggaccccttgacctttgctacccttgacctttgactcccttgacctttgtgccccttgacctttggtacccttgacctttgggcgcgccatgcttcatcagactct

SEQ ID NO: 7421 - DNA, 196 bp, Artificial Sequence; identical to SEQ ID NO: 7420
  Synthetic polynucleotide

SEQ ID NO: 7422 - DNA, 172 bp, Artificial Sequence
  Synthetic polynucleotide
atcatctcaccttgcctcctgtgacgcgaagcttcttgcctgcagggttcgaatccagagttcgaatcctcggttcgaatccgacgttcgaatccctagttcgaatccactgttcgaatcctgcgttcgaatccgtagttcgaatccggcgcgccatgcttcatcagactct

SEQ ID NO: 7423 - DNA, 172 bp, Artificial Sequence; identical to SEQ ID NO: 7422
  Synthetic polynucleotide

SEQ ID NO: 7424 - DNA, 188 bp, Artificial Sequence
  Synthetic polynucleotide
atcatctcaccttgcctcctgaaagcgacggtgcttcacctgcaggaaagatcaaaggagaaaagatcaaaggtcgaaagatcaaagggacaaagatcaaaggctaaaagatcaaaggactaaagatcaaaggtgcaaagatcaaagggtaaaagatcaaaggggcgcgccatgcttcatcagactct

SEQ ID NO: 7425 - DNA, 188 bp, Artificial Sequence; identical to SEQ ID NO: 7424
  Synthetic polynucleotide

SEQ ID NO: 7426 - DNA, 172 bp, Artificial Sequence
  Synthetic polynucleotide
atcatctcaccttgcctcctgatgtcgggataattaagcctgcaggaaatctcgcgagaaaatctcgcgtcgaaatctcgcggacaaatctcgcgctaaaatctcgcgactaaatctcgcgtgcaaatctcgcggtaaaatctcgcgggcgcgccatgcttcatcagactct

SEQ ID NO: 7427 - DNA, 172 bp, Artificial Sequence; identical to SEQ ID NO: 7426
  Synthetic polynucleotide

SEQ ID NO: 7428 - DNA, 172 bp, Artificial Sequence
  Synthetic polynucleotide
atcatctcaccttgcctcctgcagttgaagtaggccgtcctgcaggtgtttactttagatgtttacttttcgtgtttactttgactgtttactttctatgtttactttacttgtttacttttgctgtttactttgtatgtttactttggcgcgccatgcttcatcagactct

SEQ ID NO: 7429 - DNA, 172 bp, Artificial Sequence; identical to SEQ ID NO: 7428
  Synthetic polynucleotide

SEQ ID NO: 7430 - DNA, 172 bp, Artificial Sequence
  Synthetic polynucleotide
atcatctcaccttgcctcctggcaagatggtaaggcgccctgcaggaccggaagagagaaccggaagagtcgaccggaagaggacaccggaagagctaaccggaagagactaccggaagagtgcaccggaagaggtaaccggaagagggcgcgccatgcttcatcagactct

SEQ ID NO: 7431 - DNA, 172 bp, Artificial Sequence; identical to SEQ ID NO: 7430
  Synthetic polynucleotide

SEQ ID NO: 7432 - DNA, 186 bp, Artificial Sequence
  Synthetic polynucleotide
atcatctcaccttgcctcctgcctaccattatggtttccctgcagggatttcccatcatgccttgcagagatttcccatcatgccttgctcggatttcccatcatgccttgcgacgatttcccatcatgccttgcctagatttcccatcatgccttgcactggcgcgccatgcttcatcagactct

SEQ ID NO: 7433 - DNA, 186 bp, Artificial Sequence; identical to SEQ ID NO: 7432
  Synthetic polynucleotide

SEQ ID NO: 7434 - DNA, 196 bp, Artificial Sequence
  Synthetic polynucleotide
atcatctcaccttgcctcctggttctggtataacagcccctgcaggcataatttatgcaagacataatttatgcatcgcataatttatgcagaccataatttatgcactacataatttatgcaactcataatttatgcatgccataatttatgcagtacataatttatgcaggcgcgccatgcttcatcagactct

SEQ ID NO: 7435 - DNA, 196 bp, Artificial Sequence; identical to SEQ ID NO: 7434
  Synthetic polynucleotide

SEQ ID NO: 7436 - DNA, 200 bp, Artificial Sequence
  Synthetic polynucleotide
atcatctcaccttgcctcctgaaccgctaacccgggttcctgcaggcaaggtcagggtgacctggagacaaggtcagggtgacctggtcgcaaggtcagggtgacctgggaccaaggtcagggtgacctggctacaaggtcagggtgacctggactcaaggtcagggtgacctggggcgcgccatgcttcatcagactct

SEQ ID NO: 7437 - DNA, 200 bp, Artificial Sequence; identical to SEQ ID NO: 7436
  Synthetic polynucleotide

SEQ ID NO: 7438 - DNA, 164 bp, Artificial Sequence
  Synthetic polynucleotide
atcatctcaccttgcctcctgcgtcagcttacccgatacctgcaggtcagctgatagatcagctgattcgtcagctgatgactcagctgatctatcagctgatacttcagctgattgctcagctgatgtatcagctgatggcgcgccatgcttcatcagactct

SEQ ID NO: 7439 - DNA, 164 bp, Artificial Sequence; identical to SEQ ID NO: 7438
  Synthetic polynucleotide

SEQ ID NO: 7440 - DNA, 148 bp, Artificial Sequence
  Synthetic polynucleotide
atcatctcaccttgcctcctgtttaccaaagggtgctacctgcagggtatcacagagtatcactcggtatcacgacgtatcacctagtatcacactgtatcactgcgtatcacgtagtatcacggcgcgccatgcttcatcagactct

SEQ ID NO: 7441 - DNA, 148 bp, Artificial Sequence; identical to SEQ ID NO: 7440
  Synthetic polynucleotide

SEQ ID NO: 7442 - DNA, 164 bp, Artificial Sequence
  Synthetic polynucleotide
atcatctcaccttgcctcctgtattacttacagactcccctgcaggacgtcatcaagaacgtcatcatcgacgtcatcagacacgtcatcactaacgtcatcaactacgtcatcatgcacgtcatcagtaacgtcatcaggcgcgccatgcttcatcagactct

SEQ ID NO: 7443 - DNA, 164 bp, Artificial Sequence; identical to SEQ ID NO: 7442
  Synthetic polynucleotide

SEQ ID NO: 7444 - DNA, 172 bp, Artificial Sequence
  Synthetic polynucleotide
atcatctcaccttgcctcctggcatgaacggcagtgcacctgcaggccgccatgttagaccgccatgtttcgccgccatgttgacccgccatgttctaccgccatgttactccgccatgtttgcccgccatgttgtaccgccatgttggcgcgccatgcttcatcagactct

SEQ ID NO: 7445 - DNA, 172 bp, Artificial Sequence; identical to SEQ ID NO: 7444
  Synthetic polynucleotide

SEQ ID NO: 7446 - DNA, 172 bp, Artificial Sequence
  Synthetic polynucleotide
atcatctcaccttgcctcctgaagagctacggattagacctgcaggttaatgacctagattaatgaccttcgttaatgacctgacttaatgacctctattaatgacctactttaatgaccttgcttaatgacctgtattaatgacctggcgcgccatgcttcatcagactct

SEQ ID NO: 7447 - DNA, 172 bp, Artificial Sequence; identical to SEQ ID NO: 7446
  Synthetic polynucleotide

SEQ ID NO: 7448 - DNA, 187 bp, Artificial Sequence
  Synthetic polynucleotide
atcatctcaccttgcctcctgagcgtgtcttcttgcctcctgcaggatttaaccattataaccaattaataaagaatttaaccattataaccaattaataatcgatttaaccattataaccaattaataagacatttaaccattataaccaattaataactaggcgcgccatgcttcatcagactct

SEQ ID NO: 7449 - DNA, 187 bp, Artificial Sequence; identical to SEQ ID NO: 7448
  Synthetic polynucleotide

SEQ ID NO: 7450 - DNA, 172 bp, Artificial Sequence
  Synthetic polynucleotide
atcatctcaccttgcctcctgaagaacgcacacatgctcctgcaggcaagtgcgtgagacaagtgcgtgtcgcaagtgcgtggaccaagtgcgtgctacaagtgcgtgactcaagtgcgtgtgccaagtgcgtggtacaagtgcgtgggcgcgccatgcttcatcagactct

SEQ ID NO: 7451 - DNA, 172 bp, Artificial Sequence; identical to SEQ ID NO: 7450
  Synthetic polynucleotide

SEQ ID NO: 7452 - DNA, 197 bp, Artificial Sequence
  Synthetic polynucleotide
atcatctcaccttgcctcctgtcggtcgataacgctcacctgcaggtagtttcggtttcggagatagtttcggtttcggtcgtagtttcggtttcgggactagtttcggtttcggctatagtttcggtttcggacttagtttcggtttcggtgctagtttcggtttcgggtaggcgcgccatgcttcatcagactct

SEQ ID NO: 7453 - DNA, 197 bp, Artificial Sequence; identical to SEQ ID NO: 7452
  Synthetic polynucleotide

SEQ ID NO: 7454 - DNA, 172 bp, Artificial Sequence
  Synthetic polynucleotide
atcatctcaccttgcctcctgaggcctctttcaattgtcctgcagggagttgtagtagagagttgtagttcggagttgtagtgacgagttgtagtctagagttgtagtactgagttgtagttgcgagttgtagtgtagagttgtagtggcgcgccatgcttcatcagactct

SEQ ID NO: 7455 - DNA, 172 bp, Artificial Sequence; identical to SEQ ID NO: 7454
  Synthetic polynucleotide

SEQ ID NO: 7456 - DNA, 196 bp, Artificial Sequence
  Synthetic polynucleotide
atcatctcaccttgcctcctggatggagtgattagagacctgcaggcagattgcaaaatagacagattgcaaaattcgcagattgcaaaatgaccagattgcaaaatctacagattgcaaaatactcagattgcaaaattgccagattgcaaaatgtacagattgcaaaatggcgcgccatgcttcatcagactct

SEQ ID NO: 7457 - DNA, 196 bp, Artificial Sequence; identical to SEQ ID NO: 7456
  Synthetic polynucleotide

SEQ ID NO: 7458 - DNA, 172 bp, Artificial Sequence
  Synthetic polynucleotide
atcatctcaccttgcctcctgcagcatagccaacaaatcctgcaggggtcaggtcaagaggtcaggtcatcgggtcaggtcagacggtcaggtcactaggtcaggtcaactggtcaggtcatgcggtcaggtcagtaggtcaggtcaggcgcgccatgcttcatcagactct

SEQ ID NO: 7459 - DNA, 172 bp, Artificial Sequence; identical to SEQ ID NO: 7458
  Synthetic polynucleotide

SEQ ID NO: 7460 - DNA, 185 bp, Artificial Sequence
  Synthetic polynucleotide
atcatctcaccttgcctcctgacctgatctgttgtcatcctgcaggcaattagcaccaattaagacaattagcaccaattatcgcaattagcaccaattagaccaattagcaccaattactacaattagcaccaattaactcaattagcaccaattatgcggcgcgccatgcttcatcagactct

SEQ ID NO: 7461 - DNA, 185 bp, Artificial Sequence; identical to SEQ ID NO: 7460
  Synthetic polynucleotide

SEQ ID NO: 7462 - DNA, 180 bp, Artificial Sequence
  Synthetic polynucleotide
atcatctcaccttgcctcctgaaagacccatcatgtatcctgcaggcattgcgtgacagacattgcgtgactcgcattgcgtgacgaccattgcgtgacctacattgcgtgacactcattgcgtgactgccattgcgtgacgtacattgcgtgacggcgcgccatgcttcatcagactct

SEQ ID NO: 7463 - DNA, 180 bp, Artificial Sequence; identical to SEQ ID NO: 7462
  Synthetic polynucleotide

SEQ ID NO: 7464 - DNA, 172 bp, Artificial Sequence
  Synthetic polynucleotide
atcatctcaccttgcctcctgcacatggcctacagacgcctgcaggtaggggataaagataggggataatcgtaggggataagactaggggataactataggggataaacttaggggataatgctaggggataagtataggggataaggcgcgccatgcttcatcagactct

SEQ ID NO: 7465 - DNA, 172 bp, Artificial Sequence; identical to SEQ ID NO: 7464
  Synthetic polynucleotide

SEQ ID NO: 7466 - DNA, 197 bp, Artificial Sequence
  Synthetic polynucleotide
atcatctcaccttgcctcctgtagactaatctaaggtgcctgcaggctgttgctaggcagaagactgttgctaggcagatcgctgttgctaggcagagacctgttgctaggcagactactgttgctaggcagaactctgttgctaggcagatgcctgttgctaggcagagtaggcgcgccatgcttcatcagactct

SEQ ID NO: 7467 - DNA, 197 bp, Artificial Sequence; identical to SEQ ID NO: 7466
  Synthetic polynucleotide

SEQ ID NO: 7468 - DNA, 164 bp, Artificial Sequence
  Synthetic polynucleotide
atcatctcaccttgcctcctgcgatgtatagttacccgcctgcaggacgtgacttagaacgtgactttcgacgtgacttgacacgtgacttctaacgtgacttactacgtgactttgcacgtgacttgtaacgtgacttggcgcgccatgcttcatcagactct

SEQ ID NO: 7469 - DNA, 164 bp, Artificial Sequence; identical to SEQ ID NO: 7468
  Synthetic polynucleotide

SEQ ID NO: 7470 - DNA, 148 bp, Artificial Sequence
  Synthetic polynucleotide
atcatctcaccttgcctcctgagctgcctggttctgagcctgcaggccaactgagaccaactgtcgccaactggacccaactgctaccaactgactccaactgtgcccaactggtaccaactgggcgcgccatgcttcatcagactct

SEQ ID NO: 7471 - DNA, 148 bp, Artificial Sequence; identical to SEQ ID NO: 7470
  Synthetic polynucleotide

SEQ ID NO: 7472 - DNA, 172 bp, Artificial Sequence
  Synthetic polynucleotide
atcatctcaccttgcctcctggtgagagacattgtgcgcctgcaggaaaccggataagaaaaccggatatcgaaaccggatagacaaaccggatactaaaaccggataactaaaccggatatgcaaaccggatagtaaaaccggataggcgcgccatgcttcatcagactct

SEQ ID NO: 7473 - DNA, 172 bp, Artificial Sequence; identical to SEQ ID NO: 7472
  Synthetic polynucleotide

SEQ ID NO: 7474 - DNA, 186 bp, Artificial Sequence
  Synthetic polynucleotide
atcatctcaccttgcctcctgtggtgatcgtctgacgtcctgcaggcatttcccggaaatcacctgagacatttcccggaaatcacctgtcgcatttcccggaaatcacctggaccatttcccggaaatcacctgctacatttcccggaaatcacctgactggcgcgccatgcttcatcagactct

SEQ ID NO: 7475 - DNA, 186 bp, Artificial Sequence; identical to SEQ ID NO: 7474
  Synthetic polynucleotide

SEQ ID NO: 7476 - DNA, 190 bp, Artificial Sequence
  Synthetic polynucleotide
atcatctcaccttgcctcctgcgcgactcatgtacagccctgcaggtcgaaaccgaaactagatcgaaaccgaaacttcgtcgaaaccgaaactgactcgaaaccgaaactctatcgaaaccgaaactacttcgaaaccgaaacttgctcgaaaccgaaactgtaggcgcgccatgcttcatcagactct

SEQ ID NO: 7477 - DNA, 190 bp, Artificial Sequence; identical to SEQ ID NO: 7476
  Synthetic polynucleotide

SEQ ID NO: 7478 - DNA, 196 bp, Artificial Sequence
  Synthetic polynucleotide
atcatctcaccttgcctcctgtagaccaagaccttgaacctgcaggacgacagctgacgagaacgacagctgacgtcgacgacagctgacggacacgacagctgacgctaacgacagctgacgactacgacagctgacgtgcacgacagctgacggtaacgacagctgacgggcgcgccatgcttcatcagactct

SEQ ID NO: 7479 - DNA, 196 bp, Artificial Sequence; identical to SEQ ID NO: 7478
  Synthetic polynucleotide

SEQ ID NO: 7480 - DNA, 196 bp, Artificial Sequence
  Synthetic polynucleotide
atcatctcaccttgcctcctgggatgtcaattcgctagcctgcaggttctagaacgttcagattctagaacgttctcgttctagaacgttcgacttctagaacgttcctattctagaacgttcactttctagaacgttctgcttctagaacgttcgtattctagaacgttcggcgcgccatgcttcatcagactct

SEQ ID NO: 7481 - DNA, 196 bp, Artificial Sequence; identical to SEQ ID NO: 7480
  Synthetic polynucleotide

SEQ ID NO: 7482 - DNA, 200 bp, Artificial Sequence
  Synthetic polynucleotide
atcatctcaccttgcctcctgatcccgagtatactctccctgcaggaggtgtgaatttcacacctagaaggtgtgaatttcacaccttcgaggtgtgaatttcacacctgacaggtgtgaatttcacacctctaaggtgtgaatttcacacctactaggtgtgaatttcacacctggcgcgccatgcttcatcagactct

SEQ ID NO: 7483 - DNA, 200 bp, Artificial Sequence; identical to SEQ ID NO: 7482
  Synthetic polynucleotide

SEQ ID NO: 7484 - DNA, 172 bp, Artificial Sequence
  Synthetic polynucleotide
atcatctcaccttgcctcctgcatactgcccatcaatacctgcaggcccgatttggagacccgatttggtcgcccgatttgggaccccgatttggctacccgatttggactcccgatttggtgccccgatttgggtacccgatttggggcgcgccatgcttcatcagactct

SEQ ID NO: 7485 - DNA, 172 bp, Artificial Sequence; identical to SEQ ID NO: 7484
  Synthetic polynucleotide

SEQ ID NO: 7486 - DNA, 190 bp, Artificial Sequence
  Synthetic polynucleotide
atcatctcaccttgcctcctgatgcctactacgggttacctgcagggcggcacgcgccatagagcggcacgcgccattcggcggcacgcgccatgacgcggcacgcgccatctagcggcacgcgccatactgcggcacgcgccattgcgcggcacgcgccatgtaggcgcgccatgcttcatcagactct

SEQ ID NO: 7487 - DNA, 190 bp, Artificial Sequence; identical to SEQ ID NO: 7486
  Synthetic polynucleotide

SEQ ID NO: 7488 - DNA, 191 bp, Artificial Sequence
  Synthetic polynucleotide
atcatctcaccttgcctcctgattcgctctaatgatcgcctgcaggtgtgaccttttgacctcagatgtgaccttttgacctctcgtgtgaccttttgacctcgactgtgaccttttgacctcctatgtgaccttttgacctcacttgtgaccttttgacctctgcggcgcgccatgcttcatcagactct

SEQ ID NO: 7489 - DNA, 191 bp, Artificial Sequence; identical to SEQ ID NO: 7488
  Synthetic polynucleotide

SEQ ID NO: 7490 - DNA, 190 bp, Artificial Sequence
  Synthetic polynucleotide
atcatctcaccttgcctcctgtcgcatcgccctatttgcctgcaggcccccttgggccccagacccccttgggcccctcgcccccttgggccccgaccccccttgggccccctacccccttgggccccactcccccttgggcccctgccccccttgggccccgtaggcgcgccatgcttcatcagactct

SEQ ID NO: 7491 - DNA, 190 bp, Artificial Sequence; identical to SEQ ID NO: 7490
  Synthetic polynucleotide

SEQ ID NO: 7492 - DNA, 172 bp, Artificial Sequence
  Synthetic polynucleotide
atcatctcaccttgcctcctgcgtagtaagagccggtccctgcaggtattaattatagatattaattattcgtattaattatgactattaattatctatattaattatacttattaattattgctattaattatgtatattaattatggcgcgccatgcttcatcagactct

SEQ ID NO: 7493 - DNA, 172 bp, Artificial Sequence; identical to SEQ ID NO: 7492
  Synthetic polynucleotide

SEQ ID NO: 7494 - DNA, 188 bp, Artificial Sequence
  Synthetic polynucleotide
atcatctcaccttgcctcctgtagccttcgtcgaggtacctgcaggaaccaatcagagagaaaccaatcagagtcgaaccaatcagaggacaaccaatcagagctaaaccaatcagagactaaccaatcagagtgcaaccaatcagaggtaaaccaatcagagggcgcgccatgcttcatcagactct

SEQ ID NO: 7495 - DNA, 188 bp, Artificial Sequence; identical to SEQ ID NO: 7494
  Synthetic polynucleotide

SEQ ID NO: 7496 - DNA, 172 bp, Artificial Sequence
  Synthetic polynucleotide
atcatctcaccttgcctcctgtggaaatacttgggtggcctgcaggtgagtcagcgagatgagtcagcgtcgtgagtcagcggactgagtcagcgctatgagtcagcgacttgagtcagcgtgctgagtcagcggtatgagtcagcgggcgcgccatgcttcatcagactct

SEQ ID NO: 7497 - DNA, 172 bp, Artificial Sequence; identical to SEQ ID NO: 7496
  Synthetic polynucleotide

SEQ ID NO: 7498 - DNA, 191 bp, Artificial Sequence
  Synthetic polynucleotide
atcatctcaccttgcctcctggcattggcgatcactgccctgcaggaatttaagtacttaaaaagaaatttaagtacttaaaatcgaatttaagtacttaaaagacaatttaagtacttaaaactaaatttaagtacttaaaaactaatttaagtacttaaaatgcggcgcgccatgcttcatcagactct

SEQ ID NO: 7499 - DNA, 191 bp, Artificial Sequence; identical to SEQ ID NO: 7498
  Synthetic polynucleotide

SEQ ID NO: 7500 - DNA, 196 bp, Artificial Sequence
  Synthetic polynucleotide
atcatctcaccttgcctcctggctttactactggtccgcctgcaggttccagaggtttcagattccagaggtttctcgttccagaggtttcgacttccagaggtttcctattccagaggtttcactttccagaggtttctgcttccagaggtttcgtattccagaggtttcggcgcgccatgcttcatcagactct

SEQ ID NO: 7501 - DNA, 196 bp, Artificial Sequence; identical to SEQ ID NO: 7500
  Synthetic polynucleotide

SEQ ID NO: 7502 - DNA, 190 bp, Artificial Sequence
  Synthetic polynucleotide
atcatctcaccttgcctcctgtccttcccggagattcccctgcagggcgccccctggtggagagcgccccctggtggtcggcgccccctggtgggacgcgccccctggtggctagcgccccctggtggactgcgccccctggtggtgcgcgccccctggtgggtaggcgcgccatgcttcatcagactct

SEQ ID NO: 7503 - DNA, 190 bp, Artificial Sequence; identical to SEQ ID NO: 7502
  Synthetic polynucleotide

SEQ ID NO: 7504 - DNA, 197 bp, Artificial Sequence
  Synthetic polynucleotide
atcatctcaccttgcctcctgtcgtccttcgcagtcgacctgcaggagggggcggggccaaagaagggggcggggccaatcgagggggcggggccaagacagggggcggggccaactaagggggcggggccaaactagggggcggggccaatgcagggggcggggccaagtaggcgcgccatgcttcatcagactct

SEQ ID NO: 7505 - DNA, 197 bp, Artificial Sequence; identical to SEQ ID NO: 7504
  Synthetic polynucleotide

SEQ ID NO: 7506 - DNA, 180 bp, Artificial Sequence
  Synthetic polynucleotide
atcatctcaccttgcctcctggtgcagaagcactcgaccctgcagggccacttccggagagccacttccggtcggccacttccgggacgccacttccggctagccacttccggactgccacttccggtgcgccacttccgggtagccacttccggggcgcgccatgcttcatcagactct

SEQ ID NO: 7507 - DNA, 180 bp, Artificial Sequence; identical to SEQ ID NO: 7506
  Synthetic polynucleotide

SEQ ID NO: 7508 - DNA, 185 bp, Artificial Sequence
  Synthetic polynucleotide
atcatctcaccttgcctcctgaaagtcgagccgcgtagcctgcaggtgcaactaattaattcagatgcaactaattaattctcgtgcaactaattaattcgactgcaactaattaattcctatgcaactaattaattcacttgcaactaattaattctgcggcgcgccatgcttcatcagactct

SEQ ID NO: 7509 - DNA, 185 bp, Artificial Sequence; identical to SEQ ID NO: 7508
  Synthetic polynucleotide

SEQ ID NO: 7510 - DNA, 190 bp, Artificial Sequence
  Synthetic polynucleotide
atcatctcaccttgcctcctgctttgcgttgacctgatcctgcaggttggtattgtggttagattggtattgtggtttcgttggtattgtggttgacttggtattgtggttctattggtattgtggttactttggtattgtggtttgcttggtattgtggttgtaggcgcgccatgcttcatcagactct

SEQ ID NO: 7511 - DNA, 190 bp, Artificial Sequence; identical to SEQ ID NO: 7510
  Synthetic polynucleotide

SEQ ID NO: 7512 - DNA, 156 bp, Artificial Sequence
  Synthetic polynucleotide
atcatctcaccttgcctcctggctactttatccgctctcctgcaggcctttgttagacctttgtttcgcctttgttgaccctttgttctacctttgttactcctttgtttgccctttgttgtacctttgttggcgcgccatgcttcatcagactct

SEQ ID NO: 7513 - DNA, 156 bp, Artificial Sequence; identical to SEQ ID NO: 7512
  Synthetic polynucleotide

SEQ ID NO: 7514 - DNA, 196 bp, Artificial Sequence
  Synthetic polynucleotide
atcatctcaccttgcctcctgcggttccaggaactcttcctgcaggagggacagctgcaagaagggacagctgcatcgagggacagctgcagacagggacagctgcactaagggacagctgcaactagggacagctgcatgcagggacagctgcagtaagggacagctgcaggcgcgccatgcttcatcagactct

SEQ ID NO: 7515 - DNA, 196 bp, Artificial Sequence; identical to SEQ ID NO: 7514
  Synthetic polynucleotide

SEQ ID NO: 7516 - DNA, 197 bp, Artificial Sequence
  Synthetic polynucleotide
atcatctcaccttgcctcctgcaatgctagcgtttagacctgcaggtgacctttagttgaccttagatgacctttagttgacctttcgtgacctttagttgaccttgactgacctttagttgaccttctatgacctttagttgaccttacttgacctttagttgacctttgcggcgcgccatgcttcatcagactct

SEQ ID NO: 7517 - DNA, 197 bp, Artificial Sequence; identical to SEQ ID NO: 7516
  Synthetic polynucleotide

SEQ ID NO: 7518 - DNA, 156 bp, Artificial Sequence
  Synthetic polynucleotide
atcatctcaccttgcctcctgcttaggtacgtgcccttcctgcaggacacgtgaagaacacgtgatcgacacgtgagacacacgtgactaacacgtgaactacacgtgatgcacacgtgagtaacacgtgaggcgcgccatgcttcatcagactct

SEQ ID NO: 7519 - DNA, 156 bp, Artificial Sequence; identical to SEQ ID NO: 7518
  Synthetic polynucleotide

SEQ ID NO: 7520 - DNA, 197 bp, Artificial Sequence
  Synthetic polynucleotide
atcatctcaccttgcctcctgtccgttactcgaagatgcctgcaggcacatcaatcaaattagacacatcaatcaaatttcgcacatcaatcaaattgaccacatcaatcaaattctacacatcaatcaaattactcacatcaatcaaatttgccacatcaatcaaattgtaggcgcgccatgcttcatcagactct

SEQ ID NO: 7521 - DNA, 197 bp, Artificial Sequence; identical to SEQ ID NO: 7520
  Synthetic polynucleotide

SEQ ID NO: 7522 - DNA, 196 bp, Artificial Sequence
  Synthetic polynucleotide
atcatctcaccttgcctcctgtttatgcacagcttatgcctgcaggccacctgttgcacagaccacctgttgcactcgccacctgttgcacgacccacctgttgcacctaccacctgttgcacactccacctgttgcactgcccacctgttgcacgtaccacctgttgcacggcgcgccatgcttcatcagactct

SEQ ID NO: 7523 - DNA, 196 bp, Artificial Sequence; identical to SEQ ID NO: 7522
  Synthetic polynucleotide

SEQ ID NO: 7524 - DNA, 180 bp, Artificial Sequence
  Synthetic polynucleotide
atcatctcaccttgcctcctggtcggaggtttgccgttcctgcagggctcgtaaaaaagagctcgtaaaaatcggctcgtaaaaagacgctcgtaaaaactagctcgtaaaaaactgctcgtaaaaatgcgctcgtaaaaagtagctcgtaaaaaggcgcgccatgcttcatcagactct

SEQ ID NO: 7525 - DNA, 180 bp, Artificial Sequence; identical to SEQ ID NO: 7524
  Synthetic polynucleotide

SEQ ID NO: 7526 - DNA, 197 bp, Artificial Sequence
  Synthetic polynucleotide
atcatctcaccttgcctcctgttgacgtcgtattgcagcctgcaggagggggcggggccagagaagggggcggggccagtcgagggggcggggccaggacagggggcggggccagctaagggggcggggccagactagggggcggggccagtgcagggggcggggccaggtaggcgcgccatgcttcatcagactct

SEQ ID NO: 7527 - DNA, 197 bp, Artificial Sequence; identical to SEQ ID NO: 7526
  Synthetic polynucleotide

SEQ ID NO: 7528 - DNA, 196 bp, Artificial Sequence
  Synthetic polynucleotide
atcatctcaccttgcctcctggggtcagtagttggttgcctgcaggcccccgcccccgcagacccccgcccccgctcgcccccgcccccgcgaccccccgcccccgcctacccccgcccccgcactcccccgcccccgctgccccccgcccccgcgtacccccgcccccgcggcgcgccatgcttcatcagactct

SEQ ID NO: 7529 - DNA, 196 bp, Artificial Sequence; identical to SEQ ID NO: 7528
  Synthetic polynucleotide

SEQ ID NO: 7530 - DNA, 180 bp, Artificial Sequence
  Synthetic polynucleotide
atcatctcaccttgcctcctgacagctacgctgcatagcctgcagggctcgtaaaacagagctcgtaaaactcggctcgtaaaacgacgctcgtaaaacctagctcgtaaaacactgctcgtaaaactgcgctcgtaaaacgtagctcgtaaaacggcgcgccatgcttcatcagactct

SEQ ID NO: 7531 - DNA, 180 bp, Artificial Sequence; identical to SEQ ID NO: 7530
  Synthetic polynucleotide

SEQ ID NO: 7532 - DNA, 164 bp, Artificial Sequence
  Synthetic polynucleotide
atcatctcaccttgcctcctgtctaaccagctaggttacctgcaggaaagtccccagaaaagtcccctcgaaagtccccgacaaagtccccctaaaagtccccactaaagtcccctgcaaagtccccgtaaaagtccccggcgcgccatgcttcatcagactct

SEQ ID NO: 7533 - DNA, 164 bp, Artificial Sequence; identical to SEQ ID NO: 7532
  Synthetic polynucleotide

SEQ ID NO: 7534 - DNA, 172 bp, Artificial Sequence
  Synthetic polynucleotide
atcatctcaccttgcctcctgcgggtgcttagagcttgcctgcaggcggccgacgcagacggccgacgctcgcggccgacgcgaccggccgacgcctacggccgacgcactcggccgacgctgccggccgacgcgtacggccgacgcggcgcgccatgcttcatcagactct

SEQ ID NO: 7535 - DNA, 172 bp, Artificial Sequence; identical to SEQ ID NO: 7534
  Synthetic polynucleotide

SEQ ID NO: 7536 - DNA, 156 bp, Artificial Sequence
  Synthetic polynucleotide
atcatctcaccttgcctcctgcctgattaaagcttagacctgcaggacacgtgcagaacacgtgctcgacacgtgcgacacacgtgcctaacacgtgcactacacgtgctgcacacgtgcgtaacacgtgcggcgcgccatgcttcatcagactct

SEQ ID NO: 7537 - DNA, 156 bp, Artificial Sequence; identical to SEQ ID NO: 7536
  Synthetic polynucleotide

SEQ ID NO: 7538 - DNA, 191 bp, Artificial Sequence
  Synthetic polynucleotide
atcatctcaccttgcctcctggataagccctctaaggacctgcaggcctcacttccgggttcgagacctcacttccgggttcgtcgcctcacttccgggttcggaccctcacttccgggttcgctacctcacttccgggttcgactcctcacttccgggttcgtgcggcgcgccatgcttcatcagactct

SEQ ID NO: 7539 - DNA, 191 bp, Artificial Sequence; identical to SEQ ID NO: 7538
  Synthetic polynucleotide

SEQ ID NO: 7540 - DNA, 191 bp, Artificial Sequence
  Synthetic polynucleotide
atcatctcaccttgcctcctggtgagctagcgagatcccctgcaggtgaccttgactgacctaagatgaccttgactgacctatcgtgaccttgactgacctagactgaccttgactgacctactatgaccttgactgacctaacttgaccttgactgacctatgcggcgcgccatgcttcatcagactct

SEQ ID NO: 7541 - DNA, 191 bp, Artificial Sequence; identical to SEQ ID NO: 7540
  Synthetic polynucleotide

SEQ ID NO: 7542 - DNA, 180 bp, Artificial Sequence
  Synthetic polynucleotide
atcatctcaccttgcctcctgaagcatcagtcaggagccctgcaggcctcccgcccgagacctcccgcccgtcgcctcccgcccggaccctcccgcccgctacctcccgcccgactcctcccgcccgtgccctcccgcccggtacctcccgcccgggcgcgccatgcttcatcagactct

SEQ ID NO: 7543 - DNA, 180 bp, Artificial Sequence; identical to SEQ ID NO: 7542
  Synthetic polynucleotide

SEQ ID NO: 7544 - DNA, 172 bp, Artificial Sequence
  Synthetic polynucleotide
atcatctcaccttgcctcctgatagtacacctttctgacctgcaggctaattaagaagactaattaagatcgctaattaagagacctaattaagactactaattaagaactctaattaagatgcctaattaagagtactaattaagaggcgcgccatgcttcatcagactct

SEQ ID NO: 7545 - DNA, 172 bp, Artificial Sequence; identical to SEQ ID NO: 7544
  Synthetic polynucleotide

SEQ ID NO: 7546 - DNA, 180 bp, Artificial Sequence
  Synthetic polynucleotide
atcatctcaccttgcctcctgttcaccacctatacctgcctgcaggtggaaatccccagatggaaatcccctcgtggaaatccccgactggaaatccccctatggaaatccccacttggaaatcccctgctggaaatccccgtatggaaatccccggcgcgccatgcttcatcagactct

SEQ ID NO: 7547 - DNA, 180 bp, Artificial Sequence; identical to SEQ ID NO: 7546
  Synthetic polynucleotide

SEQ ID NO: 7548 - DNA, 197 bp, Artificial Sequence
  Synthetic polynucleotide
atcatctcaccttgcctcctgaagcaaggcccacaatacctgcaggcattagcatgacaatagacattagcatgacaattcgcattagcatgacaatgaccattagcatgacaatctacattagcatgacaatactcattagcatgacaattgccattagcatgacaatgtaggcgcgccatgcttcatcagactct

SEQ ID NO: 7549 - DNA, 197 bp, Artificial Sequence; identical to SEQ ID NO: 7548
  Synthetic polynucleotide

SEQ ID NO: 7550 - DNA, 190 bp, Artificial Sequence
  Synthetic polynucleotide
atcatctcaccttgcctcctgtaagccttgtccgggcacctgcagggggtcacgtggccgagagggtcacgtggccgtcggggtcacgtggccggacgggtcacgtggccgctagggtcacgtggccgactgggtcacgtggccgtgcgggtcacgtggccggtaggcgcgccatgcttcatcagactct

SEQ ID NO: 7551 - DNA, 190 bp, Artificial Sequence; identical to SEQ ID NO: 7550
  Synthetic polynucleotide

SEQ ID NO: 7552 - DNA, 191 bp, Artificial Sequence
  Synthetic polynucleotide
atcatctcaccttgcctcctgatgtagtttgaacccatcctgcaggaaaaatgataccccatcagaaaaaatgataccccatctcgaaaaatgataccccatcgacaaaaatgataccccatcctaaaaaatgataccccatcactaaaaatgataccccatctgcggcgcgccatgcttcatcagactct

SEQ ID NO: 7553 - DNA, 191 bp, Artificial Sequence; identical to SEQ ID NO: 7552
  Synthetic polynucleotide

SEQ ID NO: 7554 - DNA, 156 bp, Artificial Sequence
  Synthetic polynucleotide
atcatctcaccttgcctcctgtcaccacgttggtcttacctgcaggcggattaaagacggattaatcgcggattaagaccggattaactacggattaaactcggattaatgccggattaagtacggattaaggcgcgccatgcttcatcagactct

SEQ ID NO: 7555 - DNA, 156 bp, Artificial Sequence; identical to SEQ ID NO: 7554
  Synthetic polynucleotide

SEQ ID NO: 7556 - DNA, 164 bp, Artificial Sequence
  Synthetic polynucleotide
atcatctcaccttgcctcctgcactgtggccaaactgacctgcaggtgtaaacaaagatgtaaacaatcgtgtaaacaagactgtaaacaactatgtaaacaaacttgtaaacaatgctgtaaacaagtatgtaaacaaggcgcgccatgcttcatcagactct

SEQ ID NO: 7557 - DNA, 164 bp, Artificial Sequence; identical to SEQ ID NO: 7556
  Synthetic polynucleotide

SEQ ID NO: 7558 - DNA, 148 bp, Artificial Sequence
  Synthetic polynucleotide
atcatctcaccttgcctcctgagagccctaattgctggcctgcaggatacttaagaatacttatcgatacttagacatacttactaatacttaactatacttatgcatacttagtaatacttaggcgcgccatgcttcatcagactct

SEQ ID NO: 7559 - DNA, 148 bp, Artificial Sequence; identical to SEQ ID NO: 7558
  Synthetic polynucleotide

SEQ ID NO: 7560 - DNA, 200 bp, Artificial Sequence
  Synthetic polynucleotide
atcatctcaccttgcctcctggattatagtggtaagcccctgcaggaggtgtgaaattcacacctagaaggtgtgaaattcacaccttcgaggtgtgaaattcacacctgacaggtgtgaaattcacacctctaaggtgtgaaattcacacctactaggtgtgaaattcacacctggcgcgccatgcttcatcagactct

SEQ ID NO: 7561 - DNA, 200 bp, Artificial Sequence; identical to SEQ ID NO: 7560
  Synthetic polynucleotide

SEQ ID NO: 7562 - DNA, 164 bp, Artificial Sequence
  Synthetic polynucleotide
atcatctcaccttgcctcctggcatataatgaaggacccctgcaggcttaattagagacttaattagtcgcttaattaggaccttaattagctacttaattagactcttaattagtgccttaattaggtacttaattagggcgcgccatgcttcatcagactct

SEQ ID NO: 7563 - DNA, 164 bp, Artificial Sequence; identical to SEQ ID NO: 7562
  Synthetic polynucleotide

SEQ ID NO: 7564 - DNA, 191 bp, Artificial Sequence
  Synthetic polynucleotide
atcatctcaccttgcctcctgcaaagagtctaccatgtcctgcaggtgaccttgactgaccttagatgaccttgactgacctttcgtgaccttgactgaccttgactgaccttgactgaccttctatgaccttgactgaccttacttgaccttgactgacctttgcggcgcgccatgcttcatcagactct

SEQ ID NO: 7565 - DNA, 191 bp, Artificial Sequence; identical to SEQ ID NO: 7564
  Synthetic polynucleotide

SEQ ID NO: 7566 - DNA, 164 bp, Artificial Sequence
  Synthetic polynucleotide
atcatctcaccttgcctcctgaagttctagagttcgttcctgcaggatcaatcaaagaatcaatcaatcgatcaatcaagacatcaatcaactaatcaatcaaactatcaatcaatgcatcaatcaagtaatcaatcaaggcgcgccatgcttcatcagactct

SEQ ID NO: 7567 - DNA, 164 bp, Artificial Sequence; identical to SEQ ID NO: 7566
  Synthetic polynucleotide

SEQ ID NO: 7568 - DNA, 196 bp, Artificial Sequence
  Synthetic polynucleotide
atcatctcaccttgcctcctgaagtttaagcgggataacctgcaggcatttcccggaagagacatttcccggaagtcgcatttcccggaaggaccatttcccggaagctacatttcccggaagactcatttcccggaagtgccatttcccggaaggtacatttcccggaagggcgcgccatgcttcatcagactct

SEQ ID NO: 7569 - DNA, 196 bp, Artificial Sequence; identical to SEQ ID NO: 7568
  Synthetic polynucleotide

SEQ ID NO: 7570 - DNA, 185 bp, Artificial Sequence
  Synthetic polynucleotide
atcatctcaccttgcctcctgtaggccatatgtccgtacctgcaggtttcctaatcaggtaaagatttcctaatcaggtaatcgtttcctaatcaggtaagactttcctaatcaggtaactatttcctaatcaggtaaacttttcctaatcaggtaatgcggcgcgccatgcttcatcagactct

SEQ ID NO: 7571 - DNA, 185 bp, Artificial Sequence; identical to SEQ ID NO: 7570
  Synthetic polynucleotide

SEQ ID NO: 7572 - DNA, 197 bp, Artificial Sequence
  Synthetic polynucleotide
atcatctcaccttgcctcctgatttatcgatgtatgcgcctgcaggtgacctttgccctacagatgacctttgccctactcgtgacctttgccctacgactgacctttgccctacctatgacctttgccctacacttgacctttgccctactgctgacctttgccctacgtaggcgcgccatgcttcatcagactct

SEQ ID NO: 7573 - DNA, 197 bp, Artificial Sequence; identical to SEQ ID NO: 7572
  Synthetic polynucleotide

SEQ ID NO: 7574 - DNA, 156 bp, Artificial Sequence
  Synthetic polynucleotide
atcatctcaccttgcctcctgacgttcatccgagctaacctgcaggacacgtggagaacacgtggtcgacacgtgggacacacgtggctaacacgtggactacacgtggtgcacacgtgggtaacacgtggggcgcgccatgcttcatcagactct

SEQ ID NO: 7575 - DNA, 156 bp, Artificial Sequence; identical to SEQ ID NO: 7574
  Synthetic polynucleotide

SEQ ID NO: 7576 - DNA, 185 bp, Artificial Sequence
  Synthetic polynucleotide
atcatctcaccttgcctcctgcgaatccgtggtacgaccctgcagggcagtaagaagtatacagagcagtaagaagtatactcggcagtaagaagtatacgacgcagtaagaagtatacctagcagtaagaagtatacactgcagtaagaagtatactgcggcgcgccatgcttcatcagactct

SEQ ID NO: 7577 - DNA, 185 bp, Artificial Sequence; identical to SEQ ID NO: 7576
  Synthetic polynucleotide

SEQ ID NO: 7578 - DNA, 185 bp, Artificial Sequence
  Synthetic polynucleotide
atcatctcaccttgcctcctgcatgtcccgttgcacgtcctgcagggtgaccttttgacctcagagtgaccttttgacctctcggtgaccttttgacctcgacgtgaccttttgacctcctagtgaccttttgacctcactgtgaccttttgacctctgcggcgcgccatgcttcatcagactct

SEQ ID NO: 7579 - DNA, 185 bp, Artificial Sequence; identical to SEQ ID NO: 7578
  Synthetic polynucleotide

SEQ ID NO: 7580 - DNA, 180 bp, Artificial Sequence
  Synthetic polynucleotide
atcatctcaccttgcctcctgagtacctatgaagatgtcctgcagggtttggcgcgaagagtttggcgcgatcggtttggcgcgagacgtttggcgcgactagtttggcgcgaactgtttggcgcgatgcgtttggcgcgagtagtttggcgcgaggcgcgccatgcttcatcagactct

SEQ ID NO: 7581 - DNA, 180 bp, Artificial Sequence; identical to SEQ ID NO: 7580
  Synthetic polynucleotide

SEQ ID NO: 7582 - DNA, 197 bp, Artificial Sequence
  Synthetic polynucleotide
atcatctcaccttgcctcctggagtgaatttgattgtgcctgcaggataaaccgaaaccaaagaataaaccgaaaccaatcgataaaccgaaaccaagacataaaccgaaaccaactaataaaccgaaaccaaactataaaccgaaaccaatgcataaaccgaaaccaagtaggcgcgccatgcttcatcagactct

SEQ ID NO: 7583 - DNA, 197 bp, Artificial Sequence; identical to SEQ ID NO: 7582
  Synthetic polynucleotide

SEQ ID NO: 7584 - DNA, 164 bp, Artificial Sequence
  Synthetic polynucleotide
atcatctcaccttgcctcctggcaggagccatatgatgcctgcaggggtaataaaagaggtaataaatcgggtaataaagacggtaataaactaggtaataaaactggtaataaatgcggtaataaagtaggtaataaaggcgcgccatgcttcatcagactct

SEQ ID NO: 7585 - DNA, 164 bp, Artificial Sequence; identical to SEQ ID NO: 7584
  Synthetic polynucleotide

SEQ ID NO: 7586 - DNA, 185 bp, Artificial Sequence
  Synthetic polynucleotide
atcatctcaccttgcctcctgggcattggtcactactgcctgcaggtattggtaattaccttagatattggtaattacctttcgtattggtaattaccttgactattggtaattaccttctatattggtaattaccttacttattggtaattacctttgcggcgcgccatgcttcatcagactct

SEQ ID NO: 7587 - DNA, 185 bp, Artificial Sequence; identical to SEQ ID NO: 7586
  Synthetic polynucleotide

SEQ ID NO: 7588 - DNA, 164 bp, Artificial Sequence
  Synthetic polynucleotide
atcatctcaccttgcctcctgattactaggcacgcagccctgcaggcccccgggcagacccccgggctcgcccccgggcgaccccccgggcctacccccgggcactcccccgggctgccccccgggcgtacccccgggcggcgcgccatgcttcatcagactct

SEQ ID NO: 7589 - DNA, 164 bp, Artificial Sequence; identical to SEQ ID NO: 7588
  Synthetic polynucleotide

SEQ ID NO: 7590 - DNA, 156 bp, Artificial Sequence
  Synthetic polynucleotide
atcatctcaccttgcctcctggtcattgcccgaacactcctgcaggataaacaaagaataaacaatcgataaacaagacataaacaactaataaacaaactataaacaatgcataaacaagtaataaacaaggcgcgccatgcttcatcagactct

SEQ ID NO: 7591 - DNA, 156 bp, Artificial Sequence; identical to SEQ ID NO: 7590
  Synthetic polynucleotide

SEQ ID NO: 7592 - DNA, 190 bp, Artificial Sequence
  Synthetic polynucleotide
atcatctcaccttgcctcctgagtttattgttgccgtacctgcaggctctgattggctggagactctgattggctggtcgctctgattggctgggacctctgattggctggctactctgattggctggactctctgattggctggtgcctctgattggctgggtaggcgcgccatgcttcatcagactct

SEQ ID NO: 7593 - DNA, 190 bp, Artificial Sequence; identical to SEQ ID NO: 7592
  Synthetic polynucleotide

SEQ ID NO: 7594 - DNA, 156 bp, Artificial Sequence
  Synthetic polynucleotide
atcatctcaccttgcctcctgagagtgatctgcgggttcctgcaggctggttaaagactggttaatcgctggttaagacctggttaactactggttaaactctggttaatgcctggttaagtactggttaaggcgcgccatgcttcatcagactct

SEQ ID NO: 7595 - DNA, 156 bp, Artificial Sequence; identical to SEQ ID NO: 7594
  Synthetic polynucleotide

SEQ ID NO: 7596 - DNA, 191 bp, Artificial Sequence
  Synthetic polynucleotide
atcatctcaccttgcctcctgatctcgctccgtcctgtcctgcagggggggcacgtggcattaagagggggcacgtggcattatcggggggcacgtggcattagacgggggcacgtggcattactagggggcacgtggcattaactgggggcacgtggcattatgcggcgcgccatgcttcatcagactct

SEQ ID NO: 7597 - DNA, 191 bp, Artificial Sequence; identical to SEQ ID NO: 7596
  Synthetic polynucleotide

SEQ ID NO: 7598 - DNA, 172 bp, Artificial Sequence
  Synthetic polynucleotide
atcatctcaccttgcctcctgacgggttggcaactgtgcctgcaggaagtaggtcaagaaagtaggtcatcgaagtaggtcagacaagtaggtcactaaagtaggtcaactaagtaggtcatgcaagtaggtcagtaaagtaggtcaggcgcgccatgcttcatcagactct

SEQ ID NO: 7599 - DNA, 172 bp, Artificial Sequence; identical to SEQ ID NO: 7598
  Synthetic polynucleotide

SEQ ID NO: 7600 - DNA, 191 bp, Artificial Sequence
  Synthetic polynucleotide
atcatctcaccttgcctcctggcagcacatatagacaacctgcaggcagtttcggtttccgtttcccagacagtttcggtttccgtttccctcgcagtttcggtttccgtttcccgaccagtttcggtttccgtttcccctacagtttcggtttccgtttcccactggcgcgccatgcttcatcagactct

SEQ ID NO: 7601 - DNA, 191 bp, Artificial Sequence; identical to SEQ ID NO: 7600
  Synthetic polynucleotide

SEQ ID NO: 7602 - DNA, 172 bp, Artificial Sequence
  Synthetic polynucleotide
atcatctcaccttgcctcctgcgaatcttcgagtcaaacctgcagggcaatatcgaagagcaatatcgatcggcaatatcgagacgcaatatcgactagcaatatcgaactgcaatatcgatgcgcaatatcgagtagcaatatcgaggcgcgccatgcttcatcagactct

SEQ ID NO: 7603 - DNA, 172 bp, Artificial Sequence; identical to SEQ ID NO: 7602
  Synthetic polynucleotide

SEQ ID NO: 7604 - DNA, 197 bp, Artificial Sequence
  Synthetic polynucleotide
atcatctcaccttgcctcctgcagaaagccggatagtgcctgcaggtttgtttacttagggagatttgtttacttagggtcgtttgtttacttaggggactttgtttacttagggctatttgtttacttagggacttttgtttacttagggtgctttgtttacttaggggtaggcgcgccatgcttcatcagactct

SEQ ID NO: 7605 - DNA, 197 bp, Artificial Sequence; identical to SEQ ID NO: 7604
  Synthetic polynucleotide

SEQ ID NO: 7606 - DNA, 191 bp, Artificial Sequence
  Synthetic polynucleotide
atcatctcaccttgcctcctgggcgcgggcataaataacctgcaggtgacctttcgtgaccttagatgacctttcgtgacctttcgtgacctttcgtgaccttgactgacctttcgtgaccttctatgacctttcgtgaccttacttgacctttcgtgacctttgcggcgcgccatgcttcatcagactct

SEQ ID NO: 7607 - DNA, 191 bp, Artificial Sequence; identical to SEQ ID NO: 7606
  Synthetic polynucleotide

SEQ ID NO: 7608 - DNA, 191 bp, Artificial Sequence
  Synthetic polynucleotide
atcatctcaccttgcctcctgttcggacggtcagactccctgcagggggaacacggtgtacccagagggaacacggtgtaccctcggggaacacggtgtacccgacgggaacacggtgtacccctagggaacacggtgtacccactgggaacacggtgtaccctgcggcgcgccatgcttcatcagactct

SEQ ID NO: 7609 - DNA, 191 bp, Artificial Sequence; identical to SEQ ID NO: 7608
  Synthetic polynucleotide

SEQ ID NO: 7610 - DNA, 186 bp, Artificial Sequence
  Synthetic polynucleotide
atcatctcaccttgcctcctgctgttgtacggagcgagcctgcagggcggacgttgcaacgtccgcagagcggacgttgcaacgtccgctcggcggacgttgcaacgtccgcgacgcggacgttgcaacgtccgcctagcggacgttgcaacgtccgcactggcgcgccatgcttcatcagactct

SEQ ID NO: 7611 - DNA, 186 bp, Artificial Sequence; identical to SEQ ID NO: 7610
  Synthetic polynucleotide

SEQ ID NO: 7612 - DNA, 198 bp, Artificial Sequence
  Synthetic polynucleotide
atcatctcaccttgcctcctggcgacaagaaatagacccctgcaggttaatcggttgctaagggtcacaagattaatcggttgctaagggtcacatcgttaatcggttgctaagggtcacagacttaatcggttgctaagggtcacactattaatcggttgctaagggtcacaggcgcgccatgcttcatcagactct

SEQ ID NO: 7613 - DNA, 198 bp, Artificial Sequence; identical to SEQ ID NO: 7612
  Synthetic polynucleotide

SEQ ID NO: 7614 - DNA, 172 bp, Artificial Sequence
  Synthetic polynucleotide
atcatctcaccttgcctcctggagagtagttccggaatcctgcaggtttcacacctagatttcacaccttcgtttcacacctgactttcacacctctatttcacacctacttttcacaccttgctttcacacctgtatttcacacctggcgcgccatgcttcatcagactct

SEQ ID NO: 7615 - DNA, 172 bp, Artificial Sequence; identical to SEQ ID NO: 7614
  Synthetic polynucleotide

SEQ ID NO: 7616 - DNA, 156 bp, Artificial Sequence
  Synthetic polynucleotide
atcatctcaccttgcctcctgaggtccgtatcattgaacctgcaggtgacctctagatgacctcttcgtgacctctgactgacctctctatgacctctacttgacctcttgctgacctctgtatgacctctggcgcgccatgcttcatcagactct

SEQ ID NO: 7617 - DNA, 156 bp, Artificial Sequence; identical to SEQ ID NO: 7616
  Synthetic polynucleotide

SEQ ID NO: 7618 - DNA, 191 bp, Artificial Sequence
  Synthetic polynucleotide
atcatctcaccttgcctcctgtaaacacgtggagacaacctgcaggttccctagaacactctgtacccgcaacagattccctagaacactctgtacccgcaactcgttccctagaacactctgtacccgcaacgacttccctagaacactctgtacccgcaacctaggcgcgccatgcttcatcagactct

SEQ ID NO: 7619 - DNA, 191 bp, Artificial Sequence; identical to SEQ ID NO: 7618
  Synthetic polynucleotide

SEQ ID NO: 7620 - DNA, 185 bp, Artificial Sequence
  Synthetic polynucleotide
atcatctcaccttgcctcctgaggagttacatgtgggccctgcaggcccgaccacgtggtcaagacccgaccacgtggtcatcgcccgaccacgtggtcagaccccgaccacgtggtcactacccgaccacgtggtcaactcccgaccacgtggtcatgcggcgcgccatgcttcatcagactct

SEQ ID NO: 7621 - DNA, 185 bp, Artificial Sequence; identical to SEQ ID NO: 7620
  Synthetic polynucleotide

SEQ ID NO: 7622 - DNA, 191 bp, Artificial Sequence
  Synthetic polynucleotide
atcatctcaccttgcctcctgcgagcgtttgcatggcacctgcaggtcccagctactttgggaagatcccagctactttgggatcgtcccagctactttgggagactcccagctactttgggactatcccagctactttgggaacttcccagctactttgggatgcggcgcgccatgcttcatcagactct

SEQ ID NO: 7623 - DNA, 191 bp, Artificial Sequence; identical to SEQ ID NO: 7622
  Synthetic polynucleotide

SEQ ID NO: 7624 - DNA, 185 bp, Artificial Sequence
  Synthetic polynucleotide
atcatctcaccttgcctcctggcacgcatctcatctcacctgcaggatgtacagtagcaaagagaatgtacagtagcaaagtcgatgtacagtagcaaaggacatgtacagtagcaaagctaatgtacagtagcaaagactatgtacagtagcaaagtgcggcgcgccatgcttcatcagactct

SEQ ID NO: 7625 - DNA, 185 bp, Artificial Sequence; identical to SEQ ID NO: 7624
  Synthetic polynucleotide

SEQ ID NO: 7626 - DNA, 180 bp, Artificial Sequence
  Synthetic polynucleotide
atcatctcaccttgcctcctgctggtatagtgtatgcgcctgcaggaaaaacaaacaagaaaaaacaaacatcgaaaaacaaacagacaaaaacaaacactaaaaaacaaacaactaaaaacaaacatgcaaaaacaaacagtaaaaaacaaacaggcgcgccatgcttcatcagactct

SEQ ID NO: 7627 - DNA, 180 bp, Artificial Sequence; identical to SEQ ID NO: 7626
  Synthetic polynucleotide

SEQ ID NO: 7628 - DNA, 156 bp, Artificial Sequence
  Synthetic polynucleotide
atcatctcaccttgcctcctgcgtggtcgatttcccatcctgcagggtaattatagagtaattattcggtaattatgacgtaattatctagtaattatactgtaattattgcgtaattatgtagtaattatggcgcgccatgcttcatcagactct

SEQ ID NO: 7629 - DNA, 156 bp, Artificial Sequence; identical to SEQ ID NO: 7628
  Synthetic polynucleotide

SEQ ID NO: 7630 - DNA, 164 bp, Artificial Sequence
  Synthetic polynucleotide
atcatctcaccttgcctcctgactcagggcgtgagtgacctgcaggaaagtccaaagaaaagtccaatcgaaagtccaagacaaagtccaactaaaagtccaaactaaagtccaatgcaaagtccaagtaaaagtccaaggcgcgccatgcttcatcagactct

SEQ ID NO: 7631 - DNA, 164 bp, Artificial Sequence; identical to SEQ ID NO: 7630
  Synthetic polynucleotide

SEQ ID NO: 7632 - DNA, 172 bp, Artificial Sequence
  Synthetic polynucleotide
atcatctcaccttgcctcctgcgcacataaggacaagccctgcaggcataaacaaaagacataaacaaatcgcataaacaaagaccataaacaaactacataaacaaaactcataaacaaatgccataaacaaagtacataaacaaaggcgcgccatgcttcatcagactct

SEQ ID NO: 7633 - DNA, 172 bp, Artificial Sequence; identical to SEQ ID NO: 7632
  Synthetic polynucleotide

SEQ ID NO: 7634 - DNA, 191 bp, Artificial Sequence
  Synthetic polynucleotide
atcatctcaccttgcctcctgacaccagcgacgaattacctgcaggttccactaattagtgcaagattccactaattagtgcatcgttccactaattagtgcagacttccactaattagtgcactattccactaattagtgcaactttccactaattagtgcatgcggcgcgccatgcttcatcagactct

SEQ ID NO: 7635 - DNA, 191 bp, Artificial Sequence; identical to SEQ ID NO: 7634
  Synthetic polynucleotide

SEQ ID NO: 7636 - DNA, 190 bp, Artificial Sequence
  Synthetic polynucleotide
atcatctcaccttgcctcctggccttcagacgtctccacctgcaggtatgtaaacaacaaagatatgtaaacaacaatcgtatgtaaacaacaagactatgtaaacaacaactatatgtaaacaacaaacttatgtaaacaacaatgctatgtaaacaacaagtaggcgcgccatgcttcatcagactct

SEQ ID NO: 7637 - DNA, 190 bp, Artificial Sequence; identical to SEQ ID NO: 7636
  Synthetic polynucleotide

SEQ ID NO: 7638 - DNA, 196 bp, Artificial Sequence
  Synthetic polynucleotide
atcatctcaccttgcctcctgaaggcagctcatcagatcctgcaggcaacatctggattagacaacatctggatttcgcaacatctggattgaccaacatctggattctacaacatctggattactcaacatctggatttgccaacatctggattgtacaacatctggattggcgcgccatgcttcatcagactct

SEQ ID NO: 7639 - DNA, 196 bp, Artificial Sequence; identical to SEQ ID NO: 7638
  Synthetic polynucleotide

SEQ ID NO: 7640 - DNA, 180 bp, Artificial Sequence
  Synthetic polynucleotide
atcatctcaccttgcctcctgaccgaaccctaaggtgccctgcaggccagggggcgcagaccagggggcgctcgccagggggcgcgacccagggggcgcctaccagggggcgcactccagggggcgctgcccagggggcgcgtaccagggggcgcggcgcgccatgcttcatcagactct

SEQ ID NO: 7641 - DNA, 180 bp, Artificial Sequence; identical to SEQ ID NO: 7640
  Synthetic polynucleotide

SEQ ID NO: 7642 - DNA, 185 bp, Artificial Sequence
  Synthetic polynucleotide
atcatctcaccttgcctcctgcttggctgtaatcgatgcctgcagggaattaattagttgcaagagaattaattagttgcatcggaattaattagttgcagacgaattaattagttgcactagaattaattagttgcaactgaattaattagttgcatgcggcgcgccatgcttcatcagactct

SEQ ID NO: 7643 - DNA, 185 bp, Artificial Sequence; identical to SEQ ID NO: 7642
  Synthetic polynucleotide

SEQ ID NO: 7644 - DNA, 197 bp, Artificial Sequence
  Synthetic polynucleotide
atcatctcaccttgcctcctgtatatattgagtgcacgcctgcagggtccatggtgctgaaagagtccatggtgctgaatcggtccatggtgctgaagacgtccatggtgctgaactagtccatggtgctgaaactgtccatggtgctgaatgcgtccatggtgctgaagtaggcgcgccatgcttcatcagactct

SEQ ID NO: 7645 - DNA, 197 bp, Artificial Sequence; identical to SEQ ID NO: 7644
  Synthetic polynucleotide

SEQ ID NO: 7646 - DNA, 156 bp, Artificial Sequence
  Synthetic polynucleotide
atcatctcaccttgcctcctgcaagggcccgttagctacctgcaggttcccacgagattcccacgtcgttcccacggacttcccacgctattcccacgactttcccacgtgcttcccacggtattcccacgggcgcgccatgcttcatcagactct

SEQ ID NO: 7647 - DNA, 156 bp, Artificial Sequence; identical to SEQ ID NO: 7646
  Synthetic polynucleotide

SEQ ID NO: 7648 - DNA, 180 bp, Artificial Sequence
  Synthetic polynucleotide
atcatctcaccttgcctcctgtgcgcatagtgtcgcttcctgcaggtatcacgtgggagatatcacgtgggtcgtatcacgtggggactatcacgtgggctatatcacgtgggacttatcacgtgggtgctatcacgtggggtatatcacgtgggggcgcgccatgcttcatcagactct

SEQ ID NO: 7649 - DNA, 180 bp, Artificial Sequence; identical to SEQ ID NO: 7648
  Synthetic polynucleotide

SEQ ID NO: 7650 - DNA, 185 bp, Artificial Sequence
  Synthetic polynucleotide
atcatctcaccttgcctcctgatgatcgttacgtgggccctgcaggaacccaataaaattcgagaaacccaataaaattcgtcgaacccaataaaattcggacaacccaataaaattcgctaaacccaataaaattcgactaacccaataaaattcgtgcggcgcgccatgcttcatcagactct

SEQ ID NO: 7651 - DNA, 185 bp, Artificial Sequence; identical to SEQ ID NO: 7650
  Synthetic polynucleotide

SEQ ID NO: 7652 - DNA, 190 bp, Artificial Sequence
  Synthetic polynucleotide
atcatctcaccttgcctcctgctccaacgattgaatatcctgcagggaccccccacgaagagagaccccccacgaagtcggaccccccacgaaggacgaccccccacgaagctagaccccccacgaagactgaccccccacgaagtgcgaccccccacgaaggtaggcgcgccatgcttcatcagactct

SEQ ID NO: 7653 - DNA, 190 bp, Artificial Sequence; identical to SEQ ID NO: 7652
  Synthetic polynucleotide

SEQ ID NO: 7654 - DNA, 197 bp, Artificial Sequence
  Synthetic polynucleotide
atcatctcaccttgcctcctgggccgtatcatcaccagcctgcaggatgccaaaaatagcaagaatgccaaaaatagcatcgatgccaaaaatagcagacatgccaaaaatagcactaatgccaaaaatagcaactatgccaaaaatagcatgcatgccaaaaatagcagtaggcgcgccatgcttcatcagactct

SEQ ID NO: 7655 - DNA, 197 bp, Artificial Sequence; identical to SEQ ID NO: 7654
  Synthetic polynucleotide

SEQ ID NO: 7656 - DNA, 186 bp, Artificial Sequence
  Synthetic polynucleotide
atcatctcaccttgcctcctgcagttacttgcgactagcctgcaggcaaaactaggtcaaaggtcaagacaaaactaggtcaaaggtcatcgcaaaactaggtcaaaggtcagaccaaaactaggtcaaaggtcactacaaaactaggtcaaaggtcaactggcgcgccatgcttcatcagactct

SEQ ID NO: 7657 - DNA, 186 bp, Artificial Sequence; identical to SEQ ID NO: 7656
  Synthetic polynucleotide

SEQ ID NO: 7658 - DNA, 156 bp, Artificial Sequence
  Synthetic polynucleotide
atcatctcaccttgcctcctgtgactacatgagactatcctgcagggtaatcaaagagtaatcaatcggtaatcaagacgtaatcaactagtaatcaaactgtaatcaatgcgtaatcaagtagtaatcaaggcgcgccatgcttcatcagactct

SEQ ID NO: 7659 - DNA, 156 bp, Artificial Sequence; identical to SEQ ID NO: 7658
  Synthetic polynucleotide

SEQ ID NO: 7660 - DNA, 190 bp, Artificial Sequence
  Synthetic polynucleotide
atcatctcaccttgcctcctgtgcgcaaacgttgctgtcctgcaggattgtttacgtttgagaattgtttacgtttgtcgattgtttacgtttggacattgtttacgtttgctaattgtttacgtttgactattgtttacgtttgtgcattgtttacgtttggtaggcgcgccatgcttcatcagactct

SEQ ID NO: 7661 - DNA, 190 bp, Artificial Sequence; identical to SEQ ID NO: 7660
  Synthetic polynucleotide

SEQ ID NO: 7662 - DNA, 196 bp, Artificial Sequence
  Synthetic polynucleotide
atcatctcaccttgcctcctgcgatcaacagcgtcgtacctgcaggtgaagcgtgacgaagatgaagcgtgacgatcgtgaagcgtgacgagactgaagcgtgacgactatgaagcgtgacgaacttgaagcgtgacgatgctgaagcgtgacgagtatgaagcgtgacgaggcgcgccatgcttcatcagactct

SEQ ID NO: 7663 - DNA, 196 bp, Artificial Sequence; identical to SEQ ID NO: 7662
  Synthetic polynucleotide

SEQ ID NO: 7664 - DNA, 164 bp, Artificial Sequence
  Synthetic polynucleotide
atcatctcaccttgcctcctgcagtctaccgccgtgtacctgcaggaaagtccagagaaaagtccagtcgaaagtccaggacaaagtccagctaaaagtccagactaaagtccagtgcaaagtccaggtaaaagtccagggcgcgccatgcttcatcagactct

SEQ ID NO: 7665 - DNA, 164 bp, Artificial Sequence; identical to SEQ ID NO: 7664
  Synthetic polynucleotide

SEQ ID NO: 7666 - DNA, 188 bp, Artificial Sequence
  Synthetic polynucleotide
atcatctcaccttgcctcctgaggtccttatggtattccctgcaggaatgcgggtgtgagaaatgcgggtgtgtcgaatgcgggtgtggacaatgcgggtgtgctaaatgcgggtgtgactaatgcgggtgtgtgcaatgcgggtgtggtaaatgcgggtgtgggcgcgccatgcttcatcagactct

SEQ ID NO: 7667 - DNA, 188 bp, Artificial Sequence; identical to SEQ ID NO: 7666
  Synthetic polynucleotide

SEQ ID NO: 7668 - DNA, 180 bp, Artificial Sequence
  Synthetic polynucleotide
atcatctcaccttgcctcctgatagagttatcgtttgccctgcaggccaataaaaccagaccaataaaacctcgccaataaaaccgacccaataaaaccctaccaataaaaccactccaataaaacctgcccaataaaaccgtaccaataaaaccggcgcgccatgcttcatcagactct

SEQ ID NO: 7669 - DNA, 180 bp, Artificial Sequence; identical to SEQ ID NO: 7668
  Synthetic polynucleotide

SEQ ID NO: 7670 - DNA, 172 bp, Artificial Sequence
  Synthetic polynucleotide
atcatctcaccttgcctcctgaaattgttccaggaccccctgcagggctacgtcacagagctacgtcactcggctacgtcacgacgctacgtcacctagctacgtcacactgctacgtcactgcgctacgtcacgtagctacgtcacggcgcgccatgcttcatcagactct

SEQ ID NO: 7671 - DNA, 172 bp, Artificial Sequence; identical to SEQ ID NO: 7670
  Synthetic polynucleotide

SEQ ID NO: 7672 - DNA, 200 bp, Artificial Sequence
  Synthetic polynucleotide
atcatctcaccttgcctcctgggaccttaatacaaccccctgcaggatggccatataaggagatgagaatggccatataaggagatgtcgatggccatataaggagatggacatggccatataaggagatgctaatggccatataaggagatgactatggccatataaggagatgggcgcgccatgcttcatcagactct

SEQ ID NO: 7673 - DNA, 200 bp, Artificial Sequence; identical to SEQ ID NO: 7672
  Synthetic polynucleotide

SEQ ID NO: 7674 - DNA, 197 bp, Artificial Sequence
  Synthetic polynucleotide
atcatctcaccttgcctcctgtgcacagcagtttcgtccctgcaggtctgcctagcaacagagatctgcctagcaacagtcgtctgcctagcaacaggactctgcctagcaacagctatctgcctagcaacagacttctgcctagcaacagtgctctgcctagcaacaggtaggcgcgccatgcttcatcagactct

SEQ ID NO: 7675 - DNA, 197 bp, Artificial Sequence; identical to SEQ ID NO: 7674
  Synthetic polynucleotide

SEQ ID NO: 7676 - DNA, 156 bp, Artificial Sequence
  Synthetic polynucleotide
atcatctcaccttgcctcctgcgtccacaacatacaggcctgcaggcagctgtcagacagctgtctcgcagctgtcgaccagctgtcctacagctgtcactcagctgtctgccagctgtcgtacagctgtcggcgcgccatgcttcatcagactct

SEQ ID NO: 7677 - DNA, 156 bp, Artificial Sequence; identical to SEQ ID NO: 7676
  Synthetic polynucleotide

SEQ ID NO: 7678 - DNA, 172 bp, Artificial Sequence
  Synthetic polynucleotide
atcatctcaccttgcctcctgagccggaggtctgcaaacctgcaggaagcacttaaagaaagcacttaatcgaagcacttaagacaagcacttaactaaagcacttaaactaagcacttaatgcaagcacttaagtaaagcacttaaggcgcgccatgcttcatcagactct

SEQ ID NO: 7679 - DNA, 172 bp, Artificial Sequence; identical to SEQ ID NO: 7678
  Synthetic polynucleotide

SEQ ID NO: 7680 - DNA, 148 bp, Artificial Sequence
  Synthetic polynucleotide
atcatctcaccttgcctcctggagattctcaattctgtcctgcaggaatatatagaaatatattcgaatatatgacaatatatctaaatatatactaatatattgcaatatatgtaaatatatggcgcgccatgcttcatcagactct

SEQ ID NO: 7681 - DNA, 148 bp, Artificial Sequence; identical to SEQ ID NO: 7680
  Synthetic polynucleotide

SEQ ID NO: 7682 - DNA, 188 bp, Artificial Sequence
  Synthetic polynucleotide
atcatctcaccttgcctcctgacagcgttcttgacagccctgcaggcaccacctgttgagacaccacctgttgtcgcaccacctgttggaccaccacctgttgctacaccacctgttgactcaccacctgttgtgccaccacctgttggtacaccacctgttgggcgcgccatgcttcatcagactct

SEQ ID NO: 7683 - DNA, 188 bp, Artificial Sequence; identical to SEQ ID NO: 7682
  Synthetic polynucleotide

SEQ ID NO: 7684 - DNA, 172 bp, Artificial Sequence
  Synthetic polynucleotide
atcatctcaccttgcctcctggtccacatcaatcctatcctgcagggcccccgggcagagcccccgggctcggcccccgggcgacgcccccgggcctagcccccgggcactgcccccgggctgcgcccccgggcgtagcccccgggcggcgcgccatgcttcatcagactct

SEQ ID NO: 7685 - DNA, 172 bp, Artificial Sequence; identical to SEQ ID NO: 7684
  Synthetic polynucleotide

SEQ ID NO: 7686 - DNA, 197 bp, Artificial Sequence
  Synthetic polynucleotide
atcatctcaccttgcctcctgaaatggcttcgcgtcaccctgcaggctcttgttgtttgttagactcttgttgtttgtttcgctcttgttgtttgttgacctcttgttgtttgttctactcttgttgtttgttactctcttgttgtttgtttgcctcttgttgtttgttgtaggcgcgccatgcttcatcagactct

SEQ ID NO: 7687 - DNA, 197 bp, Artificial Sequence; identical to SEQ ID NO: 7686
  Synthetic polynucleotide

SEQ ID NO: 7688 - DNA, 172 bp, Artificial Sequence
  Synthetic polynucleotide
atcatctcaccttgcctcctgccatcgcaaggctacgtcctgcagggttgctatggagagttgctatggtcggttgctatgggacgttgctatggctagttgctatggactgttgctatggtgcgttgctatgggtagttgctatggggcgcgccatgcttcatcagactct

SEQ ID NO: 7689 - DNA, 172 bp, Artificial Sequence; identical to SEQ ID NO: 7688
  Synthetic polynucleotide

SEQ ID NO: 7690 - DNA, 191 bp, Artificial Sequence
  Synthetic polynucleotide
atcatctcaccttgcctcctgagcatcttccggcacctcctgcagggatgaacttcctgaaccgtttagagatgaacttcctgaaccgttttcggatgaacttcctgaaccgtttgacgatgaacttcctgaaccgtttctagatgaacttcctgaaccgtttactggcgcgccatgcttcatcagactct

SEQ ID NO: 7691 - DNA, 191 bp, Artificial Sequence; identical to SEQ ID NO: 7690
  Synthetic polynucleotide

SEQ ID NO: 7692 - DNA, 190 bp, Artificial Sequence
  Synthetic polynucleotide
atcatctcaccttgcctcctgattccacgcctcagatacctgcaggaacggttaacggttagaaacggttaacggtttcgaacggttaacggttgacaacggttaacggttctaaacggttaacggttactaacggttaacggtttgcaacggttaacggttgtaggcgcgccatgcttcatcagactct

SEQ ID NO: 7693 - DNA, 190 bp, Artificial Sequence; identical to SEQ ID NO: 7692
  Synthetic polynucleotide

SEQ ID NO: 7694 - DNA, 172 bp, Artificial Sequence
  Synthetic polynucleotide
atcatctcaccttgcctcctgtccgatttgtacacatccctgcaggcttttatagaagacttttatagatcgcttttatagagaccttttatagactacttttatagaactcttttatagatgccttttatagagtacttttatagaggcgcgccatgcttcatcagactct

SEQ ID NO: 7695 - DNA, 172 bp, Artificial Sequence; identical to SEQ ID NO: 7694
  Synthetic polynucleotide

SEQ ID NO: 7696 - DNA, 164 bp, Artificial Sequence
  Synthetic polynucleotide
atcatctcaccttgcctcctgttacaaatctcggtgtacctgcagggggcaacccagagggcaaccctcggggcaacccgacgggcaacccctagggcaacccactgggcaaccctgcgggcaacccgtagggcaacccggcgcgccatgcttcatcagactct

SEQ ID NO: 7697 - DNA, 164 bp, Artificial Sequence; identical to SEQ ID NO: 7696
  Synthetic polynucleotide

SEQ ID NO: 7698 - DNA, 191 bp, Artificial Sequence
  Synthetic polynucleotide
atcatctcaccttgcctcctgacagaagagttccttggcctgcagggtgcgctaattagtgcaagagtgcgctaattagtgcatcggtgcgctaattagtgcagacgtgcgctaattagtgcactagtgcgctaattagtgcaactgtgcgctaattagtgcatgcggcgcgccatgcttcatcagactct

SEQ ID NO: 7699 - DNA, 191 bp, Artificial Sequence; identical to SEQ ID NO: 7698
  Synthetic polynucleotide

SEQ ID NO: 7700 - DNA, 196 bp, Artificial Sequence
  Synthetic polynucleotide
atcatctcaccttgcctcctgacaagtttgccagctaacctgcaggcacttttaattagagacacttttaattagtcgcacttttaattaggaccacttttaattagctacacttttaattagactcacttttaattagtgccacttttaattaggtacacttttaattagggcgcgccatgcttcatcagactct

SEQ ID NO: 7701 - DNA, 196 bp, Artificial Sequence; identical to SEQ ID NO: 7700
  Synthetic polynucleotide

SEQ ID NO: 7702 - DNA, 180 bp, Artificial Sequence
  Synthetic polynucleotide
atcatctcaccttgcctcctgtcagttggctggtgaagcctgcaggagtcgtaaaaaagaagtcgtaaaaatcgagtcgtaaaaagacagtcgtaaaaactaagtcgtaaaaaactagtcgtaaaaatgcagtcgtaaaaagtaagtcgtaaaaaggcgcgccatgcttcatcagactct

SEQ ID NO: 7703 - DNA, 180 bp, Artificial Sequence; identical to SEQ ID NO: 7702
  Synthetic polynucleotide

SEQ ID NO: 7704 - DNA, 188 bp, Artificial Sequence
  Synthetic polynucleotide
atcatctcaccttgcctcctgaaccacagctaaggctccctgcagggatttaacataaagagatttaacataatcggatttaacataagacgatttaacataactagatttaacataaactgatttaacataatgcgatttaacataagtagatttaacataaggcgcgccatgcttcatcagactct

SEQ ID NO: 7705 - DNA, 188 bp, Artificial Sequence; identical to SEQ ID NO: 7704
  Synthetic polynucleotide

SEQ ID NO: 7706 - DNA, 172 bp, Artificial Sequence
  Synthetic polynucleotide
atcatctcaccttgcctcctgtttagtggatgactggacctgcaggttatcccctaagattatcccctatcgttatcccctagacttatcccctactattatcccctaactttatcccctatgcttatcccctagtattatcccctaggcgcgccatgcttcatcagactct

SEQ ID NO: 7707 - DNA, 172 bp, Artificial Sequence; identical to SEQ ID NO: 7706
  Synthetic polynucleotide

SEQ ID NO: 7708 - DNA, 172 bp, Artificial Sequence
  Synthetic polynucleotide
atcatctcaccttgcctcctgggtgaggctgaatcccacctgcaggaccacttgaaagaaccacttgaatcgaccacttgaagacaccacttgaactaaccacttgaaactaccacttgaatgcaccacttgaagtaaccacttgaaggcgcgccatgcttcatcagactct

SEQ ID NO: 7709 - DNA, 172 bp, Artificial Sequence; identical to SEQ ID NO: 7708
  Synthetic polynucleotide

SEQ ID NO: 7710 - DNA, 191 bp, Artificial Sequence
  Synthetic polynucleotide
atcatctcaccttgcctcctgtatgtgcttattggtggcctgcaggaaccggttaaaccggttagaaaccggttaaaccggtttcgaaccggttaaaccggttgacaaccggttaaaccggttctaaaccggttaaaccggttactaaccggttaaaccggtttgcggcgcgccatgcttcatcagactct

SEQ ID NO: 7711 - DNA, 191 bp, Artificial Sequence; identical to SEQ ID NO: 7710
  Synthetic polynucleotide

SEQ ID NO: 7712 - DNA, 197 bp, Artificial Sequence
  Synthetic polynucleotide
atcatctcaccttgcctcctgacccgcacatgttgaagcctgcaggatcgatcaggttatcgatagaatcgatcaggttatcgattcgatcgatcaggttatcgatgacatcgatcaggttatcgatctaatcgatcaggttatcgatactatcgatcaggttatcgattgcggcgcgccatgcttcatcagactct

SEQ ID NO: 7713 - DNA, 197 bp, Artificial Sequence; identical to SEQ ID NO: 7712
  Synthetic polynucleotide

SEQ ID NO: 7714 - DNA, 164 bp, Artificial Sequence
  Synthetic polynucleotide
atcatctcaccttgcctcctgcgtcgacgcactctaatcctgcaggctaattatcagactaattatctcgctaattatcgacctaattatcctactaattatcactctaattatctgcctaattatcgtactaattatcggcgcgccatgcttcatcagactct

SEQ ID NO: 7715 - DNA, 164 bp, Artificial Sequence; identical to SEQ ID NO: 7714
  Synthetic polynucleotide

SEQ ID NO: 7716 - DNA, 197 bp, Artificial Sequence
  Synthetic polynucleotide
atcatctcaccttgcctcctggttccttactacggtgacctgcaggccgaaaccgaaactaagaccgaaaccgaaactatcgccgaaaccgaaactagacccgaaaccgaaactactaccgaaaccgaaactaactccgaaaccgaaactatgcccgaaaccgaaactagtaggcgcgccatgcttcatcagactct

SEQ ID NO: 7717 - DNA, 197 bp, Artificial Sequence; identical to SEQ ID NO: 7716
  Synthetic polynucleotide

SEQ ID NO: 7718 - DNA, 172 bp, Artificial Sequence
  Synthetic polynucleotide
atcatctcaccttgcctcctgggagcaacgctggttaacctgcagggttacgtaatagagttacgtaattcggttacgtaatgacgttacgtaatctagttacgtaatactgttacgtaattgcgttacgtaatgtagttacgtaatggcgcgccatgcttcatcagactct

SEQ ID NO: 7719 - DNA, 172 bp, Artificial Sequence; identical to SEQ ID NO: 7718
  Synthetic polynucleotide

SEQ ID NO: 7720 - DNA, 188 bp, Artificial Sequence
  Synthetic polynucleotide
atcatctcaccttgcctcctgcttgccctattcagggacctgcaggtcggtggtcgccagatcggtggtcgcctcgtcggtggtcgccgactcggtggtcgccctatcggtggtcgccacttcggtggtcgcctgctcggtggtcgccgtatcggtggtcgccggcgcgccatgcttcatcagactct

SEQ ID NO: 7721 - DNA, 188 bp, Artificial Sequence; identical to SEQ ID NO: 7720
  Synthetic polynucleotide

SEQ ID NO: 7722 - DNA, 180 bp, Artificial Sequence
  Synthetic polynucleotide
atcatctcaccttgcctcctgggccggaatctctgagtcctgcaggctcattggctgagactcattggctgtcgctcattggctggacctcattggctgctactcattggctgactctcattggctgtgcctcattggctggtactcattggctgggcgcgccatgcttcatcagactct

SEQ ID NO: 7723 - DNA, 180 bp, Artificial Sequence; identical to SEQ ID NO: 7722
  Synthetic polynucleotide

SEQ ID NO: 7724 - DNA, 156 bp, Artificial Sequence
  Synthetic polynucleotide
atcatctcaccttgcctcctgcgtctagcttacgaccacctgcaggtgacctagagatgacctagtcgtgacctaggactgacctagctatgacctagacttgacctagtgctgacctaggtatgacctagggcgcgccatgcttcatcagactct

SEQ ID NO: 7725 - DNA, 156 bp, Artificial Sequence; identical to SEQ ID NO: 7724
  Synthetic polynucleotide

SEQ ID NO: 7726 - DNA, 197 bp, Artificial Sequence
  Synthetic polynucleotide
atcatctcaccttgcctcctgtcaatagtgaagcgttgcctgcaggtccatgtttactttgagatccatgtttactttgtcgtccatgtttactttggactccatgtttactttgctatccatgtttactttgacttccatgtttactttgtgctccatgtttactttggtaggcgcgccatgcttcatcagactct

SEQ ID NO: 7727 - DNA, 197 bp, Artificial Sequence; identical to SEQ ID NO: 7726
  Synthetic polynucleotide

SEQ ID NO: 7728 - DNA, 197 bp, Artificial Sequence
  Synthetic polynucleotide
atcatctcaccttgcctcctgtggagccgaacggtcatcctgcaggaacaatgaaattgttagaaacaatgaaattgtttcgaacaatgaaattgttgacaacaatgaaattgttctaaacaatgaaattgttactaacaatgaaattgtttgcaacaatgaaattgttgtaggcgcgccatgcttcatcagactct

SEQ ID NO: 7729 - DNA, 197 bp, Artificial Sequence; identical to SEQ ID NO: 7728
  Synthetic polynucleotide

SEQ ID NO: 7730 - DNA, 196 bp, Artificial Sequence
  Synthetic polynucleotide
atcatctcaccttgcctcctgagttgagcccgatctgccctgcaggaaacccgcatattagaaaacccgcatatttcgaaacccgcatattgacaaacccgcatattctaaaacccgcatattactaaacccgcatatttgcaaacccgcatattgtaaaacccgcatattggcgcgccatgcttcatcagactct

SEQ ID NO: 7731 - DNA, 196 bp, Artificial Sequence; identical to SEQ ID NO: 7730
  Synthetic polynucleotide

SEQ ID NO: 7732 - DNA, 156 bp, Artificial Sequence
  Synthetic polynucleotide
atcatctcaccttgcctcctgccttaagcacggcttgacctgcaggaagtgataagaaagtgatatcgaagtgatagacaagtgatactaaagtgataactaagtgatatgcaagtgatagtaaagtgataggcgcgccatgcttcatcagactct

SEQ ID NO: 7733 - DNA, 156 bp, Artificial Sequence; identical to SEQ ID NO: 7732
  Synthetic polynucleotide

SEQ ID NO: 7734 - DNA, 164 bp, Artificial Sequence
  Synthetic polynucleotide
atcatctcaccttgcctcctggttgacggtagtcagcacctgcaggcgtgacgtcagacgtgacgtctcgcgtgacgtcgaccgtgacgtcctacgtgacgtcactcgtgacgtctgccgtgacgtcgtacgtgacgtcggcgcgccatgcttcatcagactct

SEQ ID NO: 7735 - DNA, 164 bp, Artificial Sequence; identical to SEQ ID NO: 7734
  Synthetic polynucleotide

SEQ ID NO: 7736 - DNA, 197 bp, Artificial Sequence
  Synthetic polynucleotide
atcatctcaccttgcctcctgcttgactcaggacctgccctgcaggggggccgctctaggcagaggggccgctctaggctcgggggccgctctaggcgacggggccgctctaggcctaggggccgctctaggcactggggccgctctaggctgcggggccgctctaggcgtaggcgcgccatgcttcatcagactct

SEQ ID NO: 7737 - DNA, 197 bp, Artificial Sequence; identical to SEQ ID NO: 7736
  Synthetic polynucleotide

SEQ ID NO: 7738 - DNA, 196 bp, Artificial Sequence
  Synthetic polynucleotide
atcatctcaccttgcctcctgacctgtcaaatcattaccctgcaggaggccaaagtccaagaaggccaaagtccatcgaggccaaagtccagacaggccaaagtccactaaggccaaagtccaactaggccaaagtccatgcaggccaaagtccagtaaggccaaagtccaggcgcgccatgcttcatcagactct

SEQ ID NO: 7739 - DNA, 196 bp, Artificial Sequence; identical to SEQ ID NO: 7738
  Synthetic polynucleotide

SEQ ID NO: 7740 - DNA, 185 bp, Artificial Sequence
  Synthetic polynucleotide
atcatctcaccttgcctcctgcattcccattcaaagatcctgcagggattgaggtcacgccaagagattgaggtcacgccatcggattgaggtcacgccagacgattgaggtcacgccactagattgaggtcacgccaactgattgaggtcacgccatgcggcgcgccatgcttcatcagactct

SEQ ID NO: 7741 - DNA, 185 bp, Artificial Sequence; identical to SEQ ID NO: 7740
  Synthetic polynucleotide

SEQ ID NO: 7742 - DNA, 180 bp, Artificial Sequence
  Synthetic polynucleotide
atcatctcaccttgcctcctgttgataatccctcgtggcctgcaggaacacctgtcaagaaacacctgtcatcgaacacctgtcagacaacacctgtcactaaacacctgtcaactaacacctgtcatgcaacacctgtcagtaaacacctgtcaggcgcgccatgcttcatcagactct

SEQ ID NO: 7743 - DNA, 180 bp, Artificial Sequence; identical to SEQ ID NO: 7742
  Synthetic polynucleotide

SEQ ID NO: 7744 - DNA, 188 bp, Artificial Sequence
  Synthetic polynucleotide
atcatctcaccttgcctcctgctggtgtagcagttatgcctgcaggtaaatcactgcaagataaatcactgcatcgtaaatcactgcagactaaatcactgcactataaatcactgcaacttaaatcactgcatgctaaatcactgcagtataaatcactgcaggcgcgccatgcttcatcagactct

SEQ ID NO: 7745 - DNA, 188 bp, Artificial Sequence; identical to SEQ ID NO: 7744
  Synthetic polynucleotide

SEQ ID NO: 7746 - DNA, 188 bp, Artificial Sequence
  Synthetic polynucleotide
atcatctcaccttgcctcctgttgtcatggttctgactcctgcaggaaattgtgcaatagaaaattgtgcaattcgaaattgtgcaatgacaaattgtgcaatctaaaattgtgcaatactaaattgtgcaattgcaaattgtgcaatgtaaaattgtgcaatggcgcgccatgcttcatcagactct

SEQ ID NO: 7747 - DNA, 188 bp, Artificial Sequence; identical to SEQ ID NO: 7746
  Synthetic polynucleotide

SEQ ID NO: 7748 - DNA, 156 bp, Artificial Sequence
  Synthetic polynucleotide
atcatctcaccttgcctcctgctgagaaggtagtatgccctgcagggggaagccagagggaagcctcggggaagccgacgggaagccctagggaagccactgggaagcctgcgggaagccgtagggaagccggcgcgccatgcttcatcagactct

SEQ ID NO: 7749 - DNA, 156 bp, Artificial Sequence; identical to SEQ ID NO: 7748
  Synthetic polynucleotide

SEQ ID NO: 7750 - DNA, 180 bp, Artificial Sequence
  Synthetic polynucleotide
atcatctcaccttgcctcctgcgtagaggtctaattctcctgcagggcataatttatagagcataatttattcggcataatttatgacgcataatttatctagcataatttatactgcataatttattgcgcataatttatgtagcataatttatggcgcgccatgcttcatcagactct

SEQ ID NO: 7751 - DNA, 180 bp, Artificial Sequence; identical to SEQ ID NO: 7750
  Synthetic polynucleotide

SEQ ID NO: 7752 - DNA, 164 bp, Artificial Sequence
  Synthetic polynucleotide
atcatctcaccttgcctcctgaccgattgtagtcccaccctgcaggggccgggttagaggccgggtttcgggccgggttgacggccgggttctaggccgggttactggccgggtttgcggccgggttgtaggccgggttggcgcgccatgcttcatcagactct

SEQ ID NO: 7753 - DNA, 164 bp, Artificial Sequence; identical to SEQ ID NO: 7752
  Synthetic polynucleotide

SEQ ID NO: 7754 - DNA, 200 bp, Artificial Sequence
  Synthetic polynucleotide
atcatctcaccttgcctcctgctacggttctctgagatcctgcagggccgaggcctggggcccccagagccgaggcctggggccccctcggccgaggcctggggcccccgacgccgaggcctggggcccccctagccgaggcctggggcccccactgccgaggcctggggcccccggcgcgccatgcttcatcagactct

SEQ ID NO: 7755 - DNA, 200 bp, Artificial Sequence; identical to SEQ ID NO: 7754
  Synthetic polynucleotide

SEQ ID NO: 7756 - DNA, 190 bp, Artificial Sequence
  Synthetic polynucleotide
atcatctcaccttgcctcctgattgtacgatgcaggctcctgcaggggggccgaggcctgagaggggccgaggcctgtcgggggccgaggcctggacggggccgaggcctgctaggggccgaggcctgactggggccgaggcctgtgcggggccgaggcctggtaggcgcgccatgcttcatcagactct

SEQ ID NO: 7757 - DNA, 190 bp, Artificial Sequence; identical to SEQ ID NO: 7756
  Synthetic polynucleotide

SEQ ID NO: 7758 - DNA, 164 bp, Artificial Sequence
  Synthetic polynucleotide
atcatctcaccttgcctcctgcagttccgtccatcttgcctgcaggccacctgccagaccacctgcctcgccacctgccgacccacctgccctaccacctgccactccacctgcctgcccacctgccgtaccacctgccggcgcgccatgcttcatcagactct

SEQ ID NO: 7759 - DNA, 164 bp, Artificial Sequence; identical to SEQ ID NO: 7758
  Synthetic polynucleotide

SEQ ID NO: 7760 - DNA, 172 bp, Artificial Sequence
  Synthetic polynucleotide
atcatctcaccttgcctcctgcatatatctgtgccgatcctgcaggtttgcggtttagatttgcggttttcgtttgcggtttgactttgcggtttctatttgcggtttacttttgcggttttgctttgcggtttgtatttgcggtttggcgcgccatgcttcatcagactct

SEQ ID NO: 7761 - DNA, 172 bp, Artificial Sequence; identical to SEQ ID NO: 7760
  Synthetic polynucleotide

SEQ ID NO: 7762 - DNA, 188 bp, Artificial Sequence
  Synthetic polynucleotide
atcatctcaccttgcctcctgtagaaccttaccacctccctgcaggaaaattgctgacagaaaaattgctgactcgaaaattgctgacgacaaaattgctgacctaaaaattgctgacactaaaattgctgactgcaaaattgctgacgtaaaaattgctgacggcgcgccatgcttcatcagactct

SEQ ID NO: 7763 - DNA, 188 bp, Artificial Sequence; identical to SEQ ID NO: 7762
  Synthetic polynucleotide

SEQ ID NO: 7764 - DNA, 180 bp, Artificial Sequence
  Synthetic polynucleotide
atcatctcaccttgcctcctgctgcagccatttgagctcctgcaggagggtaacagcagaagggtaacagctcgagggtaacagcgacagggtaacagcctaagggtaacagcactagggtaacagctgcagggtaacagcgtaagggtaacagcggcgcgccatgcttcatcagactct

SEQ ID NO: 7765 - DNA, 180 bp, Artificial Sequence; identical to SEQ ID NO: 7764
  Synthetic polynucleotide

SEQ ID NO: 7766 - DNA, 197 bp, Artificial Sequence
  Synthetic polynucleotide
atcatctcaccttgcctcctgactagcagcgatgaatacctgcagggctaaccacagacttagagctaaccacagactttcggctaaccacagacttgacgctaaccacagacttctagctaaccacagacttactgctaaccacagactttgcgctaaccacagacttgtaggcgcgccatgcttcatcagactct

SEQ ID NO: 7767 - DNA, 197 bp, Artificial Sequence; identical to SEQ ID NO: 7766
  Synthetic polynucleotide

SEQ ID NO: 7768 - DNA, 197 bp, Artificial Sequence
  Synthetic polynucleotide
atcatctcaccttgcctcctgactaatagtctagctcgcctgcaggatgccaaaaatagaaagaatgccaaaaatagaatcgatgccaaaaatagaagacatgccaaaaatagaactaatgccaaaaatagaaactatgccaaaaatagaatgcatgccaaaaatagaagtaggcgcgccatgcttcatcagactct

SEQ ID NO: 7769 - DNA, 197 bp, Artificial Sequence; identical to SEQ ID NO: 7768
  Synthetic polynucleotide

SEQ ID NO: 7770 - DNA, 132 bp, Artificial Sequence
  Synthetic polynucleotide
atcatctcaccttgcctcctgggaggtgattgtcagcccctgcaggaccaaagaaccaatcgaccaagacaccaactaaccaaactaccaatgcaccaagtaaccaaggcgcgccatgcttcatcagactct

SEQ ID NO: 7771 - DNA, 132 bp, Artificial Sequence; identical to SEQ ID NO: 7770
  Synthetic polynucleotide

SEQ ID NO: 7772 - DNA, 172 bp, Artificial Sequence
  Synthetic polynucleotide
atcatctcaccttgcctcctgcttaccgccttagatgccctgcaggtgtttacttaagatgtttacttatcgtgtttacttagactgtttacttactatgtttacttaacttgtttacttatgctgtttacttagtatgtttacttaggcgcgccatgcttcatcagactct

SEQ ID NO: 7773 - DNA, 172 bp, Artificial Sequence; identical to SEQ ID NO: 7772
  Synthetic polynucleotide

SEQ ID NO: 7774 - DNA, 180 bp, Artificial Sequence
  Synthetic polynucleotide
atcatctcaccttgcctcctgaaccattaatatccggccctgcaggataatggcggcagaataatggcggctcgataatggcggcgacataatggcggcctaataatggcggcactataatggcggctgcataatggcggcgtaataatggcggcggcgcgccatgcttcatcagactct

SEQ ID NO: 7775 - DNA, 180 bp, Artificial Sequence; identical to SEQ ID NO: 7774
  Synthetic polynucleotide

SEQ ID NO: 7776 - DNA, 185 bp, Artificial Sequence
  Synthetic polynucleotide
atcatctcaccttgcctcctgtgaacgagcatggcatgcctgcaggcttaattataattaaaagacttaattataattaaatcgcttaattataattaaagaccttaattataattaaactacttaattataattaaaactcttaattataattaaatgcggcgcgccatgcttcatcagactct

SEQ ID NO: 7777 - DNA, 185 bp, Artificial Sequence; identical to SEQ ID NO: 7776
  Synthetic polynucleotide

SEQ ID NO: 7778 - DNA, 196 bp, Artificial Sequence
  Synthetic polynucleotide
atcatctcaccttgcctcctgcgatgctgactagaggacctgcagggaggggcgcagctgcgccccaaagagaggggcgcagctgcgccccaatcggaggggcgcagctgcgccccaagacgaggggcgcagctgcgccccaactagaggggcgcagctgcgccccaaactggcgcgccatgcttcatcagactct

SEQ ID NO: 7779 - DNA, 196 bp, Artificial Sequence; identical to SEQ ID NO: 7778
  Synthetic polynucleotide

SEQ ID NO: 7780 - DNA, 191 bp, Artificial Sequence
  Synthetic polynucleotide
atcatctcaccttgcctcctggtatacaactaccattgcctgcaggtccggcgccccctggtggccgagatccggcgccccctggtggccgtcgtccggcgccccctggtggccggactccggcgccccctggtggccgctatccggcgccccctggtggccgactggcgcgccatgcttcatcagactct

SEQ ID NO: 7781 - DNA, 191 bp, Artificial Sequence; identical to SEQ ID NO: 7780
  Synthetic polynucleotide

SEQ ID NO: 7782 - DNA, 156 bp, Artificial Sequence
  Synthetic polynucleotide
atcatctcaccttgcctcctgcccttattaatccttgccctgcaggtatcgattagatatcgatttcgtatcgattgactatcgattctatatcgattacttatcgatttgctatcgattgtatatcgattggcgcgccatgcttcatcagactct

SEQ ID NO: 7783 - DNA, 156 bp, Artificial Sequence; identical to SEQ ID NO: 7782
  Synthetic polynucleotide

SEQ ID NO: 7784 - DNA, 197 bp, Artificial Sequence
  Synthetic polynucleotide
atcatctcaccttgcctcctgaactaccgagactctgtcctgcaggaggtcacggtgacctagaaggtcacggtgaccttcgaggtcacggtgacctgacaggtcacggtgacctctaaggtcacggtgacctactaggtcacggtgaccttgcaggtcacggtgacctgtaggcgcgccatgcttcatcagactct

SEQ ID NO: 7785 - DNA, 197 bp, Artificial Sequence; identical to SEQ ID NO: 7784
  Synthetic polynucleotide

SEQ ID NO: 7786 - DNA, 172 bp, Artificial Sequence
  Synthetic polynucleotide
atcatctcaccttgcctcctgcctcgacgagtttagtgcctgcaggtataattattagatataattatttcgtataattattgactataattattctatataattattacttataattatttgctataattattgtatataattattggcgcgccatgcttcatcagactct

SEQ ID NO: 7787 - DNA, 172 bp, Artificial Sequence; identical to SEQ ID NO: 7786
  Synthetic polynucleotide

SEQ ID NO: 7788 - DNA, 185 bp, Artificial Sequence
  Synthetic polynucleotide
atcatctcaccttgcctcctgcagatggataagcaaggcctgcaggtcaggcgcgcgcgccaagatcaggcgcgcgcgccatcgtcaggcgcgcgcgccagactcaggcgcgcgcgccactatcaggcgcgcgcgccaacttcaggcgcgcgcgccatgcggcgcgccatgcttcatcagactct

SEQ ID NO: 7789 - DNA, 185 bp, Artificial Sequence; identical to SEQ ID NO: 7788
  Synthetic polynucleotide

SEQ ID NO: 7790 - DNA, 156 bp, Artificial Sequence
  Synthetic polynucleotide
atcatctcaccttgcctcctgggaaggatagtatctagcctgcaggcttaattaagacttaattatcgcttaattagaccttaattactacttaattaactcttaattatgccttaattagtacttaattaggcgcgccatgcttcatcagactct

SEQ ID NO: 7791 - DNA, 156 bp, Artificial Sequence; identical to SEQ ID NO: 7790
  Synthetic polynucleotide

SEQ ID NO: 7792 - DNA, 196 bp, Artificial Sequence
  Synthetic polynucleotide
atcatctcaccttgcctcctgttgtcgcttgtagatctcctgcagggttgtttgtttttagagttgtttgttttttcggttgtttgtttttgacgttgtttgtttttctagttgtttgtttttactgttgtttgttttttgcgttgtttgtttttgtagttgtttgtttttggcgcgccatgcttcatcagactct

SEQ ID NO: 7793 - DNA, 196 bp, Artificial Sequence; identical to SEQ ID NO: 7792
  Synthetic polynucleotide

SEQ ID NO: 7794 - DNA, 164 bp, Artificial Sequence
  Synthetic polynucleotide
atcatctcaccttgcctcctgagccgtacgatacgctgcctgcaggtttaagtgcagatttaagtgctcgtttaagtgcgactttaagtgcctatttaagtgcacttttaagtgctgctttaagtgcgtatttaagtgcggcgcgccatgcttcatcagactct

SEQ ID NO: 7795 - DNA, 164 bp, Artificial Sequence; identical to SEQ ID NO: 7794
  Synthetic polynucleotide

SEQ ID NO: 7796 - DNA, 196 bp, Artificial Sequence
  Synthetic polynucleotide
atcatctcaccttgcctcctgtccgacgagacggtcatcctgcaggttgtttttgtttaagattgtttttgtttatcgttgtttttgtttagacttgtttttgtttactattgtttttgtttaactttgtttttgtttatgcttgtttttgtttagtattgtttttgtttaggcgcgccatgcttcatcagactct

SEQ ID NO: 7797 - DNA, 196 bp, Artificial Sequence; identical to SEQ ID NO: 7796
  Synthetic polynucleotide

SEQ ID NO: 7798 - DNA, 196 bp, Artificial Sequence
  Synthetic polynucleotide
atcatctcaccttgcctcctgccgtgaagttcatcattcctgcaggcatctcgtctagtagacatctcgtctagttcgcatctcgtctagtgaccatctcgtctagtctacatctcgtctagtactcatctcgtctagttgccatctcgtctagtgtacatctcgtctagtggcgcgccatgcttcatcagactct

SEQ ID NO: 7799 - DNA, 196 bp, Artificial Sequence; identical to SEQ ID NO: 7798
  Synthetic polynucleotide

SEQ ID NO: 7800 - DNA, 185 bp, Artificial Sequence
  Synthetic polynucleotide
atcatctcaccttgcctcctgtagatggacatggctcacctgcaggctcattaattatgcatagactcattaattatgcattcgctcattaattatgcatgacctcattaattatgcatctactcattaattatgcatactctcattaattatgcattgcggcgcgccatgcttcatcagactct

SEQ ID NO: 7801 - DNA, 185 bp, Artificial Sequence; identical to SEQ ID NO: 7800
  Synthetic polynucleotide

SEQ ID NO: 7802 - DNA, 180 bp, Artificial Sequence
  Synthetic polynucleotide
atcatctcaccttgcctcctggtttgtatccttacgcacctgcaggctgtccatggtagactgtccatggttcgctgtccatggtgacctgtccatggtctactgtccatggtactctgtccatggttgcctgtccatggtgtactgtccatggtggcgcgccatgcttcatcagactct

SEQ ID NO: 7803 - DNA, 180 bp, Artificial Sequence; identical to SEQ ID NO: 7802
  Synthetic polynucleotide

SEQ ID NO: 7804 - DNA, 197 bp, Artificial Sequence
  Synthetic polynucleotide
atcatctcaccttgcctcctgtcaagatggcggaatatcctgcagggatatttctgctctaagagatatttctgctctatcggatatttctgctctagacgatatttctgctctactagatatttctgctctaactgatatttctgctctatgcgatatttctgctctagtaggcgcgccatgcttcatcagactct

SEQ ID NO: 7805 - DNA, 197 bp, Artificial Sequence; identical to SEQ ID NO: 7804
  Synthetic polynucleotide

SEQ ID NO: 7806 - DNA, 188 bp, Artificial Sequence
  Synthetic polynucleotide
atcatctcaccttgcctcctggcttcaggtctcccagacctgcaggtgcgcatgcgcaagatgcgcatgcgcatcgtgcgcatgcgcagactgcgcatgcgcactatgcgcatgcgcaacttgcgcatgcgcatgctgcgcatgcgcagtatgcgcatgcgcaggcgcgccatgcttcatcagactct

SEQ ID NO: 7807 - DNA, 188 bp, Artificial Sequence; identical to SEQ ID NO: 7806
  Synthetic polynucleotide

SEQ ID NO: 7808 - DNA, 196 bp, Artificial Sequence
  Synthetic polynucleotide
atcatctcaccttgcctcctgcttcctcaaacccacttcctgcagggggtcacgtggccagagggtcacgtggcctcggggtcacgtggccgacgggtcacgtggccctagggtcacgtggccactgggtcacgtggcctgcgggtcacgtggccgtagggtcacgtggccggcgcgccatgcttcatcagactct

SEQ ID NO: 7809 - DNA, 196 bp, Artificial Sequence; identical to SEQ ID NO: 7808
  Synthetic polynucleotide

SEQ ID NO: 7810 - DNA, 197 bp, Artificial Sequence
  Synthetic polynucleotide
atcatctcaccttgcctcctgtcattgggcagtaaatgcctgcaggctgggaaatcccctaagactgggaaatcccctatcgctgggaaatcccctagacctgggaaatcccctactactgggaaatcccctaactctgggaaatcccctatgcctgggaaatcccctagtaggcgcgccatgcttcatcagactct

SEQ ID NO: 7811 - DNA, 197 bp, Artificial Sequence; identical to SEQ ID NO: 7810
  Synthetic polynucleotide

SEQ ID NO: 7812 - DNA, 190 bp, Artificial Sequence
  Synthetic polynucleotide
atcatctcaccttgcctcctgacccgaaagtggcgttgcctgcagggtgcgtgggcggggagagtgcgtgggcggggtcggtgcgtgggcgggggacgtgcgtgggcggggctagtgcgtgggcggggactgtgcgtgggcggggtgcgtgcgtgggcgggggtaggcgcgccatgcttcatcagactct

SEQ ID NO: 7813 - DNA, 190 bp, Artificial Sequence; identical to SEQ ID NO: 7812
  Synthetic polynucleotide

SEQ ID NO: 7814 - DNA, 156 bp, Artificial Sequence
  Synthetic polynucleotide
atcatctcaccttgcctcctgtcgtcttgtttctttgccctgcaggggggtcaaagaggggtcaatcgggggtcaagacggggtcaactaggggtcaaactggggtcaatgcggggtcaagtaggggtcaaggcgcgccatgcttcatcagactct

SEQ ID NO: 7815 - DNA, 156 bp, Artificial Sequence; identical to SEQ ID NO: 7814
  Synthetic polynucleotide

SEQ ID NO: 7816 - DNA, 156 bp, Artificial Sequence
  Synthetic polynucleotide
atcatctcaccttgcctcctgttgtctaactaggtacacctgcaggccatcccaagaccatcccatcgccatcccagacccatcccactaccatcccaactccatcccatgcccatcccagtaccatcccaggcgcgccatgcttcatcagactct

SEQ ID NO: 7817 - DNA, 156 bp, Artificial Sequence; identical to SEQ ID NO: 7816
  Synthetic polynucleotide

SEQ ID NO: 7818 - DNA, 185 bp, Artificial Sequence
  Synthetic polynucleotide
atcatctcaccttgcctcctggctatagttcgattacacctgcaggggagccataaaattcgagaggagccataaaattcgtcgggagccataaaattcggacggagccataaaattcgctaggagccataaaattcgactggagccataaaattcgtgcggcgcgccatgcttcatcagactct

SEQ ID NO: 7819 - DNA, 185 bp, Artificial Sequence; identical to SEQ ID NO: 7818
  Synthetic polynucleotide

SEQ ID NO: 7820 - DNA, 188 bp, Artificial Sequence
  Synthetic polynucleotide
atcatctcaccttgcctcctgcgcatttccacatatcacctgcaggcaagatggcggcagacaagatggcggctcgcaagatggcggcgaccaagatggcggcctacaagatggcggcactcaagatggcggctgccaagatggcggcgtacaagatggcggcggcgcgccatgcttcatcagactct

SEQ ID NO: 7821 - DNA, 188 bp, Artificial Sequence; identical to SEQ ID NO: 7820
  Synthetic polynucleotide

SEQ ID NO: 7822 - DNA, 172 bp, Artificial Sequence
  Synthetic polynucleotide
atcatctcaccttgcctcctggaattaaatcgccctagcctgcaggcgcgagatttagacgcgagattttcgcgcgagatttgaccgcgagatttctacgcgagatttactcgcgagattttgccgcgagatttgtacgcgagatttggcgcgccatgcttcatcagactct

SEQ ID NO: 7823 - DNA, 172 bp, Artificial Sequence; identical to SEQ ID NO: 7822
  Synthetic polynucleotide

SEQ ID NO: 7824 - DNA, 196 bp, Artificial Sequence
  Synthetic polynucleotide
atcatctcaccttgcctcctggttggacctgataacagcctgcaggctctccctttcccagactctccctttccctcgctctccctttcccgacctctccctttcccctactctccctttcccactctctccctttccctgcctctccctttcccgtactctccctttcccggcgcgccatgcttcatcagactct

SEQ ID NO: 7825 - DNA, 196 bp, Artificial Sequence; identical to SEQ ID NO: 7824
  Synthetic polynucleotide

SEQ ID NO: 7826 - DNA, 156 bp, Artificial Sequence
  Synthetic polynucleotide
atcatctcaccttgcctcctgaatagctttcatctacgcctgcaggggggtcagagaggggtcagtcgggggtcaggacggggtcagctaggggtcagactggggtcagtgcggggtcaggtaggggtcagggcgcgccatgcttcatcagactct

SEQ ID NO: 7827 - DNA, 156 bp, Artificial Sequence; identical to SEQ ID NO: 7826
  Synthetic polynucleotide

SEQ ID NO: 7828 - DNA, 180 bp, Artificial Sequence
  Synthetic polynucleotide
atcatctcaccttgcctcctgcctctcttaagtgtaatcctgcaggtgcgcaggcgcagatgcgcaggcgctcgtgcgcaggcgcgactgcgcaggcgcctatgcgcaggcgcacttgcgcaggcgctgctgcgcaggcgcgtatgcgcaggcgcggcgcgccatgcttcatcagactct

SEQ ID NO: 7829 - DNA, 180 bp, Artificial Sequence; identical to SEQ ID NO: 7828
  Synthetic polynucleotide

SEQ ID NO: 7830 - DNA, 186 bp, Artificial Sequence
  Synthetic polynucleotide
atcatctcaccttgcctcctgctacagttgcaccattgcctgcaggtgcgtgggcgggggggggggagatgcgtgggcgggggggggggtcgtgcgtgggcggggggggggggactgcgtgggcgggggggggggctatgcgtgggcgggggggggggactggcgcgccatgcttcatcagactct

SEQ ID NO: 7831 - DNA, 186 bp, Artificial Sequence; identical to SEQ ID NO: 7830
  Synthetic polynucleotide

SEQ ID NO: 7832 - DNA, 180 bp, Artificial Sequence
  Synthetic polynucleotide
atcatctcaccttgcctcctgctgacttcatacagtctcctgcagggccatatggtgagagccatatggtgtcggccatatggtggacgccatatggtgctagccatatggtgactgccatatggtgtgcgccatatggtggtagccatatggtgggcgcgccatgcttcatcagactct

SEQ ID NO: 7833 - DNA, 180 bp, Artificial Sequence; identical to SEQ ID NO: 7832
  Synthetic polynucleotide

SEQ ID NO: 7834 - DNA, 156 bp, Artificial Sequence
  Synthetic polynucleotide
atcatctcaccttgcctcctgacctcctcccaagcttacctgcaggggggtcacagaggggtcactcgggggtcacgacggggtcacctaggggtcacactggggtcactgcggggtcacgtaggggtcacggcgcgccatgcttcatcagactct

SEQ ID NO: 7835 - DNA, 156 bp, Artificial Sequence; identical to SEQ ID NO: 7834
  Synthetic polynucleotide

SEQ ID NO: 7836 - DNA, 156 bp, Artificial Sequence
  Synthetic polynucleotide
atcatctcaccttgcctcctgacttgtagttgccggagcctgcaggggccgttgagaggccgttgtcgggccgttggacggccgttgctaggccgttgactggccgttgtgcggccgttggtaggccgttgggcgcgccatgcttcatcagactct

SEQ ID NO: 7837 - DNA, 156 bp, Artificial Sequence; identical to SEQ ID NO: 7836
  Synthetic polynucleotide

SEQ ID NO: 7838 - DNA, 190 bp, Artificial Sequence
  Synthetic polynucleotide
atcatctcaccttgcctcctgattgtctctaaggagtccctgcaggaggattgtgcaataagaaggattgtgcaatatcgaggattgtgcaatagacaggattgtgcaatactaaggattgtgcaataactaggattgtgcaatatgcaggattgtgcaatagtaggcgcgccatgcttcatcagactct

SEQ ID NO: 7839 - DNA, 190 bp, Artificial Sequence; identical to SEQ ID NO: 7838
  Synthetic polynucleotide

SEQ ID NO: 7840 - DNA, 164 bp, Artificial Sequence
  Synthetic polynucleotide
atcatctcaccttgcctcctggtgacccgcaaatggcacctgcaggttaatgaccagattaatgacctcgttaatgaccgacttaatgaccctattaatgaccactttaatgacctgcttaatgaccgtattaatgaccggcgcgccatgcttcatcagactct

SEQ ID NO: 7841 - DNA, 164 bp, Artificial Sequence; identical to SEQ ID NO: 7840
  Synthetic polynucleotide

SEQ ID NO: 7842 - DNA, 190 bp, Artificial Sequence
  Synthetic polynucleotide
atcatctcaccttgcctcctgtcaatgacgagtatggccctgcaggaaaaaatatttactagaaaaaaatatttacttcgaaaaaatatttactgacaaaaaatatttactctaaaaaaatatttactactaaaaaatatttacttgcaaaaaatatttactgtaggcgcgccatgcttcatcagactct

SEQ ID NO: 7843 - DNA, 190 bp, Artificial Sequence; identical to SEQ ID NO: 7842
  Synthetic polynucleotide

SEQ ID NO: 7844 - DNA, 191 bp, Artificial Sequence
  Synthetic polynucleotide
atcatctcaccttgcctcctgcgcgtaacttggattgccctgcaggagtatttaattaattcgagaagtatttaattaattcgtcgagtatttaattaattcggacagtatttaattaattcgctaagtatttaattaattcgactagtatttaattaattcgtgcggcgcgccatgcttcatcagactct

SEQ ID NO: 7845 - DNA, 191 bp, Artificial Sequence; identical to SEQ ID NO: 7844
  Synthetic polynucleotide

SEQ ID NO: 7846 - DNA, 172 bp, Artificial Sequence
  Synthetic polynucleotide
atcatctcaccttgcctcctgggcgcgttatggcatcacctgcaggaccaattagcagaaccaattagctcgaccaattagcgacaccaattagcctaaccaattagcactaccaattagctgcaccaattagcgtaaccaattagcggcgcgccatgcttcatcagactct

SEQ ID NO: 7847 - DNA, 172 bp, Artificial Sequence; identical to SEQ ID NO: 7846
  Synthetic polynucleotide

SEQ ID NO: 7848 - DNA, 164 bp, Artificial Sequence
  Synthetic polynucleotide
atcatctcaccttgcctcctgcacaggagtattggactcctgcaggcttatctctagacttatctcttcgcttatctctgaccttatctctctacttatctctactcttatctcttgccttatctctgtacttatctctggcgcgccatgcttcatcagactct

SEQ ID NO: 7849 - DNA, 164 bp, Artificial Sequence; identical to SEQ ID NO: 7848
  Synthetic polynucleotide

SEQ ID NO: 7850 - DNA, 188 bp, Artificial Sequence
  Synthetic polynucleotide
atcatctcaccttgcctcctggtctgttgaccgattgacctgcaggtacttccgggttagatacttccgggtttcgtacttccgggttgactacttccgggttctatacttccgggttacttacttccgggtttgctacttccgggttgtatacttccgggttggcgcgccatgcttcatcagactct

SEQ ID NO: 7851 - DNA, 188 bp, Artificial Sequence; identical to SEQ ID NO: 7850
  Synthetic polynucleotide

SEQ ID NO: 7852 - DNA, 196 bp, Artificial Sequence
  Synthetic polynucleotide
atcatctcaccttgcctcctggagaaagcggcgtataccctgcaggccttcacttggggagaccttcacttggggtcgccttcacttgggggacccttcacttggggctaccttcacttggggactccttcacttggggtgcccttcacttgggggtaccttcacttggggggcgcgccatgcttcatcagactct

SEQ ID NO: 7853 - DNA, 196 bp, Artificial Sequence; identical to SEQ ID NO: 7852
  Synthetic polynucleotide

SEQ ID NO: 7854 - DNA, 190 bp, Artificial Sequence
  Synthetic polynucleotide
atcatctcaccttgcctcctgacgagggttagtagcgtcctgcaggcactagatggcagcagacactagatggcagctcgcactagatggcagcgaccactagatggcagcctacactagatggcagcactcactagatggcagctgccactagatggcagcgtaggcgcgccatgcttcatcagactct

SEQ ID NO: 7855 - DNA, 190 bp, Artificial Sequence; identical to SEQ ID NO: 7854
  Synthetic polynucleotide

SEQ ID NO: 7856 - DNA, 180 bp, Artificial Sequence
  Synthetic polynucleotide
atcatctcaccttgcctcctgatgccaaaccaatagtacctgcaggcagcaccccggagacagcaccccggtcgcagcaccccgggaccagcaccccggctacagcaccccggactcagcaccccggtgccagcaccccgggtacagcaccccggggcgcgccatgcttcatcagactct

SEQ ID NO: 7857 - DNA, 180 bp, Artificial Sequence; identical to SEQ ID NO: 7856
  Synthetic polynucleotide

SEQ ID NO: 7858 - DNA, 180 bp, Artificial Sequence
  Synthetic polynucleotide
atcatctcaccttgcctcctgagtgcgccagtcgagatcctgcaggatgtaaacaaaagaatgtaaacaaatcgatgtaaacaaagacatgtaaacaaactaatgtaaacaaaactatgtaaacaaatgcatgtaaacaaagtaatgtaaacaaaggcgcgccatgcttcatcagactct

SEQ ID NO: 7859 - DNA, 180 bp, Artificial Sequence; identical to SEQ ID NO: 7858
  Synthetic polynucleotide

SEQ ID NO: 7860 - DNA, 172 bp, Artificial Sequence
  Synthetic polynucleotide
atcatctcaccttgcctcctgagagagtcacgctacggcctgcaggagtaattagcagaagtaattagctcgagtaattagcgacagtaattagcctaagtaattagcactagtaattagctgcagtaattagcgtaagtaattagcggcgcgccatgcttcatcagactct

SEQ ID NO: 7861 - DNA, 172 bp, Artificial Sequence; identical to SEQ ID NO: 7860
  Synthetic polynucleotide

SEQ ID NO: 7862 - DNA, 196 bp, Artificial Sequence
  Synthetic polynucleotide
atcatctcaccttgcctcctgtcggtagtgacgctcaacctgcaggaaattaattaatcagaaaattaattaatctcgaaattaattaatcgacaaattaattaatcctaaaattaattaatcactaaattaattaatctgcaaattaattaatcgtaaaattaattaatcggcgcgccatgcttcatcagactct

SEQ ID NO: 7863 - DNA, 196 bp, Artificial Sequence; identical to SEQ ID NO: 7862
  Synthetic polynucleotide

SEQ ID NO: 7864 - DNA, 188 bp, Artificial Sequence
  Synthetic polynucleotide
atcatctcaccttgcctcctgtgccgagaaattcgtgtcctgcaggggcgaccaccgaagaggcgaccaccgatcgggcgaccaccgagacggcgaccaccgactaggcgaccaccgaactggcgaccaccgatgcggcgaccaccgagtaggcgaccaccgaggcgcgccatgcttcatcagactct

SEQ ID NO: 7865 - DNA, 188 bp, Artificial Sequence; identical to SEQ ID NO: 7864
  Synthetic polynucleotide

SEQ ID NO: 7866 - DNA, 190 bp, Artificial Sequence
  Synthetic polynucleotide
atcatctcaccttgcctcctgtcctcgcctatagttagcctgcaggtgtttattgtttacagatgtttattgtttactcgtgtttattgtttacgactgtttattgtttacctatgtttattgtttacacttgtttattgtttactgctgtttattgtttacgtaggcgcgccatgcttcatcagactct

SEQ ID NO: 7867 - DNA, 190 bp, Artificial Sequence; identical to SEQ ID NO: 7866
  Synthetic polynucleotide

SEQ ID NO: 7868 - DNA, 172 bp, Artificial Sequence
  Synthetic polynucleotide
atcatctcaccttgcctcctgtctccttcagagcatcacctgcaggtaatcgattaagataatcgattatcgtaatcgattagactaatcgattactataatcgattaacttaatcgattatgctaatcgattagtataatcgattaggcgcgccatgcttcatcagactct

SEQ ID NO: 7869 - DNA, 172 bp, Artificial Sequence; identical to SEQ ID NO: 7868
  Synthetic polynucleotide

SEQ ID NO: 7870 - DNA, 188 bp, Artificial Sequence
  Synthetic polynucleotide
atcatctcaccttgcctcctgcttgcgccagaagtgtacctgcaggtgccccagggcaagatgccccagggcatcgtgccccagggcagactgccccagggcactatgccccagggcaacttgccccagggcatgctgccccagggcagtatgccccagggcaggcgcgccatgcttcatcagactct

SEQ ID NO: 7871 - DNA, 188 bp, Artificial Sequence; identical to SEQ ID NO: 7870
  Synthetic polynucleotide

SEQ ID NO: 7872 - DNA, 190 bp, Artificial Sequence
  Synthetic polynucleotide
atcatctcaccttgcctcctggactgagtgagcaatctcctgcaggaaatggcgccatttagaaaatggcgccattttcgaaatggcgccatttgacaaatggcgccatttctaaaatggcgccatttactaaatggcgccattttgcaaatggcgccatttgtaggcgcgccatgcttcatcagactct

SEQ ID NO: 7873 - DNA, 190 bp, Artificial Sequence; identical to SEQ ID NO: 7872
  Synthetic polynucleotide

SEQ ID NO: 7874 - DNA, 190 bp, Artificial Sequence
  Synthetic polynucleotide
atcatctcaccttgcctcctgaactcgcccaagagacgcctgcaggggccatataaggacagaggccatataaggactcgggccatataaggacgacggccatataaggacctaggccatataaggacactggccatataaggactgcggccatataaggacgtaggcgcgccatgcttcatcagactct

SEQ ID NO: 7875 - DNA, 190 bp, Artificial Sequence; identical to SEQ ID NO: 7874
  Synthetic polynucleotide

SEQ ID NO: 7876 - DNA, 191 bp, Artificial Sequence
  Synthetic polynucleotide
atcatctcaccttgcctcctgctagtaaagtgtgaagccctgcaggtgtttacaattgtttatagatgtttacaattgtttattcgtgtttacaattgtttatgactgtttacaattgtttatctatgtttacaattgtttatacttgtttacaattgtttattgcggcgcgccatgcttcatcagactct

SEQ ID NO: 7877 - DNA, 191 bp, Artificial Sequence; identical to SEQ ID NO: 7876
  Synthetic polynucleotide

SEQ ID NO: 7878 - DNA, 185 bp, Artificial Sequence
  Synthetic polynucleotide
atcatctcaccttgcctcctggcatatcctcggactcgcctgcaggtctttatatataaataagatctttatatataaatatcgtctttatatataaatagactctttatatataaatactatctttatatataaataacttctttatatataaatatgcggcgcgccatgcttcatcagactct

SEQ ID NO: 7879 - DNA, 185 bp, Artificial Sequence; identical to SEQ ID NO: 7878
  Synthetic polynucleotide

SEQ ID NO: 7880 - DNA, 188 bp, Artificial Sequence
  Synthetic polynucleotide
atcatctcaccttgcctcctgtggaagacctactccctcctgcaggcctgacgcaatgagacctgacgcaatgtcgcctgacgcaatggaccctgacgcaatgctacctgacgcaatgactcctgacgcaatgtgccctgacgcaatggtacctgacgcaatgggcgcgccatgcttcatcagactct

SEQ ID NO: 7881 - DNA, 188 bp, Artificial Sequence; identical to SEQ ID NO: 7880
  Synthetic polynucleotide

SEQ ID NO: 7882 - DNA, 196 bp, Artificial Sequence
  Synthetic polynucleotide
atcatctcaccttgcctcctggcagtatctttaagcggcctgcaggtcactaatcccacagatcactaatcccactcgtcactaatcccacgactcactaatcccacctatcactaatcccacacttcactaatcccactgctcactaatcccacgtatcactaatcccacggcgcgccatgcttcatcagactct

SEQ ID NO: 7883 - DNA, 196 bp, Artificial Sequence; identical to SEQ ID NO: 7882
  Synthetic polynucleotide

SEQ ID NO: 7884 - DNA, 197 bp, Artificial Sequence
  Synthetic polynucleotide
atcatctcaccttgcctcctggctactaaggcacaacgcctgcaggccgccagggggcgccagaccgccagggggcgcctcgccgccagggggcgccgacccgccagggggcgccctaccgccagggggcgccactccgccagggggcgcctgcccgccagggggcgccgtaggcgcgccatgcttcatcagactct

SEQ ID NO: 7885 - DNA, 197 bp, Artificial Sequence; identical to SEQ ID NO: 7884
  Synthetic polynucleotide

SEQ ID NO: 7886 - DNA, 156 bp, Artificial Sequence
  Synthetic polynucleotide
atcatctcaccttgcctcctgtccatccaccgaactctcctgcagggccagctgagagccagctgtcggccagctggacgccagctgctagccagctgactgccagctgtgcgccagctggtagccagctgggcgcgccatgcttcatcagactct

SEQ ID NO: 7887 - DNA, 156 bp, Artificial Sequence; identical to SEQ ID NO: 7886
  Synthetic polynucleotide

SEQ ID NO: 7888 - DNA, 191 bp, Artificial Sequence
  Synthetic polynucleotide
atcatctcaccttgcctcctgggcagtagaatatcgcccctgcagggccttctgggaattgtagttcagagccttctgggaattgtagttctcggccttctgggaattgtagttcgacgccttctgggaattgtagttcctagccttctgggaattgtagttcactggcgcgccatgcttcatcagactct

SEQ ID NO: 7889 - DNA, 191 bp, Artificial Sequence; identical to SEQ ID NO: 7888
  Synthetic polynucleotide

SEQ ID NO: 7890 - DNA, 180 bp, Artificial Sequence
  Synthetic polynucleotide
atcatctcaccttgcctcctggactagtcgtgtgcaaacctgcaggaccacgtggccagaaccacgtggcctcgaccacgtggccgacaccacgtggccctaaccacgtggccactaccacgtggcctgcaccacgtggccgtaaccacgtggccggcgcgccatgcttcatcagactct

SEQ ID NO: 7891 - DNA, 180 bp, Artificial Sequence; identical to SEQ ID NO: 7890
  Synthetic polynucleotide

SEQ ID NO: 7892 - DNA, 180 bp, Artificial Sequence
  Synthetic polynucleotide
atcatctcaccttgcctcctgtcggaagagcccgtagtcctgcaggtacttccttatagatacttccttattcgtacttccttatgactacttccttatctatacttccttatacttacttccttattgctacttccttatgtatacttccttatggcgcgccatgcttcatcagactct

SEQ ID NO: 7893 - DNA, 180 bp, Artificial Sequence; identical to SEQ ID NO: 7892
  Synthetic polynucleotide

SEQ ID NO: 7894 - DNA, 164 bp, Artificial Sequence
  Synthetic polynucleotide
atcatctcaccttgcctcctggcacacatacctccgaacctgcaggttaattggcagattaattggctcgttaattggcgacttaattggcctattaattggcactttaattggctgcttaattggcgtattaattggcggcgcgccatgcttcatcagactct

SEQ ID NO: 7895 - DNA, 164 bp, Artificial Sequence; identical to SEQ ID NO: 7894
  Synthetic polynucleotide

SEQ ID NO: 7896 - DNA, 172 bp, Artificial Sequence
  Synthetic polynucleotide
atcatctcaccttgcctcctgcaatcatgtcgccaaagcctgcaggcgccgccgccagacgccgccgcctcgcgccgccgccgaccgccgccgccctacgccgccgccactcgccgccgcctgccgccgccgccgtacgccgccgccggcgcgccatgcttcatcagactct

SEQ ID NO: 7897 - DNA, 172 bp, Artificial Sequence; identical to SEQ ID NO: 7896
  Synthetic polynucleotide

SEQ ID NO: 7898 - DNA, 191 bp, Artificial Sequence
  Synthetic polynucleotide
atcatctcaccttgcctcctgataacccttcaaacgcacctgcaggtgcattaattaatgcgaagatgcattaattaatgcgatcgtgcattaattaatgcgagactgcattaattaatgcgactatgcattaattaatgcgaacttgcattaattaatgcgatgcggcgcgccatgcttcatcagactct

SEQ ID NO: 7899 - DNA, 191 bp, Artificial Sequence; identical to SEQ ID NO: 7898
  Synthetic polynucleotide

SEQ ID NO: 7900 - DNA, 185 bp, Artificial Sequence
  Synthetic polynucleotide
atcatctcaccttgcctcctgactcagtacgcttattacctgcaggaacaatgaacattgttagaaacaatgaacattgtttcgaacaatgaacattgttgacaacaatgaacattgttctaaacaatgaacattgttactaacaatgaacattgtttgcggcgcgccatgcttcatcagactct

SEQ ID NO: 7901 - DNA, 185 bp, Artificial Sequence; identical to SEQ ID NO: 7900
  Synthetic polynucleotide

SEQ ID NO: 7902 - DNA, 156 bp, Artificial Sequence
  Synthetic polynucleotide
atcatctcaccttgcctcctgccagcaacaggtacactcctgcaggctaatggcagactaatggctcgctaatggcgacctaatggcctactaatggcactctaatggctgcctaatggcgtactaatggcggcgcgccatgcttcatcagactct

SEQ ID NO: 7903 - DNA, 156 bp, Artificial Sequence; identical to SEQ ID NO: 7902
  Synthetic polynucleotide

SEQ ID NO: 7904 - DNA, 191 bp, Artificial Sequence
  Synthetic polynucleotide
atcatctcaccttgcctcctgcaaccgtgccgtatcgtcctgcaggtgacctctactgaccccagatgacctctactgacccctcgtgacctctactgaccccgactgacctctactgaccccctatgacctctactgaccccacttgacctctactgacccctgcggcgcgccatgcttcatcagactct

SEQ ID NO: 7905 - DNA, 191 bp, Artificial Sequence; identical to SEQ ID NO: 7904
  Synthetic polynucleotide

SEQ ID NO: 7906 - DNA, 196 bp, Artificial Sequence
  Synthetic polynucleotide
atcatctcaccttgcctcctgatggatacgatttgcttcctgcaggaagttcaaggtcaagaaagttcaaggtcatcgaagttcaaggtcagacaagttcaaggtcactaaagttcaaggtcaactaagttcaaggtcatgcaagttcaaggtcagtaaagttcaaggtcaggcgcgccatgcttcatcagactct

SEQ ID NO: 7907 - DNA, 196 bp, Artificial Sequence; identical to SEQ ID NO: 7906
  Synthetic polynucleotide

SEQ ID NO: 7908 - DNA, 180 bp, Artificial Sequence
  Synthetic polynucleotide
atcatctcaccttgcctcctggccgcattcttcacaatcctgcaggtgggtgtggccagatgggtgtggcctcgtgggtgtggccgactgggtgtggccctatgggtgtggccacttgggtgtggcctgctgggtgtggccgtatgggtgtggccggcgcgccatgcttcatcagactct

SEQ ID NO: 7909 - DNA, 180 bp, Artificial Sequence; identical to SEQ ID NO: 7908
  Synthetic polynucleotide

SEQ ID NO: 7910 - DNA, 188 bp, Artificial Sequence
  Synthetic polynucleotide
atcatctcaccttgcctcctgggatcgtgcgccgtatacctgcagggcttttcccacaagagcttttcccacatcggcttttcccacagacgcttttcccacactagcttttcccacaactgcttttcccacatgcgcttttcccacagtagcttttcccacaggcgcgccatgcttcatcagactct

SEQ ID NO: 7911 - DNA, 188 bp, Artificial Sequence; identical to SEQ ID NO: 7910
  Synthetic polynucleotide

SEQ ID NO: 7912 - DNA, 185 bp, Artificial Sequence
  Synthetic polynucleotide
atcatctcaccttgcctcctgtaataacccacggagtccctgcaggaaaggtcaaaaggtcaagaaaaggtcaaaaggtcatcgaaaggtcaaaaggtcagacaaaggtcaaaaggtcactaaaaggtcaaaaggtcaactaaaggtcaaaaggtcatgcggcgcgccatgcttcatcagactct

SEQ ID NO: 7913 - DNA, 185 bp, Artificial Sequence; identical to SEQ ID NO: 7912
  Synthetic polynucleotide

SEQ ID NO: 7914 - DNA, 188 bp, Artificial Sequence
  Synthetic polynucleotide
atcatctcaccttgcctcctggaacctcaaagctttcccctgcaggaaataagtatatagaaaataagtatattcgaaataagtatatgacaaataagtatatctaaaataagtatatactaaataagtatattgcaaataagtatatgtaaaataagtatatggcgcgccatgcttcatcagactct

SEQ ID NO: 7915 - DNA, 188 bp, Artificial Sequence; identical to SEQ ID NO: 7914
  Synthetic polynucleotide

SEQ ID NO: 7916 - DNA, 197 bp, Artificial Sequence
  Synthetic polynucleotide
atcatctcaccttgcctcctgctctcatgagatcgcgccctgcaggcagttgctaggcaacgggagacagttgctaggcaacgggtcgcagttgctaggcaacggggaccagttgctaggcaacgggctacagttgctaggcaacgggactcagttgctaggcaacgggtgcggcgcgccatgcttcatcagactct

SEQ ID NO: 7917 - DNA, 197 bp, Artificial Sequence; identical to SEQ ID NO: 7916
  Synthetic polynucleotide

SEQ ID NO: 7918 - DNA, 188 bp, Artificial Sequence
  Synthetic polynucleotide
atcatctcaccttgcctcctgtaagatggatgagggcgcctgcaggccggacacaatcagaccggacacaatctcgccggacacaatcgacccggacacaatcctaccggacacaatcactccggacacaatctgcccggacacaatcgtaccggacacaatcggcgcgccatgcttcatcagactct

SEQ ID NO: 7919 - DNA, 188 bp, Artificial Sequence; identical to SEQ ID NO: 7918
  Synthetic polynucleotide

SEQ ID NO: 7920 - DNA, 180 bp, Artificial Sequence
  Synthetic polynucleotide
atcatctcaccttgcctcctgggctcattcaggacgatcctgcaggaccacgtggctagaaccacgtggcttcgaccacgtggctgacaccacgtggctctaaccacgtggctactaccacgtggcttgcaccacgtggctgtaaccacgtggctggcgcgccatgcttcatcagactct

SEQ ID NO: 7921 - DNA, 180 bp, Artificial Sequence; identical to SEQ ID NO: 7920
  Synthetic polynucleotide

SEQ ID NO: 7922 - DNA, 172 bp, Artificial Sequence
  Synthetic polynucleotide
atcatctcaccttgcctcctgatgaagtgtactcgtaccctgcaggatagataagaagaatagataagatcgatagataagagacatagataagactaatagataagaactatagataagatgcatagataagagtaatagataagaggcgcgccatgcttcatcagactct

SEQ ID NO: 7923 - DNA, 172 bp, Artificial Sequence; identical to SEQ ID NO: 7922
  Synthetic polynucleotide

SEQ ID NO: 7924 - DNA, 148 bp, Artificial Sequence
  Synthetic polynucleotide
atcatctcaccttgcctcctgagcttcgatcaaagttgcctgcaggacaggtgagaacaggtgtcgacaggtggacacaggtgctaacaggtgactacaggtgtgcacaggtggtaacaggtgggcgcgccatgcttcatcagactct

SEQ ID NO: 7925 - DNA, 148 bp, Artificial Sequence; identical to SEQ ID NO: 7924
  Synthetic polynucleotide

SEQ ID NO: 7926 - DNA, 196 bp, Artificial Sequence
  Synthetic polynucleotide
atcatctcaccttgcctcctgcagtggtgaatattgcacctgcaggggtcacgtgacccagaggtcacgtgaccctcgggtcacgtgacccgacggtcacgtgacccctaggtcacgtgacccactggtcacgtgaccctgcggtcacgtgacccgtaggtcacgtgacccggcgcgccatgcttcatcagactct

SEQ ID NO: 7927 - DNA, 196 bp, Artificial Sequence; identical to SEQ ID NO: 7926
  Synthetic polynucleotide

SEQ ID NO: 7928 - DNA, 197 bp, Artificial Sequence
  Synthetic polynucleotide
atcatctcaccttgcctcctgactttcacaccaccggccctgcaggtgaccttgaaatgaccttagatgaccttgaaatgacctttcgtgaccttgaaatgaccttgactgaccttgaaatgaccttctatgaccttgaaatgaccttacttgaccttgaaatgacctttgcggcgcgccatgcttcatcagactct

SEQ ID NO: 7929 - DNA, 197 bp, Artificial Sequence; identical to SEQ ID NO: 7928
  Synthetic polynucleotide

SEQ ID NO: 7930 - DNA, 179 bp, Artificial Sequence
  Synthetic polynucleotide
atcatctcaccttgcctcctgaggcgcctatagatcgacctgcaggcggccccgccccccccctggccccagacggccccgccccccccctggcccctcgcggccccgccccccccctggccccgaccggccccgccccccccctggccccctaggcgcgccatgcttcatcagactct

SEQ ID NO: 7931 - DNA, 179 bp, Artificial Sequence; identical to SEQ ID NO: 7930
  Synthetic polynucleotide

SEQ ID NO: 7932 - DNA, 164 bp, Artificial Sequence
  Synthetic polynucleotide
atcatctcaccttgcctcctgagacatcttctgagacacctgcagggttgcgtgcagagttgcgtgctcggttgcgtgcgacgttgcgtgcctagttgcgtgcactgttgcgtgctgcgttgcgtgcgtagttgcgtgcggcgcgccatgcttcatcagactct

SEQ ID NO: 7933 - DNA, 164 bp, Artificial Sequence; identical to SEQ ID NO: 7932
  Synthetic polynucleotide

SEQ ID NO: 7934 - DNA, 197 bp, Artificial Sequence
  Synthetic polynucleotide
atcatctcaccttgcctcctgatcttccgcgtaagccacctgcaggaaagggctgcggcccagaaaagggctgcggccctcgaaagggctgcggcccgacaaagggctgcggcccctaaaagggctgcggcccactaaagggctgcggccctgcaaagggctgcggcccgtaggcgcgccatgcttcatcagactct

SEQ ID NO: 7935 - DNA, 197 bp, Artificial Sequence; identical to SEQ ID NO: 7934
  Synthetic polynucleotide

SEQ ID NO: 7936 - DNA, 148 bp, Artificial Sequence
  Synthetic polynucleotide
atcatctcaccttgcctcctggaccactaagaaaggttcctgcaggtatcattagatatcatttcgtatcattgactatcattctatatcattacttatcatttgctatcattgtatatcattggcgcgccatgcttcatcagactct

SEQ ID NO: 7937 - DNA, 148 bp, Artificial Sequence; identical to SEQ ID NO: 7936
  Synthetic polynucleotide

SEQ ID NO: 7938 - DNA, 180 bp, Artificial Sequence
  Synthetic polynucleotide
atcatctcaccttgcctcctgcacttcaagtaccgtaccctgcaggccaaggtcacaagaccaaggtcacatcgccaaggtcacagacccaaggtcacactaccaaggtcacaactccaaggtcacatgcccaaggtcacagtaccaaggtcacaggcgcgccatgcttcatcagactct

SEQ ID NO: 7939 - DNA, 180 bp, Artificial Sequence; identical to SEQ ID NO: 7938
  Synthetic polynucleotide

SEQ ID NO: 7940 - DNA, 191 bp, Artificial Sequence
  Synthetic polynucleotide
atcatctcaccttgcctcctgatagatggccctttgtgcctgcaggaaaatacatgtaaaaatagaaaaatacatgtaaaaattcgaaaatacatgtaaaaatgacaaaatacatgtaaaaatctaaaaatacatgtaaaaatactaaaatacatgtaaaaattgcggcgcgccatgcttcatcagactct

SEQ ID NO: 7941 - DNA, 191 bp, Artificial Sequence; identical to SEQ ID NO: 7940
  Synthetic polynucleotide

SEQ ID NO: 7942 - DNA, 172 bp, Artificial Sequence
  Synthetic polynucleotide
atcatctcaccttgcctcctgggcaaccatttaattctcctgcagggagcacgtggagagagcacgtggtcggagcacgtgggacgagcacgtggctagagcacgtggactgagcacgtggtgcgagcacgtgggtagagcacgtggggcgcgccatgcttcatcagactct

SEQ ID NO: 7943 - DNA, 172 bp, Artificial Sequence; identical to SEQ ID NO: 7942
  Synthetic polynucleotide

SEQ ID NO: 7944 - DNA, 164 bp, Artificial Sequence
  Synthetic polynucleotide
atcatctcaccttgcctcctgcaagatactggtctgcccctgcaggtgagcacgaagatgagcacgatcgtgagcacgagactgagcacgactatgagcacgaacttgagcacgatgctgagcacgagtatgagcacgaggcgcgccatgcttcatcagactct

SEQ ID NO: 7945 - DNA, 164 bp, Artificial Sequence; identical to SEQ ID NO: 7944
  Synthetic polynucleotide

SEQ ID NO: 7946 - DNA, 197 bp, Artificial Sequence
  Synthetic polynucleotide
atcatctcaccttgcctcctgtggtgcacgtgtattcccctgcaggtgaccgccagtgaccccaagatgaccgccagtgaccccatcgtgaccgccagtgaccccagactgaccgccagtgaccccactatgaccgccagtgaccccaacttgaccgccagtgaccccatgcggcgcgccatgcttcatcagactct

SEQ ID NO: 7947 - DNA, 197 bp, Artificial Sequence; identical to SEQ ID NO: 7946
  Synthetic polynucleotide

SEQ ID NO: 7948 - DNA, 172 bp, Artificial Sequence
  Synthetic polynucleotide
atcatctcaccttgcctcctggttacccaataagccgtcctgcagggcgggcgccgagagcgggcgccgtcggcgggcgccggacgcgggcgccgctagcgggcgccgactgcgggcgccgtgcgcgggcgccggtagcgggcgccgggcgcgccatgcttcatcagactct

SEQ ID NO: 7949 - DNA, 172 bp, Artificial Sequence; identical to SEQ ID NO: 7948
  Synthetic polynucleotide

SEQ ID NO: 7950 - DNA, 188 bp, Artificial Sequence
  Synthetic polynucleotide
atcatctcaccttgcctcctggtcaacatccactcatccctgcaggggggtggggattagaggggtggggatttcgggggtggggattgacggggtggggattctaggggtggggattactggggtggggatttgcggggtggggattgtaggggtggggattggcgcgccatgcttcatcagactct

SEQ ID NO: 7951 - DNA, 188 bp, Artificial Sequence; identical to SEQ ID NO: 7950
  Synthetic polynucleotide

SEQ ID NO: 7952 - DNA, 185 bp, Artificial Sequence
  Synthetic polynucleotide
atcatctcaccttgcctcctgcgttctgacaggttaatcctgcaggtctcaaaggtcacgagagatctcaaaggtcacgagtcgtctcaaaggtcacgaggactctcaaaggtcacgagctatctcaaaggtcacgagacttctcaaaggtcacgagtgcggcgcgccatgcttcatcagactct

SEQ ID NO: 7953 - DNA, 185 bp, Artificial Sequence; identical to SEQ ID NO: 7952
  Synthetic polynucleotide

SEQ ID NO: 7954 - DNA, 191 bp, Artificial Sequence
  Synthetic polynucleotide
atcatctcaccttgcctcctgaactttctactgtgtgtcctgcaggatatatgataccctattagaatatatgataccctatttcgatatatgataccctattgacatatatgataccctattctaatatatgataccctattactatatatgataccctatttgcggcgcgccatgcttcatcagactct

SEQ ID NO: 7955 - DNA, 191 bp, Artificial Sequence; identical to SEQ ID NO: 7954
  Synthetic polynucleotide

SEQ ID NO: 7956 - DNA, 196 bp, Artificial Sequence
  Synthetic polynucleotide
atcatctcaccttgcctcctgaccaccatagcgcgcttcctgcaggctgacctctggccagactgacctctggcctcgctgacctctggccgacctgacctctggccctactgacctctggccactctgacctctggcctgcctgacctctggccgtactgacctctggccggcgcgccatgcttcatcagactct

SEQ ID NO: 7957 - DNA, 196 bp, Artificial Sequence; identical to SEQ ID NO: 7956
  Synthetic polynucleotide

SEQ ID NO: 7958 - DNA, 156 bp, Artificial Sequence
  Synthetic polynucleotide
atcatctcaccttgcctcctggattaaagtgtcgatcacctgcaggtaatcaaaagataatcaaatcgtaatcaaagactaatcaaactataatcaaaacttaatcaaatgctaatcaaagtataatcaaaggcgcgccatgcttcatcagactct

SEQ ID NO: 7959 - DNA, 156 bp, Artificial Sequence; identical to SEQ ID NO: 7958
  Synthetic polynucleotide

SEQ ID NO: 7960 - DNA, 180 bp, Artificial Sequence
  Synthetic polynucleotide
atcatctcaccttgcctcctgaaacgtaccgataagcccctgcagggtgattggttaagagtgattggttatcggtgattggttagacgtgattggttactagtgattggttaactgtgattggttatgcgtgattggttagtagtgattggttaggcgcgccatgcttcatcagactct

SEQ ID NO: 7961 - DNA, 180 bp, Artificial Sequence; identical to SEQ ID NO: 7960
  Synthetic polynucleotide

SEQ ID NO: 7962 - DNA, 188 bp, Artificial Sequence
  Synthetic polynucleotide
atcatctcaccttgcctcctgccctatagttcggccaccctgcagggcggcgggcaatagagcggcgggcaattcggcggcgggcaatgacgcggcgggcaatctagcggcgggcaatactgcggcgggcaattgcgcggcgggcaatgtagcggcgggcaatggcgcgccatgcttcatcagactct

SEQ ID NO: 7963 - DNA, 188 bp, Artificial Sequence; identical to SEQ ID NO: 7962
  Synthetic polynucleotide

SEQ ID NO: 7964 - DNA, 148 bp, Artificial Sequence
  Synthetic polynucleotide
atcatctcaccttgcctcctgagaacccaccatcctcgcctgcaggtcataaaagatcataaatcgtcataaagactcataaactatcataaaacttcataaatgctcataaagtatcataaaggcgcgccatgcttcatcagactct

SEQ ID NO: 7965 - DNA, 148 bp, Artificial Sequence; identical to SEQ ID NO: 7964
  Synthetic polynucleotide

SEQ ID NO: 7966 - DNA, 164 bp, Artificial Sequence
  Synthetic polynucleotide
atcatctcaccttgcctcctggaattgtccgaattgggcctgcaggacaggtggtagaacaggtggttcgacaggtggtgacacaggtggtctaacaggtggtactacaggtggttgcacaggtggtgtaacaggtggtggcgcgccatgcttcatcagactct

SEQ ID NO: 7967 - DNA, 164 bp, Artificial Sequence; identical to SEQ ID NO: 7966
  Synthetic polynucleotide

SEQ ID NO: 7968 - DNA, 191 bp, Artificial Sequence
  Synthetic polynucleotide
atcatctcaccttgcctcctgcaatcgtttaccggttccctgcaggacgtatgtgcacatctgagaacgtatgtgcacatctgtcgacgtatgtgcacatctggacacgtatgtgcacatctgctaacgtatgtgcacatctgactacgtatgtgcacatctgtgcggcgcgccatgcttcatcagactct

SEQ ID NO: 7969 - DNA, 191 bp, Artificial Sequence; identical to SEQ ID NO: 7968
  Synthetic polynucleotide

SEQ ID NO: 7970 - DNA, 172 bp, Artificial Sequence
  Synthetic polynucleotide
atcatctcaccttgcctcctgcagatggtgaattaatccctgcaggggcaacgcccagaggcaacgccctcgggcaacgcccgacggcaacgcccctaggcaacgcccactggcaacgccctgcggcaacgcccgtaggcaacgcccggcgcgccatgcttcatcagactct

SEQ ID NO: 7971 - DNA, 172 bp, Artificial Sequence; identical to SEQ ID NO: 7970
  Synthetic polynucleotide

SEQ ID NO: 7972 - DNA, 186 bp, Artificial Sequence
  Synthetic polynucleotide
atcatctcaccttgcctcctgaatatacagtacatccgcctgcaggtttcacacctaggtgtgaaaagatttcacacctaggtgtgaaatcgtttcacacctaggtgtgaaagactttcacacctaggtgtgaaactatttcacacctaggtgtgaaaactggcgcgccatgcttcatcagactct

SEQ ID NO: 7973 - DNA, 186 bp, Artificial Sequence; identical to SEQ ID NO: 7972
  Synthetic polynucleotide

SEQ ID NO: 7974 - DNA, 186 bp, Artificial Sequence
  Synthetic polynucleotide
atcatctcaccttgcctcctgtggtcggcaacaccgatcctgcagggcttctgcacgtgacccggtagagcttctgcacgtgacccggttcggcttctgcacgtgacccggtgacgcttctgcacgtgacccggtctagcttctgcacgtgacccggtactggcgcgccatgcttcatcagactct

SEQ ID NO: 7975 - DNA, 186 bp, Artificial Sequence; identical to SEQ ID NO: 7974
  Synthetic polynucleotide

SEQ ID NO: 7976 - DNA, 164 bp, Artificial Sequence
  Synthetic polynucleotide
atcatctcaccttgcctcctgccgtgaatgggagtacccctgcaggttaaccaggagattaaccaggtcgttaaccagggacttaaccaggctattaaccaggactttaaccaggtgcttaaccagggtattaaccaggggcgcgccatgcttcatcagactct

SEQ ID NO: 7977 - DNA, 164 bp, Artificial Sequence; identical to SEQ ID NO: 7976
  Synthetic polynucleotide

SEQ ID NO: 7978 - DNA, 190 bp, Artificial Sequence
  Synthetic polynucleotide
atcatctcaccttgcctcctgttcatcggtaccagctacctgcagggaggtcaaaggtcaagagaggtcaaaggtcatcggaggtcaaaggtcagacgaggtcaaaggtcactagaggtcaaaggtcaactgaggtcaaaggtcatgcgaggtcaaaggtcagtaggcgcgccatgcttcatcagactct

SEQ ID NO: 7979 - DNA, 190 bp, Artificial Sequence; identical to SEQ ID NO: 7978
  Synthetic polynucleotide

SEQ ID NO: 7980 - DNA, 191 bp, Artificial Sequence
  Synthetic polynucleotide
atcatctcaccttgcctcctgatcataccgcaccctttcctgcaggatttttacatgtattttagaatttttacatgtatttttcgatttttacatgtattttgacatttttacatgtattttctaatttttacatgtattttactatttttacatgtatttttgcggcgcgccatgcttcatcagactct

SEQ ID NO: 7981 - DNA, 191 bp, Artificial Sequence; identical to SEQ ID NO: 7980
  Synthetic polynucleotide

SEQ ID NO: 7982 - DNA, 172 bp, Artificial Sequence
  Synthetic polynucleotide
atcatctcaccttgcctcctgggtagaggagggcgtaacctgcaggtttgtggttaagatttgtggttatcgtttgtggttagactttgtggttactatttgtggttaacttttgtggttatgctttgtggttagtatttgtggttaggcgcgccatgcttcatcagactct

SEQ ID NO: 7983 - DNA, 172 bp, Artificial Sequence; identical to SEQ ID NO: 7982
  Synthetic polynucleotide

SEQ ID NO: 7984 - DNA, 185 bp, Artificial Sequence
  Synthetic polynucleotide
atcatctcaccttgcctcctgtccgtaaatgactcctacctgcaggcaggtgacctttgagaagacaggtgacctttgagatcgcaggtgacctttgagagaccaggtgacctttgagactacaggtgacctttgagaactcaggtgacctttgagatgcggcgcgccatgcttcatcagactct

SEQ ID NO: 7985 - DNA, 185 bp, Artificial Sequence; identical to SEQ ID NO: 7984
  Synthetic polynucleotide

SEQ ID NO: 7986 - DNA, 164 bp, Artificial Sequence
  Synthetic polynucleotide
atcatctcaccttgcctcctggtcacgctgtacacgcacctgcaggcaacccaaaagacaacccaaatcgcaacccaaagaccaacccaaactacaacccaaaactcaacccaaatgccaacccaaagtacaacccaaaggcgcgccatgcttcatcagactct

SEQ ID NO: 7987 - DNA, 164 bp, Artificial Sequence; identical to SEQ ID NO: 7986
  Synthetic polynucleotide

SEQ ID NO: 7988 - DNA, 191 bp, Artificial Sequence
  Synthetic polynucleotide
atcatctcaccttgcctcctgacagcagaacctttcatcctgcaggaaacataatgaggttgcagaaaacataatgaggttgctcgaaacataatgaggttgcgacaaacataatgaggttgcctaaaacataatgaggttgcactaaacataatgaggttgctgcggcgcgccatgcttcatcagactct

SEQ ID NO: 7989 - DNA, 191 bp, Artificial Sequence; identical to SEQ ID NO: 7988
  Synthetic polynucleotide

SEQ ID NO: 7990 - DNA, 197 bp, Artificial Sequence
  Synthetic polynucleotide
atcatctcaccttgcctcctgagtacaaccttagctgacctgcaggagccacacccaggcaagaagccacacccaggcatcgagccacacccaggcagacagccacacccaggcactaagccacacccaggcaactagccacacccaggcatgcagccacacccaggcagtaggcgcgccatgcttcatcagactct

SEQ ID NO: 7991 - DNA, 197 bp, Artificial Sequence; identical to SEQ ID NO: 7990
  Synthetic polynucleotide

SEQ ID NO: 7992 - DNA, 172 bp, Artificial Sequence
  Synthetic polynucleotide
atcatctcaccttgcctcctgcacccgctgtattggaccctgcaggaacaggaagtagaaacaggaagttcgaacaggaagtgacaacaggaagtctaaacaggaagtactaacaggaagttgcaacaggaagtgtaaacaggaagtggcgcgccatgcttcatcagactct

SEQ ID NO: 7993 - DNA, 172 bp, Artificial Sequence; identical to SEQ ID NO: 7992
  Synthetic polynucleotide

SEQ ID NO: 7994 - DNA, 197 bp, Artificial Sequence
  Synthetic polynucleotide
atcatctcaccttgcctcctgtgaggatcttgacgtcacctgcaggcttggaaatccccttagacttggaaatcccctttcgcttggaaatccccttgaccttggaaatccccttctacttggaaatccccttactcttggaaatcccctttgccttggaaatccccttgtaggcgcgccatgcttcatcagactct

SEQ ID NO: 7995 - DNA, 197 bp, Artificial Sequence; identical to SEQ ID NO: 7994
  Synthetic polynucleotide

SEQ ID NO: 7996 - DNA, 188 bp, Artificial Sequence
  Synthetic polynucleotide
atcatctcaccttgcctcctggtgtcatctttccgggacctgcaggcatgtcatgtaaagacatgtcatgtaatcgcatgtcatgtaagaccatgtcatgtaactacatgtcatgtaaactcatgtcatgtaatgccatgtcatgtaagtacatgtcatgtaaggcgcgccatgcttcatcagactct

SEQ ID NO: 7997 - DNA, 188 bp, Artificial Sequence; identical to SEQ ID NO: 7996
  Synthetic polynucleotide

SEQ ID NO: 7998 - DNA, 191 bp, Artificial Sequence
  Synthetic polynucleotide
atcatctcaccttgcctcctggcggccaaattccttgtcctgcagggcattctgggaattgtagtttagagcattctgggaattgtagttttcggcattctgggaattgtagtttgacgcattctgggaattgtagtttctagcattctgggaattgtagtttactggcgcgccatgcttcatcagactct

SEQ ID NO: 7999 - DNA, 191 bp, Artificial Sequence; identical to SEQ ID NO: 7998
  Synthetic polynucleotide

SEQ ID NO: 8000 - DNA, 172 bp, Artificial Sequence
  Synthetic polynucleotide
atcatctcaccttgcctcctgcaaatctcgagccacgacctgcaggtaacgtccgcagataacgtccgctcgtaacgtccgcgactaacgtccgcctataacgtccgcacttaacgtccgctgctaacgtccgcgtataacgtccgcggcgcgccatgcttcatcagactct

SEQ ID NO: 8001 - DNA, 172 bp, Artificial Sequence; identical to SEQ ID NO: 8000
  Synthetic polynucleotide

SEQ ID NO: 8002 - DNA, 164 bp, Artificial Sequence
  Synthetic polynucleotide
atcatctcaccttgcctcctgtaccataggccgggtctcctgcaggaacccggccagaaacccggcctcgaacccggccgacaacccggccctaaacccggccactaacccggcctgcaacccggccgtaaacccggccggcgcgccatgcttcatcagactct

SEQ ID NO: 8003 - DNA, 164 bp, Artificial Sequence; identical to SEQ ID NO: 8002
  Synthetic polynucleotide

SEQ ID NO: 8004 - DNA, 148 bp, Artificial Sequence
  Synthetic polynucleotide
atcatctcaccttgcctcctgctcctagtctcatggatcctgcaggccggaagagaccggaagtcgccggaaggacccggaagctaccggaagactccggaagtgcccggaaggtaccggaagggcgcgccatgcttcatcagactct

SEQ ID NO: 8005 - DNA, 148 bp, Artificial Sequence; identical to SEQ ID NO: 8004
  Synthetic polynucleotide

SEQ ID NO: 8006 - DNA, 191 bp, Artificial Sequence
  Synthetic polynucleotide
atcatctcaccttgcctcctgttcctctcgaaattgtacctgcaggcgaattaattaaatactagacgaattaattaaatacttcgcgaattaattaaatactgaccgaattaattaaatactctacgaattaattaaatactactcgaattaattaaatacttgcggcgcgccatgcttcatcagactct

SEQ ID NO: 8007 - DNA, 191 bp, Artificial Sequence; identical to SEQ ID NO: 8006
  Synthetic polynucleotide

SEQ ID NO: 8008 - DNA, 164 bp, Artificial Sequence
  Synthetic polynucleotide
atcatctcaccttgcctcctgatgtgagtaaagcttcacctgcaggccgcacgcaagaccgcacgcatcgccgcacgcagacccgcacgcactaccgcacgcaactccgcacgcatgcccgcacgcagtaccgcacgcaggcgcgccatgcttcatcagactct

SEQ ID NO: 8009 - DNA, 164 bp, Artificial Sequence; identical to SEQ ID NO: 8008
  Synthetic polynucleotide

SEQ ID NO: 8010 - DNA, 200 bp, Artificial Sequence
  Synthetic polynucleotide
atcatctcaccttgcctcctgtcgttccactactgacccctgcaggccaggtcaccctgaccttgagaccaggtcaccctgaccttgtcgccaggtcaccctgaccttggacccaggtcaccctgaccttgctaccaggtcaccctgaccttgactccaggtcaccctgaccttgggcgcgccatgcttcatcagactct

SEQ ID NO: 8011 - DNA, 200 bp, Artificial Sequence; identical to SEQ ID NO: 8010
  Synthetic polynucleotide

SEQ ID NO: 8012 - DNA, 197 bp, Artificial Sequence
  Synthetic polynucleotide
atcatctcaccttgcctcctggagtctttcacaaccgacctgcagggggaggagggagaggagagggaggagggagaggtcggggaggagggagagggacgggaggagggagaggctagggaggagggagaggactgggaggagggagaggtgcgggaggagggagagggtaggcgcgccatgcttcatcagactct

SEQ ID NO: 8013 - DNA, 197 bp, Artificial Sequence; identical to SEQ ID NO: 8012
  Synthetic polynucleotide

SEQ ID NO: 8014 - DNA, 191 bp, Artificial Sequence
  Synthetic polynucleotide
atcatctcaccttgcctcctgttggttcccgttaaagacctgcaggcataaccacttaacaacagacataaccacttaacaactcgcataaccacttaacaacgaccataaccacttaacaacctacataaccacttaacaacactcataaccacttaacaactgcggcgcgccatgcttcatcagactct

SEQ ID NO: 8015 - DNA, 191 bp, Artificial Sequence; identical to SEQ ID NO: 8014
  Synthetic polynucleotide

SEQ ID NO: 8016 - DNA, 180 bp, Artificial Sequence
  Synthetic polynucleotide
atcatctcaccttgcctcctgaagcagaagcggaagggcctgcaggaggtgtgaagaagaaggtgtgaagatcgaggtgtgaagagacaggtgtgaagactaaggtgtgaagaactaggtgtgaagatgcaggtgtgaagagtaaggtgtgaagaggcgcgccatgcttcatcagactct

SEQ ID NO: 8017 - DNA, 180 bp, Artificial Sequence; identical to SEQ ID NO: 8016
  Synthetic polynucleotide

SEQ ID NO: 8018 - DNA, 191 bp, Artificial Sequence
  Synthetic polynucleotide
atcatctcaccttgcctcctgaacacgctcgaccctagcctgcagggtccattaattaatggaagagtccattaattaatggatcggtccattaattaatggagacgtccattaattaatggactagtccattaattaatggaactgtccattaattaatggatgcggcgcgccatgcttcatcagactct

SEQ ID NO: 8019 - DNA, 191 bp, Artificial Sequence; identical to SEQ ID NO: 8018
  Synthetic polynucleotide

SEQ ID NO: 8020 - DNA, 172 bp, Artificial Sequence
  Synthetic polynucleotide
atcatctcaccttgcctcctgggtatgacaggttccgacctgcaggtgattggctgagatgattggctgtcgtgattggctggactgattggctgctatgattggctgacttgattggctgtgctgattggctggtatgattggctgggcgcgccatgcttcatcagactct

SEQ ID NO: 8021 - DNA, 172 bp, Artificial Sequence; identical to SEQ ID NO: 8020
  Synthetic polynucleotide

SEQ ID NO: 8022 - DNA, 188 bp, Artificial Sequence
  Synthetic polynucleotide
atcatctcaccttgcctcctgcttgcaactctactggccctgcagggcgaccacactgagagcgaccacactgtcggcgaccacactggacgcgaccacactgctagcgaccacactgactgcgaccacactgtgcgcgaccacactggtagcgaccacactgggcgcgccatgcttcatcagactct

SEQ ID NO: 8023 - DNA, 188 bp, Artificial Sequence; identical to SEQ ID NO: 8022
  Synthetic polynucleotide

SEQ ID NO: 8024 - DNA, 188 bp, Artificial Sequence
  Synthetic polynucleotide
atcatctcaccttgcctcctggctcggattaagcgcttcctgcaggcagtgacaggtcagacagtgacaggtctcgcagtgacaggtcgaccagtgacaggtcctacagtgacaggtcactcagtgacaggtctgccagtgacaggtcgtacagtgacaggtcggcgcgccatgcttcatcagactct

SEQ ID NO: 8025 - DNA, 188 bp, Artificial Sequence; identical to SEQ ID NO: 8024
  Synthetic polynucleotide

SEQ ID NO: 8026 - DNA, 191 bp, Artificial Sequence
  Synthetic polynucleotide
atcatctcaccttgcctcctgcaccttatcaaagtacacctgcaggtaagagataacttagatagataagagataacttagattcgtaagagataacttagatgactaagagataacttagatctataagagataacttagatacttaagagataacttagattgcggcgcgccatgcttcatcagactct

SEQ ID NO: 8027 - DNA, 191 bp, Artificial Sequence; identical to SEQ ID NO: 8026
  Synthetic polynucleotide

SEQ ID NO: 8028 - DNA, 179 bp, Artificial Sequence
  Synthetic polynucleotide
atcatctcaccttgcctcctgaaggcggtccaaagcaccctgcaggtgactgacagccacgctggccaatagatgactgacagccacgctggccaattcgtgactgacagccacgctggccaatgactgactgacagccacgctggccaatctaggcgcgccatgcttcatcagactct

SEQ ID NO: 8029 - DNA, 179 bp, Artificial Sequence; identical to SEQ ID NO: 8028
  Synthetic polynucleotide

SEQ ID NO: 8030 - DNA, 156 bp, Artificial Sequence
  Synthetic polynucleotide
atcatctcaccttgcctcctgacgattgaccattagttcctgcaggtatacataagatatacatatcgtatacatagactatacatactatatacataacttatacatatgctatacatagtatatacataggcgcgccatgcttcatcagactct

SEQ ID NO: 8031 - DNA, 156 bp, Artificial Sequence; identical to SEQ ID NO: 8030
  Synthetic polynucleotide

SEQ ID NO: 8032 - DNA, 156 bp, Artificial Sequence
  Synthetic polynucleotide
atcatctcaccttgcctcctgcttgatcttcacgttcacctgcaggatttcctgagaatttcctgtcgatttcctggacatttcctgctaatttcctgactatttcctgtgcatttcctggtaatttcctgggcgcgccatgcttcatcagactct

SEQ ID NO: 8033 - DNA, 156 bp, Artificial Sequence; identical to SEQ ID NO: 8032
  Synthetic polynucleotide

SEQ ID NO: 8034 - DNA, 190 bp, Artificial Sequence
  Synthetic polynucleotide
atcatctcaccttgcctcctgagtattgtggccgagtgcctgcaggcagggtcagagcggagacagggtcagagcggtcgcagggtcagagcgggaccagggtcagagcggctacagggtcagagcggactcagggtcagagcggtgccagggtcagagcgggtaggcgcgccatgcttcatcagactct

SEQ ID NO: 8035 - DNA, 190 bp, Artificial Sequence; identical to SEQ ID NO: 8034
  Synthetic polynucleotide

SEQ ID NO: 8036 - DNA, 197 bp, Artificial Sequence
  Synthetic polynucleotide
atcatctcaccttgcctcctgtaatagcaatcagcgtgcctgcaggtagcaggaagtgactagatagcaggaagtgacttcgtagcaggaagtgactgactagcaggaagtgactctatagcaggaagtgactacttagcaggaagtgacttgctagcaggaagtgactgtaggcgcgccatgcttcatcagactct

SEQ ID NO: 8037 - DNA, 197 bp, Artificial Sequence; identical to SEQ ID NO: 8036
  Synthetic polynucleotide

SEQ ID NO: 8038 - DNA, 197 bp, Artificial Sequence
  Synthetic polynucleotide
atcatctcaccttgcctcctgtggtagggataccgctgcctgcagggggtcacggtgacctagagggtcacggtgaccttcggggtcacggtgacctgacgggtcacggtgacctctagggtcacggtgacctactgggtcacggtgaccttgcgggtcacggtgacctgtaggcgcgccatgcttcatcagactct

SEQ ID NO: 8039 - DNA, 197 bp, Artificial Sequence; identical to SEQ ID NO: 8038
  Synthetic polynucleotide

SEQ ID NO: 8040 - DNA, 191 bp, Artificial Sequence
  Synthetic polynucleotide
atcatctcaccttgcctcctgacggaaacgtacagtaccctgcaggaaggtcaacagaggtcaagaaaggtcaacagaggtcatcgaaggtcaacagaggtcagacaaggtcaacagaggtcactaaaggtcaacagaggtcaactaaggtcaacagaggtcatgcggcgcgccatgcttcatcagactct

SEQ ID NO: 8041 - DNA, 191 bp, Artificial Sequence; identical to SEQ ID NO: 8040
  Synthetic polynucleotide

SEQ ID NO: 8042 - DNA, 156 bp, Artificial Sequence
  Synthetic polynucleotide
atcatctcaccttgcctcctgtgtaaattcttcccactcctgcaggtgagtcatagatgagtcattcgtgagtcatgactgagtcatctatgagtcatacttgagtcattgctgagtcatgtatgagtcatggcgcgccatgcttcatcagactct

SEQ ID NO: 8043 - DNA, 156 bp, Artificial Sequence; identical to SEQ ID NO: 8042
  Synthetic polynucleotide

SEQ ID NO: 8044 - DNA, 196 bp, Artificial Sequence
  Synthetic polynucleotide
atcatctcaccttgcctcctgtgcgatatcgcccacgtcctgcaggtcagccaatcagaagggggggtagatcagccaatcagaagggggggttcgtcagccaatcagaagggggggtgactcagccaatcagaagggggggtctatcagccaatcagaagggggggtactggcgcgccatgcttcatcagactct

SEQ ID NO: 8045 - DNA, 196 bp, Artificial Sequence; identical to SEQ ID NO: 8044
  Synthetic polynucleotide

SEQ ID NO: 8046 - DNA, 164 bp, Artificial Sequence
  Synthetic polynucleotide
atcatctcaccttgcctcctgaaagccataaagctttccctgcaggtcagctgttagatcagctgtttcgtcagctgttgactcagctgttctatcagctgttacttcagctgtttgctcagctgttgtatcagctgttggcgcgccatgcttcatcagactct

SEQ ID NO: 8047 - DNA, 164 bp, Artificial Sequence; identical to SEQ ID NO: 8046
  Synthetic polynucleotide

SEQ ID NO: 8048 - DNA, 185 bp, Artificial Sequence
  Synthetic polynucleotide
atcatctcaccttgcctcctgaacacttatgcattctccctgcaggggaggtcattaattatagaggaggtcattaattattcgggaggtcattaattatgacggaggtcattaattatctaggaggtcattaattatactggaggtcattaattattgcggcgcgccatgcttcatcagactct

SEQ ID NO: 8049 - DNA, 185 bp, Artificial Sequence; identical to SEQ ID NO: 8048
  Synthetic polynucleotide

SEQ ID NO: 8050 - DNA, 180 bp, Artificial Sequence
  Synthetic polynucleotide
atcatctcaccttgcctcctgcagcgaatcctatcccgcctgcaggagtgactaagtagaagtgactaagttcgagtgactaagtgacagtgactaagtctaagtgactaagtactagtgactaagttgcagtgactaagtgtaagtgactaagtggcgcgccatgcttcatcagactct

SEQ ID NO: 8051 - DNA, 180 bp, Artificial Sequence; identical to SEQ ID NO: 8050
  Synthetic polynucleotide

SEQ ID NO: 8052 - DNA, 196 bp, Artificial Sequence
  Synthetic polynucleotide
atcatctcaccttgcctcctgcggagcgtaatggaagacctgcaggttcatttgcatatagattcatttgcatattcgttcatttgcatatgacttcatttgcatatctattcatttgcatatactttcatttgcatattgcttcatttgcatatgtattcatttgcatatggcgcgccatgcttcatcagactct

SEQ ID NO: 8053 - DNA, 196 bp, Artificial Sequence; identical to SEQ ID NO: 8052
  Synthetic polynucleotide

SEQ ID NO: 8054 - DNA, 148 bp, Artificial Sequence
  Synthetic polynucleotide
atcatctcaccttgcctcctggccactccaacacttaacctgcaggctaattaagactaattatcgctaattagacctaattactactaattaactctaattatgcctaattagtactaattaggcgcgccatgcttcatcagactct

SEQ ID NO: 8055 - DNA, 148 bp, Artificial Sequence; identical to SEQ ID NO: 8054
  Synthetic polynucleotide

SEQ ID NO: 8056 - DNA, 148 bp, Artificial Sequence
  Synthetic polynucleotide
atcatctcaccttgcctcctgctcaatggcgatcatcgcctgcaggctaattgagactaattgtcgctaattggacctaattgctactaattgactctaattgtgcctaattggtactaattgggcgcgccatgcttcatcagactct

SEQ ID NO: 8057 - DNA, 148 bp, Artificial Sequence; identical to SEQ ID NO: 8056
  Synthetic polynucleotide

SEQ ID NO: 8058 - DNA, 180 bp, Artificial Sequence
  Synthetic polynucleotide
atcatctcaccttgcctcctgacacttgttgagtatagcctgcaggtccctaataaaagatccctaataaatcgtccctaataaagactccctaataaactatccctaataaaacttccctaataaatgctccctaataaagtatccctaataaaggcgcgccatgcttcatcagactct

SEQ ID NO: 8059 - DNA, 180 bp, Artificial Sequence; identical to SEQ ID NO: 8058
  Synthetic polynucleotide

SEQ ID NO: 8060 - DNA, 188 bp, Artificial Sequence
  Synthetic polynucleotide
atcatctcaccttgcctcctgttaaacgcgtgttgccccctgcaggattgtaaacaaaagaattgtaaacaaatcgattgtaaacaaagacattgtaaacaaactaattgtaaacaaaactattgtaaacaaatgcattgtaaacaaagtaattgtaaacaaaggcgcgccatgcttcatcagactct

SEQ ID NO: 8061 - DNA, 188 bp, Artificial Sequence; identical to SEQ ID NO: 8060
  Synthetic polynucleotide

SEQ ID NO: 8062 - DNA, 188 bp, Artificial Sequence
  Synthetic polynucleotide
atcatctcaccttgcctcctgctatctagtatggcttacctgcaggcagcggggggtcagacagcggggggtctcgcagcggggggtcgaccagcggggggtcctacagcggggggtcactcagcggggggtctgccagcggggggtcgtacagcggggggtcggcgcgccatgcttcatcagactct

SEQ ID NO: 8063 - DNA, 188 bp, Artificial Sequence; identical to SEQ ID NO: 8062
  Synthetic polynucleotide

SEQ ID NO: 8064 - DNA, 172 bp, Artificial Sequence
  Synthetic polynucleotide
atcatctcaccttgcctcctggcgacgctcccagtttacctgcaggaccaattaagagaaccaattaagtcgaccaattaaggacaccaattaagctaaccaattaagactaccaattaagtgcaccaattaaggtaaccaattaagggcgcgccatgcttcatcagactct

SEQ ID NO: 8065 - DNA, 172 bp, Artificial Sequence; identical to SEQ ID NO: 8064
  Synthetic polynucleotide

SEQ ID NO: 8066 - DNA, 190 bp, Artificial Sequence
  Synthetic polynucleotide
atcatctcaccttgcctcctggaagtcctactggtaatcctgcaggaaaaatattattatagaaaaaatattattattcgaaaaatattattatgacaaaaatattattatctaaaaaatattattatactaaaaatattattattgcaaaaatattattatgtaggcgcgccatgcttcatcagactct

SEQ ID NO: 8067 - DNA, 190 bp, Artificial Sequence; identical to SEQ ID NO: 8066
  Synthetic polynucleotide

SEQ ID NO: 8068 - DNA, 172 bp, Artificial Sequence
  Synthetic polynucleotide
atcatctcaccttgcctcctgggcgcgtctaagtagaacctgcaggaccaattaaaagaaccaattaaatcgaccaattaaagacaccaattaaactaaccaattaaaactaccaattaaatgcaccaattaaagtaaccaattaaaggcgcgccatgcttcatcagactct

SEQ ID NO: 8069 - DNA, 172 bp, Artificial Sequence; identical to SEQ ID NO: 8068
  Synthetic polynucleotide

SEQ ID NO: 8070 - DNA, 180 bp, Artificial Sequence
  Synthetic polynucleotide
atcatctcaccttgcctcctggctaaactagccggaagcctgcaggaatttgcatatagaaatttgcatattcgaatttgcatatgacaatttgcatatctaaatttgcatatactaatttgcatattgcaatttgcatatgtaaatttgcatatggcgcgccatgcttcatcagactct

SEQ ID NO: 8071 - DNA, 180 bp, Artificial Sequence; identical to SEQ ID NO: 8070
  Synthetic polynucleotide

SEQ ID NO: 8072 - DNA, 172 bp, Artificial Sequence
  Synthetic polynucleotide
atcatctcaccttgcctcctgcgcgttacacagacgtccctgcaggaccaattaacagaaccaattaactcgaccaattaacgacaccaattaacctaaccaattaacactaccaattaactgcaccaattaacgtaaccaattaacggcgcgccatgcttcatcagactct

SEQ ID NO: 8073 - DNA, 172 bp, Artificial Sequence; identical to SEQ ID NO: 8072
  Synthetic polynucleotide

SEQ ID NO: 8074 - DNA, 172 bp, Artificial Sequence
  Synthetic polynucleotide
atcatctcaccttgcctcctgtaatgcatcaggtttgacctgcaggccagtcatttagaccagtcattttcgccagtcatttgacccagtcatttctaccagtcatttactccagtcattttgcccagtcatttgtaccagtcatttggcgcgccatgcttcatcagactct

SEQ ID NO: 8075 - DNA, 172 bp, Artificial Sequence; identical to SEQ ID NO: 8074
  Synthetic polynucleotide

SEQ ID NO: 8076 - DNA, 156 bp, Artificial Sequence
  Synthetic polynucleotide
atcatctcaccttgcctcctggacctaatccggacccacctgcaggaatgtatcagaaatgtatctcgaatgtatcgacaatgtatcctaaatgtatcactaatgtatctgcaatgtatcgtaaatgtatcggcgcgccatgcttcatcagactct

SEQ ID NO: 8077 - DNA, 156 bp, Artificial Sequence; identical to SEQ ID NO: 8076
  Synthetic polynucleotide

SEQ ID NO: 8078 - DNA, 172 bp, Artificial Sequence
  Synthetic polynucleotide
atcatctcaccttgcctcctgcagcctggcttggtgttcctgcaggtgacgtcaccagatgacgtcacctcgtgacgtcaccgactgacgtcaccctatgacgtcaccacttgacgtcacctgctgacgtcaccgtatgacgtcaccggcgcgccatgcttcatcagactct

SEQ ID NO: 8079 - DNA, 172 bp, Artificial Sequence; identical to SEQ ID NO: 8078
  Synthetic polynucleotide

SEQ ID NO: 8080 - DNA, 156 bp, Artificial Sequence
  Synthetic polynucleotide
atcatctcaccttgcctcctgctaagcgggttaatgcacctgcaggagagttcaagaagagttcatcgagagttcagacagagttcactaagagttcaactagagttcatgcagagttcagtaagagttcaggcgcgccatgcttcatcagactct

SEQ ID NO: 8081 - DNA, 156 bp, Artificial Sequence; identical to SEQ ID NO: 8080
  Synthetic polynucleotide

SEQ ID NO: 8082 - DNA, 164 bp, Artificial Sequence
  Synthetic polynucleotide
atcatctcaccttgcctcctgatcttgatataccacggcctgcaggtgaccgttaagatgaccgttatcgtgaccgttagactgaccgttactatgaccgttaacttgaccgttatgctgaccgttagtatgaccgttaggcgcgccatgcttcatcagactct

SEQ ID NO: 8083 - DNA, 164 bp, Artificial Sequence; identical to SEQ ID NO: 8082
  Synthetic polynucleotide

SEQ ID NO: 8084 - DNA, 197 bp, Artificial Sequence
  Synthetic polynucleotide
atcatctcaccttgcctcctgaagatacatacgcggatcctgcagggactaagcaaacaatgaaagagactaagcaaacaatgaatcggactaagcaaacaatgaagacgactaagcaaacaatgaactagactaagcaaacaatgaaactgactaagcaaacaatgaatgcggcgcgccatgcttcatcagactct

SEQ ID NO: 8085 - DNA, 197 bp, Artificial Sequence; identical to SEQ ID NO: 8084
  Synthetic polynucleotide

SEQ ID NO: 8086 - DNA, 191 bp, Artificial Sequence
  Synthetic polynucleotide
atcatctcaccttgcctcctgattaccttcacacgcatcctgcaggggactacaactcccagcaggcagaggactacaactcccagcaggctcgggactacaactcccagcaggcgacggactacaactcccagcaggcctaggactacaactcccagcaggcactggcgcgccatgcttcatcagactct

SEQ ID NO: 8087 - DNA, 191 bp, Artificial Sequence; identical to SEQ ID NO: 8086
  Synthetic polynucleotide

SEQ ID NO: 8088 - DNA, 196 bp, Artificial Sequence
  Synthetic polynucleotide
atcatctcaccttgcctcctgcttattcattcaaccgacctgcaggaagtaaataaacaagaaagtaaataaacatcgaagtaaataaacagacaagtaaataaacactaaagtaaataaacaactaagtaaataaacatgcaagtaaataaacagtaaagtaaataaacaggcgcgccatgcttcatcagactct

SEQ ID NO: 8089 - DNA, 196 bp, Artificial Sequence; identical to SEQ ID NO: 8088
  Synthetic polynucleotide

SEQ ID NO: 8090 - DNA, 180 bp, Artificial Sequence
  Synthetic polynucleotide
atcatctcaccttgcctcctgcaccttaaatctcgtgtcctgcaggtccttatctgcagatccttatctgctcgtccttatctgcgactccttatctgcctatccttatctgcacttccttatctgctgctccttatctgcgtatccttatctgcggcgcgccatgcttcatcagactct

SEQ ID NO: 8091 - DNA, 180 bp, Artificial Sequence; identical to SEQ ID NO: 8090
  Synthetic polynucleotide

SEQ ID NO: 8092 - DNA, 156 bp, Artificial Sequence
  Synthetic polynucleotide
atcatctcaccttgcctcctgtgccacaattggtccttcctgcaggtttcgcgcagatttcgcgctcgtttcgcgcgactttcgcgcctatttcgcgcacttttcgcgctgctttcgcgcgtatttcgcgcggcgcgccatgcttcatcagactct

SEQ ID NO: 8093 - DNA, 156 bp, Artificial Sequence; identical to SEQ ID NO: 8092
  Synthetic polynucleotide

SEQ ID NO: 8094 - DNA, 164 bp, Artificial Sequence
  Synthetic polynucleotide
atcatctcaccttgcctcctgccaatgtcgggtgatcccctgcaggagcaaacagagaagcaaacagtcgagcaaacaggacagcaaacagctaagcaaacagactagcaaacagtgcagcaaacaggtaagcaaacagggcgcgccatgcttcatcagactct

SEQ ID NO: 8095 - DNA, 164 bp, Artificial Sequence; identical to SEQ ID NO: 8094
  Synthetic polynucleotide

SEQ ID NO: 8096 - DNA, 190 bp, Artificial Sequence
  Synthetic polynucleotide
atcatctcaccttgcctcctgggcttcttctcatctcgcctgcaggccccgctgcccggcagaccccgctgcccggctcgccccgctgcccggcgacccccgctgcccggcctaccccgctgcccggcactccccgctgcccggctgcccccgctgcccggcgtaggcgcgccatgcttcatcagactct

SEQ ID NO: 8097 - DNA, 190 bp, Artificial Sequence; identical to SEQ ID NO: 8096
  Synthetic polynucleotide

SEQ ID NO: 8098 - DNA, 172 bp, Artificial Sequence
  Synthetic polynucleotide
atcatctcaccttgcctcctggtaaacttccgtagactcctgcagggcgcgcgcgcagagcgcgcgcgctcggcgcgcgcgcgacgcgcgcgcgcctagcgcgcgcgcactgcgcgcgcgctgcgcgcgcgcgcgtagcgcgcgcgcggcgcgccatgcttcatcagactct

SEQ ID NO: 8099 - DNA, 172 bp, Artificial Sequence; identical to SEQ ID NO: 8098
  Synthetic polynucleotide

SEQ ID NO: 8100 - DNA, 196 bp, Artificial Sequence
  Synthetic polynucleotide
atcatctcaccttgcctcctggctttgatcgatccgatcctgcaggtaaacaaacacatagataaacaaacacattcgtaaacaaacacatgactaaacaaacacatctataaacaaacacatacttaaacaaacacattgctaaacaaacacatgtataaacaaacacatggcgcgccatgcttcatcagactct

SEQ ID NO: 8101 - DNA, 196 bp, Artificial Sequence; identical to SEQ ID NO: 8100
  Synthetic polynucleotide

SEQ ID NO: 8102 - DNA, 196 bp, Artificial Sequence
  Synthetic polynucleotide
atcatctcaccttgcctcctggatagagactagactagcctgcaggaagcgcgcccccgagaaagcgcgcccccgtcgaagcgcgcccccggacaagcgcgcccccgctaaagcgcgcccccgactaagcgcgcccccgtgcaagcgcgcccccggtaaagcgcgcccccgggcgcgccatgcttcatcagactct

SEQ ID NO: 8103 - DNA, 196 bp, Artificial Sequence; identical to SEQ ID NO: 8102
  Synthetic polynucleotide

SEQ ID NO: 8104 - DNA, 196 bp, Artificial Sequence
  Synthetic polynucleotide
atcatctcaccttgcctcctgtttggtgccctcgtgttcctgcaggtaaacaaacatccagataaacaaacatcctcgtaaacaaacatccgactaaacaaacatccctataaacaaacatccacttaaacaaacatcctgctaaacaaacatccgtataaacaaacatccggcgcgccatgcttcatcagactct

SEQ ID NO: 8105 - DNA, 196 bp, Artificial Sequence; identical to SEQ ID NO: 8104
  Synthetic polynucleotide

SEQ ID NO: 8106 - DNA, 180 bp, Artificial Sequence
  Synthetic polynucleotide
atcatctcaccttgcctcctgggcggtcaaatgccgatcctgcaggcgccccctggtagacgccccctggttcgcgccccctggtgaccgccccctggtctacgccccctggtactcgccccctggttgccgccccctggtgtacgccccctggtggcgcgccatgcttcatcagactct

SEQ ID NO: 8107 - DNA, 180 bp, Artificial Sequence; identical to SEQ ID NO: 8106
  Synthetic polynucleotide

SEQ ID NO: 8108 - DNA, 197 bp, Artificial Sequence
  Synthetic polynucleotide
atcatctcaccttgcctcctgcgcttattgctggcaaacctgcagggtgacctttgaccccagagtgacctttgacccctcggtgacctttgaccccgacgtgacctttgaccccctagtgacctttgaccccactgtgacctttgacccctgcgtgacctttgaccccgtaggcgcgccatgcttcatcagactct

SEQ ID NO: 8109 - DNA, 197 bp, Artificial Sequence; identical to SEQ ID NO: 8108
  Synthetic polynucleotide

SEQ ID NO: 8110 - DNA, 188 bp, Artificial Sequence
  Synthetic polynucleotide
atcatctcaccttgcctcctggatgggcttcatctccacctgcaggtgacaggtgtcaagatgacaggtgtcatcgtgacaggtgtcagactgacaggtgtcactatgacaggtgtcaacttgacaggtgtcatgctgacaggtgtcagtatgacaggtgtcaggcgcgccatgcttcatcagactct

SEQ ID NO: 8111 - DNA, 188 bp, Artificial Sequence; identical to SEQ ID NO: 8110
  Synthetic polynucleotide

SEQ ID NO: 8112 - DNA, 156 bp, Artificial Sequence
  Synthetic polynucleotide
atcatctcaccttgcctcctgcatcagatctagatagccctgcaggggcaggtgagaggcaggtgtcgggcaggtggacggcaggtgctaggcaggtgactggcaggtgtgcggcaggtggtaggcaggtgggcgcgccatgcttcatcagactct

SEQ ID NO: 8113 - DNA, 156 bp, Artificial Sequence; identical to SEQ ID NO: 8112
  Synthetic polynucleotide

SEQ ID NO: 8114 - DNA, 186 bp, Artificial Sequence
  Synthetic polynucleotide
atcatctcaccttgcctcctgcatcctaggcgttcagacctgcaggcattcctgagggatgacttaagacattcctgagggatgacttatcgcattcctgagggatgacttagaccattcctgagggatgacttactacattcctgagggatgacttaactggcgcgccatgcttcatcagactct

SEQ ID NO: 8115 - DNA, 186 bp, Artificial Sequence; identical to SEQ ID NO: 8114
  Synthetic polynucleotide

SEQ ID NO: 8116 - DNA, 172 bp, Artificial Sequence
  Synthetic polynucleotide
atcatctcaccttgcctcctgctccactcactcttcagcctgcagggctaaacggtagagctaaacggttcggctaaacggtgacgctaaacggtctagctaaacggtactgctaaacggttgcgctaaacggtgtagctaaacggtggcgcgccatgcttcatcagactct

SEQ ID NO: 8117 - DNA, 172 bp, Artificial Sequence; identical to SEQ ID NO: 8116
  Synthetic polynucleotide

SEQ ID NO: 8118 - DNA, 164 bp, Artificial Sequence
  Synthetic polynucleotide
atcatctcaccttgcctcctgagaggtgtaggattgtacctgcaggagggtatcaagaagggtatcatcgagggtatcagacagggtatcactaagggtatcaactagggtatcatgcagggtatcagtaagggtatcaggcgcgccatgcttcatcagactct

SEQ ID NO: 8119 - DNA, 164 bp, Artificial Sequence; identical to SEQ ID NO: 8118
  Synthetic polynucleotide

SEQ ID NO: 8120 - DNA, 197 bp, Artificial Sequence
  Synthetic polynucleotide
atcatctcaccttgcctcctgcctgtttgataggcctccctgcaggtatatcgattattttagatatatcgattatttttcgtatatcgattattttgactatatcgattattttctatatatcgattattttacttatatcgattatttttgctatatcgattattttgtaggcgcgccatgcttcatcagactct

SEQ ID NO: 8121 - DNA, 197 bp, Artificial Sequence; identical to SEQ ID NO: 8120
  Synthetic polynucleotide

SEQ ID NO: 8122 - DNA, 188 bp, Artificial Sequence
  Synthetic polynucleotide
atcatctcaccttgcctcctggccacactgccctttaacctgcaggaccatatatggcagaaccatatatggctcgaccatatatggcgacaccatatatggcctaaccatatatggcactaccatatatggctgcaccatatatggcgtaaccatatatggcggcgcgccatgcttcatcagactct

SEQ ID NO: 8123 - DNA, 188 bp, Artificial Sequence; identical to SEQ ID NO: 8122
  Synthetic polynucleotide

SEQ ID NO: 8124 - DNA, 156 bp, Artificial Sequence
  Synthetic polynucleotide
atcatctcaccttgcctcctggcaacaagaccttcttgcctgcaggttgatgtgagattgatgtgtcgttgatgtggacttgatgtgctattgatgtgactttgatgtgtgcttgatgtggtattgatgtgggcgcgccatgcttcatcagactct

SEQ ID NO: 8125 - DNA, 156 bp, Artificial Sequence; identical to SEQ ID NO: 8124
  Synthetic polynucleotide

SEQ ID NO: 8126 - DNA, 172 bp, Artificial Sequence
  Synthetic polynucleotide
atcatctcaccttgcctcctgcacatgaacgctaacgccctgcaggctaattaattagactaattaatttcgctaattaattgacctaattaattctactaattaattactctaattaatttgcctaattaattgtactaattaattggcgcgccatgcttcatcagactct

SEQ ID NO: 8127 - DNA, 172 bp, Artificial Sequence; identical to SEQ ID NO: 8126
  Synthetic polynucleotide

SEQ ID NO: 8128 - DNA, 188 bp, Artificial Sequence
  Synthetic polynucleotide
atcatctcaccttgcctcctgtattaacggtcctttgacctgcagggcggctgagcggagagcggctgagcggtcggcggctgagcgggacgcggctgagcggctagcggctgagcggactgcggctgagcggtgcgcggctgagcgggtagcggctgagcggggcgcgccatgcttcatcagactct

SEQ ID NO: 8129 - DNA, 188 bp, Artificial Sequence; identical to SEQ ID NO: 8128
  Synthetic polynucleotide

SEQ ID NO: 8130 - DNA, 191 bp, Artificial Sequence
  Synthetic polynucleotide
atcatctcaccttgcctcctgatacaccgccgtatttacctgcaggcaatctatttttagcatagacaatctatttttagcattcgcaatctatttttagcatgaccaatctatttttagcatctacaatctatttttagcatactcaatctatttttagcattgcggcgcgccatgcttcatcagactct

SEQ ID NO: 8131 - DNA, 191 bp, Artificial Sequence; identical to SEQ ID NO: 8130
  Synthetic polynucleotide

SEQ ID NO: 8132 - DNA, 191 bp, Artificial Sequence
  Synthetic polynucleotide
atcatctcaccttgcctcctgtcgtagctacgaagcgacctgcaggtcgcaaggcatgatgggaaatagatcgcaaggcatgatgggaaattcgtcgcaaggcatgatgggaaatgactcgcaaggcatgatgggaaatctatcgcaaggcatgatgggaaatactggcgcgccatgcttcatcagactct

SEQ ID NO: 8133 - DNA, 191 bp, Artificial Sequence; identical to SEQ ID NO: 8132
  Synthetic polynucleotide

SEQ ID NO: 8134 - DNA, 188 bp, Artificial Sequence
  Synthetic polynucleotide
atcatctcaccttgcctcctggttggagacaacagaggcctgcaggcaggaagtggttagacaggaagtggtttcgcaggaagtggttgaccaggaagtggttctacaggaagtggttactcaggaagtggtttgccaggaagtggttgtacaggaagtggttggcgcgccatgcttcatcagactct

SEQ ID NO: 8135 - DNA, 188 bp, Artificial Sequence; identical to SEQ ID NO: 8134
  Synthetic polynucleotide

SEQ ID NO: 8136 - DNA, 196 bp, Artificial Sequence
  Synthetic polynucleotide
atcatctcaccttgcctcctgtaacgggaacaacgtttcctgcaggctaagtaaacaagagactaagtaaacaagtcgctaagtaaacaaggacctaagtaaacaagctactaagtaaacaagactctaagtaaacaagtgcctaagtaaacaaggtactaagtaaacaagggcgcgccatgcttcatcagactct

SEQ ID NO: 8137 - DNA, 196 bp, Artificial Sequence; identical to SEQ ID NO: 8136
  Synthetic polynucleotide

SEQ ID NO: 8138 - DNA, 172 bp, Artificial Sequence
  Synthetic polynucleotide
atcatctcaccttgcctcctgcaactatatgatgaggtcctgcaggccgtgaccccagaccgtgacccctcgccgtgaccccgacccgtgaccccctaccgtgaccccactccgtgacccctgcccgtgaccccgtaccgtgaccccggcgcgccatgcttcatcagactct

SEQ ID NO: 8139 - DNA, 172 bp, Artificial Sequence; identical to SEQ ID NO: 8138
  Synthetic polynucleotide

SEQ ID NO: 8140 - DNA, 188 bp, Artificial Sequence
  Synthetic polynucleotide
atcatctcaccttgcctcctgcccacgtcatcgagcaacctgcagggttcaaggtcagagagttcaaggtcagtcggttcaaggtcaggacgttcaaggtcagctagttcaaggtcagactgttcaaggtcagtgcgttcaaggtcaggtagttcaaggtcagggcgcgccatgcttcatcagactct

SEQ ID NO: 8141 - DNA, 188 bp, Artificial Sequence; identical to SEQ ID NO: 8140
  Synthetic polynucleotide

SEQ ID NO: 8142 - DNA, 172 bp, Artificial Sequence
  Synthetic polynucleotide
atcatctcaccttgcctcctgacaccaccgttgcctaccctgcaggtgtgacctcaagatgtgacctcatcgtgtgacctcagactgtgacctcactatgtgacctcaacttgtgacctcatgctgtgacctcagtatgtgacctcaggcgcgccatgcttcatcagactct

SEQ ID NO: 8143 - DNA, 172 bp, Artificial Sequence; identical to SEQ ID NO: 8142
  Synthetic polynucleotide

SEQ ID NO: 8144 - DNA, 198 bp, Artificial Sequence
  Synthetic polynucleotide
atcatctcaccttgcctcctgtctctccagaggctatccctgcaggaagtaggtcaccgtgacctacttagaaagtaggtcaccgtgacctactttcgaagtaggtcaccgtgacctacttgacaagtaggtcaccgtgacctacttctaaagtaggtcaccgtgacctacttggcgcgccatgcttcatcagactct

SEQ ID NO: 8145 - DNA, 198 bp, Artificial Sequence; identical to SEQ ID NO: 8144
  Synthetic polynucleotide

SEQ ID NO: 8146 - DNA, 197 bp, Artificial Sequence
  Synthetic polynucleotide
atcatctcaccttgcctcctgcagccaatcagctcattcctgcagggacatgtccagacatgtcagagacatgtccagacatgtctcggacatgtccagacatgtcgacgacatgtccagacatgtcctagacatgtccagacatgtcactgacatgtccagacatgtctgcggcgcgccatgcttcatcagactct

SEQ ID NO: 8147 - DNA, 197 bp, Artificial Sequence; identical to SEQ ID NO: 8146
  Synthetic polynucleotide

SEQ ID NO: 8148 - DNA, 180 bp, Artificial Sequence
  Synthetic polynucleotide
atcatctcaccttgcctcctgactatcgaacaagtgcgcctgcaggtacatccgggtagatacatccgggttcgtacatccgggtgactacatccgggtctatacatccgggtacttacatccgggttgctacatccgggtgtatacatccgggtggcgcgccatgcttcatcagactct

SEQ ID NO: 8149 - DNA, 180 bp, Artificial Sequence; identical to SEQ ID NO: 8148
  Synthetic polynucleotide

SEQ ID NO: 8150 - DNA, 172 bp, Artificial Sequence
  Synthetic polynucleotide
atcatctcaccttgcctcctgaatgtcctctttgcgagcctgcagggacaggtgtaagagacaggtgtatcggacaggtgtagacgacaggtgtactagacaggtgtaactgacaggtgtatgcgacaggtgtagtagacaggtgtaggcgcgccatgcttcatcagactct

SEQ ID NO: 8151 - DNA, 172 bp, Artificial Sequence; identical to SEQ ID NO: 8150
  Synthetic polynucleotide

SEQ ID NO: 8152 - DNA, 190 bp, Artificial Sequence
  Synthetic polynucleotide
atcatctcaccttgcctcctggcatggaggcctcttatcctgcaggctgtggggggtcgtagactgtggggggtcgttcgctgtggggggtcgtgacctgtggggggtcgtctactgtggggggtcgtactctgtggggggtcgttgcctgtggggggtcgtgtaggcgcgccatgcttcatcagactct

SEQ ID NO: 8153 - DNA, 190 bp, Artificial Sequence; identical to SEQ ID NO: 8152
  Synthetic polynucleotide

SEQ ID NO: 8154 - DNA, 197 bp, Artificial Sequence
  Synthetic polynucleotide
atcatctcaccttgcctcctggggactcatgagtctaccctgcagggacatgtcccaacatgttagagacatgtcccaacatgtttcggacatgtcccaacatgttgacgacatgtcccaacatgttctagacatgtcccaacatgttactgacatgtcccaacatgtttgcggcgcgccatgcttcatcagactct

SEQ ID NO: 8155 - DNA, 197 bp, Artificial Sequence; identical to SEQ ID NO: 8154
  Synthetic polynucleotide

SEQ ID NO: 8156 - DNA, 185 bp, Artificial Sequence
  Synthetic polynucleotide
atcatctcaccttgcctcctggaaaggaattcctccaacctgcaggaggttaattaactcaaagaaggttaattaactcaatcgaggttaattaactcaagacaggttaattaactcaactaaggttaattaactcaaactaggttaattaactcaatgcggcgcgccatgcttcatcagactct

SEQ ID NO: 8157 - DNA, 185 bp, Artificial Sequence; identical to SEQ ID NO: 8156
  Synthetic polynucleotide

SEQ ID NO: 8158 - DNA, 148 bp, Artificial Sequence
  Synthetic polynucleotide
atcatctcaccttgcctcctgtgcatcggcgaccttagcctgcaggttgacagagattgacagtcgttgacaggacttgacagctattgacagactttgacagtgcttgacaggtattgacagggcgcgccatgcttcatcagactct

SEQ ID NO: 8159 - DNA, 148 bp, Artificial Sequence; identical to SEQ ID NO: 8158
  Synthetic polynucleotide

SEQ ID NO: 8160 - DNA, 191 bp, Artificial Sequence
  Synthetic polynucleotide
atcatctcaccttgcctcctgacggtgcgctcctattacctgcaggcacaattaattaacgcgagacacaattaattaacgcgtcgcacaattaattaacgcggaccacaattaattaacgcgctacacaattaattaacgcgactcacaattaattaacgcgtgcggcgcgccatgcttcatcagactct

SEQ ID NO: 8161 - DNA, 191 bp, Artificial Sequence; identical to SEQ ID NO: 8160
  Synthetic polynucleotide

SEQ ID NO: 8162 - DNA, 185 bp, Artificial Sequence
  Synthetic polynucleotide
atcatctcaccttgcctcctgacgatagtgctaccttgcctgcaggcggtttaaaaataaccagacggtttaaaaataacctcgcggtttaaaaataaccgaccggtttaaaaataaccctacggtttaaaaataaccactcggtttaaaaataacctgcggcgcgccatgcttcatcagactct

SEQ ID NO: 8163 - DNA, 185 bp, Artificial Sequence; identical to SEQ ID NO: 8162
  Synthetic polynucleotide

SEQ ID NO: 8164 - DNA, 190 bp, Artificial Sequence
  Synthetic polynucleotide
atcatctcaccttgcctcctggtcgactgggaacaacacctgcaggcctgcggcaggtggagacctgcggcaggtggtcgcctgcggcaggtgggaccctgcggcaggtggctacctgcggcaggtggactcctgcggcaggtggtgccctgcggcaggtgggtaggcgcgccatgcttcatcagactct

SEQ ID NO: 8165 - DNA, 190 bp, Artificial Sequence; identical to SEQ ID NO: 8164
  Synthetic polynucleotide

SEQ ID NO: 8166 - DNA, 196 bp, Artificial Sequence
  Synthetic polynucleotide
atcatctcaccttgcctcctgcctataggtgtaaagcgcctgcaggacccccccttctgattggctgaagaacccccccttctgattggctgatcgacccccccttctgattggctgagacacccccccttctgattggctgactaacccccccttctgattggctgaactggcgcgccatgcttcatcagactct

SEQ ID NO: 8167 - DNA, 196 bp, Artificial Sequence; identical to SEQ ID NO: 8166
  Synthetic polynucleotide

SEQ ID NO: 8168 - DNA, 183 bp, Artificial Sequence
  Synthetic polynucleotide
atcatctcaccttgcctcctgggagttagtacctgaggcctgcaggcctctgcccttaaccaagatggcggagacctctgcccttaaccaagatggcggtcgcctctgcccttaaccaagatggcgggaccctctgcccttaaccaagatggcggctaggcgcgccatgcttcatcagactct

SEQ ID NO: 8169 - DNA, 183 bp, Artificial Sequence; identical to SEQ ID NO: 8168
  Synthetic polynucleotide

SEQ ID NO: 8170 - DNA, 172 bp, Artificial Sequence
  Synthetic polynucleotide
atcatctcaccttgcctcctgttacgtttgggctggtgcctgcaggcccctggtggagacccctggtggtcgcccctggtgggaccccctggtggctacccctggtggactcccctggtggtgccccctggtgggtacccctggtggggcgcgccatgcttcatcagactct

SEQ ID NO: 8171 - DNA, 172 bp, Artificial Sequence; identical to SEQ ID NO: 8170
  Synthetic polynucleotide

SEQ ID NO: 8172 - DNA, 164 bp, Artificial Sequence
  Synthetic polynucleotide
atcatctcaccttgcctcctgattgttggacaaatccgcctgcaggatttccggtagaatttccggttcgatttccggtgacatttccggtctaatttccggtactatttccggttgcatttccggtgtaatttccggtggcgcgccatgcttcatcagactct

SEQ ID NO: 8173 - DNA, 164 bp, Artificial Sequence; identical to SEQ ID NO: 8172
  Synthetic polynucleotide

SEQ ID NO: 8174 - DNA, 172 bp, Artificial Sequence
  Synthetic polynucleotide
atcatctcaccttgcctcctgatcgttcaaccttccctcctgcaggtatgcattatagatatgcattattcgtatgcattatgactatgcattatctatatgcattatacttatgcattattgctatgcattatgtatatgcattatggcgcgccatgcttcatcagactct

SEQ ID NO: 8175 - DNA, 172 bp, Artificial Sequence; identical to SEQ ID NO: 8174
  Synthetic polynucleotide

SEQ ID NO: 8176 - DNA, 180 bp, Artificial Sequence
  Synthetic polynucleotide
atcatctcaccttgcctcctgtgtaacaagagtcctggcctgcaggtcaatattatcagatcaatattatctcgtcaatattatcgactcaatattatcctatcaatattatcacttcaatattatctgctcaatattatcgtatcaatattatcggcgcgccatgcttcatcagactct

SEQ ID NO: 8177 - DNA, 180 bp, Artificial Sequence; identical to SEQ ID NO: 8176
  Synthetic polynucleotide

SEQ ID NO: 8178 - DNA, 185 bp, Artificial Sequence
  Synthetic polynucleotide
atcatctcaccttgcctcctggtacatgaagcgaccgccctgcaggcattaagtacttaaagagacattaagtacttaaagtcgcattaagtacttaaaggaccattaagtacttaaagctacattaagtacttaaagactcattaagtacttaaagtgcggcgcgccatgcttcatcagactct

SEQ ID NO: 8179 - DNA, 185 bp, Artificial Sequence; identical to SEQ ID NO: 8178
  Synthetic polynucleotide

SEQ ID NO: 8180 - DNA, 188 bp, Artificial Sequence
  Synthetic polynucleotide
atcatctcaccttgcctcctgtgattctgattccactacctgcaggcacttccgggttagacacttccgggtttcgcacttccgggttgaccacttccgggttctacacttccgggttactcacttccgggtttgccacttccgggttgtacacttccgggttggcgcgccatgcttcatcagactct

SEQ ID NO: 8181 - DNA, 188 bp, Artificial Sequence; identical to SEQ ID NO: 8180
  Synthetic polynucleotide

SEQ ID NO: 8182 - DNA, 197 bp, Artificial Sequence
  Synthetic polynucleotide
atcatctcaccttgcctcctgacctgcccttatgccgacctgcagggccgccgccatcttgagagccgccgccatcttgtcggccgccgccatcttggacgccgccgccatcttgctagccgccgccatcttgactgccgccgccatcttgtgcgccgccgccatcttggtaggcgcgccatgcttcatcagactct

SEQ ID NO: 8183 - DNA, 197 bp, Artificial Sequence; identical to SEQ ID NO: 8182
  Synthetic polynucleotide

SEQ ID NO: 8184 - DNA, 196 bp, Artificial Sequence
  Synthetic polynucleotide
atcatctcaccttgcctcctggggcgacgtaattgcgtcctgcaggtacttccgggtttagatacttccgggttttcgtacttccgggtttgactacttccgggtttctatacttccgggtttacttacttccgggttttgctacttccgggtttgtatacttccgggtttggcgcgccatgcttcatcagactct

SEQ ID NO: 8185 - DNA, 196 bp, Artificial Sequence; identical to SEQ ID NO: 8184
  Synthetic polynucleotide

SEQ ID NO: 8186 - DNA, 191 bp, Artificial Sequence
  Synthetic polynucleotide
atcatctcaccttgcctcctgatctattgggaacgcttcctgcagggtaattaccgtaattaaagagtaattaccgtaattaatcggtaattaccgtaattaagacgtaattaccgtaattaactagtaattaccgtaattaaactgtaattaccgtaattaatgcggcgcgccatgcttcatcagactct

SEQ ID NO: 8187 - DNA, 191 bp, Artificial Sequence; identical to SEQ ID NO: 8186
  Synthetic polynucleotide

SEQ ID NO: 8188 - DNA, 191 bp, Artificial Sequence
  Synthetic polynucleotide
atcatctcaccttgcctcctgtcgtcagctgtgagcctcctgcagggaacaataacattgttcagagaacaataacattgttctcggaacaataacattgttcgacgaacaataacattgttcctagaacaataacattgttcactgaacaataacattgttctgcggcgcgccatgcttcatcagactct

SEQ ID NO: 8189 - DNA, 191 bp, Artificial Sequence; identical to SEQ ID NO: 8188
  Synthetic polynucleotide

SEQ ID NO: 8190 - DNA, 196 bp, Artificial Sequence
  Synthetic polynucleotide
atcatctcaccttgcctcctgcctccgttcagtcctaccctgcaggggccccgccccccagaggccccgcccccctcgggccccgccccccgacggccccgccccccctaggccccgccccccactggccccgcccccctgcggccccgccccccgtaggccccgccccccggcgcgccatgcttcatcagactct

SEQ ID NO: 8191 - DNA, 196 bp, Artificial Sequence; identical to SEQ ID NO: 8190
  Synthetic polynucleotide

SEQ ID NO: 8192 - DNA, 190 bp, Artificial Sequence
  Synthetic polynucleotide
atcatctcaccttgcctcctggatcgttcatggcactccctgcaggtacttcctctttttagatacttcctcttttttcgtacttcctctttttgactacttcctctttttctatacttcctctttttacttacttcctcttttttgctacttcctctttttgtaggcgcgccatgcttcatcagactct

SEQ ID NO: 8193 - DNA, 190 bp, Artificial Sequence; identical to SEQ ID NO: 8192
  Synthetic polynucleotide

SEQ ID NO: 8194 - DNA, 172 bp, Artificial Sequence
  Synthetic polynucleotide
atcatctcaccttgcctcctgtcggcacttagtttagccctgcaggaagcacatggagaaagcacatggtcgaagcacatgggacaagcacatggctaaagcacatggactaagcacatggtgcaagcacatgggtaaagcacatggggcgcgccatgcttcatcagactct

SEQ ID NO: 8195 - DNA, 172 bp, Artificial Sequence; identical to SEQ ID NO: 8194
  Synthetic polynucleotide

SEQ ID NO: 8196 - DNA, 190 bp, Artificial Sequence
  Synthetic polynucleotide
atcatctcaccttgcctcctgcgaaactcaacgccctacctgcagggctgtggttttcccagagctgtggttttccctcggctgtggttttcccgacgctgtggttttcccctagctgtggttttcccactgctgtggttttccctgcgctgtggttttcccgtaggcgcgccatgcttcatcagactct

SEQ ID NO: 8197 - DNA, 190 bp, Artificial Sequence; identical to SEQ ID NO: 8196
  Synthetic polynucleotide

SEQ ID NO: 8198 - DNA, 197 bp, Artificial Sequence
  Synthetic polynucleotide
atcatctcaccttgcctcctgcacgatcggagtattagcctgcagggcggccgccatcttgagagcggccgccatcttgtcggcggccgccatcttggacgcggccgccatcttgctagcggccgccatcttgactgcggccgccatcttgtgcgcggccgccatcttggtaggcgcgccatgcttcatcagactct

SEQ ID NO: 8199 - DNA, 197 bp, Artificial Sequence; identical to SEQ ID NO: 8198
  Synthetic polynucleotide

SEQ ID NO: 8200 - DNA, 164 bp, Artificial Sequence
  Synthetic polynucleotide
atcatctcaccttgcctcctgaaagtttagcgcctatgcctgcaggtgattggctagatgattggcttcgtgattggctgactgattggctctatgattggctacttgattggcttgctgattggctgtatgattggctggcgcgccatgcttcatcagactct

SEQ ID NO: 8201 - DNA, 164 bp, Artificial Sequence; identical to SEQ ID NO: 8200
  Synthetic polynucleotide

SEQ ID NO: 8202 - DNA, 190 bp, Artificial Sequence
  Synthetic polynucleotide
atcatctcaccttgcctcctgggccttccggaagacatcctgcaggggccacgcccatttagaggccacgcccattttcgggccacgcccatttgacggccacgcccatttctaggccacgcccatttactggccacgcccattttgcggccacgcccatttgtaggcgcgccatgcttcatcagactct

SEQ ID NO: 8203 - DNA, 190 bp, Artificial Sequence; identical to SEQ ID NO: 8202
  Synthetic polynucleotide

SEQ ID NO: 8204 - DNA, 164 bp, Artificial Sequence
  Synthetic polynucleotide
atcatctcaccttgcctcctgccaacaaggtagacggtcctgcaggcctgtccttagacctgtcctttcgcctgtccttgaccctgtccttctacctgtccttactcctgtcctttgccctgtccttgtacctgtccttggcgcgccatgcttcatcagactct

SEQ ID NO: 8205 - DNA, 164 bp, Artificial Sequence; identical to SEQ ID NO: 8204
  Synthetic polynucleotide

SEQ ID NO: 8206 - DNA, 197 bp, Artificial Sequence
  Synthetic polynucleotide
atcatctcaccttgcctcctgtctggatgatgtagactcctgcaggggcacccaggggtgcagaggcacccaggggtgctcgggcacccaggggtgcgacggcacccaggggtgcctaggcacccaggggtgcactggcacccaggggtgctgcggcacccaggggtgcgtaggcgcgccatgcttcatcagactct

SEQ ID NO: 8207 - DNA, 197 bp, Artificial Sequence; identical to SEQ ID NO: 8206
  Synthetic polynucleotide

SEQ ID NO: 8208 - DNA, 148 bp, Artificial Sequence
  Synthetic polynucleotide
atcatctcaccttgcctcctgcagcattcgaggaacgacctgcaggccaatctagaccaatcttcgccaatctgacccaatctctaccaatctactccaatcttgcccaatctgtaccaatctggcgcgccatgcttcatcagactct

SEQ ID NO: 8209 - DNA, 148 bp, Artificial Sequence; identical to SEQ ID NO: 8208
  Synthetic polynucleotide

SEQ ID NO: 8210 - DNA, 156 bp, Artificial Sequence
  Synthetic polynucleotide
atcatctcaccttgcctcctgtatgcctctcggtcacacctgcaggaaaatagcagaaaaatagctcgaaaatagcgacaaaatagcctaaaaatagcactaaaatagctgcaaaatagcgtaaaaatagcggcgcgccatgcttcatcagactct

SEQ ID NO: 8211 - DNA, 156 bp, Artificial Sequence; identical to SEQ ID NO: 8210
  Synthetic polynucleotide

SEQ ID NO: 8212 - DNA, 190 bp, Artificial Sequence
  Synthetic polynucleotide
atcatctcaccttgcctcctggggcctacatcgggaatcctgcaggttttggcgggaaaaagattttggcgggaaaatcgttttggcgggaaaagacttttggcgggaaaactattttggcgggaaaaactttttggcgggaaaatgcttttggcgggaaaagtaggcgcgccatgcttcatcagactct

SEQ ID NO: 8213 - DNA, 190 bp, Artificial Sequence; identical to SEQ ID NO: 8212
  Synthetic polynucleotide

SEQ ID NO: 8214 - DNA, 172 bp, Artificial Sequence
  Synthetic polynucleotide
atcatctcaccttgcctcctgagcgctaagccgaactccctgcaggaataattataagaaataattatatcgaataattatagacaataattatactaaataattataactaataattatatgcaataattatagtaaataattataggcgcgccatgcttcatcagactct

SEQ ID NO: 8215 - DNA, 172 bp, Artificial Sequence; identical to SEQ ID NO: 8214
  Synthetic polynucleotide

SEQ ID NO: 8216 - DNA, 197 bp, Artificial Sequence
  Synthetic polynucleotide
atcatctcaccttgcctcctgtgagcttaaggaaatagcctgcaggtgccaggaagtaggtcacagatgccaggaagtaggtcactcgtgccaggaagtaggtcacgactgccaggaagtaggtcacctatgccaggaagtaggtcacacttgccaggaagtaggtcactgcggcgcgccatgcttcatcagactct

SEQ ID NO: 8217 - DNA, 197 bp, Artificial Sequence; identical to SEQ ID NO: 8216
  Synthetic polynucleotide

SEQ ID NO: 8218 - DNA, 190 bp, Artificial Sequence
  Synthetic polynucleotide
atcatctcaccttgcctcctgagctctgcaagtaggtacctgcagggtcactgaagcgggagagtcactgaagcgggtcggtcactgaagcggggacgtcactgaagcgggctagtcactgaagcgggactgtcactgaagcgggtgcgtcactgaagcggggtaggcgcgccatgcttcatcagactct

SEQ ID NO: 8219 - DNA, 190 bp, Artificial Sequence; identical to SEQ ID NO: 8218
  Synthetic polynucleotide

SEQ ID NO: 8220 - DNA, 148 bp, Artificial Sequence
  Synthetic polynucleotide
atcatctcaccttgcctcctgaataggcattgtcggaacctgcaggtcacgtgagatcacgtgtcgtcacgtggactcacgtgctatcacgtgacttcacgtgtgctcacgtggtatcacgtgggcgcgccatgcttcatcagactct

SEQ ID NO: 8221 - DNA, 148 bp, Artificial Sequence; identical to SEQ ID NO: 8220
  Synthetic polynucleotide

SEQ ID NO: 8222 - DNA, 172 bp, Artificial Sequence
  Synthetic polynucleotide
atcatctcaccttgcctcctgcactctggaagtaaacacctgcaggtttggcgcgtagatttggcgcgttcgtttggcgcgtgactttggcgcgtctatttggcgcgtacttttggcgcgttgctttggcgcgtgtatttggcgcgtggcgcgccatgcttcatcagactct

SEQ ID NO: 8223 - DNA, 172 bp, Artificial Sequence; identical to SEQ ID NO: 8222
  Synthetic polynucleotide

SEQ ID NO: 8224 - DNA, 196 bp, Artificial Sequence
  Synthetic polynucleotide
atcatctcaccttgcctcctgcaccgcattagatgacacctgcaggggccccgccccctagaggccccgcccccttcgggccccgccccctgacggccccgccccctctaggccccgccccctactggccccgcccccttgcggccccgccccctgtaggccccgccccctggcgcgccatgcttcatcagactct

SEQ ID NO: 8225 - DNA, 196 bp, Artificial Sequence; identical to SEQ ID NO: 8224
  Synthetic polynucleotide

SEQ ID NO: 8226 - DNA, 180 bp, Artificial Sequence
  Synthetic polynucleotide
atcatctcaccttgcctcctggataaactgtaagcaagcctgcagggctctacccagagagctctacccagtcggctctacccaggacgctctacccagctagctctacccagactgctctacccagtgcgctctacccaggtagctctacccagggcgcgccatgcttcatcagactct

SEQ ID NO: 8227 - DNA, 180 bp, Artificial Sequence; identical to SEQ ID NO: 8226
  Synthetic polynucleotide

SEQ ID NO: 8228 - DNA, 164 bp, Artificial Sequence
  Synthetic polynucleotide
atcatctcaccttgcctcctggtttgcgctcgttgacccctgcaggctaatcggtagactaatcggttcgctaatcggtgacctaatcggtctactaatcggtactctaatcggttgcctaatcggtgtactaatcggtggcgcgccatgcttcatcagactct

SEQ ID NO: 8229 - DNA, 164 bp, Artificial Sequence; identical to SEQ ID NO: 8228
  Synthetic polynucleotide

SEQ ID NO: 8230 - DNA, 188 bp, Artificial Sequence
  Synthetic polynucleotide
atcatctcaccttgcctcctgtcctatggcaattccgtcctgcaggaacccggaagtaagaaacccggaagtatcgaacccggaagtagacaacccggaagtactaaacccggaagtaactaacccggaagtatgcaacccggaagtagtaaacccggaagtaggcgcgccatgcttcatcagactct

SEQ ID NO: 8231 - DNA, 188 bp, Artificial Sequence; identical to SEQ ID NO: 8230
  Synthetic polynucleotide

SEQ ID NO: 8232 - DNA, 172 bp, Artificial Sequence
  Synthetic polynucleotide
atcatctcaccttgcctcctgtttgattaactgtgggtcctgcaggaattgctgacagaaattgctgactcgaattgctgacgacaattgctgacctaaattgctgacactaattgctgactgcaattgctgacgtaaattgctgacggcgcgccatgcttcatcagactct

SEQ ID NO: 8233 - DNA, 172 bp, Artificial Sequence; identical to SEQ ID NO: 8232
  Synthetic polynucleotide

SEQ ID NO: 8234 - DNA, 191 bp, Artificial Sequence
  Synthetic polynucleotide
atcatctcaccttgcctcctgtttgaagaatcctgcgtcctgcaggataaattaatcccctccagaataaattaatcccctcctcgataaattaatcccctccgacataaattaatcccctccctaataaattaatcccctccactataaattaatcccctcctgcggcgcgccatgcttcatcagactct

SEQ ID NO: 8235 - DNA, 191 bp, Artificial Sequence; identical to SEQ ID NO: 8234
  Synthetic polynucleotide

SEQ ID NO: 8236 - DNA, 172 bp, Artificial Sequence
  Synthetic polynucleotide
atcatctcaccttgcctcctgatgcatagtgatcctcgcctgcagggtcacgtggcagagtcacgtggctcggtcacgtggcgacgtcacgtggcctagtcacgtggcactgtcacgtggctgcgtcacgtggcgtagtcacgtggcggcgcgccatgcttcatcagactct

SEQ ID NO: 8237 - DNA, 172 bp, Artificial Sequence; identical to SEQ ID NO: 8236
  Synthetic polynucleotide

SEQ ID NO: 8238 - DNA, 188 bp, Artificial Sequence
  Synthetic polynucleotide
atcatctcaccttgcctcctgcgccaacctggtgcattcctgcaggaacccggaagtgagaaacccggaagtgtcgaacccggaagtggacaacccggaagtgctaaacccggaagtgactaacccggaagtgtgcaacccggaagtggtaaacccggaagtgggcgcgccatgcttcatcagactct

SEQ ID NO: 8239 - DNA, 188 bp, Artificial Sequence; identical to SEQ ID NO: 8238
  Synthetic polynucleotide

SEQ ID NO: 8240 - DNA, 185 bp, Artificial Sequence
  Synthetic polynucleotide
atcatctcaccttgcctcctgcttatgtcatggcgtctcctgcaggctcgtgacctttgagaagactcgtgacctttgagatcgctcgtgacctttgagagacctcgtgacctttgagactactcgtgacctttgagaactctcgtgacctttgagatgcggcgcgccatgcttcatcagactct

SEQ ID NO: 8241 - DNA, 185 bp, Artificial Sequence; identical to SEQ ID NO: 8240
  Synthetic polynucleotide

SEQ ID NO: 8242 - DNA, 188 bp, Artificial Sequence
  Synthetic polynucleotide
atcatctcaccttgcctcctggtgtgactgatttcaaccctgcagggggattgcatctagagggattgcatcttcggggattgcatctgacgggattgcatctctagggattgcatctactgggattgcatcttgcgggattgcatctgtagggattgcatctggcgcgccatgcttcatcagactct

SEQ ID NO: 8243 - DNA, 188 bp, Artificial Sequence; identical to SEQ ID NO: 8242
  Synthetic polynucleotide

SEQ ID NO: 8244 - DNA, 188 bp, Artificial Sequence
  Synthetic polynucleotide
atcatctcaccttgcctcctgctgcctggattattacccctgcagggttgccagggaaagagttgccagggaatcggttgccagggaagacgttgccagggaactagttgccagggaaactgttgccagggaatgcgttgccagggaagtagttgccagggaaggcgcgccatgcttcatcagactct

SEQ ID NO: 8245 - DNA, 188 bp, Artificial Sequence; identical to SEQ ID NO: 8244
  Synthetic polynucleotide

SEQ ID NO: 8246 - DNA, 190 bp, Artificial Sequence
  Synthetic polynucleotide
atcatctcaccttgcctcctggatcatgtatgcagagccctgcaggtgaatgactattcaagatgaatgactattcatcgtgaatgactattcagactgaatgactattcactatgaatgactattcaacttgaatgactattcatgctgaatgactattcagtaggcgcgccatgcttcatcagactct

SEQ ID NO: 8247 - DNA, 190 bp, Artificial Sequence; identical to SEQ ID NO: 8246
  Synthetic polynucleotide

SEQ ID NO: 8248 - DNA, 191 bp, Artificial Sequence
  Synthetic polynucleotide
atcatctcaccttgcctcctgtcatctaccaaattgagcctgcagggaattttaattaaacccagagaattttaattaaaccctcggaattttaattaaacccgacgaattttaattaaacccctagaattttaattaaacccactgaattttaattaaaccctgcggcgcgccatgcttcatcagactct

SEQ ID NO: 8249 - DNA, 191 bp, Artificial Sequence; identical to SEQ ID NO: 8248
  Synthetic polynucleotide

SEQ ID NO: 8250 - DNA, 197 bp, Artificial Sequence
  Synthetic polynucleotide
atcatctcaccttgcctcctgagaccgtgcaaggtttacctgcaggtgccctgaggcaatgagatgccctgaggcaatgtcgtgccctgaggcaatggactgccctgaggcaatgctatgccctgaggcaatgacttgccctgaggcaatgtgctgccctgaggcaatggtaggcgcgccatgcttcatcagactct

SEQ ID NO: 8251 - DNA, 197 bp, Artificial Sequence; identical to SEQ ID NO: 8250
  Synthetic polynucleotide

SEQ ID NO: 8252 - DNA, 185 bp, Artificial Sequence
  Synthetic polynucleotide
atcatctcaccttgcctcctgttattggcgtctcctggcctgcagggctaattataattatcagagctaattataattatctcggctaattataattatcgacgctaattataattatcctagctaattataattatcactgctaattataattatctgcggcgcgccatgcttcatcagactct

SEQ ID NO: 8253 - DNA, 185 bp, Artificial Sequence; identical to SEQ ID NO: 8252
  Synthetic polynucleotide

SEQ ID NO: 8254 - DNA, 180 bp, Artificial Sequence
  Synthetic polynucleotide
atcatctcaccttgcctcctgacaccattggtaccactcctgcaggggccccacccaagaggccccacccatcgggccccacccagacggccccacccactaggccccacccaactggccccacccatgcggccccacccagtaggccccacccaggcgcgccatgcttcatcagactct

SEQ ID NO: 8255 - DNA, 180 bp, Artificial Sequence; identical to SEQ ID NO: 8254
  Synthetic polynucleotide

SEQ ID NO: 8256 - DNA, 180 bp, Artificial Sequence
  Synthetic polynucleotide
atcatctcaccttgcctcctgtctcactattggagcatcctgcaggtttattagggaagatttattagggatcgtttattagggagactttattagggactatttattagggaacttttattagggatgctttattagggagtatttattagggaggcgcgccatgcttcatcagactct

SEQ ID NO: 8257 - DNA, 180 bp, Artificial Sequence; identical to SEQ ID NO: 8256
  Synthetic polynucleotide

SEQ ID NO: 8258 - DNA, 197 bp, Artificial Sequence
  Synthetic polynucleotide
atcatctcaccttgcctcctgcgaaacgcccgtgttaccctgcaggatcgataaaattatcgatagaatcgataaaattatcgattcgatcgataaaattatcgatgacatcgataaaattatcgatctaatcgataaaattatcgatactatcgataaaattatcgattgcggcgcgccatgcttcatcagactct

SEQ ID NO: 8259 - DNA, 197 bp, Artificial Sequence; identical to SEQ ID NO: 8258
  Synthetic polynucleotide

SEQ ID NO: 8260 - DNA, 191 bp, Artificial Sequence
  Synthetic polynucleotide
atcatctcaccttgcctcctgtaacacgctctagaggtcctgcaggaggtcatgcaaaggtcaagaaggtcatgcaaaggtcatcgaggtcatgcaaaggtcagacaggtcatgcaaaggtcactaaggtcatgcaaaggtcaactaggtcatgcaaaggtcatgcggcgcgccatgcttcatcagactct

SEQ ID NO: 8261 - DNA, 191 bp, Artificial Sequence; identical to SEQ ID NO: 8260
  Synthetic polynucleotide

SEQ ID NO: 8262 - DNA, 172 bp, Artificial Sequence
  Synthetic polynucleotide
atcatctcaccttgcctcctgtcgaggtcctttattgccctgcaggtctcccacgcagatctcccacgctcgtctcccacgcgactctcccacgcctatctcccacgcacttctcccacgctgctctcccacgcgtatctcccacgcggcgcgccatgcttcatcagactct

SEQ ID NO: 8263 - DNA, 172 bp, Artificial Sequence; identical to SEQ ID NO: 8262
  Synthetic polynucleotide

SEQ ID NO: 8264 - DNA, 185 bp, Artificial Sequence
  Synthetic polynucleotide
atcatctcaccttgcctcctgacatagtttccggcgcgcctgcaggagagttatttttagagagaagagttatttttagagtcgagagttatttttagaggacagagttatttttagagctaagagttatttttagagactagagttatttttagagtgcggcgcgccatgcttcatcagactct

SEQ ID NO: 8265 - DNA, 185 bp, Artificial Sequence; identical to SEQ ID NO: 8264
  Synthetic polynucleotide

SEQ ID NO: 8266 - DNA, 191 bp, Artificial Sequence
  Synthetic polynucleotide
atcatctcaccttgcctcctggaagatccaccgtcccacctgcaggaaaatatgcataataaaagaaaaatatgcataataaatcgaaaatatgcataataaagacaaaatatgcataataaactaaaaatatgcataataaaactaaaatatgcataataaatgcggcgcgccatgcttcatcagactct

SEQ ID NO: 8267 - DNA, 191 bp, Artificial Sequence; identical to SEQ ID NO: 8266
  Synthetic polynucleotide

SEQ ID NO: 8268 - DNA, 172 bp, Artificial Sequence
  Synthetic polynucleotide
atcatctcaccttgcctcctgctgaaaccaagtgctctcctgcaggggtcacgtacagaggtcacgtactcgggtcacgtacgacggtcacgtacctaggtcacgtacactggtcacgtactgcggtcacgtacgtaggtcacgtacggcgcgccatgcttcatcagactct

SEQ ID NO: 8269 - DNA, 172 bp, Artificial Sequence; identical to SEQ ID NO: 8268
  Synthetic polynucleotide

SEQ ID NO: 8270 - DNA, 156 bp, Artificial Sequence
  Synthetic polynucleotide
atcatctcaccttgcctcctgactgttgccaagccaggcctgcaggtggcaaccagatggcaacctcgtggcaaccgactggcaaccctatggcaaccacttggcaacctgctggcaaccgtatggcaaccggcgcgccatgcttcatcagactct

SEQ ID NO: 8271 - DNA, 156 bp, Artificial Sequence; identical to SEQ ID NO: 8270
  Synthetic polynucleotide

SEQ ID NO: 8272 - DNA, 190 bp, Artificial Sequence
  Synthetic polynucleotide
atcatctcaccttgcctcctgggcgttatgacttaagtcctgcagggagttccaggtcagagagagttccaggtcagtcggagttccaggtcaggacgagttccaggtcagctagagttccaggtcagactgagttccaggtcagtgcgagttccaggtcaggtaggcgcgccatgcttcatcagactct

SEQ ID NO: 8273 - DNA, 190 bp, Artificial Sequence; identical to SEQ ID NO: 8272
  Synthetic polynucleotide

SEQ ID NO: 8274 - DNA, 180 bp, Artificial Sequence
  Synthetic polynucleotide
atcatctcaccttgcctcctgggactgtttagctctatcctgcaggccgcagctggcagaccgcagctggctcgccgcagctggcgacccgcagctggcctaccgcagctggcactccgcagctggctgcccgcagctggcgtaccgcagctggcggcgcgccatgcttcatcagactct

SEQ ID NO: 8275 - DNA, 180 bp, Artificial Sequence; identical to SEQ ID NO: 8274
  Synthetic polynucleotide

SEQ ID NO: 8276 - DNA, 188 bp, Artificial Sequence
  Synthetic polynucleotide
atcatctcaccttgcctcctgccagcccgaatgcattccctgcaggaaacaaacatccagaaaacaaacatcctcgaaacaaacatccgacaaacaaacatccctaaaacaaacatccactaaacaaacatcctgcaaacaaacatccgtaaaacaaacatccggcgcgccatgcttcatcagactct

SEQ ID NO: 8277 - DNA, 188 bp, Artificial Sequence; identical to SEQ ID NO: 8276
  Synthetic polynucleotide

SEQ ID NO: 8278 - DNA, 156 bp, Artificial Sequence
  Synthetic polynucleotide
atcatctcaccttgcctcctgccgagtcggaacttgcacctgcagggccataaaagagccataaatcggccataaagacgccataaactagccataaaactgccataaatgcgccataaagtagccataaaggcgcgccatgcttcatcagactct

SEQ ID NO: 8279 - DNA, 156 bp, Artificial Sequence; identical to SEQ ID NO: 8278
  Synthetic polynucleotide

SEQ ID NO: 8280 - DNA, 188 bp, Artificial Sequence
  Synthetic polynucleotide
atcatctcaccttgcctcctgtgagtcgggtgctactccctgcaggcattgtgtccgtagacattgtgtccgttcgcattgtgtccgtgaccattgtgtccgtctacattgtgtccgtactcattgtgtccgttgccattgtgtccgtgtacattgtgtccgtggcgcgccatgcttcatcagactct

SEQ ID NO: 8281 - DNA, 188 bp, Artificial Sequence; identical to SEQ ID NO: 8280
  Synthetic polynucleotide

SEQ ID NO: 8282 - DNA, 197 bp, Artificial Sequence
  Synthetic polynucleotide
atcatctcaccttgcctcctgatcgccgaccgttaacccctgcaggaagtaggtcaaaggtcacagaaagtaggtcaaaggtcactcgaagtaggtcaaaggtcacgacaagtaggtcaaaggtcacctaaagtaggtcaaaggtcacactaagtaggtcaaaggtcactgcggcgcgccatgcttcatcagactct

SEQ ID NO: 8283 - DNA, 197 bp, Artificial Sequence; identical to SEQ ID NO: 8282
  Synthetic polynucleotide

SEQ ID NO: 8284 - DNA, 196 bp, Artificial Sequence
  Synthetic polynucleotide
atcatctcaccttgcctcctgagaagcgccctatgcgtcctgcaggaggtcattaacccagaaggtcattaaccctcgaggtcattaacccgacaggtcattaacccctaaggtcattaacccactaggtcattaaccctgcaggtcattaacccgtaaggtcattaacccggcgcgccatgcttcatcagactct

SEQ ID NO: 8285 - DNA, 196 bp, Artificial Sequence; identical to SEQ ID NO: 8284
  Synthetic polynucleotide

SEQ ID NO: 8286 - DNA, 196 bp, Artificial Sequence
  Synthetic polynucleotide
atcatctcaccttgcctcctgccacataactttagagtcctgcaggaacatgtataaaaagaaacatgtataaaatcgaacatgtataaaagacaacatgtataaaactaaacatgtataaaaactaacatgtataaaatgcaacatgtataaaagtaaacatgtataaaaggcgcgccatgcttcatcagactct

SEQ ID NO: 8287 - DNA, 196 bp, Artificial Sequence; identical to SEQ ID NO: 8286
  Synthetic polynucleotide

SEQ ID NO: 8288 - DNA, 156 bp, Artificial Sequence
  Synthetic polynucleotide
atcatctcaccttgcctcctgttgtctgcgctactattcctgcagggtcacgcaagagtcacgcatcggtcacgcagacgtcacgcactagtcacgcaactgtcacgcatgcgtcacgcagtagtcacgcaggcgcgccatgcttcatcagactct

SEQ ID NO: 8289 - DNA, 156 bp, Artificial Sequence; identical to SEQ ID NO: 8288
  Synthetic polynucleotide

SEQ ID NO: 8290 - DNA, 180 bp, Artificial Sequence
  Synthetic polynucleotide
atcatctcaccttgcctcctggccagaccgcctataatcctgcaggggccataaaaaagaggccataaaaatcgggccataaaaagacggccataaaaactaggccataaaaaactggccataaaaatgcggccataaaaagtaggccataaaaaggcgcgccatgcttcatcagactct

SEQ ID NO: 8291 - DNA, 180 bp, Artificial Sequence; identical to SEQ ID NO: 8290
  Synthetic polynucleotide

SEQ ID NO: 8292 - DNA, 196 bp, Artificial Sequence
  Synthetic polynucleotide
atcatctcaccttgcctcctggtccataattctaggatcctgcaggttaattagattagagattaattagattagtcgttaattagattaggacttaattagattagctattaattagattagactttaattagattagtgcttaattagattaggtattaattagattagggcgcgccatgcttcatcagactct

SEQ ID NO: 8293 - DNA, 196 bp, Artificial Sequence; identical to SEQ ID NO: 8292
  Synthetic polynucleotide

SEQ ID NO: 8294 - DNA, 172 bp, Artificial Sequence
  Synthetic polynucleotide
atcatctcaccttgcctcctggtttgaaactaggcgatcctgcaggatttccgggtagaatttccgggttcgatttccgggtgacatttccgggtctaatttccgggtactatttccgggttgcatttccgggtgtaatttccgggtggcgcgccatgcttcatcagactct

SEQ ID NO: 8295 - DNA, 172 bp, Artificial Sequence; identical to SEQ ID NO: 8294
  Synthetic polynucleotide

SEQ ID NO: 8296 - DNA, 185 bp, Artificial Sequence
  Synthetic polynucleotide
atcatctcaccttgcctcctgcaattgcccgagtcattcctgcaggtgtttatttacttaccagatgtttatttacttacctcgtgtttatttacttaccgactgtttatttacttaccctatgtttatttacttaccacttgtttatttacttacctgcggcgcgccatgcttcatcagactct

SEQ ID NO: 8297 - DNA, 185 bp, Artificial Sequence; identical to SEQ ID NO: 8296
  Synthetic polynucleotide

SEQ ID NO: 8298 - DNA, 180 bp, Artificial Sequence
  Synthetic polynucleotide
atcatctcaccttgcctcctgtcgcaagacacgacaaccctgcaggagacaagataaagaagacaagataatcgagacaagataagacagacaagataactaagacaagataaactagacaagataatgcagacaagataagtaagacaagataaggcgcgccatgcttcatcagactct

SEQ ID NO: 8299 - DNA, 180 bp, Artificial Sequence; identical to SEQ ID NO: 8298
  Synthetic polynucleotide

SEQ ID NO: 8300 - DNA, 197 bp, Artificial Sequence
  Synthetic polynucleotide
atcatctcaccttgcctcctgccgctgataacacttagcctgcaggaggtgtgaagtcacacctagaaggtgtgaagtcacaccttcgaggtgtgaagtcacacctgacaggtgtgaagtcacacctctaaggtgtgaagtcacacctactaggtgtgaagtcacaccttgcggcgcgccatgcttcatcagactct

SEQ ID NO: 8301 - DNA, 197 bp, Artificial Sequence; identical to SEQ ID NO: 8300
  Synthetic polynucleotide

SEQ ID NO: 8302 - DNA, 164 bp, Artificial Sequence
  Synthetic polynucleotide
atcatctcaccttgcctcctgagtgataccctgcagtacctgcaggtcacgtgacagatcacgtgactcgtcacgtgacgactcacgtgacctatcacgtgacacttcacgtgactgctcacgtgacgtatcacgtgacggcgcgccatgcttcatcagactct

SEQ ID NO: 8303 - DNA, 164 bp, Artificial Sequence; identical to SEQ ID NO: 8302
  Synthetic polynucleotide

SEQ ID NO: 8304 - DNA, 190 bp, Artificial Sequence
  Synthetic polynucleotide
atcatctcaccttgcctcctgaagtacatcctccctttcctgcaggggccacgcccacttagaggccacgcccactttcgggccacgcccacttgacggccacgcccacttctaggccacgcccacttactggccacgcccactttgcggccacgcccacttgtaggcgcgccatgcttcatcagactct

SEQ ID NO: 8305 - DNA, 190 bp, Artificial Sequence; identical to SEQ ID NO: 8304
  Synthetic polynucleotide

SEQ ID NO: 8306 - DNA, 200 bp, Artificial Sequence
  Synthetic polynucleotide
atcatctcaccttgcctcctgctcggttcactttcgcccctgcaggcgttgacctttgacctttaagacgttgacctttgacctttatcgcgttgacctttgacctttagaccgttgacctttgacctttactacgttgacctttgacctttaactcgttgacctttgacctttaggcgcgccatgcttcatcagactct

SEQ ID NO: 8307 - DNA, 200 bp, Artificial Sequence; identical to SEQ ID NO: 8306
  Synthetic polynucleotide

SEQ ID NO: 8308 - DNA, 197 bp, Artificial Sequence
  Synthetic polynucleotide
atcatctcaccttgcctcctgtacacaggccctgaagtcctgcaggatcgataattttatcgatagaatcgataattttatcgattcgatcgataattttatcgatgacatcgataattttatcgatctaatcgataattttatcgatactatcgataattttatcgattgcggcgcgccatgcttcatcagactct

SEQ ID NO: 8309 - DNA, 197 bp, Artificial Sequence; identical to SEQ ID NO: 8308
  Synthetic polynucleotide

SEQ ID NO: 8310 - DNA, 172 bp, Artificial Sequence
  Synthetic polynucleotide
atcatctcaccttgcctcctgttaacggagctgtacctcctgcaggattgtgcaatagaattgtgcaattcgattgtgcaatgacattgtgcaatctaattgtgcaatactattgtgcaattgcattgtgcaatgtaattgtgcaatggcgcgccatgcttcatcagactct

SEQ ID NO: 8311 - DNA, 172 bp, Artificial Sequence; identical to SEQ ID NO: 8310
  Synthetic polynucleotide

SEQ ID NO: 8312 - DNA, 172 bp, Artificial Sequence
  Synthetic polynucleotide
atcatctcaccttgcctcctggataatagcggccatggcctgcagggggcgcggggagagggcgcggggtcggggcgcgggggacgggcgcggggctagggcgcggggactgggcgcggggtgcgggcgcgggggtagggcgcggggggcgcgccatgcttcatcagactct

SEQ ID NO: 8313 - DNA, 172 bp, Artificial Sequence; identical to SEQ ID NO: 8312
  Synthetic polynucleotide

SEQ ID NO: 8314 - DNA, 164 bp, Artificial Sequence
  Synthetic polynucleotide
atcatctcaccttgcctcctgctgagccagtataacttcctgcaggaacaggtgtagaaacaggtgttcgaacaggtgtgacaacaggtgtctaaacaggtgtactaacaggtgttgcaacaggtgtgtaaacaggtgtggcgcgccatgcttcatcagactct

SEQ ID NO: 8315 - DNA, 164 bp, Artificial Sequence; identical to SEQ ID NO: 8314
  Synthetic polynucleotide

SEQ ID NO: 8316 - DNA, 190 bp, Artificial Sequence
  Synthetic polynucleotide
atcatctcaccttgcctcctgggaatatgcgcatcaagcctgcaggtatgaccttgatctagatatgaccttgatcttcgtatgaccttgatctgactatgaccttgatctctatatgaccttgatctacttatgaccttgatcttgctatgaccttgatctgtaggcgcgccatgcttcatcagactct

SEQ ID NO: 8317 - DNA, 190 bp, Artificial Sequence; identical to SEQ ID NO: 8316
  Synthetic polynucleotide

SEQ ID NO: 8318 - DNA, 172 bp, Artificial Sequence
  Synthetic polynucleotide
atcatctcaccttgcctcctggagcgtgccacctaactcctgcaggtaccccccacagataccccccactcgtaccccccacgactaccccccacctataccccccacacttaccccccactgctaccccccacgtataccccccacggcgcgccatgcttcatcagactct

SEQ ID NO: 8319 - DNA, 172 bp, Artificial Sequence; identical to SEQ ID NO: 8318
  Synthetic polynucleotide

SEQ ID NO: 8320 - DNA, 172 bp, Artificial Sequence
  Synthetic polynucleotide
atcatctcaccttgcctcctgcagttgtctacattactcctgcagggacaggtggtagagacaggtggttcggacaggtggtgacgacaggtggtctagacaggtggtactgacaggtggttgcgacaggtggtgtagacaggtggtggcgcgccatgcttcatcagactct

SEQ ID NO: 8321 - DNA, 172 bp, Artificial Sequence; identical to SEQ ID NO: 8320
  Synthetic polynucleotide

SEQ ID NO: 8322 - DNA, 172 bp, Artificial Sequence
  Synthetic polynucleotide
atcatctcaccttgcctcctggaaacggttctccacgacctgcagggatgagtcatagagatgagtcattcggatgagtcatgacgatgagtcatctagatgagtcatactgatgagtcattgcgatgagtcatgtagatgagtcatggcgcgccatgcttcatcagactct

SEQ ID NO: 8323 - DNA, 172 bp, Artificial Sequence; identical to SEQ ID NO: 8322
  Synthetic polynucleotide

SEQ ID NO: 8324 - DNA, 180 bp, Artificial Sequence
  Synthetic polynucleotide
atcatctcaccttgcctcctggtttcttcgctgagttacctgcaggaccgccattttagaaccgccatttttcgaccgccattttgacaccgccattttctaaccgccattttactaccgccatttttgcaccgccattttgtaaccgccattttggcgcgccatgcttcatcagactct

SEQ ID NO: 8325 - DNA, 180 bp, Artificial Sequence; identical to SEQ ID NO: 8324
  Synthetic polynucleotide

SEQ ID NO: 8326 - DNA, 196 bp, Artificial Sequence
  Synthetic polynucleotide
atcatctcaccttgcctcctgggctatgatgtagccgtcctgcaggttgattaaattagagattgattaaattagtcgttgattaaattaggacttgattaaattagctattgattaaattagactttgattaaattagtgcttgattaaattaggtattgattaaattagggcgcgccatgcttcatcagactct

SEQ ID NO: 8327 - DNA, 196 bp, Artificial Sequence; identical to SEQ ID NO: 8326
  Synthetic polynucleotide

SEQ ID NO: 8328 - DNA, 164 bp, Artificial Sequence
  Synthetic polynucleotide
atcatctcaccttgcctcctgcagtaggtttgaatctgcctgcaggatgagtcatagaatgagtcattcgatgagtcatgacatgagtcatctaatgagtcatactatgagtcattgcatgagtcatgtaatgagtcatggcgcgccatgcttcatcagactct

SEQ ID NO: 8329 - DNA, 164 bp, Artificial Sequence; identical to SEQ ID NO: 8328
  Synthetic polynucleotide

SEQ ID NO: 8330 - DNA, 197 bp, Artificial Sequence
  Synthetic polynucleotide
atcatctcaccttgcctcctgtccgggacggtttcgttcctgcaggatcaatgcaattgatagaatcaatgcaattgattcgatcaatgcaattgatgacatcaatgcaattgatctaatcaatgcaattgatactatcaatgcaattgattgcatcaatgcaattgatgtaggcgcgccatgcttcatcagactct

SEQ ID NO: 8331 - DNA, 197 bp, Artificial Sequence; identical to SEQ ID NO: 8330
  Synthetic polynucleotide

SEQ ID NO: 8332 - DNA, 197 bp, Artificial Sequence
  Synthetic polynucleotide
atcatctcaccttgcctcctgaaatgggatttgaccagcctgcaggctctcgcgagatctgagactctcgcgagatctgtcgctctcgcgagatctggacctctcgcgagatctgctactctcgcgagatctgactctctcgcgagatctgtgcctctcgcgagatctggtaggcgcgccatgcttcatcagactct

SEQ ID NO: 8333 - DNA, 197 bp, Artificial Sequence; identical to SEQ ID NO: 8332
  Synthetic polynucleotide

SEQ ID NO: 8334 - DNA, 196 bp, Artificial Sequence
  Synthetic polynucleotide
atcatctcaccttgcctcctgtctcttcgtcagcagctcctgcaggctttcccgcccccagactttcccgccccctcgctttcccgcccccgacctttcccgcccccctactttcccgcccccactctttcccgccccctgcctttcccgcccccgtactttcccgcccccggcgcgccatgcttcatcagactct

SEQ ID NO: 8335 - DNA, 196 bp, Artificial Sequence; identical to SEQ ID NO: 8334
  Synthetic polynucleotide

SEQ ID NO: 8336 - DNA, 172 bp, Artificial Sequence
  Synthetic polynucleotide
atcatctcaccttgcctcctgctggtcacttgctgggacctgcaggtttcctggaaagatttcctggaatcgtttcctggaagactttcctggaactatttcctggaaacttttcctggaatgctttcctggaagtatttcctggaaggcgcgccatgcttcatcagactct

SEQ ID NO: 8337 - DNA, 172 bp, Artificial Sequence; identical to SEQ ID NO: 8336
  Synthetic polynucleotide

SEQ ID NO: 8338 - DNA, 196 bp, Artificial Sequence
  Synthetic polynucleotide
atcatctcaccttgcctcctgtccgttgttgtctaacccctgcaggaggggatttccaaagaaggggatttccaatcgaggggatttccaagacaggggatttccaactaaggggatttccaaactaggggatttccaatgcaggggatttccaagtaaggggatttccaaggcgcgccatgcttcatcagactct

SEQ ID NO: 8339 - DNA, 196 bp, Artificial Sequence; identical to SEQ ID NO: 8338
  Synthetic polynucleotide

SEQ ID NO: 8340 - DNA, 185 bp, Artificial Sequence
  Synthetic polynucleotide
atcatctcaccttgcctcctgccgacttccgcgttagtcctgcaggattttattgttctaaaagaattttattgttctaaatcgattttattgttctaaagacattttattgttctaaactaattttattgttctaaaactattttattgttctaaatgcggcgcgccatgcttcatcagactct

SEQ ID NO: 8341 - DNA, 185 bp, Artificial Sequence; identical to SEQ ID NO: 8340
  Synthetic polynucleotide

SEQ ID NO: 8342 - DNA, 191 bp, Artificial Sequence
  Synthetic polynucleotide
atcatctcaccttgcctcctgtgcaatatcgtggcatacctgcaggaatcaataacattgatcagaaatcaataacattgatctcgaatcaataacattgatcgacaatcaataacattgatcctaaatcaataacattgatcactaatcaataacattgatctgcggcgcgccatgcttcatcagactct

SEQ ID NO: 8343 - DNA, 191 bp, Artificial Sequence; identical to SEQ ID NO: 8342
  Synthetic polynucleotide

SEQ ID NO: 8344 - DNA, 180 bp, Artificial Sequence
  Synthetic polynucleotide
atcatctcaccttgcctcctgataaaccgtaacgaaagcctgcaggataaggaagtaagaataaggaagtatcgataaggaagtagacataaggaagtactaataaggaagtaactataaggaagtatgcataaggaagtagtaataaggaagtaggcgcgccatgcttcatcagactct

SEQ ID NO: 8345 - DNA, 180 bp, Artificial Sequence; identical to SEQ ID NO: 8344
  Synthetic polynucleotide

SEQ ID NO: 8346 - DNA, 180 bp, Artificial Sequence
  Synthetic polynucleotide
atcatctcaccttgcctcctgcggtccaatgcaccacacctgcaggggggaatccccagaggggaatcccctcgggggaatccccgacggggaatccccctaggggaatccccactggggaatcccctgcggggaatccccgtaggggaatccccggcgcgccatgcttcatcagactct

SEQ ID NO: 8347 - DNA, 180 bp, Artificial Sequence; identical to SEQ ID NO: 8346
  Synthetic polynucleotide

SEQ ID NO: 8348 - DNA, 156 bp, Artificial Sequence
  Synthetic polynucleotide
atcatctcaccttgcctcctgagcgaatcaggagtaggcctgcaggcttaatgaagacttaatgatcgcttaatgagaccttaatgactacttaatgaactcttaatgatgccttaatgagtacttaatgaggcgcgccatgcttcatcagactct

SEQ ID NO: 8349 - DNA, 156 bp, Artificial Sequence; identical to SEQ ID NO: 8348
  Synthetic polynucleotide

SEQ ID NO: 8350 - DNA, 191 bp, Artificial Sequence
  Synthetic polynucleotide
atcatctcaccttgcctcctgcatttccagaacttctacctgcaggtgagggggattaactatagatgagggggattaactattcgtgagggggattaactatgactgagggggattaactatctatgagggggattaactatacttgagggggattaactattgcggcgcgccatgcttcatcagactct

SEQ ID NO: 8351 - DNA, 191 bp, Artificial Sequence; identical to SEQ ID NO: 8350
  Synthetic polynucleotide

SEQ ID NO: 8352 - DNA, 164 bp, Artificial Sequence
  Synthetic polynucleotide
atcatctcaccttgcctcctgcgttaactcggtgtagacctgcaggggcaggtggagaggcaggtggtcgggcaggtgggacggcaggtggctaggcaggtggactggcaggtggtgcggcaggtgggtaggcaggtggggcgcgccatgcttcatcagactct

SEQ ID NO: 8353 - DNA, 164 bp, Artificial Sequence; identical to SEQ ID NO: 8352
  Synthetic polynucleotide

SEQ ID NO: 8354 - DNA, 185 bp, Artificial Sequence
  Synthetic polynucleotide
atcatctcaccttgcctcctgcataaacgcacaagctgcctgcaggggtaggttggcatagtagaggtaggttggcatagttcgggtaggttggcatagtgacggtaggttggcatagtctaggtaggttggcatagtactggtaggttggcatagttgcggcgcgccatgcttcatcagactct

SEQ ID NO: 8355 - DNA, 185 bp, Artificial Sequence; identical to SEQ ID NO: 8354
  Synthetic polynucleotide

SEQ ID NO: 8356 - DNA, 191 bp, Artificial Sequence
  Synthetic polynucleotide
atcatctcaccttgcctcctgtaaggtgttctcacatacctgcaggcaattcttatctctataagacaattcttatctctatatcgcaattcttatctctatagaccaattcttatctctatactacaattcttatctctataactcaattcttatctctatatgcggcgcgccatgcttcatcagactct

SEQ ID NO: 8357 - DNA, 191 bp, Artificial Sequence; identical to SEQ ID NO: 8356
  Synthetic polynucleotide

SEQ ID NO: 8358 - DNA, 196 bp, Artificial Sequence
  Synthetic polynucleotide
atcatctcaccttgcctcctggattaagttacctttggcctgcaggttaattagattaaagattaattagattaatcgttaattagattaagacttaattagattaactattaattagattaaactttaattagattaatgcttaattagattaagtattaattagattaaggcgcgccatgcttcatcagactct

SEQ ID NO: 8359 - DNA, 196 bp, Artificial Sequence; identical to SEQ ID NO: 8358
  Synthetic polynucleotide

SEQ ID NO: 8360 - DNA, 180 bp, Artificial Sequence
  Synthetic polynucleotide
atcatctcaccttgcctcctgtaagcagttgcctgaagcctgcaggtgtaatcccaaagatgtaatcccaatcgtgtaatcccaagactgtaatcccaactatgtaatcccaaacttgtaatcccaatgctgtaatcccaagtatgtaatcccaaggcgcgccatgcttcatcagactct

SEQ ID NO: 8361 - DNA, 180 bp, Artificial Sequence; identical to SEQ ID NO: 8360
  Synthetic polynucleotide

SEQ ID NO: 8362 - DNA, 148 bp, Artificial Sequence
  Synthetic polynucleotide
atcatctcaccttgcctcctgttgacaacgcgctatgtcctgcaggctaatgaagactaatgatcgctaatgagacctaatgactactaatgaactctaatgatgcctaatgagtactaatgaggcgcgccatgcttcatcagactct

SEQ ID NO: 8363 - DNA, 148 bp, Artificial Sequence; identical to SEQ ID NO: 8362
  Synthetic polynucleotide

SEQ ID NO: 8364 - DNA, 164 bp, Artificial Sequence
  Synthetic polynucleotide
atcatctcaccttgcctcctgtatccagttactgggtgcctgcaggatgagtcagagaatgagtcagtcgatgagtcaggacatgagtcagctaatgagtcagactatgagtcagtgcatgagtcaggtaatgagtcagggcgcgccatgcttcatcagactct

SEQ ID NO: 8365 - DNA, 164 bp, Artificial Sequence; identical to SEQ ID NO: 8364
  Synthetic polynucleotide

SEQ ID NO: 8366 - DNA, 180 bp, Artificial Sequence
  Synthetic polynucleotide
atcatctcaccttgcctcctggcccgcggtaataaggtcctgcagggttatgtaacaagagttatgtaacatcggttatgtaacagacgttatgtaacactagttatgtaacaactgttatgtaacatgcgttatgtaacagtagttatgtaacaggcgcgccatgcttcatcagactct

SEQ ID NO: 8367 - DNA, 180 bp, Artificial Sequence; identical to SEQ ID NO: 8366
  Synthetic polynucleotide

SEQ ID NO: 8368 - DNA, 172 bp, Artificial Sequence
  Synthetic polynucleotide
atcatctcaccttgcctcctgggcacaaagatagcctacctgcagggggggtggggagagggggtggggtcggggggtgggggacgggggtggggctagggggtggggactgggggtggggtgcgggggtgggggtagggggtggggggcgcgccatgcttcatcagactct

SEQ ID NO: 8369 - DNA, 172 bp, Artificial Sequence; identical to SEQ ID NO: 8368
  Synthetic polynucleotide

SEQ ID NO: 8370 - DNA, 180 bp, Artificial Sequence
  Synthetic polynucleotide
atcatctcaccttgcctcctgcctacaagctggactcgcctgcaggaaatcactgcaagaaaatcactgcatcgaaatcactgcagacaaatcactgcactaaaatcactgcaactaaatcactgcatgcaaatcactgcagtaaaatcactgcaggcgcgccatgcttcatcagactct

SEQ ID NO: 8371 - DNA, 180 bp, Artificial Sequence; identical to SEQ ID NO: 8370
  Synthetic polynucleotide

SEQ ID NO: 8372 - DNA, 172 bp, Artificial Sequence
  Synthetic polynucleotide
atcatctcaccttgcctcctgcttgggcaaacacgcctcctgcagggatgagtcagagagatgagtcagtcggatgagtcaggacgatgagtcagctagatgagtcagactgatgagtcagtgcgatgagtcaggtagatgagtcagggcgcgccatgcttcatcagactct

SEQ ID NO: 8373 - DNA, 172 bp, Artificial Sequence; identical to SEQ ID NO: 8372
  Synthetic polynucleotide

SEQ ID NO: 8374 - DNA, 164 bp, Artificial Sequence
  Synthetic polynucleotide
atcatctcaccttgcctcctgcactaaactcgagtagccctgcaggtggcagttgagatggcagttgtcgtggcagttggactggcagttgctatggcagttgacttggcagttgtgctggcagttggtatggcagttgggcgcgccatgcttcatcagactct

SEQ ID NO: 8375 - DNA, 164 bp, Artificial Sequence; identical to SEQ ID NO: 8374
  Synthetic polynucleotide

SEQ ID NO: 8376 - DNA, 172 bp, Artificial Sequence
  Synthetic polynucleotide
atcatctcaccttgcctcctgggtttcgtgggacctcacctgcaggagtaattaacagaagtaattaactcgagtaattaacgacagtaattaacctaagtaattaacactagtaattaactgcagtaattaacgtaagtaattaacggcgcgccatgcttcatcagactct

SEQ ID NO: 8377 - DNA, 172 bp, Artificial Sequence; identical to SEQ ID NO: 8376
  Synthetic polynucleotide

SEQ ID NO: 8378 - DNA, 190 bp, Artificial Sequence
  Synthetic polynucleotide
atcatctcaccttgcctcctgggcttactatggatgcacctgcaggccaaccggaagtccagaccaaccggaagtcctcgccaaccggaagtccgacccaaccggaagtccctaccaaccggaagtccactccaaccggaagtcctgcccaaccggaagtccgtaggcgcgccatgcttcatcagactct

SEQ ID NO: 8379 - DNA, 190 bp, Artificial Sequence; identical to SEQ ID NO: 8378
  Synthetic polynucleotide

SEQ ID NO: 8380 - DNA, 172 bp, Artificial Sequence
  Synthetic polynucleotide
atcatctcaccttgcctcctgtggcgcaagacttggtccctgcaggttacgcaatcagattacgcaatctcgttacgcaatcgacttacgcaatcctattacgcaatcactttacgcaatctgcttacgcaatcgtattacgcaatcggcgcgccatgcttcatcagactct

SEQ ID NO: 8381 - DNA, 172 bp, Artificial Sequence; identical to SEQ ID NO: 8380
  Synthetic polynucleotide

SEQ ID NO: 8382 - DNA, 164 bp, Artificial Sequence
  Synthetic polynucleotide
atcatctcaccttgcctcctgcattcgactgataggaccctgcaggggccagacaagaggccagacatcgggccagacagacggccagacactaggccagacaactggccagacatgcggccagacagtaggccagacaggcgcgccatgcttcatcagactct

SEQ ID NO: 8383 - DNA, 164 bp, Artificial Sequence; identical to SEQ ID NO: 8382
  Synthetic polynucleotide

SEQ ID NO: 8384 - DNA, 172 bp, Artificial Sequence
  Synthetic polynucleotide
atcatctcaccttgcctcctgtccactcgtgcaattctcctgcaggggtcacgtgcagaggtcacgtgctcgggtcacgtgcgacggtcacgtgcctaggtcacgtgcactggtcacgtgctgcggtcacgtgcgtaggtcacgtgcggcgcgccatgcttcatcagactct

SEQ ID NO: 8385 - DNA, 172 bp, Artificial Sequence; identical to SEQ ID NO: 8384
  Synthetic polynucleotide

SEQ ID NO: 8386 - DNA, 172 bp, Artificial Sequence
  Synthetic polynucleotide
atcatctcaccttgcctcctgatccgtactatatatggcctgcaggtaaccacaaaagataaccacaaatcgtaaccacaaagactaaccacaaactataaccacaaaacttaaccacaaatgctaaccacaaagtataaccacaaaggcgcgccatgcttcatcagactct

SEQ ID NO: 8387 - DNA, 172 bp, Artificial Sequence; identical to SEQ ID NO: 8386
  Synthetic polynucleotide

SEQ ID NO: 8388 - DNA, 172 bp, Artificial Sequence
  Synthetic polynucleotide
atcatctcaccttgcctcctgacggaaggcgaacgttgcctgcaggggtcacgtggagaggtcacgtggtcgggtcacgtgggacggtcacgtggctaggtcacgtggactggtcacgtggtgcggtcacgtgggtaggtcacgtggggcgcgccatgcttcatcagactct

SEQ ID NO: 8389 - DNA, 172 bp, Artificial Sequence; identical to SEQ ID NO: 8388
  Synthetic polynucleotide

SEQ ID NO: 8390 - DNA, 196 bp, Artificial Sequence
  Synthetic polynucleotide
atcatctcaccttgcctcctggctagcgtttatagagtcctgcaggtactgattatgcatatttttaaagatactgattatgcatatttttaatcgtactgattatgcatatttttaagactactgattatgcatatttttaactatactgattatgcatatttttaaactggcgcgccatgcttcatcagactct

SEQ ID NO: 8391 - DNA, 196 bp, Artificial Sequence; identical to SEQ ID NO: 8390
  Synthetic polynucleotide

SEQ ID NO: 8392 - DNA, 185 bp, Artificial Sequence
  Synthetic polynucleotide
atcatctcaccttgcctcctgtcatgtagcatgtgcatcctgcaggcatttaacaccaattaagacatttaacaccaattatcgcatttaacaccaattagaccatttaacaccaattactacatttaacaccaattaactcatttaacaccaattatgcggcgcgccatgcttcatcagactct

SEQ ID NO: 8393 - DNA, 185 bp, Artificial Sequence; identical to SEQ ID NO: 8392
  Synthetic polynucleotide

SEQ ID NO: 8394 - DNA, 186 bp, Artificial Sequence
  Synthetic polynucleotide
atcatctcaccttgcctcctgaaacctgttattgcaagcctgcaggctggtgggggcagataaggaagactggtgggggcagataaggatcgctggtgggggcagataaggagacctggtgggggcagataaggactactggtgggggcagataaggaactggcgcgccatgcttcatcagactct

SEQ ID NO: 8395 - DNA, 186 bp, Artificial Sequence; identical to SEQ ID NO: 8394
  Synthetic polynucleotide

SEQ ID NO: 8396 - DNA, 172 bp, Artificial Sequence
  Synthetic polynucleotide
atcatctcaccttgcctcctgaccgtcagataataggccctgcaggattgacaggtagaattgacaggttcgattgacaggtgacattgacaggtctaattgacaggtactattgacaggttgcattgacaggtgtaattgacaggtggcgcgccatgcttcatcagactct

SEQ ID NO: 8397 - DNA, 172 bp, Artificial Sequence; identical to SEQ ID NO: 8396
  Synthetic polynucleotide

SEQ ID NO: 8398 - DNA, 196 bp, Artificial Sequence
  Synthetic polynucleotide
atcatctcaccttgcctcctgttgtagccgatggtgggcctgcaggagggggcgcagctgcgtcccctagaagggggcgcagctgcgtccccttcgagggggcgcagctgcgtcccctgacagggggcgcagctgcgtcccctctaagggggcgcagctgcgtcccctactggcgcgccatgcttcatcagactct

SEQ ID NO: 8399 - DNA, 196 bp, Artificial Sequence; identical to SEQ ID NO: 8398
  Synthetic polynucleotide

SEQ ID NO: 8400 - DNA, 172 bp, Artificial Sequence
  Synthetic polynucleotide
atcatctcaccttgcctcctggacattgctgacaatgccctgcagggctaattactagagctaattacttcggctaattactgacgctaattactctagctaattactactgctaattacttgcgctaattactgtagctaattactggcgcgccatgcttcatcagactct

SEQ ID NO: 8401 - DNA, 172 bp, Artificial Sequence; identical to SEQ ID NO: 8400
  Synthetic polynucleotide

SEQ ID NO: 8402 - DNA, 179 bp, Artificial Sequence
  Synthetic polynucleotide
atcatctcaccttgcctcctgtcctgtacggagcaacgcctgcaggcagaaagatgacgtgtcatttaatagacagaaagatgacgtgtcatttaattcgcagaaagatgacgtgtcatttaatgaccagaaagatgacgtgtcatttaatctaggcgcgccatgcttcatcagactct

SEQ ID NO: 8403 - DNA, 179 bp, Artificial Sequence; identical to SEQ ID NO: 8402
  Synthetic polynucleotide

SEQ ID NO: 8404 - DNA, 148 bp, Artificial Sequence
  Synthetic polynucleotide
atcatctcaccttgcctcctggtcggcatccatcgttacctgcaggaaacaaaagaaaacaaatcgaaacaaagacaaacaaactaaaacaaaactaaacaaatgcaaacaaagtaaaacaaaggcgcgccatgcttcatcagactct

SEQ ID NO: 8405 - DNA, 148 bp, Artificial Sequence; identical to SEQ ID NO: 8404
  Synthetic polynucleotide

SEQ ID NO: 8406 - DNA, 188 bp, Artificial Sequence
  Synthetic polynucleotide
atcatctcaccttgcctcctggtcagacattggcaacacctgcagggggctcaggtggagagggctcaggtggtcggggctcaggtgggacgggctcaggtggctagggctcaggtggactgggctcaggtggtgcgggctcaggtgggtagggctcaggtggggcgcgccatgcttcatcagactct

SEQ ID NO: 8407 - DNA, 188 bp, Artificial Sequence; identical to SEQ ID NO: 8406
  Synthetic polynucleotide

SEQ ID NO: 8408 - DNA, 172 bp, Artificial Sequence
  Synthetic polynucleotide
atcatctcaccttgcctcctgcgctctggtactagaggcctgcagggtcacgtgatagagtcacgtgattcggtcacgtgatgacgtcacgtgatctagtcacgtgatactgtcacgtgattgcgtcacgtgatgtagtcacgtgatggcgcgccatgcttcatcagactct

SEQ ID NO: 8409 - DNA, 172 bp, Artificial Sequence; identical to SEQ ID NO: 8408
  Synthetic polynucleotide

SEQ ID NO: 8410 - DNA, 191 bp, Artificial Sequence
  Synthetic polynucleotide
atcatctcaccttgcctcctgaacaagtcccgcgcatccctgcagggggtttgtttactttttagagggtttgtttacttttttcggggtttgtttactttttgacgggtttgtttactttttctagggtttgtttactttttactgggtttgtttacttttttgcggcgcgccatgcttcatcagactct

SEQ ID NO: 8411 - DNA, 191 bp, Artificial Sequence; identical to SEQ ID NO: 8410
  Synthetic polynucleotide

SEQ ID NO: 8412 - DNA, 190 bp, Artificial Sequence
  Synthetic polynucleotide
atcatctcaccttgcctcctgtctctgtctgggtgctacctgcaggcaaataacggtactagacaaataacggtacttcgcaaataacggtactgaccaaataacggtactctacaaataacggtactactcaaataacggtacttgccaaataacggtactgtaggcgcgccatgcttcatcagactct

SEQ ID NO: 8413 - DNA, 190 bp, Artificial Sequence; identical to SEQ ID NO: 8412
  Synthetic polynucleotide

SEQ ID NO: 8414 - DNA, 188 bp, Artificial Sequence
  Synthetic polynucleotide
atcatctcaccttgcctcctgacgaccatcttgtatggcctgcaggtttgtttacaatagatttgtttacaattcgtttgtttacaatgactttgtttacaatctatttgtttacaatacttttgtttacaattgctttgtttacaatgtatttgtttacaatggcgcgccatgcttcatcagactct

SEQ ID NO: 8415 - DNA, 188 bp, Artificial Sequence; identical to SEQ ID NO: 8414
  Synthetic polynucleotide

SEQ ID NO: 8416 - DNA, 172 bp, Artificial Sequence
  Synthetic polynucleotide
atcatctcaccttgcctcctgcatggcaattcaccctacctgcaggaggggcgtgtagaaggggcgtgttcgaggggcgtgtgacaggggcgtgtctaaggggcgtgtactaggggcgtgttgcaggggcgtgtgtaaggggcgtgtggcgcgccatgcttcatcagactct

SEQ ID NO: 8417 - DNA, 172 bp, Artificial Sequence; identical to SEQ ID NO: 8416
  Synthetic polynucleotide

SEQ ID NO: 8418 - DNA, 164 bp, Artificial Sequence
  Synthetic polynucleotide
atcatctcaccttgcctcctgaataacgagactcagttcctgcaggagtccaaagagaagtccaaagtcgagtccaaaggacagtccaaagctaagtccaaagactagtccaaagtgcagtccaaaggtaagtccaaagggcgcgccatgcttcatcagactct

SEQ ID NO: 8419 - DNA, 164 bp, Artificial Sequence; identical to SEQ ID NO: 8418
  Synthetic polynucleotide

SEQ ID NO: 8420 - DNA, 156 bp, Artificial Sequence
  Synthetic polynucleotide
atcatctcaccttgcctcctgagcgccaagtgtgtgtgcctgcaggtgtttataagatgtttatatcgtgtttatagactgtttatactatgtttataacttgtttatatgctgtttatagtatgtttataggcgcgccatgcttcatcagactct

SEQ ID NO: 8421 - DNA, 156 bp, Artificial Sequence; identical to SEQ ID NO: 8420
  Synthetic polynucleotide

SEQ ID NO: 8422 - DNA, 190 bp, Artificial Sequence
  Synthetic polynucleotide
atcatctcaccttgcctcctggaagtggtgtttactgacctgcaggagtttcggtttcgaagaagtttcggtttcgatcgagtttcggtttcgagacagtttcggtttcgactaagtttcggtttcgaactagtttcggtttcgatgcagtttcggtttcgagtaggcgcgccatgcttcatcagactct

SEQ ID NO: 8423 - DNA, 190 bp, Artificial Sequence; identical to SEQ ID NO: 8422
  Synthetic polynucleotide

SEQ ID NO: 8424 - DNA, 172 bp, Artificial Sequence
  Synthetic polynucleotide
atcatctcaccttgcctcctgctagctccttaatctcacctgcagggctaattaccagagctaattacctcggctaattaccgacgctaattaccctagctaattaccactgctaattacctgcgctaattaccgtagctaattaccggcgcgccatgcttcatcagactct

SEQ ID NO: 8425 - DNA, 172 bp, Artificial Sequence; identical to SEQ ID NO: 8424
  Synthetic polynucleotide

SEQ ID NO: 8426 - DNA, 172 bp, Artificial Sequence
  Synthetic polynucleotide
atcatctcaccttgcctcctgacgggaacagtttacggcctgcagggggatcgatcagagggatcgatctcggggatcgatcgacgggatcgatcctagggatcgatcactgggatcgatctgcgggatcgatcgtagggatcgatcggcgcgccatgcttcatcagactct

SEQ ID NO: 8427 - DNA, 172 bp, Artificial Sequence; identical to SEQ ID NO: 8426
  Synthetic polynucleotide

SEQ ID NO: 8428 - DNA, 185 bp, Artificial Sequence
  Synthetic polynucleotide
atcatctcaccttgcctcctgttccacccgccttaccacctgcaggcaatgcattgtgggtaagacaatgcattgtgggtatcgcaatgcattgtgggtagaccaatgcattgtgggtactacaatgcattgtgggtaactcaatgcattgtgggtatgcggcgcgccatgcttcatcagactct

SEQ ID NO: 8429 - DNA, 185 bp, Artificial Sequence; identical to SEQ ID NO: 8428
  Synthetic polynucleotide

SEQ ID NO: 8430 - DNA, 172 bp, Artificial Sequence
  Synthetic polynucleotide
atcatctcaccttgcctcctgtgtcaggacaagcactacctgcaggaaccaattaaagaaaccaattaatcgaaccaattaagacaaccaattaactaaaccaattaaactaaccaattaatgcaaccaattaagtaaaccaattaaggcgcgccatgcttcatcagactct

SEQ ID NO: 8431 - DNA, 172 bp, Artificial Sequence; identical to SEQ ID NO: 8430
  Synthetic polynucleotide

SEQ ID NO: 8432 - DNA, 156 bp, Artificial Sequence
  Synthetic polynucleotide
atcatctcaccttgcctcctgagtcggaggagggaaatcctgcagggcgcgaaaagagcgcgaaatcggcgcgaaagacgcgcgaaactagcgcgaaaactgcgcgaaatgcgcgcgaaagtagcgcgaaaggcgcgccatgcttcatcagactct

SEQ ID NO: 8433 - DNA, 156 bp, Artificial Sequence; identical to SEQ ID NO: 8432
  Synthetic polynucleotide

SEQ ID NO: 8434 - DNA, 190 bp, Artificial Sequence
  Synthetic polynucleotide
atcatctcaccttgcctcctgacggacacagtagcaaccctgcaggcgcccgaggcgcgtagacgcccgaggcgcgttcgcgcccgaggcgcgtgaccgcccgaggcgcgtctacgcccgaggcgcgtactcgcccgaggcgcgttgccgcccgaggcgcgtgtaggcgcgccatgcttcatcagactct

SEQ ID NO: 8435 - DNA, 190 bp, Artificial Sequence; identical to SEQ ID NO: 8434
  Synthetic polynucleotide

SEQ ID NO: 8436 - DNA, 191 bp, Artificial Sequence
  Synthetic polynucleotide
atcatctcaccttgcctcctgaaagtagaatcgctgggcctgcaggaaattgctgagtcagcatattagaaaattgctgagtcagcatatttcgaaattgctgagtcagcatattgacaaattgctgagtcagcatattctaaaattgctgagtcagcatattactggcgcgccatgcttcatcagactct

SEQ ID NO: 8437 - DNA, 191 bp, Artificial Sequence; identical to SEQ ID NO: 8436
  Synthetic polynucleotide

SEQ ID NO: 8438 - DNA, 191 bp, Artificial Sequence
  Synthetic polynucleotide
atcatctcaccttgcctcctgtgcaatttgacagggaccctgcaggaagagggattaattatcagaaagagggattaattatctcgaagagggattaattatcgacaagagggattaattatcctaaagagggattaattatcactaagagggattaattatctgcggcgcgccatgcttcatcagactct

SEQ ID NO: 8439 - DNA, 191 bp, Artificial Sequence; identical to SEQ ID NO: 8438
  Synthetic polynucleotide

SEQ ID NO: 8440 - DNA, 172 bp, Artificial Sequence
  Synthetic polynucleotide
atcatctcaccttgcctcctgggtatttcactgctctccctgcagggtcacgtgacagagtcacgtgactcggtcacgtgacgacgtcacgtgacctagtcacgtgacactgtcacgtgactgcgtcacgtgacgtagtcacgtgacggcgcgccatgcttcatcagactct

SEQ ID NO: 8441 - DNA, 172 bp, Artificial Sequence; identical to SEQ ID NO: 8440
  Synthetic polynucleotide

SEQ ID NO: 8442 - DNA, 191 bp, Artificial Sequence
  Synthetic polynucleotide
atcatctcaccttgcctcctgcaaatgtctcgcattaccctgcagggccacaggaagtgaggaagagccacaggaagtgaggatcggccacaggaagtgaggagacgccacaggaagtgaggactagccacaggaagtgaggaactgccacaggaagtgaggatgcggcgcgccatgcttcatcagactct

SEQ ID NO: 8443 - DNA, 191 bp, Artificial Sequence; identical to SEQ ID NO: 8442
  Synthetic polynucleotide

SEQ ID NO: 8444 - DNA, 156 bp, Artificial Sequence
  Synthetic polynucleotide
atcatctcaccttgcctcctgagtgttaaatggtctcccctgcagggcgtcagcagagcgtcagctcggcgtcagcgacgcgtcagcctagcgtcagcactgcgtcagctgcgcgtcagcgtagcgtcagcggcgcgccatgcttcatcagactct

SEQ ID NO: 8445 - DNA, 156 bp, Artificial Sequence; identical to SEQ ID NO: 8444
  Synthetic polynucleotide

SEQ ID NO: 8446 - DNA, 196 bp, Artificial Sequence
  Synthetic polynucleotide
atcatctcaccttgcctcctgacactcctggcgctaaacctgcaggataagtaggtcaaagaataagtaggtcaatcgataagtaggtcaagacataagtaggtcaactaataagtaggtcaaactataagtaggtcaatgcataagtaggtcaagtaataagtaggtcaaggcgcgccatgcttcatcagactct

SEQ ID NO: 8447 - DNA, 196 bp, Artificial Sequence; identical to SEQ ID NO: 8446
  Synthetic polynucleotide

SEQ ID NO: 8448 - DNA, 185 bp, Artificial Sequence
  Synthetic polynucleotide
atcatctcaccttgcctcctggtcttacggcgtaggagcctgcaggctggcgccccctggtgagactggcgccccctggtgtcgctggcgccccctggtggacctggcgccccctggtgctactggcgccccctggtgactctggcgccccctggtgtgcggcgcgccatgcttcatcagactct

SEQ ID NO: 8449 - DNA, 185 bp, Artificial Sequence; identical to SEQ ID NO: 8448
  Synthetic polynucleotide

SEQ ID NO: 8450 - DNA, 148 bp, Artificial Sequence
  Synthetic polynucleotide
atcatctcaccttgcctcctggggcttaactaatatctcctgcaggaaacaatagaaaacaattcgaaacaatgacaaacaatctaaaacaatactaaacaattgcaaacaatgtaaaacaatggcgcgccatgcttcatcagactct

SEQ ID NO: 8451 - DNA, 148 bp, Artificial Sequence; identical to SEQ ID NO: 8450
  Synthetic polynucleotide

SEQ ID NO: 8452 - DNA, 191 bp, Artificial Sequence
  Synthetic polynucleotide
atcatctcaccttgcctcctgcctgtaataaggctgatcctgcagggaaattttacgacctaaagagaaattttacgacctaatcggaaattttacgacctaagacgaaattttacgacctaactagaaattttacgacctaaactgaaattttacgacctaatgcggcgcgccatgcttcatcagactct

SEQ ID NO: 8453 - DNA, 191 bp, Artificial Sequence; identical to SEQ ID NO: 8452
  Synthetic polynucleotide

SEQ ID NO: 8454 - DNA, 188 bp, Artificial Sequence
  Synthetic polynucleotide
atcatctcaccttgcctcctggtgtatagaccttggtacctgcagggtgacgtcaacgagagtgacgtcaacgtcggtgacgtcaacggacgtgacgtcaacgctagtgacgtcaacgactgtgacgtcaacgtgcgtgacgtcaacggtagtgacgtcaacgggcgcgccatgcttcatcagactct

SEQ ID NO: 8455 - DNA, 188 bp, Artificial Sequence; identical to SEQ ID NO: 8454
  Synthetic polynucleotide

SEQ ID NO: 8456 - DNA, 180 bp, Artificial Sequence
  Synthetic polynucleotide
atcatctcaccttgcctcctgtggtcgactgtacgtcgcctgcaggggccataaaatagaggccataaaattcgggccataaaatgacggccataaaatctaggccataaaatactggccataaaattgcggccataaaatgtaggccataaaatggcgcgccatgcttcatcagactct

SEQ ID NO: 8457 - DNA, 180 bp, Artificial Sequence; identical to SEQ ID NO: 8456
  Synthetic polynucleotide

SEQ ID NO: 8458 - DNA, 185 bp, Artificial Sequence
  Synthetic polynucleotide
atcatctcaccttgcctcctggtccttccctagcctgtcctgcaggcaaacgtaaacaatccagacaaacgtaaacaatcctcgcaaacgtaaacaatccgaccaaacgtaaacaatccctacaaacgtaaacaatccactcaaacgtaaacaatcctgcggcgcgccatgcttcatcagactct

SEQ ID NO: 8459 - DNA, 185 bp, Artificial Sequence; identical to SEQ ID NO: 8458
  Synthetic polynucleotide

SEQ ID NO: 8460 - DNA, 172 bp, Artificial Sequence
  Synthetic polynucleotide
atcatctcaccttgcctcctgatctatctggtcagttacctgcaggatcgcgtgatagaatcgcgtgattcgatcgcgtgatgacatcgcgtgatctaatcgcgtgatactatcgcgtgattgcatcgcgtgatgtaatcgcgtgatggcgcgccatgcttcatcagactct

SEQ ID NO: 8461 - DNA, 172 bp, Artificial Sequence; identical to SEQ ID NO: 8460
  Synthetic polynucleotide

SEQ ID NO: 8462 - DNA, 197 bp, Artificial Sequence
  Synthetic polynucleotide
atcatctcaccttgcctcctgtttgcgcttgcgtcttgcctgcaggaaaaacacctgcgccagaaaaaacacctgcgcctcgaaaaacacctgcgccgacaaaaacacctgcgccctaaaaaacacctgcgccactaaaaacacctgcgcctgcaaaaacacctgcgccgtaggcgcgccatgcttcatcagactct

SEQ ID NO: 8463 - DNA, 197 bp, Artificial Sequence; identical to SEQ ID NO: 8462
  Synthetic polynucleotide

SEQ ID NO: 8464 - DNA, 197 bp, Artificial Sequence
  Synthetic polynucleotide
atcatctcaccttgcctcctgttccgggaagaattaagcctgcaggaaagggatgactcatagaaaagggatgactcattcgaaagggatgactcatgacaaagggatgactcatctaaaagggatgactcatactaaagggatgactcattgcaaagggatgactcatgtaggcgcgccatgcttcatcagactct

SEQ ID NO: 8465 - DNA, 197 bp, Artificial Sequence; identical to SEQ ID NO: 8464
  Synthetic polynucleotide

SEQ ID NO: 8466 - DNA, 197 bp, Artificial Sequence
  Synthetic polynucleotide
atcatctcaccttgcctcctgtcacccgaaagttgtaacctgcagggatgacgtcatcctcagagatgacgtcatcctctcggatgacgtcatcctcgacgatgacgtcatcctcctagatgacgtcatcctcactgatgacgtcatcctctgcgatgacgtcatcctcgtaggcgcgccatgcttcatcagactct

SEQ ID NO: 8467 - DNA, 197 bp, Artificial Sequence; identical to SEQ ID NO: 8466
  Synthetic polynucleotide

SEQ ID NO: 8468 - DNA, 180 bp, Artificial Sequence
  Synthetic polynucleotide
atcatctcaccttgcctcctgggcataaacgtgacggtcctgcaggaaatcgtgactagaaaatcgtgacttcgaaatcgtgactgacaaatcgtgactctaaaatcgtgactactaaatcgtgacttgcaaatcgtgactgtaaaatcgtgactggcgcgccatgcttcatcagactct

SEQ ID NO: 8469 - DNA, 180 bp, Artificial Sequence; identical to SEQ ID NO: 8468
  Synthetic polynucleotide

SEQ ID NO: 8470 - DNA, 188 bp, Artificial Sequence
  Synthetic polynucleotide
atcatctcaccttgcctcctgtggcgggtgattatatgcctgcaggtgacacgtggtaagatgacacgtggtatcgtgacacgtggtagactgacacgtggtactatgacacgtggtaacttgacacgtggtatgctgacacgtggtagtatgacacgtggtaggcgcgccatgcttcatcagactct

SEQ ID NO: 8471 - DNA, 188 bp, Artificial Sequence; identical to SEQ ID NO: 8470
  Synthetic polynucleotide

SEQ ID NO: 8472 - DNA, 185 bp, Artificial Sequence
  Synthetic polynucleotide
atcatctcaccttgcctcctgtgtaatgtctgcaaccccctgcaggctaccaataaaattctagactaccaataaaattcttcgctaccaataaaattctgacctaccaataaaattctctactaccaataaaattctactctaccaataaaattcttgcggcgcgccatgcttcatcagactct

SEQ ID NO: 8473 - DNA, 185 bp, Artificial Sequence; identical to SEQ ID NO: 8472
  Synthetic polynucleotide

SEQ ID NO: 8474 - DNA, 196 bp, Artificial Sequence
  Synthetic polynucleotide
atcatctcaccttgcctcctgacttcgatcaaatcatccctgcaggaaattgctgacgtagaaaattgctgacgttcgaaattgctgacgtgacaaattgctgacgtctaaaattgctgacgtactaaattgctgacgttgcaaattgctgacgtgtaaaattgctgacgtggcgcgccatgcttcatcagactct

SEQ ID NO: 8475 - DNA, 196 bp, Artificial Sequence; identical to SEQ ID NO: 8474
  Synthetic polynucleotide

SEQ ID NO: 8476 - DNA, 172 bp, Artificial Sequence
  Synthetic polynucleotide
atcatctcaccttgcctcctgcttaacaagcgattgcgcctgcaggccctagcaacagaccctagcaactcgccctagcaacgacccctagcaacctaccctagcaacactccctagcaactgcccctagcaacgtaccctagcaacggcgcgccatgcttcatcagactct

SEQ ID NO: 8477 - DNA, 172 bp, Artificial Sequence; identical to SEQ ID NO: 8476
  Synthetic polynucleotide

SEQ ID NO: 8478 - DNA, 172 bp, Artificial Sequence
  Synthetic polynucleotide
atcatctcaccttgcctcctgtaacgaactgccggtcccctgcaggaatcgatcgcagaaatcgatcgctcgaatcgatcgcgacaatcgatcgcctaaatcgatcgcactaatcgatcgctgcaatcgatcgcgtaaatcgatcgcggcgcgccatgcttcatcagactct

SEQ ID NO: 8479 - DNA, 172 bp, Artificial Sequence; identical to SEQ ID NO: 8478
  Synthetic polynucleotide

SEQ ID NO: 8480 - DNA, 197 bp, Artificial Sequence
  Synthetic polynucleotide
atcatctcaccttgcctcctgcaacctatgcgactcttcctgcagggagaaattaatataaagagagaaattaatataatcggagaaattaatataagacgagaaattaatataactagagaaattaatataaactgagaaattaatataatgcgagaaattaatataagtaggcgcgccatgcttcatcagactct

SEQ ID NO: 8481 - DNA, 197 bp, Artificial Sequence; identical to SEQ ID NO: 8480
  Synthetic polynucleotide

SEQ ID NO: 8482 - DNA, 185 bp, Artificial Sequence
  Synthetic polynucleotide
atcatctcaccttgcctcctgcttatgcactattatcgcctgcagggcgctgattggctgagagagcgctgattggctgagtcggcgctgattggctgaggacgcgctgattggctgagctagcgctgattggctgagactgcgctgattggctgagtgcggcgcgccatgcttcatcagactct

SEQ ID NO: 8483 - DNA, 185 bp, Artificial Sequence; identical to SEQ ID NO: 8482
  Synthetic polynucleotide

SEQ ID NO: 8484 - DNA, 190 bp, Artificial Sequence
  Synthetic polynucleotide
atcatctcaccttgcctcctgacccggttgtcttgacacctgcaggtgactgaacattcaagatgactgaacattcatcgtgactgaacattcagactgactgaacattcactatgactgaacattcaacttgactgaacattcatgctgactgaacattcagtaggcgcgccatgcttcatcagactct

SEQ ID NO: 8485 - DNA, 190 bp, Artificial Sequence; identical to SEQ ID NO: 8484
  Synthetic polynucleotide

SEQ ID NO: 8486 - DNA, 156 bp, Artificial Sequence
  Synthetic polynucleotide
atcatctcaccttgcctcctggggaaagttcgtcagaacctgcaggatgataccagaatgatacctcgatgataccgacatgataccctaatgataccactatgatacctgcatgataccgtaatgataccggcgcgccatgcttcatcagactct

SEQ ID NO: 8487 - DNA, 156 bp, Artificial Sequence; identical to SEQ ID NO: 8486
  Synthetic polynucleotide

SEQ ID NO: 8488 - DNA, 188 bp, Artificial Sequence
  Synthetic polynucleotide
atcatctcaccttgcctcctgatgcgcttccgcaacatcctgcaggtgttatgtaataagatgttatgtaatatcgtgttatgtaatagactgttatgtaatactatgttatgtaataacttgttatgtaatatgctgttatgtaatagtatgttatgtaataggcgcgccatgcttcatcagactct

SEQ ID NO: 8489 - DNA, 188 bp, Artificial Sequence; identical to SEQ ID NO: 8488
  Synthetic polynucleotide

SEQ ID NO: 8490 - DNA, 172 bp, Artificial Sequence
  Synthetic polynucleotide
atcatctcaccttgcctcctgatggaaatgttgtacggcctgcagggtcacgtgctagagtcacgtgcttcggtcacgtgctgacgtcacgtgctctagtcacgtgctactgtcacgtgcttgcgtcacgtgctgtagtcacgtgctggcgcgccatgcttcatcagactct

SEQ ID NO: 8491 - DNA, 172 bp, Artificial Sequence; identical to SEQ ID NO: 8490
  Synthetic polynucleotide

SEQ ID NO: 8492 - DNA, 191 bp, Artificial Sequence
  Synthetic polynucleotide
atcatctcaccttgcctcctgaaggccatgtcctatgacctgcaggtgaagggattaatcatcagatgaagggattaatcatctcgtgaagggattaatcatcgactgaagggattaatcatcctatgaagggattaatcatcacttgaagggattaatcatctgcggcgcgccatgcttcatcagactct

SEQ ID NO: 8493 - DNA, 191 bp, Artificial Sequence; identical to SEQ ID NO: 8492
  Synthetic polynucleotide

SEQ ID NO: 8494 - DNA, 172 bp, Artificial Sequence
  Synthetic polynucleotide
atcatctcaccttgcctcctgtccgtagatagcccactcctgcaggcgaatagggaagacgaatagggatcgcgaatagggagaccgaatagggactacgaatagggaactcgaatagggatgccgaatagggagtacgaatagggaggcgcgccatgcttcatcagactct

SEQ ID NO: 8495 - DNA, 172 bp, Artificial Sequence; identical to SEQ ID NO: 8494
  Synthetic polynucleotide

SEQ ID NO: 8496 - DNA, 197 bp, Artificial Sequence
  Synthetic polynucleotide
atcatctcaccttgcctcctgattctgaccctttacaacctgcaggcaaaatcgaaactaaagacaaaatcgaaactaatcgcaaaatcgaaactaagaccaaaatcgaaactaactacaaaatcgaaactaaactcaaaatcgaaactaatgccaaaatcgaaactaagtaggcgcgccatgcttcatcagactct

SEQ ID NO: 8497 - DNA, 197 bp, Artificial Sequence; identical to SEQ ID NO: 8496
  Synthetic polynucleotide

SEQ ID NO: 8498 - DNA, 196 bp, Artificial Sequence
  Synthetic polynucleotide
atcatctcaccttgcctcctgtcacttgtccaatgagtcctgcaggggggggcggggccagaggggggcggggcctcgggggggcggggccgacggggggcggggccctaggggggcggggccactggggggcggggcctgcggggggcggggccgtaggggggcggggccggcgcgccatgcttcatcagactct

SEQ ID NO: 8499 - DNA, 196 bp, Artificial Sequence; identical to SEQ ID NO: 8498
  Synthetic polynucleotide

SEQ ID NO: 8500 - DNA, 190 bp, Artificial Sequence
  Synthetic polynucleotide
atcatctcaccttgcctcctgcaggtgccgaccgtatacctgcaggaatgcgggggcggaagaaatgcgggggcggatcgaatgcgggggcggagacaatgcgggggcggactaaatgcgggggcggaactaatgcgggggcggatgcaatgcgggggcggagtaggcgcgccatgcttcatcagactct

SEQ ID NO: 8501 - DNA, 190 bp, Artificial Sequence; identical to SEQ ID NO: 8500
  Synthetic polynucleotide

SEQ ID NO: 8502 - DNA, 197 bp, Artificial Sequence
  Synthetic polynucleotide
atcatctcaccttgcctcctgggaggaccaattgctcccctgcaggtcgctgactcagcatagatcgctgactcagcattcgtcgctgactcagcatgactcgctgactcagcatctatcgctgactcagcatacttcgctgactcagcattgctcgctgactcagcatgtaggcgcgccatgcttcatcagactct

SEQ ID NO: 8503 - DNA, 197 bp, Artificial Sequence; identical to SEQ ID NO: 8502
  Synthetic polynucleotide

SEQ ID NO: 8504 - DNA, 148 bp, Artificial Sequence
  Synthetic polynucleotide
atcatctcaccttgcctcctgccctgccacttgtcatccctgcaggtgtcaaaagatgtcaaatcgtgtcaaagactgtcaaactatgtcaaaacttgtcaaatgctgtcaaagtatgtcaaaggcgcgccatgcttcatcagactct

SEQ ID NO: 8505 - DNA, 148 bp, Artificial Sequence; identical to SEQ ID NO: 8504
  Synthetic polynucleotide

SEQ ID NO: 8506 - DNA, 190 bp, Artificial Sequence
  Synthetic polynucleotide
atcatctcaccttgcctcctgaactgggctctgctcaacctgcaggactttcgctttcgtagaactttcgctttcgttcgactttcgctttcgtgacactttcgctttcgtctaactttcgctttcgtactactttcgctttcgttgcactttcgctttcgtgtaggcgcgccatgcttcatcagactct

SEQ ID NO: 8507 - DNA, 190 bp, Artificial Sequence; identical to SEQ ID NO: 8506
  Synthetic polynucleotide

SEQ ID NO: 8508 - DNA, 164 bp, Artificial Sequence
  Synthetic polynucleotide
atcatctcaccttgcctcctgctaggcaaggtacctaacctgcaggggtgacctaagaggtgacctatcgggtgacctagacggtgacctactaggtgacctaactggtgacctatgcggtgacctagtaggtgacctaggcgcgccatgcttcatcagactct

SEQ ID NO: 8509 - DNA, 164 bp, Artificial Sequence; identical to SEQ ID NO: 8508
  Synthetic polynucleotide

SEQ ID NO: 8510 - DNA, 172 bp, Artificial Sequence
  Synthetic polynucleotide
atcatctcaccttgcctcctgcgcataggagttacattcctgcaggagtcagcaaaagaagtcagcaaatcgagtcagcaaagacagtcagcaaactaagtcagcaaaactagtcagcaaatgcagtcagcaaagtaagtcagcaaaggcgcgccatgcttcatcagactct

SEQ ID NO: 8511 - DNA, 172 bp, Artificial Sequence; identical to SEQ ID NO: 8510
  Synthetic polynucleotide

SEQ ID NO: 8512 - DNA, 197 bp, Artificial Sequence
  Synthetic polynucleotide
atcatctcaccttgcctcctgagggcgagctttggagtcctgcaggttacttccgggtcctagattacttccgggtccttcgttacttccgggtcctgacttacttccgggtcctctattacttccgggtcctactttacttccgggtccttgcttacttccgggtcctgtaggcgcgccatgcttcatcagactct

SEQ ID NO: 8513 - DNA, 197 bp, Artificial Sequence; identical to SEQ ID NO: 8512
  Synthetic polynucleotide

SEQ ID NO: 8514 - DNA, 197 bp, Artificial Sequence
  Synthetic polynucleotide
atcatctcaccttgcctcctgacactgcagttgatgaccctgcaggggccaccagggggcgctaagaggccaccagggggcgctatcgggccaccagggggcgctagacggccaccagggggcgctactaggccaccagggggcgctaactggccaccagggggcgctatgcggcgcgccatgcttcatcagactct

SEQ ID NO: 8515 - DNA, 197 bp, Artificial Sequence; identical to SEQ ID NO: 8514
  Synthetic polynucleotide

SEQ ID NO: 8516 - DNA, 172 bp, Artificial Sequence
  Synthetic polynucleotide
atcatctcaccttgcctcctgagtctcgcagatcaccgcctgcaggtggcgcaaaaagatggcgcaaaatcgtggcgcaaaagactggcgcaaaactatggcgcaaaaacttggcgcaaaatgctggcgcaaaagtatggcgcaaaaggcgcgccatgcttcatcagactct

SEQ ID NO: 8517 - DNA, 172 bp, Artificial Sequence; identical to SEQ ID NO: 8516
  Synthetic polynucleotide

SEQ ID NO: 8518 - DNA, 172 bp, Artificial Sequence
  Synthetic polynucleotide
atcatctcaccttgcctcctgcggctctattggcctttcctgcaggatataaggttagaatataaggtttcgatataaggttgacatataaggttctaatataaggttactatataaggtttgcatataaggttgtaatataaggttggcgcgccatgcttcatcagactct

SEQ ID NO: 8519 - DNA, 172 bp, Artificial Sequence; identical to SEQ ID NO: 8518
  Synthetic polynucleotide

SEQ ID NO: 8520 - DNA, 191 bp, Artificial Sequence
  Synthetic polynucleotide
atcatctcaccttgcctcctgtttccgaacactggtatcctgcagggaattaattaattaattagagaattaattaattaatttcggaattaattaattaattgacgaattaattaattaattctagaattaattaattaattactgaattaattaattaatttgcggcgcgccatgcttcatcagactct

SEQ ID NO: 8521 - DNA, 191 bp, Artificial Sequence; identical to SEQ ID NO: 8520
  Synthetic polynucleotide

SEQ ID NO: 8522 - DNA, 180 bp, Artificial Sequence
  Synthetic polynucleotide
atcatctcaccttgcctcctgaaacgctgtagtaagaacctgcagggtggggggtctagagtggggggtcttcggtggggggtctgacgtggggggtctctagtggggggtctactgtggggggtcttgcgtggggggtctgtagtggggggtctggcgcgccatgcttcatcagactct

SEQ ID NO: 8523 - DNA, 180 bp, Artificial Sequence; identical to SEQ ID NO: 8522
  Synthetic polynucleotide

SEQ ID NO: 8524 - DNA, 172 bp, Artificial Sequence
  Synthetic polynucleotide
atcatctcaccttgcctcctgtccaatgatgtccgcctcctgcagggtcacgtgccagagtcacgtgcctcggtcacgtgccgacgtcacgtgccctagtcacgtgccactgtcacgtgcctgcgtcacgtgccgtagtcacgtgccggcgcgccatgcttcatcagactct

SEQ ID NO: 8525 - DNA, 172 bp, Artificial Sequence; identical to SEQ ID NO: 8524
  Synthetic polynucleotide

SEQ ID NO: 8526 - DNA, 172 bp, Artificial Sequence
  Synthetic polynucleotide
atcatctcaccttgcctcctgacctcacaaacgtgctacctgcagggctaattaacagagctaattaactcggctaattaacgacgctaattaacctagctaattaacactgctaattaactgcgctaattaacgtagctaattaacggcgcgccatgcttcatcagactct

SEQ ID NO: 8527 - DNA, 172 bp, Artificial Sequence; identical to SEQ ID NO: 8526
  Synthetic polynucleotide

SEQ ID NO: 8528 - DNA, 183 bp, Artificial Sequence
  Synthetic polynucleotide
atcatctcaccttgcctcctgcattgataatactgggacctgcaggtccagtggttgggcgaccatctgttagatccagtggttgggcgaccatctgtttcgtccagtggttgggcgaccatctgttgactccagtggttgggcgaccatctgttctaggcgcgccatgcttcatcagactct

SEQ ID NO: 8529 - DNA, 183 bp, Artificial Sequence; identical to SEQ ID NO: 8528
  Synthetic polynucleotide

SEQ ID NO: 8530 - DNA, 191 bp, Artificial Sequence
  Synthetic polynucleotide
atcatctcaccttgcctcctgagtgctgttcttgtcgacctgcaggataggacacgtcatcatagaataggacacgtcatcattcgataggacacgtcatcatgacataggacacgtcatcatctaataggacacgtcatcatactataggacacgtcatcattgcggcgcgccatgcttcatcagactct

SEQ ID NO: 8531 - DNA, 191 bp, Artificial Sequence; identical to SEQ ID NO: 8530
  Synthetic polynucleotide

SEQ ID NO: 8532 - DNA, 172 bp, Artificial Sequence
  Synthetic polynucleotide
atcatctcaccttgcctcctggagaattgtacacctgacctgcagggctaattaagagagctaattaagtcggctaattaaggacgctaattaagctagctaattaagactgctaattaagtgcgctaattaaggtagctaattaagggcgcgccatgcttcatcagactct

SEQ ID NO: 8533 - DNA, 172 bp, Artificial Sequence; identical to SEQ ID NO: 8532
  Synthetic polynucleotide

SEQ ID NO: 8534 - DNA, 196 bp, Artificial Sequence
  Synthetic polynucleotide
atcatctcaccttgcctcctggcgccaagcataggtgtcctgcaggaataagtatataaagaaataagtatataatcgaataagtatataagacaataagtatataactaaataagtatataaactaataagtatataatgcaataagtatataagtaaataagtatataaggcgcgccatgcttcatcagactct

SEQ ID NO: 8535 - DNA, 196 bp, Artificial Sequence; identical to SEQ ID NO: 8534
  Synthetic polynucleotide

SEQ ID NO: 8536 - DNA, 191 bp, Artificial Sequence
  Synthetic polynucleotide
atcatctcaccttgcctcctggtatgggtaagatcttccctgcaggcgcacaagaacacaatgtaccctcccgagacgcacaagaacacaatgtaccctcccgtcgcgcacaagaacacaatgtaccctcccggaccgcacaagaacacaatgtaccctcccgctaggcgcgccatgcttcatcagactct

SEQ ID NO: 8537 - DNA, 191 bp, Artificial Sequence; identical to SEQ ID NO: 8536
  Synthetic polynucleotide

SEQ ID NO: 8538 - DNA, 156 bp, Artificial Sequence
  Synthetic polynucleotide
atcatctcaccttgcctcctggaaaggttataactcgtcctgcaggtcaatgaaagatcaatgaatcgtcaatgaagactcaatgaactatcaatgaaacttcaatgaatgctcaatgaagtatcaatgaaggcgcgccatgcttcatcagactct

SEQ ID NO: 8539 - DNA, 156 bp, Artificial Sequence; identical to SEQ ID NO: 8538
  Synthetic polynucleotide

SEQ ID NO: 8540 - DNA, 191 bp, Artificial Sequence
  Synthetic polynucleotide
atcatctcaccttgcctcctgtagaggaggaggagattcctgcaggaatgaattgcagtcattagaaatgaattgcagtcatttcgaatgaattgcagtcattgacaatgaattgcagtcattctaaatgaattgcagtcattactaatgaattgcagtcatttgcggcgcgccatgcttcatcagactct

SEQ ID NO: 8541 - DNA, 191 bp, Artificial Sequence; identical to SEQ ID NO: 8540
  Synthetic polynucleotide

SEQ ID NO: 8542 - DNA, 198 bp, Artificial Sequence
  Synthetic polynucleotide
atcatctcaccttgcctcctgcccgaggtactttcgtacctgcaggcctcctccaggaagccctccgggagacctcctccaggaagccctccgggtcgcctcctccaggaagccctccggggaccctcctccaggaagccctccgggctacctcctccaggaagccctccgggggcgcgccatgcttcatcagactct

SEQ ID NO: 8543 - DNA, 198 bp, Artificial Sequence; identical to SEQ ID NO: 8542
  Synthetic polynucleotide

SEQ ID NO: 8544 - DNA, 186 bp, Artificial Sequence
  Synthetic polynucleotide
atcatctcaccttgcctcctgactaacctaacgagatgcctgcagggtgacctctgggtgacccccagagtgacctctgggtgaccccctcggtgacctctgggtgacccccgacgtgacctctgggtgacccccctagtgacctctgggtgacccccactggcgcgccatgcttcatcagactct

SEQ ID NO: 8545 - DNA, 186 bp, Artificial Sequence; identical to SEQ ID NO: 8544
  Synthetic polynucleotide

SEQ ID NO: 8546 - DNA, 197 bp, Artificial Sequence
  Synthetic polynucleotide
atcatctcaccttgcctcctggttctccataacaaggacctgcaggagtgttaacagaacacctagaagtgttaacagaacaccttcgagtgttaacagaacacctgacagtgttaacagaacacctctaagtgttaacagaacacctactagtgttaacagaacaccttgcggcgcgccatgcttcatcagactct

SEQ ID NO: 8547 - DNA, 197 bp, Artificial Sequence; identical to SEQ ID NO: 8546
  Synthetic polynucleotide

SEQ ID NO: 8548 - DNA, 156 bp, Artificial Sequence
  Synthetic polynucleotide
atcatctcaccttgcctcctgaaatgcggagacctaaccctgcaggcatttccgagacatttccgtcgcatttccggaccatttccgctacatttccgactcatttccgtgccatttccggtacatttccgggcgcgccatgcttcatcagactct

SEQ ID NO: 8549 - DNA, 156 bp, Artificial Sequence; identical to SEQ ID NO: 8548
  Synthetic polynucleotide

SEQ ID NO: 8550 - DNA, 190 bp, Artificial Sequence
  Synthetic polynucleotide
atcatctcaccttgcctcctgtccggtagagctacaagcctgcaggacattgcataattaagaacattgcataattatcgacattgcataattagacacattgcataattactaacattgcataattaactacattgcataattatgcacattgcataattagtaggcgcgccatgcttcatcagactct

SEQ ID NO: 8551 - DNA, 190 bp, Artificial Sequence; identical to SEQ ID NO: 8550
  Synthetic polynucleotide

SEQ ID NO: 8552 - DNA, 197 bp, Artificial Sequence
  Synthetic polynucleotide
atcatctcaccttgcctcctgacggttccgtgggttaccctgcaggattgtcatgctaatgagaattgtcatgctaatgtcgattgtcatgctaatggacattgtcatgctaatgctaattgtcatgctaatgactattgtcatgctaatgtgcattgtcatgctaatggtaggcgcgccatgcttcatcagactct

SEQ ID NO: 8553 - DNA, 197 bp, Artificial Sequence; identical to SEQ ID NO: 8552
  Synthetic polynucleotide

SEQ ID NO: 8554 - DNA, 172 bp, Artificial Sequence
  Synthetic polynucleotide
atcatctcaccttgcctcctggttcggagtctatggttcctgcaggtcttaatgacagatcttaatgactcgtcttaatgacgactcttaatgacctatcttaatgacacttcttaatgactgctcttaatgacgtatcttaatgacggcgcgccatgcttcatcagactct

SEQ ID NO: 8555 - DNA, 172 bp, Artificial Sequence; identical to SEQ ID NO: 8554
  Synthetic polynucleotide

SEQ ID NO: 8556 - DNA, 164 bp, Artificial Sequence
  Synthetic polynucleotide
atcatctcaccttgcctcctgccatagtctaggtcaaccctgcagggacaggtgtagagacaggtgttcggacaggtgtgacgacaggtgtctagacaggtgtactgacaggtgttgcgacaggtgtgtagacaggtgtggcgcgccatgcttcatcagactct

SEQ ID NO: 8557 - DNA, 164 bp, Artificial Sequence; identical to SEQ ID NO: 8556
  Synthetic polynucleotide

SEQ ID NO: 8558 - DNA, 180 bp, Artificial Sequence
  Synthetic polynucleotide
atcatctcaccttgcctcctgatgcgtgggattcttgccctgcagggccggcccctcagagccggcccctctcggccggcccctcgacgccggcccctcctagccggcccctcactgccggcccctctgcgccggcccctcgtagccggcccctcggcgcgccatgcttcatcagactct

SEQ ID NO: 8559 - DNA, 180 bp, Artificial Sequence; identical to SEQ ID NO: 8558
  Synthetic polynucleotide

SEQ ID NO: 8560 - DNA, 188 bp, Artificial Sequence
  Synthetic polynucleotide
atcatctcaccttgcctcctgtatattggcaccctgggcctgcaggtaattgcaatcaagataattgcaatcatcgtaattgcaatcagactaattgcaatcactataattgcaatcaacttaattgcaatcatgctaattgcaatcagtataattgcaatcaggcgcgccatgcttcatcagactct

SEQ ID NO: 8561 - DNA, 188 bp, Artificial Sequence; identical to SEQ ID NO: 8560
  Synthetic polynucleotide

SEQ ID NO: 8562 - DNA, 197 bp, Artificial Sequence
  Synthetic polynucleotide
atcatctcaccttgcctcctggcaatgacatagttgcccctgcaggtaccatagcaacggtagataccatagcaacggttcgtaccatagcaacggtgactaccatagcaacggtctataccatagcaacggtacttaccatagcaacggttgctaccatagcaacggtgtaggcgcgccatgcttcatcagactct

SEQ ID NO: 8563 - DNA, 197 bp, Artificial Sequence; identical to SEQ ID NO: 8562
  Synthetic polynucleotide

SEQ ID NO: 8564 - DNA, 180 bp, Artificial Sequence
  Synthetic polynucleotide
atcatctcaccttgcctcctgcggaaggaaacatgtaccctgcaggcgtgagtcatcagacgtgagtcatctcgcgtgagtcatcgaccgtgagtcatcctacgtgagtcatcactcgtgagtcatctgccgtgagtcatcgtacgtgagtcatcggcgcgccatgcttcatcagactct

SEQ ID NO: 8565 - DNA, 180 bp, Artificial Sequence; identical to SEQ ID NO: 8564
  Synthetic polynucleotide

SEQ ID NO: 8566 - DNA, 190 bp, Artificial Sequence
  Synthetic polynucleotide
atcatctcaccttgcctcctgcagcaagtacagggctgcctgcaggatatcacgtgatttagaatatcacgtgattttcgatatcacgtgatttgacatatcacgtgatttctaatatcacgtgatttactatatcacgtgattttgcatatcacgtgatttgtaggcgcgccatgcttcatcagactct

SEQ ID NO: 8567 - DNA, 190 bp, Artificial Sequence; identical to SEQ ID NO: 8566
  Synthetic polynucleotide

SEQ ID NO: 8568 - DNA, 164 bp, Artificial Sequence
  Synthetic polynucleotide
atcatctcaccttgcctcctgacaactagtgcgttggtcctgcagggggggagggagagggggagggtcggggggaggggacgggggagggctagggggagggactgggggagggtgcgggggaggggtagggggagggggcgcgccatgcttcatcagactct

SEQ ID NO: 8569 - DNA, 164 bp, Artificial Sequence; identical to SEQ ID NO: 8568
  Synthetic polynucleotide

SEQ ID NO: 8570 - DNA, 164 bp, Artificial Sequence
  Synthetic polynucleotide
atcatctcaccttgcctcctgtcgtacaacgtgcagctcctgcaggctaattaacagactaattaactcgctaattaacgacctaattaacctactaattaacactctaattaactgcctaattaacgtactaattaacggcgcgccatgcttcatcagactct

SEQ ID NO: 8571 - DNA, 164 bp, Artificial Sequence; identical to SEQ ID NO: 8570
  Synthetic polynucleotide

SEQ ID NO: 8572 - DNA, 191 bp, Artificial Sequence
  Synthetic polynucleotide
atcatctcaccttgcctcctggcactagaccggccattcctgcagggttcaaaaatggtgttcagagttcaaaaatggtgttctcggttcaaaaatggtgttcgacgttcaaaaatggtgttcctagttcaaaaatggtgttcactgttcaaaaatggtgttctgcggcgcgccatgcttcatcagactct

SEQ ID NO: 8573 - DNA, 191 bp, Artificial Sequence; identical to SEQ ID NO: 8572
  Synthetic polynucleotide

SEQ ID NO: 8574 - DNA, 164 bp, Artificial Sequence
  Synthetic polynucleotide
atcatctcaccttgcctcctgcgaacggtcttgtgtcacctgcaggcccacgcatagacccacgcattcgcccacgcatgaccccacgcatctacccacgcatactcccacgcattgccccacgcatgtacccacgcatggcgcgccatgcttcatcagactct

SEQ ID NO: 8575 - DNA, 164 bp, Artificial Sequence; identical to SEQ ID NO: 8574
  Synthetic polynucleotide

SEQ ID NO: 8576 - DNA, 164 bp, Artificial Sequence
  Synthetic polynucleotide
atcatctcaccttgcctcctgaccttgaacgcgttcggcctgcaggctaattaaaagactaattaaatcgctaattaaagacctaattaaactactaattaaaactctaattaaatgcctaattaaagtactaattaaaggcgcgccatgcttcatcagactct

SEQ ID NO: 8577 - DNA, 164 bp, Artificial Sequence; identical to SEQ ID NO: 8576
  Synthetic polynucleotide

SEQ ID NO: 8578 - DNA, 164 bp, Artificial Sequence
  Synthetic polynucleotide
atcatctcaccttgcctcctgaccacactttggctcatcctgcaggctaattaagagactaattaagtcgctaattaaggacctaattaagctactaattaagactctaattaagtgcctaattaaggtactaattaagggcgcgccatgcttcatcagactct

SEQ ID NO: 8579 - DNA, 164 bp, Artificial Sequence; identical to SEQ ID NO: 8578
  Synthetic polynucleotide

SEQ ID NO: 8580 - DNA, 172 bp, Artificial Sequence
  Synthetic polynucleotide
atcatctcaccttgcctcctgctacgcctactagctagcctgcaggctaattgcttagactaattgctttcgctaattgcttgacctaattgcttctactaattgcttactctaattgctttgcctaattgcttgtactaattgcttggcgcgccatgcttcatcagactct

SEQ ID NO: 8581 - DNA, 172 bp, Artificial Sequence; identical to SEQ ID NO: 8580
  Synthetic polynucleotide

SEQ ID NO: 8582 - DNA, 172 bp, Artificial Sequence
  Synthetic polynucleotide
atcatctcaccttgcctcctgtacctccaatcgcgcgacctgcagggctgatgcaaagagctgatgcaatcggctgatgcaagacgctgatgcaactagctgatgcaaactgctgatgcaatgcgctgatgcaagtagctgatgcaaggcgcgccatgcttcatcagactct

SEQ ID NO: 8583 - DNA, 172 bp, Artificial Sequence; identical to SEQ ID NO: 8582
  Synthetic polynucleotide

SEQ ID NO: 8584 - DNA, 188 bp, Artificial Sequence
  Synthetic polynucleotide
atcatctcaccttgcctcctgttaccctgcctaatggccctgcaggggatgtttgtttagaggatgtttgttttcgggatgtttgtttgacggatgtttgtttctaggatgtttgtttactggatgtttgttttgcggatgtttgtttgtaggatgtttgtttggcgcgccatgcttcatcagactct

SEQ ID NO: 8585 - DNA, 188 bp, Artificial Sequence; identical to SEQ ID NO: 8584
  Synthetic polynucleotide

SEQ ID NO: 8586 - DNA, 188 bp, Artificial Sequence
  Synthetic polynucleotide
atcatctcaccttgcctcctgtcgatggtaccgtactgcctgcaggaacagctgacgcagaaacagctgacgctcgaacagctgacgcgacaacagctgacgcctaaacagctgacgcactaacagctgacgctgcaacagctgacgcgtaaacagctgacgcggcgcgccatgcttcatcagactct

SEQ ID NO: 8587 - DNA, 188 bp, Artificial Sequence; identical to SEQ ID NO: 8586
  Synthetic polynucleotide

SEQ ID NO: 8588 - DNA, 185 bp, Artificial Sequence
  Synthetic polynucleotide
atcatctcaccttgcctcctgtcccgattagcgtcattcctgcaggttttacagtagcaaaaagattttacagtagcaaaatcgttttacagtagcaaaagacttttacagtagcaaaactattttacagtagcaaaaactttttacagtagcaaaatgcggcgcgccatgcttcatcagactct

SEQ ID NO: 8589 - DNA, 185 bp, Artificial Sequence; identical to SEQ ID NO: 8588
  Synthetic polynucleotide

SEQ ID NO: 8590 - DNA, 172 bp, Artificial Sequence
  Synthetic polynucleotide
atcatctcaccttgcctcctggtcggagttgataaattcctgcaggcgcccgaggcagacgcccgaggctcgcgcccgaggcgaccgcccgaggcctacgcccgaggcactcgcccgaggctgccgcccgaggcgtacgcccgaggcggcgcgccatgcttcatcagactct

SEQ ID NO: 8591 - DNA, 172 bp, Artificial Sequence; identical to SEQ ID NO: 8590
  Synthetic polynucleotide

SEQ ID NO: 8592 - DNA, 156 bp, Artificial Sequence
  Synthetic polynucleotide
atcatctcaccttgcctcctgctttaaacgcttacgagcctgcaggttctgttgagattctgttgtcgttctgttggacttctgttgctattctgttgactttctgttgtgcttctgttggtattctgttgggcgcgccatgcttcatcagactct

SEQ ID NO: 8593 - DNA, 156 bp, Artificial Sequence; identical to SEQ ID NO: 8592
  Synthetic polynucleotide

SEQ ID NO: 8594 - DNA, 197 bp, Artificial Sequence
  Synthetic polynucleotide
atcatctcaccttgcctcctgatagcactagccatcaccctgcaggattggttatattggttaaagaattggttatattggttaatcgattggttatattggttaagacattggttatattggttaactaattggttatattggttaaactattggttatattggttaatgcggcgcgccatgcttcatcagactct

SEQ ID NO: 8595 - DNA, 197 bp, Artificial Sequence; identical to SEQ ID NO: 8594
  Synthetic polynucleotide

SEQ ID NO: 8596 - DNA, 164 bp, Artificial Sequence
  Synthetic polynucleotide
atcatctcaccttgcctcctgcactatcgcgatgcgtccctgcaggggccatgtgagaggccatgtgtcgggccatgtggacggccatgtgctaggccatgtgactggccatgtgtgcggccatgtggtaggccatgtgggcgcgccatgcttcatcagactct

SEQ ID NO: 8597 - DNA, 164 bp, Artificial Sequence; identical to SEQ ID NO: 8596
  Synthetic polynucleotide

SEQ ID NO: 8598 - DNA, 156 bp, Artificial Sequence
  Synthetic polynucleotide
atcatctcaccttgcctcctggttcttaccagatccaccctgcaggcacgtggcagacacgtggctcgcacgtggcgaccacgtggcctacacgtggcactcacgtggctgccacgtggcgtacacgtggcggcgcgccatgcttcatcagactct

SEQ ID NO: 8599 - DNA, 156 bp, Artificial Sequence; identical to SEQ ID NO: 8598
  Synthetic polynucleotide

SEQ ID NO: 8600 - DNA, 185 bp, Artificial Sequence
  Synthetic polynucleotide
atcatctcaccttgcctcctgatacgccttatgtacggcctgcaggcaaaaccaattaatttagacaaaaccaattaattttcgcaaaaccaattaatttgaccaaaaccaattaatttctacaaaaccaattaatttactcaaaaccaattaattttgcggcgcgccatgcttcatcagactct

SEQ ID NO: 8601 - DNA, 185 bp, Artificial Sequence; identical to SEQ ID NO: 8600
  Synthetic polynucleotide

SEQ ID NO: 8602 - DNA, 172 bp, Artificial Sequence
  Synthetic polynucleotide
atcatctcaccttgcctcctgaagctccagaaggtccacctgcaggggttgctatgagaggttgctatgtcgggttgctatggacggttgctatgctaggttgctatgactggttgctatgtgcggttgctatggtaggttgctatgggcgcgccatgcttcatcagactct

SEQ ID NO: 8603 - DNA, 172 bp, Artificial Sequence; identical to SEQ ID NO: 8602
  Synthetic polynucleotide

SEQ ID NO: 8604 - DNA, 197 bp, Artificial Sequence
  Synthetic polynucleotide
atcatctcaccttgcctcctgttgctaggacagcccaccctgcaggcaaaaaggggcgtggcatagacaaaaaggggcgtggcattcgcaaaaaggggcgtggcatgaccaaaaaggggcgtggcatctacaaaaaggggcgtggcatactcaaaaaggggcgtggcattgcggcgcgccatgcttcatcagactct

SEQ ID NO: 8605 - DNA, 197 bp, Artificial Sequence; identical to SEQ ID NO: 8604
  Synthetic polynucleotide

SEQ ID NO: 8606 - DNA, 180 bp, Artificial Sequence
  Synthetic polynucleotide
atcatctcaccttgcctcctgcccaggttggataaggtcctgcaggcttgagtggctagacttgagtggcttcgcttgagtggctgaccttgagtggctctacttgagtggctactcttgagtggcttgccttgagtggctgtacttgagtggctggcgcgccatgcttcatcagactct

SEQ ID NO: 8607 - DNA, 180 bp, Artificial Sequence; identical to SEQ ID NO: 8606
  Synthetic polynucleotide

SEQ ID NO: 8608 - DNA, 190 bp, Artificial Sequence
  Synthetic polynucleotide
atcatctcaccttgcctcctgtgtaattcgggtgacttcctgcaggccacaggcaggtgcagaccacaggcaggtgctcgccacaggcaggtgcgacccacaggcaggtgcctaccacaggcaggtgcactccacaggcaggtgctgcccacaggcaggtgcgtaggcgcgccatgcttcatcagactct

SEQ ID NO: 8609 - DNA, 190 bp, Artificial Sequence; identical to SEQ ID NO: 8608
  Synthetic polynucleotide

SEQ ID NO: 8610 - DNA, 179 bp, Artificial Sequence
  Synthetic polynucleotide
atcatctcaccttgcctcctgcgatcccggtagtattccctgcaggaggtagagaattaggtgataaaaaagaaggtagagaattaggtgataaaaatcgaggtagagaattaggtgataaaaagacaggtagagaattaggtgataaaaactaggcgcgccatgcttcatcagactct

SEQ ID NO: 8611 - DNA, 179 bp, Artificial Sequence; identical to SEQ ID NO: 8610
  Synthetic polynucleotide

SEQ ID NO: 8612 - DNA, 190 bp, Artificial Sequence
  Synthetic polynucleotide
atcatctcaccttgcctcctggaaggtcatctttggatcctgcaggtttccccacacgacagatttccccacacgactcgtttccccacacgacgactttccccacacgacctatttccccacacgacacttttccccacacgactgctttccccacacgacgtaggcgcgccatgcttcatcagactct

SEQ ID NO: 8613 - DNA, 190 bp, Artificial Sequence; identical to SEQ ID NO: 8612
  Synthetic polynucleotide

SEQ ID NO: 8614 - DNA, 156 bp, Artificial Sequence
  Synthetic polynucleotide
atcatctcaccttgcctcctgcccatgtaatatatctccctgcaggcacgtggtagacacgtggttcgcacgtggtgaccacgtggtctacacgtggtactcacgtggttgccacgtggtgtacacgtggtggcgcgccatgcttcatcagactct

SEQ ID NO: 8615 - DNA, 156 bp, Artificial Sequence; identical to SEQ ID NO: 8614
  Synthetic polynucleotide

SEQ ID NO: 8616 - DNA, 172 bp, Artificial Sequence
  Synthetic polynucleotide
atcatctcaccttgcctcctgaagtagtgatgtccttacctgcaggacccggatgtagaacccggatgttcgacccggatgtgacacccggatgtctaacccggatgtactacccggatgttgcacccggatgtgtaacccggatgtggcgcgccatgcttcatcagactct

SEQ ID NO: 8617 - DNA, 172 bp, Artificial Sequence; identical to SEQ ID NO: 8616
  Synthetic polynucleotide

SEQ ID NO: 8618 - DNA, 191 bp, Artificial Sequence
  Synthetic polynucleotide
atcatctcaccttgcctcctgtatgctccgggcagaaccctgcaggggggcacgtgtcggctgagaggggcacgtgtcggctgtcgggggcacgtgtcggctggacggggcacgtgtcggctgctaggggcacgtgtcggctgactggggcacgtgtcggctgtgcggcgcgccatgcttcatcagactct

SEQ ID NO: 8619 - DNA, 191 bp, Artificial Sequence; identical to SEQ ID NO: 8618
  Synthetic polynucleotide

SEQ ID NO: 8620 - DNA, 197 bp, Artificial Sequence
  Synthetic polynucleotide
atcatctcaccttgcctcctgagtaccttcgtatcatgcctgcagggcagccaagcgtgacagagcagccaagcgtgactcggcagccaagcgtgacgacgcagccaagcgtgacctagcagccaagcgtgacactgcagccaagcgtgactgcgcagccaagcgtgacgtaggcgcgccatgcttcatcagactct

SEQ ID NO: 8621 - DNA, 197 bp, Artificial Sequence; identical to SEQ ID NO: 8620
  Synthetic polynucleotide

SEQ ID NO: 8622 - DNA, 183 bp, Artificial Sequence
  Synthetic polynucleotide
atcatctcaccttgcctcctggcaagcagtcgacacttcctgcaggtaaccaatataaccaattaataaccagataaccaatataaccaattaataacctcgtaaccaatataaccaattaataaccgactaaccaatataaccaattaataaccctaggcgcgccatgcttcatcagactct

SEQ ID NO: 8623 - DNA, 183 bp, Artificial Sequence; identical to SEQ ID NO: 8622
  Synthetic polynucleotide

SEQ ID NO: 8624 - DNA, 180 bp, Artificial Sequence
  Synthetic polynucleotide
atcatctcaccttgcctcctgtcttagtcagggaagtacctgcaggaccacgtggtcagaaccacgtggtctcgaccacgtggtcgacaccacgtggtcctaaccacgtggtcactaccacgtggtctgcaccacgtggtcgtaaccacgtggtcggcgcgccatgcttcatcagactct

SEQ ID NO: 8625 - DNA, 180 bp, Artificial Sequence; identical to SEQ ID NO: 8624
  Synthetic polynucleotide

SEQ ID NO: 8626 - DNA, 185 bp, Artificial Sequence
  Synthetic polynucleotide
atcatctcaccttgcctcctgtccgcgttaaatctacacctgcagggtcaattaattaatcaagagtcaattaattaatcatcggtcaattaattaatcagacgtcaattaattaatcactagtcaattaattaatcaactgtcaattaattaatcatgcggcgcgccatgcttcatcagactct

SEQ ID NO: 8627 - DNA, 185 bp, Artificial Sequence; identical to SEQ ID NO: 8626
  Synthetic polynucleotide

SEQ ID NO: 8628 - DNA, 172 bp, Artificial Sequence
  Synthetic polynucleotide
atcatctcaccttgcctcctgctatggacctagaggaccctgcaggttcctgctaaagattcctgctaatcgttcctgctaagacttcctgctaactattcctgctaaactttcctgctaatgcttcctgctaagtattcctgctaaggcgcgccatgcttcatcagactct

SEQ ID NO: 8629 - DNA, 172 bp, Artificial Sequence; identical to SEQ ID NO: 8628
  Synthetic polynucleotide

SEQ ID NO: 8630 - DNA, 172 bp, Artificial Sequence
  Synthetic polynucleotide
atcatctcaccttgcctcctgggtccgacgtgtcagttcctgcaggaattttaatgagaaattttaatgtcgaattttaatggacaattttaatgctaaattttaatgactaattttaatgtgcaattttaatggtaaattttaatgggcgcgccatgcttcatcagactct

SEQ ID NO: 8631 - DNA, 172 bp, Artificial Sequence; identical to SEQ ID NO: 8630
  Synthetic polynucleotide

SEQ ID NO: 8632 - DNA, 180 bp, Artificial Sequence
  Synthetic polynucleotide
atcatctcaccttgcctcctgagcgttgggattatgttcctgcagggtgacatatggagagtgacatatggtcggtgacatatgggacgtgacatatggctagtgacatatggactgtgacatatggtgcgtgacatatgggtagtgacatatggggcgcgccatgcttcatcagactct

SEQ ID NO: 8633 - DNA, 180 bp, Artificial Sequence; identical to SEQ ID NO: 8632
  Synthetic polynucleotide

SEQ ID NO: 8634 - DNA, 191 bp, Artificial Sequence
  Synthetic polynucleotide
atcatctcaccttgcctcctgaagacaggatctagtgccctgcagggtcggtaattatcgcgaagagtcggtaattatcgcgatcggtcggtaattatcgcgagacgtcggtaattatcgcgactagtcggtaattatcgcgaactgtcggtaattatcgcgatgcggcgcgccatgcttcatcagactct

SEQ ID NO: 8635 - DNA, 191 bp, Artificial Sequence; identical to SEQ ID NO: 8634
  Synthetic polynucleotide

SEQ ID NO: 8636 - DNA, 164 bp, Artificial Sequence
  Synthetic polynucleotide
atcatctcaccttgcctcctgcattgaaatccgtgttgcctgcaggaaatgctgaagaaaatgctgatcgaaatgctgagacaaatgctgactaaaatgctgaactaaatgctgatgcaaatgctgagtaaaatgctgaggcgcgccatgcttcatcagactct

SEQ ID NO: 8637 - DNA, 164 bp, Artificial Sequence; identical to SEQ ID NO: 8636
  Synthetic polynucleotide

SEQ ID NO: 8638 - DNA, 185 bp, Artificial Sequence
  Synthetic polynucleotide
atcatctcaccttgcctcctgccgctcatctagggtaacctgcaggtttagaacaataaaatagatttagaacaataaaattcgtttagaacaataaaatgactttagaacaataaaatctatttagaacaataaaatacttttagaacaataaaattgcggcgcgccatgcttcatcagactct

SEQ ID NO: 8639 - DNA, 185 bp, Artificial Sequence; identical to SEQ ID NO: 8638
  Synthetic polynucleotide

SEQ ID NO: 8640 - DNA, 197 bp, Artificial Sequence
  Synthetic polynucleotide
atcatctcaccttgcctcctggtttgtgaccttcgcgacctgcaggggggccgccatcttgagaggggccgccatcttgtcgggggccgccatcttggacggggccgccatcttgctaggggccgccatcttgactggggccgccatcttgtgcggggccgccatcttggtaggcgcgccatgcttcatcagactct

SEQ ID NO: 8641 - DNA, 197 bp, Artificial Sequence; identical to SEQ ID NO: 8640
  Synthetic polynucleotide

SEQ ID NO: 8642 - DNA, 185 bp, Artificial Sequence
  Synthetic polynucleotide
atcatctcaccttgcctcctgctgggacatagtatcaccctgcaggaaaaaccaattaagaaagaaaaaaccaattaagaatcgaaaaaccaattaagaagacaaaaaccaattaagaactaaaaaaccaattaagaaactaaaaaccaattaagaatgcggcgcgccatgcttcatcagactct

SEQ ID NO: 8643 - DNA, 185 bp, Artificial Sequence; identical to SEQ ID NO: 8642
  Synthetic polynucleotide

SEQ ID NO: 8644 - DNA, 172 bp, Artificial Sequence
  Synthetic polynucleotide
atcatctcaccttgcctcctgtattcgagtgactccatcctgcaggagaatattcgagaagaatattcgtcgagaatattcggacagaatattcgctaagaatattcgactagaatattcgtgcagaatattcggtaagaatattcgggcgcgccatgcttcatcagactct

SEQ ID NO: 8645 - DNA, 172 bp, Artificial Sequence; identical to SEQ ID NO: 8644
  Synthetic polynucleotide

SEQ ID NO: 8646 - DNA, 191 bp, Artificial Sequence
  Synthetic polynucleotide
atcatctcaccttgcctcctgtagtcgtaggtattctacctgcaggtgacctttagttgacctagatgacctttagttgaccttcgtgacctttagttgacctgactgacctttagttgacctctatgacctttagttgacctacttgacctttagttgaccttgcggcgcgccatgcttcatcagactct

SEQ ID NO: 8647 - DNA, 191 bp, Artificial Sequence; identical to SEQ ID NO: 8646
  Synthetic polynucleotide

SEQ ID NO: 8648 - DNA, 164 bp, Artificial Sequence
  Synthetic polynucleotide
atcatctcaccttgcctcctgaaaccgtgggcaccttacctgcaggcgctaattaagacgctaattatcgcgctaattagaccgctaattactacgctaattaactcgctaattatgccgctaattagtacgctaattaggcgcgccatgcttcatcagactct

SEQ ID NO: 8649 - DNA, 164 bp, Artificial Sequence; identical to SEQ ID NO: 8648
  Synthetic polynucleotide

SEQ ID NO: 8650 - DNA, 190 bp, Artificial Sequence
  Synthetic polynucleotide
atcatctcaccttgcctcctggactggagtcagacacacctgcaggaatgccacgtcatcagaaatgccacgtcatctcgaatgccacgtcatcgacaatgccacgtcatcctaaatgccacgtcatcactaatgccacgtcatctgcaatgccacgtcatcgtaggcgcgccatgcttcatcagactct

SEQ ID NO: 8651 - DNA, 190 bp, Artificial Sequence; identical to SEQ ID NO: 8650
  Synthetic polynucleotide

SEQ ID NO: 8652 - DNA, 188 bp, Artificial Sequence
  Synthetic polynucleotide
atcatctcaccttgcctcctgctttactcggatttgtgcctgcagggtggtgacgtggagagtggtgacgtggtcggtggtgacgtgggacgtggtgacgtggctagtggtgacgtggactgtggtgacgtggtgcgtggtgacgtgggtagtggtgacgtggggcgcgccatgcttcatcagactct

SEQ ID NO: 8653 - DNA, 188 bp, Artificial Sequence; identical to SEQ ID NO: 8652
  Synthetic polynucleotide

SEQ ID NO: 8654 - DNA, 180 bp, Artificial Sequence
  Synthetic polynucleotide
atcatctcaccttgcctcctgtgcatggtcggaccgtacctgcagggcacaacccagagagcacaacccagtcggcacaacccaggacgcacaacccagctagcacaacccagactgcacaacccagtgcgcacaacccaggtagcacaacccagggcgcgccatgcttcatcagactct

SEQ ID NO: 8655 - DNA, 180 bp, Artificial Sequence; identical to SEQ ID NO: 8654
  Synthetic polynucleotide

SEQ ID NO: 8656 - DNA, 185 bp, Artificial Sequence
  Synthetic polynucleotide
atcatctcaccttgcctcctggctaaatgatagcggtccctgcaggaaagtaattagtgaatagaaaagtaattagtgaattcgaaagtaattagtgaatgacaaagtaattagtgaatctaaaagtaattagtgaatactaaagtaattagtgaattgcggcgcgccatgcttcatcagactct

SEQ ID NO: 8657 - DNA, 185 bp, Artificial Sequence; identical to SEQ ID NO: 8656
  Synthetic polynucleotide

SEQ ID NO: 8658 - DNA, 200 bp, Artificial Sequence
  Synthetic polynucleotide
atcatctcaccttgcctcctgggtgcataaatgagaatcctgcaggcctcgtcacgcatgatggcagacctcgtcacgcatgatggctcgcctcgtcacgcatgatggcgaccctcgtcacgcatgatggcctacctcgtcacgcatgatggcactcctcgtcacgcatgatggcggcgcgccatgcttcatcagactct

SEQ ID NO: 8659 - DNA, 200 bp, Artificial Sequence; identical to SEQ ID NO: 8658
  Synthetic polynucleotide

SEQ ID NO: 8660 - DNA, 172 bp, Artificial Sequence
  Synthetic polynucleotide
atcatctcaccttgcctcctgcctagcccaacacgtgtcctgcagggttgcataacagagttgcataactcggttgcataacgacgttgcataacctagttgcataacactgttgcataactgcgttgcataacgtagttgcataacggcgcgccatgcttcatcagactct

SEQ ID NO: 8661 - DNA, 172 bp, Artificial Sequence; identical to SEQ ID NO: 8660
  Synthetic polynucleotide

SEQ ID NO: 8662 - DNA, 180 bp, Artificial Sequence
  Synthetic polynucleotide
atcatctcaccttgcctcctgggcactattcaagtagtcctgcagggcagataaggaagagcagataaggatcggcagataaggagacgcagataaggactagcagataaggaactgcagataaggatgcgcagataaggagtagcagataaggaggcgcgccatgcttcatcagactct

SEQ ID NO: 8663 - DNA, 180 bp, Artificial Sequence; identical to SEQ ID NO: 8662
  Synthetic polynucleotide

SEQ ID NO: 8664 - DNA, 180 bp, Artificial Sequence
  Synthetic polynucleotide
atcatctcaccttgcctcctgctagcgctaaccgtcttcctgcagggaacagctgtcagagaacagctgtctcggaacagctgtcgacgaacagctgtcctagaacagctgtcactgaacagctgtctgcgaacagctgtcgtagaacagctgtcggcgcgccatgcttcatcagactct

SEQ ID NO: 8665 - DNA, 180 bp, Artificial Sequence; identical to SEQ ID NO: 8664
  Synthetic polynucleotide

SEQ ID NO: 8666 - DNA, 180 bp, Artificial Sequence
  Synthetic polynucleotide
atcatctcaccttgcctcctgatgagaccacatgaaaccctgcaggtttttccttatagatttttccttattcgtttttccttatgactttttccttatctatttttccttatacttttttccttattgctttttccttatgtatttttccttatggcgcgccatgcttcatcagactct

SEQ ID NO: 8667 - DNA, 180 bp, Artificial Sequence; identical to SEQ ID NO: 8666
  Synthetic polynucleotide

SEQ ID NO: 8668 - DNA, 190 bp, Artificial Sequence
  Synthetic polynucleotide
atcatctcaccttgcctcctgcgatgaatgtagctgtacctgcaggaaaaacagtagccgagaaaaaacagtagccgtcgaaaaacagtagccggacaaaaacagtagccgctaaaaaacagtagccgactaaaaacagtagccgtgcaaaaacagtagccggtaggcgcgccatgcttcatcagactct

SEQ ID NO: 8669 - DNA, 190 bp, Artificial Sequence; identical to SEQ ID NO: 8668
  Synthetic polynucleotide

SEQ ID NO: 8670 - DNA, 172 bp, Artificial Sequence
  Synthetic polynucleotide
atcatctcaccttgcctcctgatgatgattcgatatcccctgcaggttccgttattagattccgttatttcgttccgttattgacttccgttattctattccgttattactttccgttatttgcttccgttattgtattccgttattggcgcgccatgcttcatcagactct

SEQ ID NO: 8671 - DNA, 172 bp, Artificial Sequence; identical to SEQ ID NO: 8670
  Synthetic polynucleotide

SEQ ID NO: 8672 - DNA, 172 bp, Artificial Sequence
  Synthetic polynucleotide
atcatctcaccttgcctcctgctgttattcttccgtcgcctgcaggttcttatctgagattcttatctgtcgttcttatctggacttcttatctgctattcttatctgactttcttatctgtgcttcttatctggtattcttatctgggcgcgccatgcttcatcagactct

SEQ ID NO: 8673 - DNA, 172 bp, Artificial Sequence; identical to SEQ ID NO: 8672
  Synthetic polynucleotide

SEQ ID NO: 8674 - DNA, 197 bp, Artificial Sequence
  Synthetic polynucleotide
atcatctcaccttgcctcctgaaactgctacgactgtgcctgcagggggccgcagccctttagagggccgcagcccttttcggggccgcagccctttgacgggccgcagccctttctagggccgcagccctttactgggccgcagcccttttgcgggccgcagccctttgtaggcgcgccatgcttcatcagactct

SEQ ID NO: 8675 - DNA, 197 bp, Artificial Sequence; identical to SEQ ID NO: 8674
  Synthetic polynucleotide

SEQ ID NO: 8676 - DNA, 156 bp, Artificial Sequence
  Synthetic polynucleotide
atcatctcaccttgcctcctgatgccgccactataggtcctgcaggtgactcaaagatgactcaatcgtgactcaagactgactcaactatgactcaaacttgactcaatgctgactcaagtatgactcaaggcgcgccatgcttcatcagactct

SEQ ID NO: 8677 - DNA, 156 bp, Artificial Sequence; identical to SEQ ID NO: 8676
  Synthetic polynucleotide

SEQ ID NO: 8678 - DNA, 196 bp, Artificial Sequence
  Synthetic polynucleotide
atcatctcaccttgcctcctggggtttacggcttataacctgcaggtgtaaataaacaaagatgtaaataaacaatcgtgtaaataaacaagactgtaaataaacaactatgtaaataaacaaacttgtaaataaacaatgctgtaaataaacaagtatgtaaataaacaaggcgcgccatgcttcatcagactct

SEQ ID NO: 8679 - DNA, 196 bp, Artificial Sequence; identical to SEQ ID NO: 8678
  Synthetic polynucleotide

SEQ ID NO: 8680 - DNA, 172 bp, Artificial Sequence
  Synthetic polynucleotide
atcatctcaccttgcctcctgctgcgtccatcctacgacctgcaggactagttaacagaactagttaactcgactagttaacgacactagttaacctaactagttaacactactagttaactgcactagttaacgtaactagttaacggcgcgccatgcttcatcagactct

SEQ ID NO: 8681 - DNA, 172 bp, Artificial Sequence; identical to SEQ ID NO: 8680
  Synthetic polynucleotide

SEQ ID NO: 8682 - DNA, 197 bp, Artificial Sequence
  Synthetic polynucleotide
atcatctcaccttgcctcctgagcacacagtgacccgacctgcaggaagtcagcatttttaagaaagtcagcatttttatcgaagtcagcatttttagacaagtcagcatttttactaaagtcagcatttttaactaagtcagcatttttatgcaagtcagcatttttagtaggcgcgccatgcttcatcagactct

SEQ ID NO: 8683 - DNA, 197 bp, Artificial Sequence; identical to SEQ ID NO: 8682
  Synthetic polynucleotide

SEQ ID NO: 8684 - DNA, 172 bp, Artificial Sequence
  Synthetic polynucleotide
atcatctcaccttgcctcctggagtcggtccattgattcctgcaggaacagctgttagaaacagctgtttcgaacagctgttgacaacagctgttctaaacagctgttactaacagctgtttgcaacagctgttgtaaacagctgttggcgcgccatgcttcatcagactct

SEQ ID NO: 8685 - DNA, 172 bp, Artificial Sequence; identical to SEQ ID NO: 8684
  Synthetic polynucleotide

SEQ ID NO: 8686 - DNA, 200 bp, Artificial Sequence
  Synthetic polynucleotide
atcatctcaccttgcctcctggtaacttaggtaccaaccctgcaggtgtgcagtcatgcgtgaaaagatgtgcagtcatgcgtgaaatcgtgtgcagtcatgcgtgaaagactgtgcagtcatgcgtgaaactatgtgcagtcatgcgtgaaaacttgtgcagtcatgcgtgaaaggcgcgccatgcttcatcagactct

SEQ ID NO: 8687 - DNA, 200 bp, Artificial Sequence; identical to SEQ ID NO: 8686
  Synthetic polynucleotide

SEQ ID NO: 8688 - DNA, 180 bp, Artificial Sequence
  Synthetic polynucleotide
atcatctcaccttgcctcctgcaaaggctgatggttgccctgcagggtgggtgtggcagagtgggtgtggctcggtgggtgtggcgacgtgggtgtggcctagtgggtgtggcactgtgggtgtggctgcgtgggtgtggcgtagtgggtgtggcggcgcgccatgcttcatcagactct

SEQ ID NO: 8689 - DNA, 180 bp, Artificial Sequence; identical to SEQ ID NO: 8688
  Synthetic polynucleotide

SEQ ID NO: 8690 - DNA, 200 bp, Artificial Sequence
  Synthetic polynucleotide
atcatctcaccttgcctcctgctttaaccacgaacacgcctgcaggcctcgtcacgcatgatggaagacctcgtcacgcatgatggatcgcctcgtcacgcatgatggagaccctcgtcacgcatgatggactacctcgtcacgcatgatggaactcctcgtcacgcatgatggaggcgcgccatgcttcatcagactct

SEQ ID NO: 8691 - DNA, 200 bp, Artificial Sequence; identical to SEQ ID NO: 8690
  Synthetic polynucleotide

SEQ ID NO: 8692 - DNA, 172 bp, Artificial Sequence
  Synthetic polynucleotide
atcatctcaccttgcctcctgcatatcacacgccctttcctgcaggtatttgcataagatatttgcatatcgtatttgcatagactatttgcatactatatttgcataacttatttgcatatgctatttgcatagtatatttgcataggcgcgccatgcttcatcagactct

SEQ ID NO: 8693 - DNA, 172 bp, Artificial Sequence; identical to SEQ ID NO: 8692
  Synthetic polynucleotide

SEQ ID NO: 8694 - DNA, 190 bp, Artificial Sequence
  Synthetic polynucleotide
atcatctcaccttgcctcctgttatggcgatcaaacggcctgcagggtttagaacaattaagagtttagaacaattatcggtttagaacaattagacgtttagaacaattactagtttagaacaattaactgtttagaacaattatgcgtttagaacaattagtaggcgcgccatgcttcatcagactct

SEQ ID NO: 8695 - DNA, 190 bp, Artificial Sequence; identical to SEQ ID NO: 8694
  Synthetic polynucleotide

SEQ ID NO: 8696 - DNA, 180 bp, Artificial Sequence
  Synthetic polynucleotide
atcatctcaccttgcctcctggccgcaagaaccgatagcctgcaggggctaattagcagaggctaattagctcgggctaattagcgacggctaattagcctaggctaattagcactggctaattagctgcggctaattagcgtaggctaattagcggcgcgccatgcttcatcagactct

SEQ ID NO: 8697 - DNA, 180 bp, Artificial Sequence; identical to SEQ ID NO: 8696
  Synthetic polynucleotide

SEQ ID NO: 8698 - DNA, 188 bp, Artificial Sequence
  Synthetic polynucleotide
atcatctcaccttgcctcctgggtgctgcgcatttggacctgcaggaatgacgtcaccagaaatgacgtcacctcgaatgacgtcaccgacaatgacgtcaccctaaatgacgtcaccactaatgacgtcacctgcaatgacgtcaccgtaaatgacgtcaccggcgcgccatgcttcatcagactct

SEQ ID NO: 8699 - DNA, 188 bp, Artificial Sequence; identical to SEQ ID NO: 8698
  Synthetic polynucleotide

SEQ ID NO: 8700 - DNA, 197 bp, Artificial Sequence
  Synthetic polynucleotide
atcatctcaccttgcctcctgtggagtgtccgaaagctcctgcagggcacccttgggtgccagagcacccttgggtgcctcggcacccttgggtgccgacgcacccttgggtgccctagcacccttgggtgccactgcacccttgggtgcctgcgcacccttgggtgccgtaggcgcgccatgcttcatcagactct

SEQ ID NO: 8701 - DNA, 197 bp, Artificial Sequence; identical to SEQ ID NO: 8700
  Synthetic polynucleotide

SEQ ID NO: 8702 - DNA, 197 bp, Artificial Sequence
  Synthetic polynucleotide
atcatctcaccttgcctcctgtcttagtaaatgtcgaccctgcaggctgaactttcctgaccccagactgaactttcctgacccctcgctgaactttcctgaccccgacctgaactttcctgaccccctactgaactttcctgaccccactctgaactttcctgacccctgcggcgcgccatgcttcatcagactct

SEQ ID NO: 8703 - DNA, 197 bp, Artificial Sequence; identical to SEQ ID NO: 8702
  Synthetic polynucleotide

SEQ ID NO: 8704 - DNA, 156 bp, Artificial Sequence
  Synthetic polynucleotide
atcatctcaccttgcctcctgggtgactatctgccgtacctgcaggatttccggagaatttccggtcgatttccgggacatttccggctaatttccggactatttccggtgcatttccgggtaatttccggggcgcgccatgcttcatcagactct

SEQ ID NO: 8705 - DNA, 156 bp, Artificial Sequence; identical to SEQ ID NO: 8704
  Synthetic polynucleotide

SEQ ID NO: 8706 - DNA, 188 bp, Artificial Sequence
  Synthetic polynucleotide
atcatctcaccttgcctcctgtgtcctgatgagagaaacctgcagggattgtgtccggagagattgtgtccggtcggattgtgtccgggacgattgtgtccggctagattgtgtccggactgattgtgtccggtgcgattgtgtccgggtagattgtgtccggggcgcgccatgcttcatcagactct

SEQ ID NO: 8707 - DNA, 188 bp, Artificial Sequence; identical to SEQ ID NO: 8706
  Synthetic polynucleotide

SEQ ID NO: 8708 - DNA, 164 bp, Artificial Sequence
  Synthetic polynucleotide
atcatctcaccttgcctcctgatatcctcgactttagccctgcaggtgggaacatagatgggaacattcgtgggaacatgactgggaacatctatgggaacatacttgggaacattgctgggaacatgtatgggaacatggcgcgccatgcttcatcagactct

SEQ ID NO: 8709 - DNA, 164 bp, Artificial Sequence; identical to SEQ ID NO: 8708
  Synthetic polynucleotide

SEQ ID NO: 8710 - DNA, 197 bp, Artificial Sequence
  Synthetic polynucleotide
atcatctcaccttgcctcctggtttactgagttgtcggcctgcaggtgacctcaaatgacctttagatgacctcaaatgaccttttcgtgacctcaaatgacctttgactgacctcaaatgacctttctatgacctcaaatgacctttacttgacctcaaatgaccttttgcggcgcgccatgcttcatcagactct

SEQ ID NO: 8711 - DNA, 197 bp, Artificial Sequence; identical to SEQ ID NO: 8710
  Synthetic polynucleotide

SEQ ID NO: 8712 - DNA, 197 bp, Artificial Sequence
  Synthetic polynucleotide
atcatctcaccttgcctcctgcagaggatacgaagggtcctgcaggaaagtaataaatcatagaaaagtaataaatcattcgaaagtaataaatcatgacaaagtaataaatcatctaaaagtaataaatcatactaaagtaataaatcattgcaaagtaataaatcatgtaggcgcgccatgcttcatcagactct

SEQ ID NO: 8713 - DNA, 197 bp, Artificial Sequence; identical to SEQ ID NO: 8712
  Synthetic polynucleotide

SEQ ID NO: 8714 - DNA, 180 bp, Artificial Sequence
  Synthetic polynucleotide
atcatctcaccttgcctcctgcttgtagtaagggaaaccctgcaggaaatcacagcaagaaaatcacagcatcgaaatcacagcagacaaatcacagcactaaaatcacagcaactaaatcacagcatgcaaatcacagcagtaaaatcacagcaggcgcgccatgcttcatcagactct

SEQ ID NO: 8715 - DNA, 180 bp, Artificial Sequence; identical to SEQ ID NO: 8714
  Synthetic polynucleotide

SEQ ID NO: 8716 - DNA, 197 bp, Artificial Sequence
  Synthetic polynucleotide
atcatctcaccttgcctcctgtctcgaccctggtatttcctgcagggggggttgacgcagaagagggggttgacgcagatcggggggttgacgcagagacgggggttgacgcagactagggggttgacgcagaactgggggttgacgcagatgcgggggttgacgcagagtaggcgcgccatgcttcatcagactct

SEQ ID NO: 8717 - DNA, 197 bp, Artificial Sequence; identical to SEQ ID NO: 8716
  Synthetic polynucleotide

SEQ ID NO: 8718 - DNA, 180 bp, Artificial Sequence
  Synthetic polynucleotide
atcatctcaccttgcctcctggtggctacggaccataacctgcaggaataaacaataagaaataaacaatatcgaataaacaatagacaataaacaatactaaataaacaataactaataaacaatatgcaataaacaatagtaaataaacaataggcgcgccatgcttcatcagactct

SEQ ID NO: 8719 - DNA, 180 bp, Artificial Sequence; identical to SEQ ID NO: 8718
  Synthetic polynucleotide

SEQ ID NO: 8720 - DNA, 172 bp, Artificial Sequence
  Synthetic polynucleotide
atcatctcaccttgcctcctgaacagccgaaagggcgacctgcaggtgacgtcattagatgacgtcatttcgtgacgtcattgactgacgtcattctatgacgtcattacttgacgtcatttgctgacgtcattgtatgacgtcattggcgcgccatgcttcatcagactct

SEQ ID NO: 8721 - DNA, 172 bp, Artificial Sequence; identical to SEQ ID NO: 8720
  Synthetic polynucleotide

SEQ ID NO: 8722 - DNA, 156 bp, Artificial Sequence
  Synthetic polynucleotide
atcatctcaccttgcctcctggtcgggaatcaattggtcctgcagggtaaacagagagtaaacagtcggtaaacaggacgtaaacagctagtaaacagactgtaaacagtgcgtaaacaggtagtaaacagggcgcgccatgcttcatcagactct

SEQ ID NO: 8723 - DNA, 156 bp, Artificial Sequence; identical to SEQ ID NO: 8722
  Synthetic polynucleotide

SEQ ID NO: 8724 - DNA, 188 bp, Artificial Sequence
  Synthetic polynucleotide
atcatctcaccttgcctcctgcgctttcaagcgattagcctgcaggatgaatattcaaagaatgaatattcaatcgatgaatattcaagacatgaatattcaactaatgaatattcaaactatgaatattcaatgcatgaatattcaagtaatgaatattcaaggcgcgccatgcttcatcagactct

SEQ ID NO: 8725 - DNA, 188 bp, Artificial Sequence; identical to SEQ ID NO: 8724
  Synthetic polynucleotide

SEQ ID NO: 8726 - DNA, 191 bp, Artificial Sequence
  Synthetic polynucleotide
atcatctcaccttgcctcctgtgagtttgcttctatagcctgcaggcgggtgacctttgacccctgaagacgggtgacctttgacccctgatcgcgggtgacctttgacccctgagaccgggtgacctttgacccctgactacgggtgacctttgacccctgaactggcgcgccatgcttcatcagactct

SEQ ID NO: 8727 - DNA, 191 bp, Artificial Sequence; identical to SEQ ID NO: 8726
  Synthetic polynucleotide

SEQ ID NO: 8728 - DNA, 185 bp, Artificial Sequence
  Synthetic polynucleotide
atcatctcaccttgcctcctgctaccttgtggttaggacctgcaggttcaattgttctaaaaagattcaattgttctaaaatcgttcaattgttctaaaagacttcaattgttctaaaactattcaattgttctaaaaactttcaattgttctaaaatgcggcgcgccatgcttcatcagactct

SEQ ID NO: 8729 - DNA, 185 bp, Artificial Sequence; identical to SEQ ID NO: 8728
  Synthetic polynucleotide

SEQ ID NO: 8730 - DNA, 197 bp, Artificial Sequence
  Synthetic polynucleotide
atcatctcaccttgcctcctgctgtattggccgaaggccctgcaggccagctcaaaccagcagaccagctcaaaccagctcgccagctcaaaccagcgacccagctcaaaccagcctaccagctcaaaccagcactccagctcaaaccagctgcccagctcaaaccagcgtaggcgcgccatgcttcatcagactct

SEQ ID NO: 8731 - DNA, 197 bp, Artificial Sequence; identical to SEQ ID NO: 8730
  Synthetic polynucleotide

SEQ ID NO: 8732 - DNA, 156 bp, Artificial Sequence
  Synthetic polynucleotide
atcatctcaccttgcctcctggagctggttgtgctagacctgcagggtaaacaaagagtaaacaatcggtaaacaagacgtaaacaactagtaaacaaactgtaaacaatgcgtaaacaagtagtaaacaaggcgcgccatgcttcatcagactct

SEQ ID NO: 8733 - DNA, 156 bp, Artificial Sequence; identical to SEQ ID NO: 8732
  Synthetic polynucleotide

SEQ ID NO: 8734 - DNA, 196 bp, Artificial Sequence
  Synthetic polynucleotide
atcatctcaccttgcctcctgcttaaccggagtcaactcctgcaggcgggggcgcgcttagacgggggcgcgctttcgcgggggcgcgcttgaccgggggcgcgcttctacgggggcgcgcttactcgggggcgcgctttgccgggggcgcgcttgtacgggggcgcgcttggcgcgccatgcttcatcagactct

SEQ ID NO: 8735 - DNA, 196 bp, Artificial Sequence; identical to SEQ ID NO: 8734
  Synthetic polynucleotide

SEQ ID NO: 8736 - DNA, 190 bp, Artificial Sequence
  Synthetic polynucleotide
atcatctcaccttgcctcctgttgaggtatttggaggacctgcaggatgcattaattcatagaatgcattaattcattcgatgcattaattcatgacatgcattaattcatctaatgcattaattcatactatgcattaattcattgcatgcattaattcatgtaggcgcgccatgcttcatcagactct

SEQ ID NO: 8737 - DNA, 190 bp, Artificial Sequence; identical to SEQ ID NO: 8736
  Synthetic polynucleotide

SEQ ID NO: 8738 - DNA, 188 bp, Artificial Sequence
  Synthetic polynucleotide
atcatctcaccttgcctcctgatgggttaatgagaagacctgcaggatgaatattcatagaatgaatattcattcgatgaatattcatgacatgaatattcatctaatgaatattcatactatgaatattcattgcatgaatattcatgtaatgaatattcatggcgcgccatgcttcatcagactct

SEQ ID NO: 8739 - DNA, 188 bp, Artificial Sequence; identical to SEQ ID NO: 8738
  Synthetic polynucleotide

SEQ ID NO: 8740 - DNA, 185 bp, Artificial Sequence
  Synthetic polynucleotide
atcatctcaccttgcctcctgaagttaccgtactatcccctgcaggatcaatgtgcagtgatagaatcaatgtgcagtgattcgatcaatgtgcagtgatgacatcaatgtgcagtgatctaatcaatgtgcagtgatactatcaatgtgcagtgattgcggcgcgccatgcttcatcagactct

SEQ ID NO: 8741 - DNA, 185 bp, Artificial Sequence; identical to SEQ ID NO: 8740
  Synthetic polynucleotide

SEQ ID NO: 8742 - DNA, 172 bp, Artificial Sequence
  Synthetic polynucleotide
atcatctcaccttgcctcctgggcctcgcgtcttacatcctgcaggattacgcaatagaattacgcaattcgattacgcaatgacattacgcaatctaattacgcaatactattacgcaattgcattacgcaatgtaattacgcaatggcgcgccatgcttcatcagactct

SEQ ID NO: 8743 - DNA, 172 bp, Artificial Sequence; identical to SEQ ID NO: 8742
  Synthetic polynucleotide

SEQ ID NO: 8744 - DNA, 185 bp, Artificial Sequence
  Synthetic polynucleotide
atcatctcaccttgcctcctgtatccagagatctgacgcctgcaggcggacacctgttcttcagacggacacctgttcttctcgcggacacctgttcttcgaccggacacctgttcttcctacggacacctgttcttcactcggacacctgttcttctgcggcgcgccatgcttcatcagactct

SEQ ID NO: 8745 - DNA, 185 bp, Artificial Sequence; identical to SEQ ID NO: 8744
  Synthetic polynucleotide

SEQ ID NO: 8746 - DNA, 188 bp, Artificial Sequence
  Synthetic polynucleotide
atcatctcaccttgcctcctgagtcacgtgcggaactacctgcaggcatgactcagacagacatgactcagactcgcatgactcagacgaccatgactcagacctacatgactcagacactcatgactcagactgccatgactcagacgtacatgactcagacggcgcgccatgcttcatcagactct

SEQ ID NO: 8747 - DNA, 188 bp, Artificial Sequence; identical to SEQ ID NO: 8746
  Synthetic polynucleotide

SEQ ID NO: 8748 - DNA, 197 bp, Artificial Sequence
  Synthetic polynucleotide
atcatctcaccttgcctcctgtcttgcatcagaaaccgcctgcagggggtcacgtggcgggagagggtcacgtggcgggtcggggtcacgtggcggggacgggtcacgtggcgggctagggtcacgtggcgggactgggtcacgtggcgggtgcgggtcacgtggcggggtaggcgcgccatgcttcatcagactct

SEQ ID NO: 8749 - DNA, 197 bp, Artificial Sequence; identical to SEQ ID NO: 8748
  Synthetic polynucleotide

SEQ ID NO: 8750 - DNA, 190 bp, Artificial Sequence
  Synthetic polynucleotide
atcatctcaccttgcctcctgtgggtactatagctgtgcctgcaggcagtttcggttctcagacagtttcggttctctcgcagtttcggttctcgaccagtttcggttctcctacagtttcggttctcactcagtttcggttctctgccagtttcggttctcgtaggcgcgccatgcttcatcagactct

SEQ ID NO: 8751 - DNA, 190 bp, Artificial Sequence; identical to SEQ ID NO: 8750
  Synthetic polynucleotide

SEQ ID NO: 8752 - DNA, 180 bp, Artificial Sequence
  Synthetic polynucleotide
atcatctcaccttgcctcctgggagcacctggctgattcctgcaggcccattgttctagacccattgttcttcgcccattgttctgaccccattgttctctacccattgttctactcccattgttcttgccccattgttctgtacccattgttctggcgcgccatgcttcatcagactct

SEQ ID NO: 8753 - DNA, 180 bp, Artificial Sequence; identical to SEQ ID NO: 8752
  Synthetic polynucleotide

SEQ ID NO: 8754 - DNA, 197 bp, Artificial Sequence
  Synthetic polynucleotide
atcatctcaccttgcctcctgcatgttaacgttgtccccctgcaggtgtaattaattatggagatgtaattaattatggtcgtgtaattaattatgggactgtaattaattatggctatgtaattaattatggacttgtaattaattatggtgctgtaattaattatgggtaggcgcgccatgcttcatcagactct

SEQ ID NO: 8755 - DNA, 197 bp, Artificial Sequence; identical to SEQ ID NO: 8754
  Synthetic polynucleotide

SEQ ID NO: 8756 - DNA, 197 bp, Artificial Sequence
  Synthetic polynucleotide
atcatctcaccttgcctcctgttccttgttgaggaatacctgcaggaggacccggaagtaaagaaggacccggaagtaatcgaggacccggaagtaagacaggacccggaagtaactaaggacccggaagtaaactaggacccggaagtaatgcaggacccggaagtaagtaggcgcgccatgcttcatcagactct

SEQ ID NO: 8757 - DNA, 197 bp, Artificial Sequence; identical to SEQ ID NO: 8756
  Synthetic polynucleotide

SEQ ID NO: 8758 - DNA, 180 bp, Artificial Sequence
  Synthetic polynucleotide
atcatctcaccttgcctcctgatcggacaacggcacagcctgcagggtgtccgtctgagagtgtccgtctgtcggtgtccgtctggacgtgtccgtctgctagtgtccgtctgactgtgtccgtctgtgcgtgtccgtctggtagtgtccgtctgggcgcgccatgcttcatcagactct

SEQ ID NO: 8759 - DNA, 180 bp, Artificial Sequence; identical to SEQ ID NO: 8758
  Synthetic polynucleotide

SEQ ID NO: 8760 - DNA, 197 bp, Artificial Sequence
  Synthetic polynucleotide
atcatctcaccttgcctcctgctacggacgagggtacacctgcaggcaccaatatgtatggagacaccaatatgtatggtcgcaccaatatgtatgggaccaccaatatgtatggctacaccaatatgtatggactcaccaatatgtatggtgccaccaatatgtatgggtaggcgcgccatgcttcatcagactct

SEQ ID NO: 8761 - DNA, 197 bp, Artificial Sequence; identical to SEQ ID NO: 8760
  Synthetic polynucleotide

SEQ ID NO: 8762 - DNA, 172 bp, Artificial Sequence
  Synthetic polynucleotide
atcatctcaccttgcctcctgcagggcctaacttagggcctgcaggtgacgtcatcagatgacgtcatctcgtgacgtcatcgactgacgtcatcctatgacgtcatcacttgacgtcatctgctgacgtcatcgtatgacgtcatcggcgcgccatgcttcatcagactct

SEQ ID NO: 8763 - DNA, 172 bp, Artificial Sequence; identical to SEQ ID NO: 8762
  Synthetic polynucleotide

SEQ ID NO: 8764 - DNA, 172 bp, Artificial Sequence
  Synthetic polynucleotide
atcatctcaccttgcctcctgttatgcagactgagggacctgcagggcgatcgattagagcgatcgatttcggcgatcgattgacgcgatcgattctagcgatcgattactgcgatcgatttgcgcgatcgattgtagcgatcgattggcgcgccatgcttcatcagactct

SEQ ID NO: 8765 - DNA, 172 bp, Artificial Sequence; identical to SEQ ID NO: 8764
  Synthetic polynucleotide

SEQ ID NO: 8766 - DNA, 191 bp, Artificial Sequence
  Synthetic polynucleotide
atcatctcaccttgcctcctgcaccgacgtagggtttgcctgcaggaaacaattgcagtgtttagaaaacaattgcagtgttttcgaaacaattgcagtgtttgacaaacaattgcagtgtttctaaaacaattgcagtgtttactaaacaattgcagtgttttgcggcgcgccatgcttcatcagactct

SEQ ID NO: 8767 - DNA, 191 bp, Artificial Sequence; identical to SEQ ID NO: 8766
  Synthetic polynucleotide

SEQ ID NO: 8768 - DNA, 197 bp, Artificial Sequence
  Synthetic polynucleotide
atcatctcaccttgcctcctgaacgcgatgcctgtggacctgcagggcggtgaccttcggactgagagcggtgaccttcggactgtcggcggtgaccttcggactggacgcggtgaccttcggactgctagcggtgaccttcggactgactgcggtgaccttcggactgtgcggcgcgccatgcttcatcagactct

SEQ ID NO: 8769 - DNA, 197 bp, Artificial Sequence; identical to SEQ ID NO: 8768
  Synthetic polynucleotide

SEQ ID NO: 8770 - DNA, 156 bp, Artificial Sequence
  Synthetic polynucleotide
atcatctcaccttgcctcctgtctctcataacttcacgcctgcaggggagttcaagaggagttcatcgggagttcagacggagttcactaggagttcaactggagttcatgcggagttcagtaggagttcaggcgcgccatgcttcatcagactct

SEQ ID NO: 8771 - DNA, 156 bp, Artificial Sequence; identical to SEQ ID NO: 8770
  Synthetic polynucleotide

SEQ ID NO: 8772 - DNA, 180 bp, Artificial Sequence
  Synthetic polynucleotide
atcatctcaccttgcctcctgatgatagcggttacccacctgcagggcacacctgcgagagcacacctgcgtcggcacacctgcggacgcacacctgcgctagcacacctgcgactgcacacctgcgtgcgcacacctgcggtagcacacctgcgggcgcgccatgcttcatcagactct

SEQ ID NO: 8773 - DNA, 180 bp, Artificial Sequence; identical to SEQ ID NO: 8772
  Synthetic polynucleotide

SEQ ID NO: 8774 - DNA, 191 bp, Artificial Sequence
  Synthetic polynucleotide
atcatctcaccttgcctcctgccaacagtgcactacgccctgcaggtcgcgataattaccgacagatcgcgataattaccgactcgtcgcgataattaccgacgactcgcgataattaccgacctatcgcgataattaccgacacttcgcgataattaccgactgcggcgcgccatgcttcatcagactct

SEQ ID NO: 8775 - DNA, 191 bp, Artificial Sequence; identical to SEQ ID NO: 8774
  Synthetic polynucleotide

SEQ ID NO: 8776 - DNA, 172 bp, Artificial Sequence
  Synthetic polynucleotide
atcatctcaccttgcctcctggaacgtgggaactgcgacctgcaggcagataaggcagacagataaggctcgcagataaggcgaccagataaggcctacagataaggcactcagataaggctgccagataaggcgtacagataaggcggcgcgccatgcttcatcagactct

SEQ ID NO: 8777 - DNA, 172 bp, Artificial Sequence; identical to SEQ ID NO: 8776
  Synthetic polynucleotide

SEQ ID NO: 8778 - DNA, 197 bp, Artificial Sequence
  Synthetic polynucleotide
atcatctcaccttgcctcctgggcgagttggtctttagcctgcaggtcaaaaaattgcattagatcaaaaaattgcatttcgtcaaaaaattgcattgactcaaaaaattgcattctatcaaaaaattgcattacttcaaaaaattgcatttgctcaaaaaattgcattgtaggcgcgccatgcttcatcagactct

SEQ ID NO: 8779 - DNA, 197 bp, Artificial Sequence; identical to SEQ ID NO: 8778
  Synthetic polynucleotide

SEQ ID NO: 8780 - DNA, 188 bp, Artificial Sequence
  Synthetic polynucleotide
atcatctcaccttgcctcctgacacgattaggtcacgtcctgcagggggaaatcccccagagggaaatccccctcggggaaatcccccgacgggaaatcccccctagggaaatcccccactgggaaatccccctgcgggaaatcccccgtagggaaatcccccggcgcgccatgcttcatcagactct

SEQ ID NO: 8781 - DNA, 188 bp, Artificial Sequence; identical to SEQ ID NO: 8780
  Synthetic polynucleotide

SEQ ID NO: 8782 - DNA, 197 bp, Artificial Sequence
  Synthetic polynucleotide
atcatctcaccttgcctcctggtctgccagttatttcccctgcaggtacaaacaaagtaataaaagatacaaacaaagtaataaatcgtacaaacaaagtaataaagactacaaacaaagtaataaactatacaaacaaagtaataaaacttacaaacaaagtaataaatgcggcgcgccatgcttcatcagactct

SEQ ID NO: 8783 - DNA, 197 bp, Artificial Sequence; identical to SEQ ID NO: 8782
  Synthetic polynucleotide

SEQ ID NO: 8784 - DNA, 196 bp, Artificial Sequence
  Synthetic polynucleotide
atcatctcaccttgcctcctggatctcggatcatacgccctgcaggtaatttatgcataagataatttatgcatatcgtaatttatgcatagactaatttatgcatactataatttatgcataacttaatttatgcatatgctaatttatgcatagtataatttatgcataggcgcgccatgcttcatcagactct

SEQ ID NO: 8785 - DNA, 196 bp, Artificial Sequence; identical to SEQ ID NO: 8784
  Synthetic polynucleotide

SEQ ID NO: 8786 - DNA, 190 bp, Artificial Sequence
  Synthetic polynucleotide
atcatctcaccttgcctcctggactcgataaagaacaacctgcaggattaattacctcagagaattaattacctcagtcgattaattacctcaggacattaattacctcagctaattaattacctcagactattaattacctcagtgcattaattacctcaggtaggcgcgccatgcttcatcagactct

SEQ ID NO: 8787 - DNA, 190 bp, Artificial Sequence; identical to SEQ ID NO: 8786
  Synthetic polynucleotide

SEQ ID NO: 8788 - DNA, 197 bp, Artificial Sequence
  Synthetic polynucleotide
atcatctcaccttgcctcctgcactatggtcttgaatccctgcaggatcaataacattgatagaatcaataacattgattcgatcaataacattgatgacatcaataacattgatctaatcaataacattgatactatcaataacattgattgcatcaataacattgatgtaggcgcgccatgcttcatcagactct

SEQ ID NO: 8789 - DNA, 197 bp, Artificial Sequence; identical to SEQ ID NO: 8788
  Synthetic polynucleotide

SEQ ID NO: 8790 - DNA, 191 bp, Artificial Sequence
  Synthetic polynucleotide
atcatctcaccttgcctcctgcaggagtaagcacgcgtcctgcagggatgattaatcccttcaagagatgattaatcccttcatcggatgattaatcccttcagacgatgattaatcccttcactagatgattaatcccttcaactgatgattaatcccttcatgcggcgcgccatgcttcatcagactct

SEQ ID NO: 8791 - DNA, 191 bp, Artificial Sequence; identical to SEQ ID NO: 8790
  Synthetic polynucleotide

SEQ ID NO: 8792 - DNA, 156 bp, Artificial Sequence
  Synthetic polynucleotide
atcatctcaccttgcctcctgaagcagtggtgctgaatcctgcagggcatgagtagagcatgagttcggcatgagtgacgcatgagtctagcatgagtactgcatgagttgcgcatgagtgtagcatgagtggcgcgccatgcttcatcagactct

SEQ ID NO: 8793 - DNA, 156 bp, Artificial Sequence; identical to SEQ ID NO: 8792
  Synthetic polynucleotide

SEQ ID NO: 8794 - DNA, 186 bp, Artificial Sequence
  Synthetic polynucleotide
atcatctcaccttgcctcctgtgttagccggcctgaaccctgcaggtcacaccttttttcacacctagatcacaccttttttcacaccttcgtcacaccttttttcacacctgactcacaccttttttcacacctctatcacaccttttttcacacctactggcgcgccatgcttcatcagactct

SEQ ID NO: 8795 - DNA, 186 bp, Artificial Sequence; identical to SEQ ID NO: 8794
  Synthetic polynucleotide

SEQ ID NO: 8796 - DNA, 196 bp, Artificial Sequence
  Synthetic polynucleotide
atcatctcaccttgcctcctgtctggtggaattgtaggcctgcagggcacgtgtcgttaagagcacgtgtcgttatcggcacgtgtcgttagacgcacgtgtcgttactagcacgtgtcgttaactgcacgtgtcgttatgcgcacgtgtcgttagtagcacgtgtcgttaggcgcgccatgcttcatcagactct

SEQ ID NO: 8797 - DNA, 196 bp, Artificial Sequence; identical to SEQ ID NO: 8796
  Synthetic polynucleotide

SEQ ID NO: 8798 - DNA, 172 bp, Artificial Sequence
  Synthetic polynucleotide
atcatctcaccttgcctcctggttaattccgcgccgcacctgcaggtgtctggaatagatgtctggaattcgtgtctggaatgactgtctggaatctatgtctggaatacttgtctggaattgctgtctggaatgtatgtctggaatggcgcgccatgcttcatcagactct

SEQ ID NO: 8799 - DNA, 172 bp, Artificial Sequence; identical to SEQ ID NO: 8798
  Synthetic polynucleotide

SEQ ID NO: 8800 - DNA, 197 bp, Artificial Sequence
  Synthetic polynucleotide
atcatctcaccttgcctcctgtcctcttaccaatagaccctgcaggcagccaagcgtgaccagacagccaagcgtgacctcgcagccaagcgtgaccgaccagccaagcgtgaccctacagccaagcgtgaccactcagccaagcgtgacctgccagccaagcgtgaccgtaggcgcgccatgcttcatcagactct

SEQ ID NO: 8801 - DNA, 197 bp, Artificial Sequence; identical to SEQ ID NO: 8800
  Synthetic polynucleotide

SEQ ID NO: 8802 - DNA, 188 bp, Artificial Sequence
  Synthetic polynucleotide
atcatctcaccttgcctcctgtatagctaaggcaggttcctgcagggggaaatccccaagagggaaatccccatcggggaaatccccagacgggaaatccccactagggaaatccccaactgggaaatccccatgcgggaaatccccagtagggaaatccccaggcgcgccatgcttcatcagactct

SEQ ID NO: 8803 - DNA, 188 bp, Artificial Sequence; identical to SEQ ID NO: 8802
  Synthetic polynucleotide

SEQ ID NO: 8804 - DNA, 156 bp, Artificial Sequence
  Synthetic polynucleotide
atcatctcaccttgcctcctggactatatctggagtcacctgcagggtaaacatagagtaaacattcggtaaacatgacgtaaacatctagtaaacatactgtaaacattgcgtaaacatgtagtaaacatggcgcgccatgcttcatcagactct

SEQ ID NO: 8805 - DNA, 156 bp, Artificial Sequence; identical to SEQ ID NO: 8804
  Synthetic polynucleotide

SEQ ID NO: 8806 - DNA, 172 bp, Artificial Sequence
  Synthetic polynucleotide
atcatctcaccttgcctcctgctattactccgtttgttcctgcaggtcccacttgaagatcccacttgatcgtcccacttgagactcccacttgactatcccacttgaacttcccacttgatgctcccacttgagtatcccacttgaggcgcgccatgcttcatcagactct

SEQ ID NO: 8807 - DNA, 172 bp, Artificial Sequence; identical to SEQ ID NO: 8806
  Synthetic polynucleotide

SEQ ID NO: 8808 - DNA, 190 bp, Artificial Sequence
  Synthetic polynucleotide
atcatctcaccttgcctcctgctatcccaatttcgccacctgcaggagatcacgtgatctagaagatcacgtgatcttcgagatcacgtgatctgacagatcacgtgatctctaagatcacgtgatctactagatcacgtgatcttgcagatcacgtgatctgtaggcgcgccatgcttcatcagactct

SEQ ID NO: 8809 - DNA, 190 bp, Artificial Sequence; identical to SEQ ID NO: 8808
  Synthetic polynucleotide

SEQ ID NO: 8810 - DNA, 190 bp, Artificial Sequence
  Synthetic polynucleotide
atcatctcaccttgcctcctgcatccacaggagcgcttcctgcagggggaaaaccacagcagagggaaaaccacagctcggggaaaaccacagcgacgggaaaaccacagcctagggaaaaccacagcactgggaaaaccacagctgcgggaaaaccacagcgtaggcgcgccatgcttcatcagactct

SEQ ID NO: 8811 - DNA, 190 bp, Artificial Sequence; identical to SEQ ID NO: 8810
  Synthetic polynucleotide

SEQ ID NO: 8812 - DNA, 180 bp, Artificial Sequence
  Synthetic polynucleotide
atcatctcaccttgcctcctggatgttaaagccctttacctgcagggtgggggcgacagagtgggggcgactcggtgggggcgacgacgtgggggcgacctagtgggggcgacactgtgggggcgactgcgtgggggcgacgtagtgggggcgacggcgcgccatgcttcatcagactct

SEQ ID NO: 8813 - DNA, 180 bp, Artificial Sequence; identical to SEQ ID NO: 8812
  Synthetic polynucleotide

SEQ ID NO: 8814 - DNA, 172 bp, Artificial Sequence
  Synthetic polynucleotide
atcatctcaccttgcctcctgaaccgatttacccactgcctgcaggccacgtgctcagaccacgtgctctcgccacgtgctcgacccacgtgctcctaccacgtgctcactccacgtgctctgcccacgtgctcgtaccacgtgctcggcgcgccatgcttcatcagactct

SEQ ID NO: 8815 - DNA, 172 bp, Artificial Sequence; identical to SEQ ID NO: 8814
  Synthetic polynucleotide

SEQ ID NO: 8816 - DNA, 164 bp, Artificial Sequence
  Synthetic polynucleotide
atcatctcaccttgcctcctgatatcggaccctgcgtccctgcaggttgattgatagattgattgattcgttgattgatgacttgattgatctattgattgatactttgattgattgcttgattgatgtattgattgatggcgcgccatgcttcatcagactct

SEQ ID NO: 8817 - DNA, 164 bp, Artificial Sequence; identical to SEQ ID NO: 8816
  Synthetic polynucleotide

SEQ ID NO: 8818 - DNA, 197 bp, Artificial Sequence
  Synthetic polynucleotide
atcatctcaccttgcctcctgcgggcacgccgtaattacctgcaggtttggtttcgatacgagatttggtttcgatacgtcgtttggtttcgatacggactttggtttcgatacgctatttggtttcgatacgacttttggtttcgatacgtgctttggtttcgatacggtaggcgcgccatgcttcatcagactct

SEQ ID NO: 8819 - DNA, 197 bp, Artificial Sequence; identical to SEQ ID NO: 8818
  Synthetic polynucleotide

SEQ ID NO: 8820 - DNA, 172 bp, Artificial Sequence
  Synthetic polynucleotide
atcatctcaccttgcctcctgtcggtaacagacgaactcctgcaggttttatgggcagattttatgggctcgttttatgggcgacttttatgggcctattttatgggcactttttatgggctgcttttatgggcgtattttatgggcggcgcgccatgcttcatcagactct

SEQ ID NO: 8821 - DNA, 172 bp, Artificial Sequence; identical to SEQ ID NO: 8820
  Synthetic polynucleotide

SEQ ID NO: 8822 - DNA, 197 bp, Artificial Sequence
  Synthetic polynucleotide
atcatctcaccttgcctcctggcttcggaaacactagtcctgcaggtcatctgttgctaggagatcatctgttgctaggtcgtcatctgttgctagggactcatctgttgctaggctatcatctgttgctaggacttcatctgttgctaggtgctcatctgttgctagggtaggcgcgccatgcttcatcagactct

SEQ ID NO: 8823 - DNA, 197 bp, Artificial Sequence; identical to SEQ ID NO: 8822
  Synthetic polynucleotide

SEQ ID NO: 8824 - DNA, 185 bp, Artificial Sequence
  Synthetic polynucleotide
atcatctcaccttgcctcctgacgtgctaccgtacgtgcctgcaggtaaggtaataaaattaagataaggtaataaaattatcgtaaggtaataaaattagactaaggtaataaaattactataaggtaataaaattaacttaaggtaataaaattatgcggcgcgccatgcttcatcagactct

SEQ ID NO: 8825 - DNA, 185 bp, Artificial Sequence; identical to SEQ ID NO: 8824
  Synthetic polynucleotide

SEQ ID NO: 8826 - DNA, 185 bp, Artificial Sequence
  Synthetic polynucleotide
atcatctcaccttgcctcctgcgtgtcgttcgagaggtcctgcaggtctttcgaggaatttgagatctttcgaggaatttgtcgtctttcgaggaatttggactctttcgaggaatttgctatctttcgaggaatttgacttctttcgaggaatttgtgcggcgcgccatgcttcatcagactct

SEQ ID NO: 8827 - DNA, 185 bp, Artificial Sequence; identical to SEQ ID NO: 8826
  Synthetic polynucleotide

SEQ ID NO: 8828 - DNA, 188 bp, Artificial Sequence
  Synthetic polynucleotide
atcatctcaccttgcctcctggtcaccctcagtgttaccctgcaggggttacgcaataagaggttacgcaatatcgggttacgcaatagacggttacgcaatactaggttacgcaataactggttacgcaatatgcggttacgcaatagtaggttacgcaataggcgcgccatgcttcatcagactct

SEQ ID NO: 8829 - DNA, 188 bp, Artificial Sequence; identical to SEQ ID NO: 8828
  Synthetic polynucleotide

SEQ ID NO: 8830 - DNA, 197 bp, Artificial Sequence
  Synthetic polynucleotide
atcatctcaccttgcctcctgcacacagaaactatgcccctgcaggtgctgagtcatgctgagatgctgagtcatgctgtcgtgctgagtcatgctggactgctgagtcatgctgctatgctgagtcatgctgacttgctgagtcatgctgtgctgctgagtcatgctggtaggcgcgccatgcttcatcagactct

SEQ ID NO: 8831 - DNA, 197 bp, Artificial Sequence; identical to SEQ ID NO: 8830
  Synthetic polynucleotide

SEQ ID NO: 8832 - DNA, 172 bp, Artificial Sequence
  Synthetic polynucleotide
atcatctcaccttgcctcctgcaacttcagggtattaccctgcaggatgagtcaccagaatgagtcacctcgatgagtcaccgacatgagtcaccctaatgagtcaccactatgagtcacctgcatgagtcaccgtaatgagtcaccggcgcgccatgcttcatcagactct

SEQ ID NO: 8833 - DNA, 172 bp, Artificial Sequence; identical to SEQ ID NO: 8832
  Synthetic polynucleotide

SEQ ID NO: 8834 - DNA, 188 bp, Artificial Sequence
  Synthetic polynucleotide
atcatctcaccttgcctcctggacgatagcagtggagacctgcaggcatgactcagcaagacatgactcagcatcgcatgactcagcagaccatgactcagcactacatgactcagcaactcatgactcagcatgccatgactcagcagtacatgactcagcaggcgcgccatgcttcatcagactct

SEQ ID NO: 8835 - DNA, 188 bp, Artificial Sequence; identical to SEQ ID NO: 8834
  Synthetic polynucleotide

SEQ ID NO: 8836 - DNA, 188 bp, Artificial Sequence
  Synthetic polynucleotide
atcatctcaccttgcctcctggtagagtagcatgctagcctgcagggaattaatgaccagagaattaatgacctcggaattaatgaccgacgaattaatgaccctagaattaatgaccactgaattaatgacctgcgaattaatgaccgtagaattaatgaccggcgcgccatgcttcatcagactct

SEQ ID NO: 8837 - DNA, 188 bp, Artificial Sequence; identical to SEQ ID NO: 8836
  Synthetic polynucleotide

SEQ ID NO: 8838 - DNA, 191 bp, Artificial Sequence
  Synthetic polynucleotide
atcatctcaccttgcctcctgacattctggctgcgcaccctgcaggcagcagccgccggcgcgagacagcagccgccggcgcgtcgcagcagccgccggcgcggaccagcagccgccggcgcgctacagcagccgccggcgcgactcagcagccgccggcgcgtgcggcgcgccatgcttcatcagactct

SEQ ID NO: 8839 - DNA, 191 bp, Artificial Sequence; identical to SEQ ID NO: 8838
  Synthetic polynucleotide

SEQ ID NO: 8840 - DNA, 197 bp, Artificial Sequence
  Synthetic polynucleotide
atcatctcaccttgcctcctggcgttctacatatgcaacctgcagggaattccaggaaataagagaattccaggaaatatcggaattccaggaaatagacgaattccaggaaatactagaattccaggaaataactgaattccaggaaatatgcgaattccaggaaatagtaggcgcgccatgcttcatcagactct

SEQ ID NO: 8841 - DNA, 197 bp, Artificial Sequence; identical to SEQ ID NO: 8840
  Synthetic polynucleotide

SEQ ID NO: 8842 - DNA, 196 bp, Artificial Sequence
  Synthetic polynucleotide
atcatctcaccttgcctcctgatgtcccttatcccacgcctgcaggaaccaattaatatagaaaccaattaatattcgaaccaattaatatgacaaccaattaatatctaaaccaattaatatactaaccaattaatattgcaaccaattaatatgtaaaccaattaatatggcgcgccatgcttcatcagactct

SEQ ID NO: 8843 - DNA, 196 bp, Artificial Sequence; identical to SEQ ID NO: 8842
  Synthetic polynucleotide

SEQ ID NO: 8844 - DNA, 197 bp, Artificial Sequence
  Synthetic polynucleotide
atcatctcaccttgcctcctgatcggcgactgagtctgcctgcaggtgcacacactgaaaaagatgcacacactgaaaatcgtgcacacactgaaaagactgcacacactgaaaactatgcacacactgaaaaacttgcacacactgaaaatgctgcacacactgaaaagtaggcgcgccatgcttcatcagactct

SEQ ID NO: 8845 - DNA, 197 bp, Artificial Sequence; identical to SEQ ID NO: 8844
  Synthetic polynucleotide

SEQ ID NO: 8846 - DNA, 188 bp, Artificial Sequence
  Synthetic polynucleotide
atcatctcaccttgcctcctgcctctctgtacatggcgcctgcaggacgcccacgcaaagaacgcccacgcaatcgacgcccacgcaagacacgcccacgcaactaacgcccacgcaaactacgcccacgcaatgcacgcccacgcaagtaacgcccacgcaaggcgcgccatgcttcatcagactct

SEQ ID NO: 8847 - DNA, 188 bp, Artificial Sequence; identical to SEQ ID NO: 8846
  Synthetic polynucleotide

SEQ ID NO: 8848 - DNA, 172 bp, Artificial Sequence
  Synthetic polynucleotide
atcatctcaccttgcctcctgtctctgttggttcacatcctgcaggggacagcgccagaggacagcgcctcgggacagcgccgacggacagcgccctaggacagcgccactggacagcgcctgcggacagcgccgtaggacagcgccggcgcgccatgcttcatcagactct

SEQ ID NO: 8849 - DNA, 172 bp, Artificial Sequence; identical to SEQ ID NO: 8848
  Synthetic polynucleotide

SEQ ID NO: 8850 - DNA, 188 bp, Artificial Sequence
  Synthetic polynucleotide
atcatctcaccttgcctcctgtcttcgtttgcagcaagcctgcagggaccacgtggtcagagaccacgtggtctcggaccacgtggtcgacgaccacgtggtcctagaccacgtggtcactgaccacgtggtctgcgaccacgtggtcgtagaccacgtggtcggcgcgccatgcttcatcagactct

SEQ ID NO: 8851 - DNA, 188 bp, Artificial Sequence; identical to SEQ ID NO: 8850
  Synthetic polynucleotide

SEQ ID NO: 8852 - DNA, 156 bp, Artificial Sequence
  Synthetic polynucleotide
atcatctcaccttgcctcctgtgatgaaggccgctggtcctgcagggtcataaaagagtcataaatcggtcataaagacgtcataaactagtcataaaactgtcataaatgcgtcataaagtagtcataaaggcgcgccatgcttcatcagactct

SEQ ID NO: 8853 - DNA, 156 bp, Artificial Sequence; identical to SEQ ID NO: 8852
  Synthetic polynucleotide

SEQ ID NO: 8854 - DNA, 156 bp, Artificial Sequence
  Synthetic polynucleotide
atcatctcaccttgcctcctgtgtatcttgaagggctacctgcagggtgctcctagagtgctccttcggtgctcctgacgtgctcctctagtgctcctactgtgctccttgcgtgctcctgtagtgctcctggcgcgccatgcttcatcagactct

SEQ ID NO: 8855 - DNA, 156 bp, Artificial Sequence; identical to SEQ ID NO: 8854
  Synthetic polynucleotide

SEQ ID NO: 8856 - DNA, 172 bp, Artificial Sequence
  Synthetic polynucleotide
atcatctcaccttgcctcctgttgttaagggagcattgcctgcaggtaatcgataaagataatcgataatcgtaatcgataagactaatcgataactataatcgataaacttaatcgataatgctaatcgataagtataatcgataaggcgcgccatgcttcatcagactct

SEQ ID NO: 8857 - DNA, 172 bp, Artificial Sequence; identical to SEQ ID NO: 8856
  Synthetic polynucleotide

SEQ ID NO: 8858 - DNA, 196 bp, Artificial Sequence
  Synthetic polynucleotide
atcatctcaccttgcctcctggtatcaggtgttgcccacctgcaggcatataaacaatgagacatataaacaatgtcgcatataaacaatggaccatataaacaatgctacatataaacaatgactcatataaacaatgtgccatataaacaatggtacatataaacaatgggcgcgccatgcttcatcagactct

SEQ ID NO: 8859 - DNA, 196 bp, Artificial Sequence; identical to SEQ ID NO: 8858
  Synthetic polynucleotide

SEQ ID NO: 8860 - DNA, 156 bp, Artificial Sequence
  Synthetic polynucleotide
atcatctcaccttgcctcctgatcttggaaatatgtcgcctgcaggccgcccccagaccgccccctcgccgcccccgacccgcccccctaccgcccccactccgccccctgcccgcccccgtaccgcccccggcgcgccatgcttcatcagactct

SEQ ID NO: 8861 - DNA, 156 bp, Artificial Sequence; identical to SEQ ID NO: 8860
  Synthetic polynucleotide

SEQ ID NO: 8862 - DNA, 196 bp, Artificial Sequence
  Synthetic polynucleotide
atcatctcaccttgcctcctgtgacctatgcagacctccctgcaggcttgtttacttagagacttgtttacttagtcgcttgtttacttaggaccttgtttacttagctacttgtttacttagactcttgtttacttagtgccttgtttacttaggtacttgtttacttagggcgcgccatgcttcatcagactct

SEQ ID NO: 8863 - DNA, 196 bp, Artificial Sequence; identical to SEQ ID NO: 8862
  Synthetic polynucleotide

SEQ ID NO: 8864 - DNA, 164 bp, Artificial Sequence
  Synthetic polynucleotide
atcatctcaccttgcctcctgctagacgcacccagagtcctgcaggttgtttaccagattgtttacctcgttgtttaccgacttgtttaccctattgtttaccactttgtttacctgcttgtttaccgtattgtttaccggcgcgccatgcttcatcagactct

SEQ ID NO: 8865 - DNA, 164 bp, Artificial Sequence; identical to SEQ ID NO: 8864
  Synthetic polynucleotide

SEQ ID NO: 8866 - DNA, 164 bp, Artificial Sequence
  Synthetic polynucleotide
atcatctcaccttgcctcctggttaaacagggccctcccctgcaggttgtttacaagattgtttacatcgttgtttacagacttgtttacactattgtttacaactttgtttacatgcttgtttacagtattgtttacaggcgcgccatgcttcatcagactct

SEQ ID NO: 8867 - DNA, 164 bp, Artificial Sequence; identical to SEQ ID NO: 8866
  Synthetic polynucleotide

SEQ ID NO: 8868 - DNA, 197 bp, Artificial Sequence
  Synthetic polynucleotide
atcatctcaccttgcctcctgctccatggtgagtacgtcctgcaggcagttttcgcgcgtaagacagttttcgcgcgtatcgcagttttcgcgcgtagaccagttttcgcgcgtactacagttttcgcgcgtaactcagttttcgcgcgtatgccagttttcgcgcgtagtaggcgcgccatgcttcatcagactct

SEQ ID NO: 8869 - DNA, 197 bp, Artificial Sequence; identical to SEQ ID NO: 8868
  Synthetic polynucleotide

SEQ ID NO: 8870 - DNA, 156 bp, Artificial Sequence
  Synthetic polynucleotide
atcatctcaccttgcctcctgtggcctgaaacccaagacctgcaggcacgtgacagacacgtgactcgcacgtgacgaccacgtgacctacacgtgacactcacgtgactgccacgtgacgtacacgtgacggcgcgccatgcttcatcagactct

SEQ ID NO: 8871 - DNA, 156 bp, Artificial Sequence; identical to SEQ ID NO: 8870
  Synthetic polynucleotide

SEQ ID NO: 8872 - DNA, 172 bp, Artificial Sequence
  Synthetic polynucleotide
atcatctcaccttgcctcctgatgtgccgtaccatccacctgcagggcacatgaatagagcacatgaattcggcacatgaatgacgcacatgaatctagcacatgaatactgcacatgaattgcgcacatgaatgtagcacatgaatggcgcgccatgcttcatcagactct

SEQ ID NO: 8873 - DNA, 172 bp, Artificial Sequence; identical to SEQ ID NO: 8872
  Synthetic polynucleotide

SEQ ID NO: 8874 - DNA, 156 bp, Artificial Sequence
  Synthetic polynucleotide
atcatctcaccttgcctcctgctgaatagccgctttatcctgcaggcacgtgatagacacgtgattcgcacgtgatgaccacgtgatctacacgtgatactcacgtgattgccacgtgatgtacacgtgatggcgcgccatgcttcatcagactct

SEQ ID NO: 8875 - DNA, 156 bp, Artificial Sequence; identical to SEQ ID NO: 8874
  Synthetic polynucleotide

SEQ ID NO: 8876 - DNA, 191 bp, Artificial Sequence
  Synthetic polynucleotide
atcatctcaccttgcctcctggtgagttcttgaatcatcctgcaggcccccaagaacaccatgtcccccccccagacccccaagaacaccatgtccccccccctcgcccccaagaacaccatgtcccccccccgaccccccaagaacaccatgtcccccccccctaggcgcgccatgcttcatcagactct

SEQ ID NO: 8877 - DNA, 191 bp, Artificial Sequence; identical to SEQ ID NO: 8876
  Synthetic polynucleotide

SEQ ID NO: 8878 - DNA, 172 bp, Artificial Sequence
  Synthetic polynucleotide
atcatctcaccttgcctcctgcactacctaccgatcggcctgcaggcctgctgtggagacctgctgtggtcgcctgctgtgggaccctgctgtggctacctgctgtggactcctgctgtggtgccctgctgtgggtacctgctgtggggcgcgccatgcttcatcagactct

SEQ ID NO: 8879 - DNA, 172 bp, Artificial Sequence; identical to SEQ ID NO: 8878
  Synthetic polynucleotide

SEQ ID NO: 8880 - DNA, 156 bp, Artificial Sequence
  Synthetic polynucleotide
atcatctcaccttgcctcctggttctctttgagtgtaccctgcagggtgctcccagagtgctccctcggtgctcccgacgtgctcccctagtgctcccactgtgctccctgcgtgctcccgtagtgctcccggcgcgccatgcttcatcagactct

SEQ ID NO: 8881 - DNA, 156 bp, Artificial Sequence; identical to SEQ ID NO: 8880
  Synthetic polynucleotide

SEQ ID NO: 8882 - DNA, 172 bp, Artificial Sequence
  Synthetic polynucleotide
atcatctcaccttgcctcctgagatgcaggaccgactacctgcagggctcataaaaagagctcataaaatcggctcataaaagacgctcataaaactagctcataaaaactgctcataaaatgcgctcataaaagtagctcataaaaggcgcgccatgcttcatcagactct

SEQ ID NO: 8883 - DNA, 172 bp, Artificial Sequence; identical to SEQ ID NO: 8882
  Synthetic polynucleotide

SEQ ID NO: 8884 - DNA, 164 bp, Artificial Sequence
  Synthetic polynucleotide
atcatctcaccttgcctcctgagtcctaccggatgtgtcctgcaggttgtttactagattgtttacttcgttgtttactgacttgtttactctattgtttactactttgtttacttgcttgtttactgtattgtttactggcgcgccatgcttcatcagactct

SEQ ID NO: 8885 - DNA, 164 bp, Artificial Sequence; identical to SEQ ID NO: 8884
  Synthetic polynucleotide

SEQ ID NO: 8886 - DNA, 190 bp, Artificial Sequence
  Synthetic polynucleotide
atcatctcaccttgcctcctgtcttgcgtagtgtttggcctgcaggggggtcatgacctcagaggggtcatgacctctcgggggtcatgacctcgacggggtcatgacctcctaggggtcatgacctcactggggtcatgacctctgcggggtcatgacctcgtaggcgcgccatgcttcatcagactct

SEQ ID NO: 8887 - DNA, 190 bp, Artificial Sequence; identical to SEQ ID NO: 8886
  Synthetic polynucleotide

SEQ ID NO: 8888 - DNA, 188 bp, Artificial Sequence
  Synthetic polynucleotide
atcatctcaccttgcctcctgctcgagttcacacacgacctgcaggttgtttacttagagattgtttacttagtcgttgtttacttaggacttgtttacttagctattgtttacttagactttgtttacttagtgcttgtttacttaggtattgtttacttagggcgcgccatgcttcatcagactct

SEQ ID NO: 8889 - DNA, 188 bp, Artificial Sequence; identical to SEQ ID NO: 8888
  Synthetic polynucleotide

SEQ ID NO: 8890 - DNA, 172 bp, Artificial Sequence
  Synthetic polynucleotide
atcatctcaccttgcctcctgtccactggagtgggaatcctgcagggtcccgcaacagagtcccgcaactcggtcccgcaacgacgtcccgcaacctagtcccgcaacactgtcccgcaactgcgtcccgcaacgtagtcccgcaacggcgcgccatgcttcatcagactct

SEQ ID NO: 8891 - DNA, 172 bp, Artificial Sequence; identical to SEQ ID NO: 8890
  Synthetic polynucleotide

SEQ ID NO: 8892 - DNA, 196 bp, Artificial Sequence
  Synthetic polynucleotide
atcatctcaccttgcctcctggtcgcatccagagccatcctgcaggaggtcaaaggtcaagaaggtcaaaggtcatcgaggtcaaaggtcagacaggtcaaaggtcactaaggtcaaaggtcaactaggtcaaaggtcatgcaggtcaaaggtcagtaaggtcaaaggtcaggcgcgccatgcttcatcagactct

SEQ ID NO: 8893 - DNA, 196 bp, Artificial Sequence; identical to SEQ ID NO: 8892
  Synthetic polynucleotide

SEQ ID NO: 8894 - DNA, 164 bp, Artificial Sequence
  Synthetic polynucleotide
atcatctcaccttgcctcctggaggttgccagcctgttcctgcaggaaggtgctgagaaaggtgctgtcgaaggtgctggacaaggtgctgctaaaggtgctgactaaggtgctgtgcaaggtgctggtaaaggtgctgggcgcgccatgcttcatcagactct

SEQ ID NO: 8895 - DNA, 164 bp, Artificial Sequence; identical to SEQ ID NO: 8894
  Synthetic polynucleotide

SEQ ID NO: 8896 - DNA, 190 bp, Artificial Sequence
  Synthetic polynucleotide
atcatctcaccttgcctcctgatccattaacgggctgtcctgcaggcaaaatgacatgcaagacaaaatgacatgcatcgcaaaatgacatgcagaccaaaatgacatgcactacaaaatgacatgcaactcaaaatgacatgcatgccaaaatgacatgcagtaggcgcgccatgcttcatcagactct

SEQ ID NO: 8897 - DNA, 190 bp, Artificial Sequence; identical to SEQ ID NO: 8896
  Synthetic polynucleotide

SEQ ID NO: 8898 - DNA, 190 bp, Artificial Sequence
  Synthetic polynucleotide
atcatctcaccttgcctcctgtgcatgggtagttcccacctgcaggcatgtaaataatgcagacatgtaaataatgctcgcatgtaaataatgcgaccatgtaaataatgcctacatgtaaataatgcactcatgtaaataatgctgccatgtaaataatgcgtaggcgcgccatgcttcatcagactct

SEQ ID NO: 8899 - DNA, 190 bp, Artificial Sequence; identical to SEQ ID NO: 8898
  Synthetic polynucleotide

SEQ ID NO: 8900 - DNA, 185 bp, Artificial Sequence
  Synthetic polynucleotide
atcatctcaccttgcctcctgaccgatcgtataggcctcctgcaggacgatgacgtcatcgaagaacgatgacgtcatcgatcgacgatgacgtcatcgagacacgatgacgtcatcgactaacgatgacgtcatcgaactacgatgacgtcatcgatgcggcgcgccatgcttcatcagactct

SEQ ID NO: 8901 - DNA, 185 bp, Artificial Sequence; identical to SEQ ID NO: 8900
  Synthetic polynucleotide

SEQ ID NO: 8902 - DNA, 185 bp, Artificial Sequence
  Synthetic polynucleotide
atcatctcaccttgcctcctgttcttcagttgtaccagcctgcaggacgatgacgtcatcggagaacgatgacgtcatcggtcgacgatgacgtcatcgggacacgatgacgtcatcggctaacgatgacgtcatcggactacgatgacgtcatcggtgcggcgcgccatgcttcatcagactct

SEQ ID NO: 8903 - DNA, 185 bp, Artificial Sequence; identical to SEQ ID NO: 8902
  Synthetic polynucleotide

SEQ ID NO: 8904 - DNA, 197 bp, Artificial Sequence
  Synthetic polynucleotide
atcatctcaccttgcctcctgaagggttccgtaactaccctgcagggaggaattaaaatacagagaggaattaaaatactcggaggaattaaaatacgacgaggaattaaaatacctagaggaattaaaatacactgaggaattaaaatactgcgaggaattaaaatacgtaggcgcgccatgcttcatcagactct

SEQ ID NO: 8905 - DNA, 197 bp, Artificial Sequence; identical to SEQ ID NO: 8904
  Synthetic polynucleotide

SEQ ID NO: 8906 - DNA, 186 bp, Artificial Sequence
  Synthetic polynucleotide
atcatctcaccttgcctcctgggcaacaagtaaggcgacctgcaggggggggggggtggtttggggagaggggggggggtggtttggggtcgggggggggggtggtttgggggacggggggggggtggtttggggctaggggggggggtggtttggggactggcgcgccatgcttcatcagactct

SEQ ID NO: 8907 - DNA, 186 bp, Artificial Sequence; identical to SEQ ID NO: 8906
  Synthetic polynucleotide

SEQ ID NO: 8908 - DNA, 172 bp, Artificial Sequence
  Synthetic polynucleotide
atcatctcaccttgcctcctgcacccggtaagttgagtcctgcagggtcagctgtgagagtcagctgtgtcggtcagctgtggacgtcagctgtgctagtcagctgtgactgtcagctgtgtgcgtcagctgtggtagtcagctgtgggcgcgccatgcttcatcagactct

SEQ ID NO: 8909 - DNA, 172 bp, Artificial Sequence; identical to SEQ ID NO: 8908
  Synthetic polynucleotide

SEQ ID NO: 8910 - DNA, 164 bp, Artificial Sequence
  Synthetic polynucleotide
atcatctcaccttgcctcctgatgctgctggccatgcacctgcaggacttcctgtagaacttcctgttcgacttcctgtgacacttcctgtctaacttcctgtactacttcctgttgcacttcctgtgtaacttcctgtggcgcgccatgcttcatcagactct

SEQ ID NO: 8911 - DNA, 164 bp, Artificial Sequence; identical to SEQ ID NO: 8910
  Synthetic polynucleotide

SEQ ID NO: 8912 - DNA, 172 bp, Artificial Sequence
  Synthetic polynucleotide
atcatctcaccttgcctcctgttcgttgtaggcaagcgcctgcagggttaattggcagagttaattggctcggttaattggcgacgttaattggcctagttaattggcactgttaattggctgcgttaattggcgtagttaattggcggcgcgccatgcttcatcagactct

SEQ ID NO: 8913 - DNA, 172 bp, Artificial Sequence; identical to SEQ ID NO: 8912
  Synthetic polynucleotide

SEQ ID NO: 8914 - DNA, 188 bp, Artificial Sequence
  Synthetic polynucleotide
atcatctcaccttgcctcctgctcaaaccctgatagctcctgcaggctcgcaggaagaagactcgcaggaagatcgctcgcaggaagagacctcgcaggaagactactcgcaggaagaactctcgcaggaagatgcctcgcaggaagagtactcgcaggaagaggcgcgccatgcttcatcagactct

SEQ ID NO: 8915 - DNA, 188 bp, Artificial Sequence; identical to SEQ ID NO: 8914
  Synthetic polynucleotide

SEQ ID NO: 8916 - DNA, 172 bp, Artificial Sequence
  Synthetic polynucleotide
atcatctcaccttgcctcctggttggtccgcaacgcatcctgcaggacccaagggaagaacccaagggatcgacccaagggagacacccaagggactaacccaagggaactacccaagggatgcacccaagggagtaacccaagggaggcgcgccatgcttcatcagactct

SEQ ID NO: 8917 - DNA, 172 bp, Artificial Sequence; identical to SEQ ID NO: 8916
  Synthetic polynucleotide

SEQ ID NO: 8918 - DNA, 191 bp, Artificial Sequence
  Synthetic polynucleotide
atcatctcaccttgcctcctgatcaacgccgccagtaacctgcagggtggccaccagggggcgctgtagagtggccaccagggggcgctgttcggtggccaccagggggcgctgtgacgtggccaccagggggcgctgtctagtggccaccagggggcgctgtactggcgcgccatgcttcatcagactct

SEQ ID NO: 8919 - DNA, 191 bp, Artificial Sequence; identical to SEQ ID NO: 8918
  Synthetic polynucleotide

SEQ ID NO: 8920 - DNA, 197 bp, Artificial Sequence
  Synthetic polynucleotide
atcatctcaccttgcctcctgactgcttccctaggctccctgcagggggattcgaacccgggacagagggattcgaacccgggactcggggattcgaacccgggacgacgggattcgaacccgggacctagggattcgaacccgggacactgggattcgaacccgggactgcggcgcgccatgcttcatcagactct

SEQ ID NO: 8921 - DNA, 197 bp, Artificial Sequence; identical to SEQ ID NO: 8920
  Synthetic polynucleotide

SEQ ID NO: 8922 - DNA, 180 bp, Artificial Sequence
  Synthetic polynucleotide
atcatctcaccttgcctcctgcgactgatcggattggacctgcaggattaactacacagaattaactacactcgattaactacacgacattaactacacctaattaactacacactattaactacactgcattaactacacgtaattaactacacggcgcgccatgcttcatcagactct

SEQ ID NO: 8923 - DNA, 180 bp, Artificial Sequence; identical to SEQ ID NO: 8922
  Synthetic polynucleotide

SEQ ID NO: 8924 - DNA, 186 bp, Artificial Sequence
  Synthetic polynucleotide
atcatctcaccttgcctcctgagtacgtgacgaggctgcctgcaggtatagtgccatctggtggccagatatagtgccatctggtggcctcgtatagtgccatctggtggccgactatagtgccatctggtggccctatatagtgccatctggtggccactggcgcgccatgcttcatcagactct

SEQ ID NO: 8925 - DNA, 186 bp, Artificial Sequence; identical to SEQ ID NO: 8924
  Synthetic polynucleotide

SEQ ID NO: 8926 - DNA, 172 bp, Artificial Sequence
  Synthetic polynucleotide
atcatctcaccttgcctcctgtcggttagcgaacgagacctgcagggttaattggaagagttaattggatcggttaattggagacgttaattggactagttaattggaactgttaattggatgcgttaattggagtagttaattggaggcgcgccatgcttcatcagactct

SEQ ID NO: 8927 - DNA, 172 bp, Artificial Sequence; identical to SEQ ID NO: 8926
  Synthetic polynucleotide

SEQ ID NO: 8928 - DNA, 196 bp, Artificial Sequence
  Synthetic polynucleotide
atcatctcaccttgcctcctgtaatcttctacctacggcctgcaggcaaaggtcaagggagacaaaggtcaagggtcgcaaaggtcaaggggaccaaaggtcaagggctacaaaggtcaagggactcaaaggtcaagggtgccaaaggtcaaggggtacaaaggtcaagggggcgcgccatgcttcatcagactct

SEQ ID NO: 8929 - DNA, 196 bp, Artificial Sequence; identical to SEQ ID NO: 8928
  Synthetic polynucleotide

SEQ ID NO: 8930 - DNA, 191 bp, Artificial Sequence
  Synthetic polynucleotide
atcatctcaccttgcctcctgtgaacgatacaaaccctcctgcaggcccggcgccccctggtggccgagacccggcgccccctggtggccgtcgcccggcgccccctggtggccggaccccggcgccccctggtggccgctacccggcgccccctggtggccgactggcgcgccatgcttcatcagactct

SEQ ID NO: 8931 - DNA, 191 bp, Artificial Sequence; identical to SEQ ID NO: 8930
  Synthetic polynucleotide

SEQ ID NO: 8932 - DNA, 148 bp, Artificial Sequence
  Synthetic polynucleotide
atcatctcaccttgcctcctgatcgggaacggaaacgccctgcaggtgtttatagatgtttattcgtgtttatgactgtttatctatgtttatacttgtttattgctgtttatgtatgtttatggcgcgccatgcttcatcagactct

SEQ ID NO: 8933 - DNA, 148 bp, Artificial Sequence; identical to SEQ ID NO: 8932
  Synthetic polynucleotide

SEQ ID NO: 8934 - DNA, 180 bp, Artificial Sequence
  Synthetic polynucleotide
atcatctcaccttgcctcctgatggataacgacaatcgcctgcaggccacctgtcacagaccacctgtcactcgccacctgtcacgacccacctgtcacctaccacctgtcacactccacctgtcactgcccacctgtcacgtaccacctgtcacggcgcgccatgcttcatcagactct

SEQ ID NO: 8935 - DNA, 180 bp, Artificial Sequence; identical to SEQ ID NO: 8934
  Synthetic polynucleotide

SEQ ID NO: 8936 - DNA, 185 bp, Artificial Sequence
  Synthetic polynucleotide
atcatctcaccttgcctcctgaagacgtccaaacttcgcctgcaggcaacccctgggtgtggagacaacccctgggtgtggtcgcaacccctgggtgtgggaccaacccctgggtgtggctacaacccctgggtgtggactcaacccctgggtgtggtgcggcgcgccatgcttcatcagactct

SEQ ID NO: 8937 - DNA, 185 bp, Artificial Sequence; identical to SEQ ID NO: 8936
  Synthetic polynucleotide

SEQ ID NO: 8938 - DNA, 180 bp, Artificial Sequence
  Synthetic polynucleotide
atcatctcaccttgcctcctgtcgcaagcgccttagtccctgcaggaccggaagtacagaaccggaagtactcgaccggaagtacgacaccggaagtacctaaccggaagtacactaccggaagtactgcaccggaagtacgtaaccggaagtacggcgcgccatgcttcatcagactct

SEQ ID NO: 8939 - DNA, 180 bp, Artificial Sequence; identical to SEQ ID NO: 8938
  Synthetic polynucleotide

SEQ ID NO: 8940 - DNA, 191 bp, Artificial Sequence
  Synthetic polynucleotide
atcatctcaccttgcctcctgtgcagactgaacccgtccctgcaggtagaaaaatgccacgaaagatagaaaaatgccacgaatcgtagaaaaatgccacgaagactagaaaaatgccacgaactatagaaaaatgccacgaaacttagaaaaatgccacgaatgcggcgcgccatgcttcatcagactct

SEQ ID NO: 8941 - DNA, 191 bp, Artificial Sequence; identical to SEQ ID NO: 8940
  Synthetic polynucleotide

SEQ ID NO: 8942 - DNA, 197 bp, Artificial Sequence
  Synthetic polynucleotide
atcatctcaccttgcctcctgaaagtatcagctcctaccctgcaggattaccatatatgggcatagaattaccatatatgggcattcgattaccatatatgggcatgacattaccatatatgggcatctaattaccatatatgggcatactattaccatatatgggcattgcggcgcgccatgcttcatcagactct

SEQ ID NO: 8943 - DNA, 197 bp, Artificial Sequence; identical to SEQ ID NO: 8942
  Synthetic polynucleotide

SEQ ID NO: 8944 - DNA, 188 bp, Artificial Sequence
  Synthetic polynucleotide
atcatctcaccttgcctcctgggagcgatcgcagctttcctgcaggtgtcagggggcaagatgtcagggggcatcgtgtcagggggcagactgtcagggggcactatgtcagggggcaacttgtcagggggcatgctgtcagggggcagtatgtcagggggcaggcgcgccatgcttcatcagactct

SEQ ID NO: 8945 - DNA, 188 bp, Artificial Sequence; identical to SEQ ID NO: 8944
  Synthetic polynucleotide

SEQ ID NO: 8946 - DNA, 180 bp, Artificial Sequence
  Synthetic polynucleotide
atcatctcaccttgcctcctgtagaaagtaaggatgtgcctgcaggggccacgcccaagaggccacgcccatcgggccacgcccagacggccacgcccactaggccacgcccaactggccacgcccatgcggccacgcccagtaggccacgcccaggcgcgccatgcttcatcagactct

SEQ ID NO: 8947 - DNA, 180 bp, Artificial Sequence; identical to SEQ ID NO: 8946
  Synthetic polynucleotide

SEQ ID NO: 8948 - DNA, 196 bp, Artificial Sequence
  Synthetic polynucleotide
atcatctcaccttgcctcctgggacgaagttggatggacctgcaggcttttctgggaaaagacttttctgggaaatcgcttttctgggaaagaccttttctgggaaactacttttctgggaaaactcttttctgggaaatgccttttctgggaaagtacttttctgggaaaggcgcgccatgcttcatcagactct

SEQ ID NO: 8949 - DNA, 196 bp, Artificial Sequence; identical to SEQ ID NO: 8948
  Synthetic polynucleotide

SEQ ID NO: 8950 - DNA, 197 bp, Artificial Sequence
  Synthetic polynucleotide
atcatctcaccttgcctcctgcaccattctgttggcatcctgcaggtaattagcgtaattaagataattagcgtaattatcgtaattagcgtaattagactaattagcgtaattactataattagcgtaattaacttaattagcgtaattatgctaattagcgtaattagtaggcgcgccatgcttcatcagactct

SEQ ID NO: 8951 - DNA, 197 bp, Artificial Sequence; identical to SEQ ID NO: 8950
  Synthetic polynucleotide

SEQ ID NO: 8952 - DNA, 148 bp, Artificial Sequence
  Synthetic polynucleotide
atcatctcaccttgcctcctgcaccgaattcgaaatatcctgcaggtgtttacagatgtttactcgtgtttacgactgtttacctatgtttacacttgtttactgctgtttacgtatgtttacggcgcgccatgcttcatcagactct

SEQ ID NO: 8953 - DNA, 148 bp, Artificial Sequence; identical to SEQ ID NO: 8952
  Synthetic polynucleotide

SEQ ID NO: 8954 - DNA, 148 bp, Artificial Sequence
  Synthetic polynucleotide
atcatctcaccttgcctcctgccaccttcatgactgcccctgcaggcattgttagacattgtttcgcattgttgaccattgttctacattgttactcattgtttgccattgttgtacattgttggcgcgccatgcttcatcagactct

SEQ ID NO: 8955 - DNA, 148 bp, Artificial Sequence; identical to SEQ ID NO: 8954
  Synthetic polynucleotide

SEQ ID NO: 8956 - DNA, 197 bp, Artificial Sequence
  Synthetic polynucleotide
atcatctcaccttgcctcctgggcccattaatcatctgcctgcaggttagtttcgattttgagattagtttcgattttgtcgttagtttcgattttggacttagtttcgattttgctattagtttcgattttgactttagtttcgattttgtgcttagtttcgattttggtaggcgcgccatgcttcatcagactct

SEQ ID NO: 8957 - DNA, 197 bp, Artificial Sequence; identical to SEQ ID NO: 8956
  Synthetic polynucleotide

SEQ ID NO: 8958 - DNA, 191 bp, Artificial Sequence
  Synthetic polynucleotide
atcatctcaccttgcctcctgtattgcgcgtgggtgagcctgcaggaaggcgaaatcatcgcaagaaaggcgaaatcatcgcatcgaaggcgaaatcatcgcagacaaggcgaaatcatcgcactaaaggcgaaatcatcgcaactaaggcgaaatcatcgcatgcggcgcgccatgcttcatcagactct

SEQ ID NO: 8959 - DNA, 191 bp, Artificial Sequence; identical to SEQ ID NO: 8958
  Synthetic polynucleotide

SEQ ID NO: 8960 - DNA, 156 bp, Artificial Sequence
  Synthetic polynucleotide
atcatctcaccttgcctcctgtctcactcacgttgttccctgcaggacctgtcaagaacctgtcatcgacctgtcagacacctgtcactaacctgtcaactacctgtcatgcacctgtcagtaacctgtcaggcgcgccatgcttcatcagactct

SEQ ID NO: 8961 - DNA, 156 bp, Artificial Sequence; identical to SEQ ID NO: 8960
  Synthetic polynucleotide

SEQ ID NO: 8962 - DNA, 188 bp, Artificial Sequence
  Synthetic polynucleotide
atcatctcaccttgcctcctgagacaaatcctgtgagtcctgcaggtgtcagggggcgagatgtcagggggcgtcgtgtcagggggcggactgtcagggggcgctatgtcagggggcgacttgtcagggggcgtgctgtcagggggcggtatgtcagggggcgggcgcgccatgcttcatcagactct

SEQ ID NO: 8963 - DNA, 188 bp, Artificial Sequence; identical to SEQ ID NO: 8962
  Synthetic polynucleotide

SEQ ID NO: 8964 - DNA, 191 bp, Artificial Sequence
  Synthetic polynucleotide
atcatctcaccttgcctcctgacccactctaccgcaaacctgcaggattctagaaatttctccagaattctagaaatttctcctcgattctagaaatttctccgacattctagaaatttctccctaattctagaaatttctccactattctagaaatttctcctgcggcgcgccatgcttcatcagactct

SEQ ID NO: 8965 - DNA, 191 bp, Artificial Sequence; identical to SEQ ID NO: 8964
  Synthetic polynucleotide

SEQ ID NO: 8966 - DNA, 164 bp, Artificial Sequence
  Synthetic polynucleotide
atcatctcaccttgcctcctgatctgctgtcccacatccctgcaggaattaattaagaaattaattatcgaattaattagacaattaattactaaattaattaactaattaattatgcaattaattagtaaattaattaggcgcgccatgcttcatcagactct

SEQ ID NO: 8967 - DNA, 164 bp, Artificial Sequence; identical to SEQ ID NO: 8966
  Synthetic polynucleotide

SEQ ID NO: 8968 - DNA, 172 bp, Artificial Sequence
  Synthetic polynucleotide
atcatctcaccttgcctcctgacgcgagctggtatgagcctgcaggccgcccccgcagaccgcccccgctcgccgcccccgcgacccgcccccgcctaccgcccccgcactccgcccccgctgcccgcccccgcgtaccgcccccgcggcgcgccatgcttcatcagactct

SEQ ID NO: 8969 - DNA, 172 bp, Artificial Sequence; identical to SEQ ID NO: 8968
  Synthetic polynucleotide

SEQ ID NO: 8970 - DNA, 172 bp, Artificial Sequence
  Synthetic polynucleotide
atcatctcaccttgcctcctgatcggacaatagccttccctgcaggatgaatatgcagaatgaatatgctcgatgaatatgcgacatgaatatgcctaatgaatatgcactatgaatatgctgcatgaatatgcgtaatgaatatgcggcgcgccatgcttcatcagactct

SEQ ID NO: 8971 - DNA, 172 bp, Artificial Sequence; identical to SEQ ID NO: 8970
  Synthetic polynucleotide

SEQ ID NO: 8972 - DNA, 172 bp, Artificial Sequence
  Synthetic polynucleotide
atcatctcaccttgcctcctggcacgcaatgtatttatcctgcaggtgttctagatagatgttctagattcgtgttctagatgactgttctagatctatgttctagatacttgttctagattgctgttctagatgtatgttctagatggcgcgccatgcttcatcagactct

SEQ ID NO: 8973 - DNA, 172 bp, Artificial Sequence; identical to SEQ ID NO: 8972
  Synthetic polynucleotide

SEQ ID NO: 8974 - DNA, 164 bp, Artificial Sequence
  Synthetic polynucleotide
atcatctcaccttgcctcctgacgccgtcaatttaaaccctgcaggagacaccacagaagacaccactcgagacaccacgacagacaccacctaagacaccacactagacaccactgcagacaccacgtaagacaccacggcgcgccatgcttcatcagactct

SEQ ID NO: 8975 - DNA, 164 bp, Artificial Sequence; identical to SEQ ID NO: 8974
  Synthetic polynucleotide

SEQ ID NO: 8976 - DNA, 172 bp, Artificial Sequence
  Synthetic polynucleotide
atcatctcaccttgcctcctgaaaggccttgccgtagccctgcaggacctttgaccagaacctttgacctcgacctttgaccgacacctttgaccctaacctttgaccactacctttgacctgcacctttgaccgtaacctttgaccggcgcgccatgcttcatcagactct

SEQ ID NO: 8977 - DNA, 172 bp, Artificial Sequence; identical to SEQ ID NO: 8976
  Synthetic polynucleotide

SEQ ID NO: 8978 - DNA, 172 bp, Artificial Sequence
  Synthetic polynucleotide
atcatctcaccttgcctcctgctcatagtgctatgtaacctgcagggttaattggtagagttaattggttcggttaattggtgacgttaattggtctagttaattggtactgttaattggttgcgttaattggtgtagttaattggtggcgcgccatgcttcatcagactct

SEQ ID NO: 8979 - DNA, 172 bp, Artificial Sequence; identical to SEQ ID NO: 8978
  Synthetic polynucleotide

SEQ ID NO: 8980 - DNA, 197 bp, Artificial Sequence
  Synthetic polynucleotide
atcatctcaccttgcctcctgtcttccgtcaatgcggtcctgcaggttggcaatttgccagagattggcaatttgccagtcgttggcaatttgccaggacttggcaatttgccagctattggcaatttgccagactttggcaatttgccagtgcttggcaatttgccaggtaggcgcgccatgcttcatcagactct

SEQ ID NO: 8981 - DNA, 197 bp, Artificial Sequence; identical to SEQ ID NO: 8980
  Synthetic polynucleotide

SEQ ID NO: 8982 - DNA, 148 bp, Artificial Sequence
  Synthetic polynucleotide
atcatctcaccttgcctcctgactctatcaagacaggccctgcaggaatttccagaaatttcctcgaatttccgacaatttccctaaatttccactaatttcctgcaatttccgtaaatttccggcgcgccatgcttcatcagactct

SEQ ID NO: 8983 - DNA, 148 bp, Artificial Sequence; identical to SEQ ID NO: 8982
  Synthetic polynucleotide

SEQ ID NO: 8984 - DNA, 172 bp, Artificial Sequence
  Synthetic polynucleotide
atcatctcaccttgcctcctgcagactcctctaggtgacctgcaggttccccctccagattccccctcctcgttccccctccgacttccccctccctattccccctccactttccccctcctgcttccccctccgtattccccctccggcgcgccatgcttcatcagactct

SEQ ID NO: 8985 - DNA, 172 bp, Artificial Sequence; identical to SEQ ID NO: 8984
  Synthetic polynucleotide

SEQ ID NO: 8986 - DNA, 172 bp, Artificial Sequence
  Synthetic polynucleotide
atcatctcaccttgcctcctgggtagtacgggtacaaccctgcaggagcgccccctagaagcgcccccttcgagcgccccctgacagcgccccctctaagcgccccctactagcgcccccttgcagcgccccctgtaagcgccccctggcgcgccatgcttcatcagactct

SEQ ID NO: 8987 - DNA, 172 bp, Artificial Sequence; identical to SEQ ID NO: 8986
  Synthetic polynucleotide

SEQ ID NO: 8988 - DNA, 197 bp, Artificial Sequence
  Synthetic polynucleotide
atcatctcaccttgcctcctgcgtttaacggaagcaggcctgcaggcagataagaatctgtagacagataagaatctgttcgcagataagaatctgtgaccagataagaatctgtctacagataagaatctgtactcagataagaatctgttgccagataagaatctgtgtaggcgcgccatgcttcatcagactct

SEQ ID NO: 8989 - DNA, 197 bp, Artificial Sequence; identical to SEQ ID NO: 8988
  Synthetic polynucleotide

SEQ ID NO: 8990 - DNA, 191 bp, Artificial Sequence
  Synthetic polynucleotide
atcatctcaccttgcctcctgtaaccagaagtgatcagcctgcaggaaaatacatgtaatactagaaaaatacatgtaatacttcgaaaatacatgtaatactgacaaaatacatgtaatactctaaaaatacatgtaatactactaaaatacatgtaatacttgcggcgcgccatgcttcatcagactct

SEQ ID NO: 8991 - DNA, 191 bp, Artificial Sequence; identical to SEQ ID NO: 8990
  Synthetic polynucleotide

SEQ ID NO: 8992 - DNA, 191 bp, Artificial Sequence
  Synthetic polynucleotide
atcatctcaccttgcctcctgacgggtaattacaatgccctgcaggtccattaattaatggacagatccattaattaatggactcgtccattaattaatggacgactccattaattaatggacctatccattaattaatggacacttccattaattaatggactgcggcgcgccatgcttcatcagactct

SEQ ID NO: 8993 - DNA, 191 bp, Artificial Sequence; identical to SEQ ID NO: 8992
  Synthetic polynucleotide

SEQ ID NO: 8994 - DNA, 156 bp, Artificial Sequence
  Synthetic polynucleotide
atcatctcaccttgcctcctgacgtttgactcgggaaacctgcaggggagttgtagaggagttgttcgggagttgtgacggagttgtctaggagttgtactggagttgttgcggagttgtgtaggagttgtggcgcgccatgcttcatcagactct

SEQ ID NO: 8995 - DNA, 156 bp, Artificial Sequence; identical to SEQ ID NO: 8994
  Synthetic polynucleotide

SEQ ID NO: 8996 - DNA, 172 bp, Artificial Sequence
  Synthetic polynucleotide
atcatctcaccttgcctcctgcgtccgcgtgcatgaaacctgcaggctgacctgaaagactgacctgaatcgctgacctgaagacctgacctgaactactgacctgaaactctgacctgaatgcctgacctgaagtactgacctgaaggcgcgccatgcttcatcagactct

SEQ ID NO: 8997 - DNA, 172 bp, Artificial Sequence; identical to SEQ ID NO: 8996
  Synthetic polynucleotide

SEQ ID NO: 8998 - DNA, 188 bp, Artificial Sequence
  Synthetic polynucleotide
atcatctcaccttgcctcctggatgccattgcttacggcctgcaggcggcagatggccagacggcagatggcctcgcggcagatggccgaccggcagatggccctacggcagatggccactcggcagatggcctgccggcagatggccgtacggcagatggccggcgcgccatgcttcatcagactct

SEQ ID NO: 8999 - DNA, 188 bp, Artificial Sequence; identical to SEQ ID NO: 8998
  Synthetic polynucleotide

SEQ ID NO: 9000 - DNA, 196 bp, Artificial Sequence
  Synthetic polynucleotide
atcatctcaccttgcctcctggtagacatgccaatagtcctgcaggggccagaggtcagagaggccagaggtcagtcgggccagaggtcaggacggccagaggtcagctaggccagaggtcagactggccagaggtcagtgcggccagaggtcaggtaggccagaggtcagggcgcgccatgcttcatcagactct

SEQ ID NO: 9001 - DNA, 196 bp, Artificial Sequence; identical to SEQ ID NO: 9000
  Synthetic polynucleotide

SEQ ID NO: 9002 - DNA, 191 bp, Artificial Sequence
  Synthetic polynucleotide
atcatctcaccttgcctcctgaccttagaggtgctctccctgcaggcgggagggtacattgtgttcttgtgcgagacgggagggtacattgtgttcttgtgcgtcgcgggagggtacattgtgttcttgtgcggaccgggagggtacattgtgttcttgtgcgctaggcgcgccatgcttcatcagactct

SEQ ID NO: 9003 - DNA, 191 bp, Artificial Sequence; identical to SEQ ID NO: 9002
  Synthetic polynucleotide

SEQ ID NO: 9004 - DNA, 180 bp, Artificial Sequence
  Synthetic polynucleotide
atcatctcaccttgcctcctgtaaacttgctctgagctcctgcaggaaaacacctgtagaaaaacacctgttcgaaaacacctgtgacaaaacacctgtctaaaaacacctgtactaaaacacctgttgcaaaacacctgtgtaaaaacacctgtggcgcgccatgcttcatcagactct

SEQ ID NO: 9005 - DNA, 180 bp, Artificial Sequence; identical to SEQ ID NO: 9004
  Synthetic polynucleotide

SEQ ID NO: 9006 - DNA, 191 bp, Artificial Sequence
  Synthetic polynucleotide
atcatctcaccttgcctcctgcgagactgaccacatgtcctgcaggaattttacatgtatataagaaattttacatgtatatatcgaattttacatgtatatagacaattttacatgtatatactaaattttacatgtatataactaattttacatgtatatatgcggcgcgccatgcttcatcagactct

SEQ ID NO: 9007 - DNA, 191 bp, Artificial Sequence; identical to SEQ ID NO: 9006
  Synthetic polynucleotide

SEQ ID NO: 9008 - DNA, 186 bp, Artificial Sequence
  Synthetic polynucleotide
atcatctcaccttgcctcctggaccgcttctattgtaacctgcaggtggggagcagctgcgtccctagatggggagcagctgcgtcccttcgtggggagcagctgcgtccctgactggggagcagctgcgtccctctatggggagcagctgcgtccctactggcgcgccatgcttcatcagactct

SEQ ID NO: 9009 - DNA, 186 bp, Artificial Sequence; identical to SEQ ID NO: 9008
  Synthetic polynucleotide

SEQ ID NO: 9010 - DNA, 180 bp, Artificial Sequence
  Synthetic polynucleotide
atcatctcaccttgcctcctgtccgtcagacatcacggcctgcagggcattaatcaaagagcattaatcaatcggcattaatcaagacgcattaatcaactagcattaatcaaactgcattaatcaatgcgcattaatcaagtagcattaatcaaggcgcgccatgcttcatcagactct

SEQ ID NO: 9011 - DNA, 180 bp, Artificial Sequence; identical to SEQ ID NO: 9010
  Synthetic polynucleotide

SEQ ID NO: 9012 - DNA, 197 bp, Artificial Sequence
  Synthetic polynucleotide
atcatctcaccttgcctcctgggccagattctgctggtcctgcagggggaaagtgaaactgagagggaaagtgaaactgtcggggaaagtgaaactggacgggaaagtgaaactgctagggaaagtgaaactgactgggaaagtgaaactgtgcgggaaagtgaaactggtaggcgcgccatgcttcatcagactct

SEQ ID NO: 9013 - DNA, 197 bp, Artificial Sequence; identical to SEQ ID NO: 9012
  Synthetic polynucleotide

SEQ ID NO: 9014 - DNA, 180 bp, Artificial Sequence
  Synthetic polynucleotide
atcatctcaccttgcctcctgcacctatgatgacctctcctgcagggctaattagccagagctaattagcctcggctaattagccgacgctaattagccctagctaattagccactgctaattagcctgcgctaattagccgtagctaattagccggcgcgccatgcttcatcagactct

SEQ ID NO: 9015 - DNA, 180 bp, Artificial Sequence; identical to SEQ ID NO: 9014
  Synthetic polynucleotide

SEQ ID NO: 9016 - DNA, 156 bp, Artificial Sequence
  Synthetic polynucleotide
atcatctcaccttgcctcctgcgtaatgatgacgtggacctgcaggtacgtcatagatacgtcattcgtacgtcatgactacgtcatctatacgtcatacttacgtcattgctacgtcatgtatacgtcatggcgcgccatgcttcatcagactct

SEQ ID NO: 9017 - DNA, 156 bp, Artificial Sequence; identical to SEQ ID NO: 9016
  Synthetic polynucleotide

SEQ ID NO: 9018 - DNA, 197 bp, Artificial Sequence
  Synthetic polynucleotide
atcatctcaccttgcctcctgaactgaaagcaatgatgcctgcaggtaaaaatgctgacttagataaaaatgctgactttcgtaaaaatgctgacttgactaaaaatgctgacttctataaaaatgctgacttacttaaaaatgctgactttgctaaaaatgctgacttgtaggcgcgccatgcttcatcagactct

SEQ ID NO: 9019 - DNA, 197 bp, Artificial Sequence; identical to SEQ ID NO: 9018
  Synthetic polynucleotide

SEQ ID NO: 9020 - DNA, 185 bp, Artificial Sequence
  Synthetic polynucleotide
atcatctcaccttgcctcctggggaatacacgtccacacctgcaggggattgtttacgtttgagaggattgtttacgtttgtcgggattgtttacgtttggacggattgtttacgtttgctaggattgtttacgtttgactggattgtttacgtttgtgcggcgcgccatgcttcatcagactct

SEQ ID NO: 9021 - DNA, 185 bp, Artificial Sequence; identical to SEQ ID NO: 9020
  Synthetic polynucleotide

SEQ ID NO: 9022 - DNA, 197 bp, Artificial Sequence
  Synthetic polynucleotide
atcatctcaccttgcctcctgtcgctagtcgaaagtcgcctgcaggatcgcgcgcctttatagaatcgcgcgcctttattcgatcgcgcgcctttatgacatcgcgcgcctttatctaatcgcgcgcctttatactatcgcgcgcctttattgcatcgcgcgcctttatgtaggcgcgccatgcttcatcagactct

SEQ ID NO: 9023 - DNA, 197 bp, Artificial Sequence; identical to SEQ ID NO: 9022
  Synthetic polynucleotide

SEQ ID NO: 9024 - DNA, 191 bp, Artificial Sequence
  Synthetic polynucleotide
atcatctcaccttgcctcctgcataaattgcgaatgctcctgcaggataaatgacacctatcaagaataaatgacacctatcatcgataaatgacacctatcagacataaatgacacctatcactaataaatgacacctatcaactataaatgacacctatcatgcggcgcgccatgcttcatcagactct

SEQ ID NO: 9025 - DNA, 191 bp, Artificial Sequence; identical to SEQ ID NO: 9024
  Synthetic polynucleotide

SEQ ID NO: 9026 - DNA, 196 bp, Artificial Sequence
  Synthetic polynucleotide
atcatctcaccttgcctcctgaatgagcggtttacgcacctgcaggaacttaccaaacaagaaacttaccaaacatcgaacttaccaaacagacaacttaccaaacactaaacttaccaaacaactaacttaccaaacatgcaacttaccaaacagtaaacttaccaaacaggcgcgccatgcttcatcagactct

SEQ ID NO: 9027 - DNA, 196 bp, Artificial Sequence; identical to SEQ ID NO: 9026
  Synthetic polynucleotide

SEQ ID NO: 9028 - DNA, 186 bp, Artificial Sequence
  Synthetic polynucleotide
atcatctcaccttgcctcctggctcgtcctagtttagccctgcaggtcctctttgtttacaattcaagatcctctttgtttacaattcatcgtcctctttgtttacaattcagactcctctttgtttacaattcactatcctctttgtttacaattcaactggcgcgccatgcttcatcagactct

SEQ ID NO: 9029 - DNA, 186 bp, Artificial Sequence; identical to SEQ ID NO: 9028
  Synthetic polynucleotide

SEQ ID NO: 9030 - DNA, 185 bp, Artificial Sequence
  Synthetic polynucleotide
atcatctcaccttgcctcctggttaagtatacgttggtcctgcaggaaatgcgtgggcgtaaagaaaatgcgtgggcgtaatcgaaatgcgtgggcgtaagacaaatgcgtgggcgtaactaaaatgcgtgggcgtaaactaaatgcgtgggcgtaatgcggcgcgccatgcttcatcagactct

SEQ ID NO: 9031 - DNA, 185 bp, Artificial Sequence; identical to SEQ ID NO: 9030
  Synthetic polynucleotide

SEQ ID NO: 9032 - DNA, 196 bp, Artificial Sequence
  Synthetic polynucleotide
atcatctcaccttgcctcctggcgtgatgcaacgatgtcctgcaggatgaattgcagtcagaatgaattgcagtctcgatgaattgcagtcgacatgaattgcagtcctaatgaattgcagtcactatgaattgcagtctgcatgaattgcagtcgtaatgaattgcagtcggcgcgccatgcttcatcagactct

SEQ ID NO: 9033 - DNA, 196 bp, Artificial Sequence; identical to SEQ ID NO: 9032
  Synthetic polynucleotide

SEQ ID NO: 9034 - DNA, 191 bp, Artificial Sequence
  Synthetic polynucleotide
atcatctcaccttgcctcctgttgaccctaccacgcaacctgcaggtaagccacgccccctttagataagccacgcccccttttcgtaagccacgccccctttgactaagccacgccccctttctataagccacgccccctttacttaagccacgcccccttttgcggcgcgccatgcttcatcagactct

SEQ ID NO: 9035 - DNA, 191 bp, Artificial Sequence; identical to SEQ ID NO: 9034
  Synthetic polynucleotide

SEQ ID NO: 9036 - DNA, 191 bp, Artificial Sequence
  Synthetic polynucleotide
atcatctcaccttgcctcctgagggcactacaggccaacctgcaggaatagggtatcaatattagaaatagggtatcaatatttcgaatagggtatcaatattgacaatagggtatcaatattctaaatagggtatcaatattactaatagggtatcaatatttgcggcgcgccatgcttcatcagactct

SEQ ID NO: 9037 - DNA, 191 bp, Artificial Sequence; identical to SEQ ID NO: 9036
  Synthetic polynucleotide

SEQ ID NO: 9038 - DNA, 186 bp, Artificial Sequence
  Synthetic polynucleotide
atcatctcaccttgcctcctggcaccacctatataggccctgcaggttatttgtgttgttttttatagattatttgtgttgttttttattcgttatttgtgttgttttttatgacttatttgtgttgttttttatctattatttgtgttgttttttatactggcgcgccatgcttcatcagactct

SEQ ID NO: 9039 - DNA, 186 bp, Artificial Sequence; identical to SEQ ID NO: 9038
  Synthetic polynucleotide

SEQ ID NO: 9040 - DNA, 156 bp, Artificial Sequence
  Synthetic polynucleotide
atcatctcaccttgcctcctgcgcaaagtgtaaccgtgcctgcagggtcacgtgagagtcacgtgtcggtcacgtggacgtcacgtgctagtcacgtgactgtcacgtgtgcgtcacgtggtagtcacgtgggcgcgccatgcttcatcagactct

SEQ ID NO: 9041 - DNA, 156 bp, Artificial Sequence; identical to SEQ ID NO: 9040
  Synthetic polynucleotide

SEQ ID NO: 9042 - DNA, 188 bp, Artificial Sequence
  Synthetic polynucleotide
atcatctcaccttgcctcctgtataaaccttagtcggtcctgcaggtgccctggggcaagatgccctggggcatcgtgccctggggcagactgccctggggcactatgccctggggcaacttgccctggggcatgctgccctggggcagtatgccctggggcaggcgcgccatgcttcatcagactct

SEQ ID NO: 9043 - DNA, 188 bp, Artificial Sequence; identical to SEQ ID NO: 9042
  Synthetic polynucleotide

SEQ ID NO: 9044 - DNA, 191 bp, Artificial Sequence
  Synthetic polynucleotide
atcatctcaccttgcctcctgccgttaaatttgcagttcctgcaggaattattaattaactcgagaaattattaattaactcgtcgaattattaattaactcggacaattattaattaactcgctaaattattaattaactcgactaattattaattaactcgtgcggcgcgccatgcttcatcagactct

SEQ ID NO: 9045 - DNA, 191 bp, Artificial Sequence; identical to SEQ ID NO: 9044
  Synthetic polynucleotide

SEQ ID NO: 9046 - DNA, 180 bp, Artificial Sequence
  Synthetic polynucleotide
atcatctcaccttgcctcctgcctcgtagaccaaactgcctgcaggttaacggttttagattaacggtttttcgttaacggttttgacttaacggttttctattaacggttttactttaacggtttttgcttaacggttttgtattaacggttttggcgcgccatgcttcatcagactct

SEQ ID NO: 9047 - DNA, 180 bp, Artificial Sequence; identical to SEQ ID NO: 9046
  Synthetic polynucleotide

SEQ ID NO: 9048 - DNA, 148 bp, Artificial Sequence
  Synthetic polynucleotide
atcatctcaccttgcctcctggtctttcttattacacccctgcaggaaatcaaagaaaatcaatcgaaatcaagacaaatcaactaaaatcaaactaaatcaatgcaaatcaagtaaaatcaaggcgcgccatgcttcatcagactct

SEQ ID NO: 9049 - DNA, 148 bp, Artificial Sequence; identical to SEQ ID NO: 9048
  Synthetic polynucleotide

SEQ ID NO: 9050 - DNA, 172 bp, Artificial Sequence
  Synthetic polynucleotide
atcatctcaccttgcctcctgatattaacagcccaagacctgcaggtttaattagtagatttaattagttcgtttaattagtgactttaattagtctatttaattagtacttttaattagttgctttaattagtgtatttaattagtggcgcgccatgcttcatcagactct

SEQ ID NO: 9051 - DNA, 172 bp, Artificial Sequence; identical to SEQ ID NO: 9050
  Synthetic polynucleotide

SEQ ID NO: 9052 - DNA, 164 bp, Artificial Sequence
  Synthetic polynucleotide
atcatctcaccttgcctcctggtactagggaatcacaacctgcaggcgcgcgcacagacgcgcgcactcgcgcgcgcacgaccgcgcgcacctacgcgcgcacactcgcgcgcactgccgcgcgcacgtacgcgcgcacggcgcgccatgcttcatcagactct

SEQ ID NO: 9053 - DNA, 164 bp, Artificial Sequence; identical to SEQ ID NO: 9052
  Synthetic polynucleotide

SEQ ID NO: 9054 - DNA, 191 bp, Artificial Sequence
  Synthetic polynucleotide
atcatctcaccttgcctcctgggcatcacgttctgacgcctgcaggaaggtcagtcaaggtcaagaaaggtcagtcaaggtcatcgaaggtcagtcaaggtcagacaaggtcagtcaaggtcactaaaggtcagtcaaggtcaactaaggtcagtcaaggtcatgcggcgcgccatgcttcatcagactct

SEQ ID NO: 9055 - DNA, 191 bp, Artificial Sequence; identical to SEQ ID NO: 9054
  Synthetic polynucleotide

SEQ ID NO: 9056 - DNA, 188 bp, Artificial Sequence
  Synthetic polynucleotide
atcatctcaccttgcctcctggatcatcagtgctagtgcctgcaggaaacaaacattcagaaaacaaacattctcgaaacaaacattcgacaaacaaacattcctaaaacaaacattcactaaacaaacattctgcaaacaaacattcgtaaaacaaacattcggcgcgccatgcttcatcagactct

SEQ ID NO: 9057 - DNA, 188 bp, Artificial Sequence; identical to SEQ ID NO: 9056
  Synthetic polynucleotide

SEQ ID NO: 9058 - DNA, 172 bp, Artificial Sequence
  Synthetic polynucleotide
atcatctcaccttgcctcctgccgtccaatcttcagcccctgcaggtttaattagaagatttaattagatcgtttaattagagactttaattagactatttaattagaacttttaattagatgctttaattagagtatttaattagaggcgcgccatgcttcatcagactct

SEQ ID NO: 9059 - DNA, 172 bp, Artificial Sequence; identical to SEQ ID NO: 9058
  Synthetic polynucleotide

SEQ ID NO: 9060 - DNA, 191 bp, Artificial Sequence
  Synthetic polynucleotide
atcatctcaccttgcctcctgccgaaacacctactgaacctgcagggagcattaattaaggcaagagagcattaattaaggcatcggagcattaattaaggcagacgagcattaattaaggcactagagcattaattaaggcaactgagcattaattaaggcatgcggcgcgccatgcttcatcagactct

SEQ ID NO: 9061 - DNA, 191 bp, Artificial Sequence; identical to SEQ ID NO: 9060
  Synthetic polynucleotide

SEQ ID NO: 9062 - DNA, 200 bp, Artificial Sequence
  Synthetic polynucleotide
atcatctcaccttgcctcctgccaacggaagcataactcctgcaggcaaaagcaatcaaccgtgaagacaaaagcaatcaaccgtgatcgcaaaagcaatcaaccgtgagaccaaaagcaatcaaccgtgactacaaaagcaatcaaccgtgaactcaaaagcaatcaaccgtgaggcgcgccatgcttcatcagactct

SEQ ID NO: 9063 - DNA, 200 bp, Artificial Sequence; identical to SEQ ID NO: 9062
  Synthetic polynucleotide

SEQ ID NO: 9064 - DNA, 197 bp, Artificial Sequence
  Synthetic polynucleotide
atcatctcaccttgcctcctgacatgacaagaaggaatcctgcagggtgcgtgggcgggggagagtgcgtgggcgggggtcggtgcgtgggcggggggacgtgcgtgggcgggggctagtgcgtgggcgggggactgtgcgtgggcgggggtgcgtgcgtgggcggggggtaggcgcgccatgcttcatcagactct

SEQ ID NO: 9065 - DNA, 197 bp, Artificial Sequence; identical to SEQ ID NO: 9064
  Synthetic polynucleotide

SEQ ID NO: 9066 - DNA, 180 bp, Artificial Sequence
  Synthetic polynucleotide
atcatctcaccttgcctcctgatgccagtgactagacccctgcagggaaatgagtcaagagaaatgagtcatcggaaatgagtcagacgaaatgagtcactagaaatgagtcaactgaaatgagtcatgcgaaatgagtcagtagaaatgagtcaggcgcgccatgcttcatcagactct

SEQ ID NO: 9067 - DNA, 180 bp, Artificial Sequence; identical to SEQ ID NO: 9066
  Synthetic polynucleotide

SEQ ID NO: 9068 - DNA, 180 bp, Artificial Sequence
  Synthetic polynucleotide
atcatctcaccttgcctcctgttcaactgccaaacgaccctgcaggagttaagtggaagaagttaagtggatcgagttaagtggagacagttaagtggactaagttaagtggaactagttaagtggatgcagttaagtggagtaagttaagtggaggcgcgccatgcttcatcagactct

SEQ ID NO: 9069 - DNA, 180 bp, Artificial Sequence; identical to SEQ ID NO: 9068
  Synthetic polynucleotide

SEQ ID NO: 9070 - DNA, 164 bp, Artificial Sequence
  Synthetic polynucleotide
atcatctcaccttgcctcctgtagcatagtgtcctgaacctgcaggatttgaattagaatttgaatttcgatttgaattgacatttgaattctaatttgaattactatttgaatttgcatttgaattgtaatttgaattggcgcgccatgcttcatcagactct

SEQ ID NO: 9071 - DNA, 164 bp, Artificial Sequence; identical to SEQ ID NO: 9070
  Synthetic polynucleotide

SEQ ID NO: 9072 - DNA, 188 bp, Artificial Sequence
  Synthetic polynucleotide
atcatctcaccttgcctcctggtgggtacattgaccctcctgcaggacatcaatcaaaagaacatcaatcaaatcgacatcaatcaaagacacatcaatcaaactaacatcaatcaaaactacatcaatcaaatgcacatcaatcaaagtaacatcaatcaaaggcgcgccatgcttcatcagactct

SEQ ID NO: 9073 - DNA, 188 bp, Artificial Sequence; identical to SEQ ID NO: 9072
  Synthetic polynucleotide

SEQ ID NO: 9074 - DNA, 172 bp, Artificial Sequence
  Synthetic polynucleotide
atcatctcaccttgcctcctggttagtgatttgagcttcctgcaggtttaattaggagatttaattaggtcgtttaattagggactttaattaggctatttaattaggacttttaattaggtgctttaattagggtatttaattaggggcgcgccatgcttcatcagactct

SEQ ID NO: 9075 - DNA, 172 bp, Artificial Sequence; identical to SEQ ID NO: 9074
  Synthetic polynucleotide

SEQ ID NO: 9076 - DNA, 148 bp, Artificial Sequence
  Synthetic polynucleotide
atcatctcaccttgcctcctggaaaccgtgtccgattccctgcaggcacttgaagacacttgatcgcacttgagaccacttgactacacttgaactcacttgatgccacttgagtacacttgaggcgcgccatgcttcatcagactct

SEQ ID NO: 9077 - DNA, 148 bp, Artificial Sequence; identical to SEQ ID NO: 9076
  Synthetic polynucleotide

SEQ ID NO: 9078 - DNA, 179 bp, Artificial Sequence
  Synthetic polynucleotide
atcatctcaccttgcctcctggttctggttatatcgtgcctgcaggaaaaaataaatcacagcatatgccagaaaaaaataaatcacagcatatgcctcgaaaaaataaatcacagcatatgccgacaaaaaataaatcacagcatatgccctaggcgcgccatgcttcatcagactct

SEQ ID NO: 9079 - DNA, 179 bp, Artificial Sequence; identical to SEQ ID NO: 9078
  Synthetic polynucleotide

SEQ ID NO: 9080 - DNA, 185 bp, Artificial Sequence
  Synthetic polynucleotide
atcatctcaccttgcctcctggggagctggagctctatcctgcagggttcattttggatggcagagttcattttggatggctcggttcattttggatggcgacgttcattttggatggcctagttcattttggatggcactgttcattttggatggctgcggcgcgccatgcttcatcagactct

SEQ ID NO: 9081 - DNA, 185 bp, Artificial Sequence; identical to SEQ ID NO: 9080
  Synthetic polynucleotide

SEQ ID NO: 9082 - DNA, 197 bp, Artificial Sequence
  Synthetic polynucleotide
atcatctcaccttgcctcctgacttggtggtacgctaacctgcaggtttttgttatgcaaaagatttttgttatgcaaatcgtttttgttatgcaaagactttttgttatgcaaactatttttgttatgcaaaacttttttgttatgcaaatgctttttgttatgcaaagtaggcgcgccatgcttcatcagactct

SEQ ID NO: 9083 - DNA, 197 bp, Artificial Sequence; identical to SEQ ID NO: 9082
  Synthetic polynucleotide

SEQ ID NO: 9084 - DNA, 185 bp, Artificial Sequence
  Synthetic polynucleotide
atcatctcaccttgcctcctgtgcacctgggcctttaccctgcaggaaatgcgtgggcgtatagaaaatgcgtgggcgtattcgaaatgcgtgggcgtatgacaaatgcgtgggcgtatctaaaatgcgtgggcgtatactaaatgcgtgggcgtattgcggcgcgccatgcttcatcagactct

SEQ ID NO: 9085 - DNA, 185 bp, Artificial Sequence; identical to SEQ ID NO: 9084
  Synthetic polynucleotide

SEQ ID NO: 9086 - DNA, 186 bp, Artificial Sequence
  Synthetic polynucleotide
atcatctcaccttgcctcctgataacgccaggcgatttcctgcaggccgcggccatcttggctgctagaccgcggccatcttggctgcttcgccgcggccatcttggctgctgacccgcggccatcttggctgctctaccgcggccatcttggctgctactggcgcgccatgcttcatcagactct

SEQ ID NO: 9087 - DNA, 186 bp, Artificial Sequence; identical to SEQ ID NO: 9086
  Synthetic polynucleotide

SEQ ID NO: 9088 - DNA, 188 bp, Artificial Sequence
  Synthetic polynucleotide
atcatctcaccttgcctcctgcagagatactgtgcagacctgcaggaaataaacaataagaaaataaacaatatcgaaataaacaatagacaaataaacaatactaaaataaacaataactaaataaacaatatgcaaataaacaatagtaaaataaacaataggcgcgccatgcttcatcagactct

SEQ ID NO: 9089 - DNA, 188 bp, Artificial Sequence; identical to SEQ ID NO: 9088
  Synthetic polynucleotide

SEQ ID NO: 9090 - DNA, 198 bp, Artificial Sequence
  Synthetic polynucleotide
atcatctcaccttgcctcctgcaccctgacttcttcctcctgcagggaataatgcgtgggcggcatctgagagaataatgcgtgggcggcatctgtcggaataatgcgtgggcggcatctggacgaataatgcgtgggcggcatctgctagaataatgcgtgggcggcatctgggcgcgccatgcttcatcagactct

SEQ ID NO: 9091 - DNA, 198 bp, Artificial Sequence; identical to SEQ ID NO: 9090
  Synthetic polynucleotide

SEQ ID NO: 9092 - DNA, 197 bp, Artificial Sequence
  Synthetic polynucleotide
atcatctcaccttgcctcctgaatcgactccggcacatcctgcagggggtccaaaggtcaaagagggtccaaaggtcaatcggggtccaaaggtcaagacgggtccaaaggtcaactagggtccaaaggtcaaactgggtccaaaggtcaatgcgggtccaaaggtcaagtaggcgcgccatgcttcatcagactct

SEQ ID NO: 9093 - DNA, 197 bp, Artificial Sequence; identical to SEQ ID NO: 9092
  Synthetic polynucleotide

SEQ ID NO: 9094 - DNA, 156 bp, Artificial Sequence
  Synthetic polynucleotide
atcatctcaccttgcctcctgtgagtgttatccactctcctgcaggtgggcggtagatgggcggttcgtgggcggtgactgggcggtctatgggcggtacttgggcggttgctgggcggtgtatgggcggtggcgcgccatgcttcatcagactct

SEQ ID NO: 9095 - DNA, 156 bp, Artificial Sequence; identical to SEQ ID NO: 9094
  Synthetic polynucleotide

SEQ ID NO: 9096 - DNA, 197 bp, Artificial Sequence
  Synthetic polynucleotide
atcatctcaccttgcctcctgcgccaactctacaaagccctgcagggctgaccttgaacttagagctgaccttgaactttcggctgaccttgaacttgacgctgaccttgaacttctagctgaccttgaacttactgctgaccttgaactttgcgctgaccttgaacttgtaggcgcgccatgcttcatcagactct

SEQ ID NO: 9097 - DNA, 197 bp, Artificial Sequence; identical to SEQ ID NO: 9096
  Synthetic polynucleotide

SEQ ID NO: 9098 - DNA, 196 bp, Artificial Sequence
  Synthetic polynucleotide
atcatctcaccttgcctcctgcttgcgatacggaacgccctgcaggggcgggtacagggtgttcttatagaggcgggtacagggtgttcttattcgggcgggtacagggtgttcttatgacggcgggtacagggtgttcttatctaggcgggtacagggtgttcttatactggcgcgccatgcttcatcagactct

SEQ ID NO: 9099 - DNA, 196 bp, Artificial Sequence; identical to SEQ ID NO: 9098
  Synthetic polynucleotide

SEQ ID NO: 9100 - DNA, 196 bp, Artificial Sequence
  Synthetic polynucleotide
atcatctcaccttgcctcctggctttaacatggaaggccctgcaggcggagagggggagggggggggcagacggagagggggagggggggggctcgcggagagggggagggggggggcgaccggagagggggagggggggggcctacggagagggggagggggggggcactggcgcgccatgcttcatcagactct

SEQ ID NO: 9101 - DNA, 196 bp, Artificial Sequence; identical to SEQ ID NO: 9100
  Synthetic polynucleotide

SEQ ID NO: 9102 - DNA, 188 bp, Artificial Sequence
  Synthetic polynucleotide
atcatctcaccttgcctcctgaggagaacacctggatgcctgcaggtctatgctaattagatctatgctaatttcgtctatgctaattgactctatgctaattctatctatgctaattacttctatgctaatttgctctatgctaattgtatctatgctaattggcgcgccatgcttcatcagactct

SEQ ID NO: 9103 - DNA, 188 bp, Artificial Sequence; identical to SEQ ID NO: 9102
  Synthetic polynucleotide

SEQ ID NO: 9104 - DNA, 186 bp, Artificial Sequence
  Synthetic polynucleotide
atcatctcaccttgcctcctgagctgagggtttcgagtcctgcaggcccccccccccgcccacgcaagacccccccccccgcccacgcatcgcccccccccccgcccacgcagaccccccccccccgcccacgcactacccccccccccgcccacgcaactggcgcgccatgcttcatcagactct

SEQ ID NO: 9105 - DNA, 186 bp, Artificial Sequence; identical to SEQ ID NO: 9104
  Synthetic polynucleotide

SEQ ID NO: 9106 - DNA, 156 bp, Artificial Sequence
  Synthetic polynucleotide
atcatctcaccttgcctcctgtgaagtggatttggatgcctgcagggtcagcaaagagtcagcaatcggtcagcaagacgtcagcaactagtcagcaaactgtcagcaatgcgtcagcaagtagtcagcaaggcgcgccatgcttcatcagactct

SEQ ID NO: 9107 - DNA, 156 bp, Artificial Sequence; identical to SEQ ID NO: 9106
  Synthetic polynucleotide

SEQ ID NO: 9108 - DNA, 172 bp, Artificial Sequence
  Synthetic polynucleotide
atcatctcaccttgcctcctgcggtcgcaatcgcacaacctgcaggcattgttcttagacattgttctttcgcattgttcttgaccattgttcttctacattgttcttactcattgttctttgccattgttcttgtacattgttcttggcgcgccatgcttcatcagactct

SEQ ID NO: 9109 - DNA, 172 bp, Artificial Sequence; identical to SEQ ID NO: 9108
  Synthetic polynucleotide

SEQ ID NO: 9110 - DNA, 172 bp, Artificial Sequence
  Synthetic polynucleotide
atcatctcaccttgcctcctgcaataagcgtgttcttccctgcaggttgacctttgagattgacctttgtcgttgacctttggacttgacctttgctattgacctttgactttgacctttgtgcttgacctttggtattgacctttgggcgcgccatgcttcatcagactct

SEQ ID NO: 9111 - DNA, 172 bp, Artificial Sequence; identical to SEQ ID NO: 9110
  Synthetic polynucleotide

SEQ ID NO: 9112 - DNA, 180 bp, Artificial Sequence
  Synthetic polynucleotide
atcatctcaccttgcctcctgccggtactgtcagttgacctgcaggtctcacctgaaagatctcacctgaatcgtctcacctgaagactctcacctgaactatctcacctgaaacttctcacctgaatgctctcacctgaagtatctcacctgaaggcgcgccatgcttcatcagactct

SEQ ID NO: 9113 - DNA, 180 bp, Artificial Sequence; identical to SEQ ID NO: 9112
  Synthetic polynucleotide

SEQ ID NO: 9114 - DNA, 197 bp, Artificial Sequence
  Synthetic polynucleotide
atcatctcaccttgcctcctgtgagtaggcgtcaccgtcctgcaggggcctgcgggcacccctcagaggcctgcgggcacccctctcgggcctgcgggcacccctcgacggcctgcgggcacccctcctaggcctgcgggcacccctcactggcctgcgggcacccctctgcggcgcgccatgcttcatcagactct

SEQ ID NO: 9115 - DNA, 197 bp, Artificial Sequence; identical to SEQ ID NO: 9114
  Synthetic polynucleotide

SEQ ID NO: 9116 - DNA, 197 bp, Artificial Sequence
  Synthetic polynucleotide
atcatctcaccttgcctcctgtttcattattccgtgtgcctgcaggttcattgtttgcttagtcagattcattgtttgcttagtctcgttcattgtttgcttagtcgacttcattgtttgcttagtcctattcattgtttgcttagtcactttcattgtttgcttagtctgcggcgcgccatgcttcatcagactct

SEQ ID NO: 9117 - DNA, 197 bp, Artificial Sequence; identical to SEQ ID NO: 9116
  Synthetic polynucleotide

SEQ ID NO: 9118 - DNA, 164 bp, Artificial Sequence
  Synthetic polynucleotide
atcatctcaccttgcctcctgcgatcgtagttcgcgaacctgcaggtaacggtcaagataacggtcatcgtaacggtcagactaacggtcactataacggtcaacttaacggtcatgctaacggtcagtataacggtcaggcgcgccatgcttcatcagactct

SEQ ID NO: 9119 - DNA, 164 bp, Artificial Sequence; identical to SEQ ID NO: 9118
  Synthetic polynucleotide

SEQ ID NO: 9120 - DNA, 164 bp, Artificial Sequence
  Synthetic polynucleotide
atcatctcaccttgcctcctgctcgtcggttagtattgcctgcaggattgcacaaagaattgcacaatcgattgcacaagacattgcacaactaattgcacaaactattgcacaatgcattgcacaagtaattgcacaaggcgcgccatgcttcatcagactct

SEQ ID NO: 9121 - DNA, 164 bp, Artificial Sequence; identical to SEQ ID NO: 9120
  Synthetic polynucleotide

SEQ ID NO: 9122 - DNA, 156 bp, Artificial Sequence
  Synthetic polynucleotide
atcatctcaccttgcctcctgctaattagagatccggccctgcagggatgacgtagagatgacgttcggatgacgtgacgatgacgtctagatgacgtactgatgacgttgcgatgacgtgtagatgacgtggcgcgccatgcttcatcagactct

SEQ ID NO: 9123 - DNA, 156 bp, Artificial Sequence; identical to SEQ ID NO: 9122
  Synthetic polynucleotide

SEQ ID NO: 9124 - DNA, 185 bp, Artificial Sequence
  Synthetic polynucleotide
atcatctcaccttgcctcctgaatgctgccgtttccgacctgcaggaaacctcgtaaaatttagaaaacctcgtaaaattttcgaaacctcgtaaaatttgacaaacctcgtaaaatttctaaaacctcgtaaaatttactaaacctcgtaaaattttgcggcgcgccatgcttcatcagactct

SEQ ID NO: 9125 - DNA, 185 bp, Artificial Sequence; identical to SEQ ID NO: 9124
  Synthetic polynucleotide

SEQ ID NO: 9126 - DNA, 190 bp, Artificial Sequence
  Synthetic polynucleotide
atcatctcaccttgcctcctggcaggctgaatgatctgcctgcaggaagtcaataagtcaagaaagtcaataagtcatcgaagtcaataagtcagacaagtcaataagtcactaaagtcaataagtcaactaagtcaataagtcatgcaagtcaataagtcagtaggcgcgccatgcttcatcagactct

SEQ ID NO: 9127 - DNA, 190 bp, Artificial Sequence; identical to SEQ ID NO: 9126
  Synthetic polynucleotide

SEQ ID NO: 9128 - DNA, 188 bp, Artificial Sequence
  Synthetic polynucleotide
atcatctcaccttgcctcctgaccattctgtccgaggccctgcagggctggggatttcagagctggggatttctcggctggggatttcgacgctggggatttcctagctggggatttcactgctggggatttctgcgctggggatttcgtagctggggatttcggcgcgccatgcttcatcagactct

SEQ ID NO: 9129 - DNA, 188 bp, Artificial Sequence; identical to SEQ ID NO: 9128
  Synthetic polynucleotide

SEQ ID NO: 9130 - DNA, 188 bp, Artificial Sequence
  Synthetic polynucleotide
atcatctcaccttgcctcctgtacatggcaactactatcctgcaggaatgtaaacataagaaatgtaaacatatcgaatgtaaacatagacaatgtaaacatactaaatgtaaacataactaatgtaaacatatgcaatgtaaacatagtaaatgtaaacataggcgcgccatgcttcatcagactct

SEQ ID NO: 9131 - DNA, 188 bp, Artificial Sequence; identical to SEQ ID NO: 9130
  Synthetic polynucleotide

SEQ ID NO: 9132 - DNA, 164 bp, Artificial Sequence
  Synthetic polynucleotide
atcatctcaccttgcctcctgacggcatgtgtcattcacctgcaggtaacggtcgagataacggtcgtcgtaacggtcggactaacggtcgctataacggtcgacttaacggtcgtgctaacggtcggtataacggtcgggcgcgccatgcttcatcagactct

SEQ ID NO: 9133 - DNA, 164 bp, Artificial Sequence; identical to SEQ ID NO: 9132
  Synthetic polynucleotide

SEQ ID NO: 9134 - DNA, 186 bp, Artificial Sequence
  Synthetic polynucleotide
atcatctcaccttgcctcctggatagtttcctatggtacctgcagggatttcccataatgccttgcagagatttcccataatgccttgctcggatttcccataatgccttgcgacgatttcccataatgccttgcctagatttcccataatgccttgcactggcgcgccatgcttcatcagactct

SEQ ID NO: 9135 - DNA, 186 bp, Artificial Sequence; identical to SEQ ID NO: 9134
  Synthetic polynucleotide

SEQ ID NO: 9136 - DNA, 180 bp, Artificial Sequence
  Synthetic polynucleotide
atcatctcaccttgcctcctgtagctcacccagcggatcctgcagggatcacgtgacagagatcacgtgactcggatcacgtgacgacgatcacgtgacctagatcacgtgacactgatcacgtgactgcgatcacgtgacgtagatcacgtgacggcgcgccatgcttcatcagactct

SEQ ID NO: 9137 - DNA, 180 bp, Artificial Sequence; identical to SEQ ID NO: 9136
  Synthetic polynucleotide

SEQ ID NO: 9138 - DNA, 172 bp, Artificial Sequence
  Synthetic polynucleotide
atcatctcaccttgcctcctgttatcatcggaggcatacctgcagggcgggggcggagagcgggggcggtcggcgggggcgggacgcgggggcggctagcgggggcggactgcgggggcggtgcgcgggggcgggtagcgggggcggggcgcgccatgcttcatcagactct

SEQ ID NO: 9139 - DNA, 172 bp, Artificial Sequence; identical to SEQ ID NO: 9138
  Synthetic polynucleotide

SEQ ID NO: 9140 - DNA, 156 bp, Artificial Sequence
  Synthetic polynucleotide
atcatctcaccttgcctcctgatggcaaggcttacacgcctgcaggaccacgtgagaaccacgtgtcgaccacgtggacaccacgtgctaaccacgtgactaccacgtgtgcaccacgtggtaaccacgtgggcgcgccatgcttcatcagactct

SEQ ID NO: 9141 - DNA, 156 bp, Artificial Sequence; identical to SEQ ID NO: 9140
  Synthetic polynucleotide

SEQ ID NO: 9142 - DNA, 191 bp, Artificial Sequence
  Synthetic polynucleotide
atcatctcaccttgcctcctgtcagctcttcagaaggtcctgcaggttttatgtgcacatgtaagattttatgtgcacatgtatcgttttatgtgcacatgtagacttttatgtgcacatgtactattttatgtgcacatgtaactttttatgtgcacatgtatgcggcgcgccatgcttcatcagactct

SEQ ID NO: 9143 - DNA, 191 bp, Artificial Sequence; identical to SEQ ID NO: 9142
  Synthetic polynucleotide

SEQ ID NO: 9144 - DNA, 164 bp, Artificial Sequence
  Synthetic polynucleotide
atcatctcaccttgcctcctgctgaataatagacctaccctgcaggttgagtcatagattgagtcattcgttgagtcatgacttgagtcatctattgagtcatactttgagtcattgcttgagtcatgtattgagtcatggcgcgccatgcttcatcagactct

SEQ ID NO: 9145 - DNA, 164 bp, Artificial Sequence; identical to SEQ ID NO: 9144
  Synthetic polynucleotide

SEQ ID NO: 9146 - DNA, 190 bp, Artificial Sequence
  Synthetic polynucleotide
atcatctcaccttgcctcctgagatagccacctcagcacctgcaggccgtcacgtgaccaagaccgtcacgtgaccatcgccgtcacgtgaccagacccgtcacgtgaccactaccgtcacgtgaccaactccgtcacgtgaccatgcccgtcacgtgaccagtaggcgcgccatgcttcatcagactct

SEQ ID NO: 9147 - DNA, 190 bp, Artificial Sequence; identical to SEQ ID NO: 9146
  Synthetic polynucleotide

SEQ ID NO: 9148 - DNA, 180 bp, Artificial Sequence
  Synthetic polynucleotide
atcatctcaccttgcctcctgtgaatgcgtttcaacttcctgcaggaactatcgataagaaactatcgatatcgaactatcgatagacaactatcgatactaaactatcgataactaactatcgatatgcaactatcgatagtaaactatcgataggcgcgccatgcttcatcagactct

SEQ ID NO: 9149 - DNA, 180 bp, Artificial Sequence; identical to SEQ ID NO: 9148
  Synthetic polynucleotide

SEQ ID NO: 9150 - DNA, 196 bp, Artificial Sequence
  Synthetic polynucleotide
atcatctcaccttgcctcctgtcgtacaatacagacgacctgcaggtgaatgttattcaagatgaatgttattcatcgtgaatgttattcagactgaatgttattcactatgaatgttattcaacttgaatgttattcatgctgaatgttattcagtatgaatgttattcaggcgcgccatgcttcatcagactct

SEQ ID NO: 9151 - DNA, 196 bp, Artificial Sequence; identical to SEQ ID NO: 9150
  Synthetic polynucleotide

SEQ ID NO: 9152 - DNA, 140 bp, Artificial Sequence
  Synthetic polynucleotide
atcatctcaccttgcctcctgtctgggtagatatttcccctgcaggttggcaagattggcatcgttggcagacttggcactattggcaactttggcatgcttggcagtattggcaggcgcgccatgcttcatcagactct

SEQ ID NO: 9153 - DNA, 140 bp, Artificial Sequence; identical to SEQ ID NO: 9152
  Synthetic polynucleotide

SEQ ID NO: 9154 - DNA, 164 bp, Artificial Sequence
  Synthetic polynucleotide
atcatctcaccttgcctcctgggatgctcgtgacgagacctgcaggttaattgctagattaattgcttcgttaattgctgacttaattgctctattaattgctactttaattgcttgcttaattgctgtattaattgctggcgcgccatgcttcatcagactct

SEQ ID NO: 9155 - DNA, 164 bp, Artificial Sequence; identical to SEQ ID NO: 9154
  Synthetic polynucleotide

SEQ ID NO: 9156 - DNA, 188 bp, Artificial Sequence
  Synthetic polynucleotide
atcatctcaccttgcctcctgaattctccgctaccggacctgcaggagctcaaggtcaagaagctcaaggtcatcgagctcaaggtcagacagctcaaggtcactaagctcaaggtcaactagctcaaggtcatgcagctcaaggtcagtaagctcaaggtcaggcgcgccatgcttcatcagactct

SEQ ID NO: 9157 - DNA, 188 bp, Artificial Sequence; identical to SEQ ID NO: 9156
  Synthetic polynucleotide

SEQ ID NO: 9158 - DNA, 156 bp, Artificial Sequence
  Synthetic polynucleotide
atcatctcaccttgcctcctgagcaatattagcccggacctgcaggtcttatctagatcttatcttcgtcttatctgactcttatctctatcttatctacttcttatcttgctcttatctgtatcttatctggcgcgccatgcttcatcagactct

SEQ ID NO: 9159 - DNA, 156 bp, Artificial Sequence; identical to SEQ ID NO: 9158
  Synthetic polynucleotide

SEQ ID NO: 9160 - DNA, 185 bp, Artificial Sequence
  Synthetic polynucleotide
atcatctcaccttgcctcctgggttaattacagatagccctgcagggccatccaaaatgaacagagccatccaaaatgaactcggccatccaaaatgaacgacgccatccaaaatgaacctagccatccaaaatgaacactgccatccaaaatgaactgcggcgcgccatgcttcatcagactct

SEQ ID NO: 9161 - DNA, 185 bp, Artificial Sequence; identical to SEQ ID NO: 9160
  Synthetic polynucleotide

SEQ ID NO: 9162 - DNA, 196 bp, Artificial Sequence
  Synthetic polynucleotide
atcatctcaccttgcctcctgaggaggtctcaacggtccctgcagggcagagggcagcgagagcagagggcagcgtcggcagagggcagcggacgcagagggcagcgctagcagagggcagcgactgcagagggcagcgtgcgcagagggcagcggtagcagagggcagcgggcgcgccatgcttcatcagactct

SEQ ID NO: 9163 - DNA, 196 bp, Artificial Sequence; identical to SEQ ID NO: 9162
  Synthetic polynucleotide

SEQ ID NO: 9164 - DNA, 180 bp, Artificial Sequence
  Synthetic polynucleotide
atcatctcaccttgcctcctggagtcagcgttcttagccctgcaggaaccggaaataagaaaccggaaatatcgaaccggaaatagacaaccggaaatactaaaccggaaataactaaccggaaatatgcaaccggaaatagtaaaccggaaataggcgcgccatgcttcatcagactct

SEQ ID NO: 9165 - DNA, 180 bp, Artificial Sequence; identical to SEQ ID NO: 9164
  Synthetic polynucleotide

SEQ ID NO: 9166 - DNA, 190 bp, Artificial Sequence
  Synthetic polynucleotide
atcatctcaccttgcctcctgtacactgccagggattccctgcaggtgccgcacgtacgcagatgccgcacgtacgctcgtgccgcacgtacgcgactgccgcacgtacgcctatgccgcacgtacgcacttgccgcacgtacgctgctgccgcacgtacgcgtaggcgcgccatgcttcatcagactct

SEQ ID NO: 9167 - DNA, 190 bp, Artificial Sequence; identical to SEQ ID NO: 9166
  Synthetic polynucleotide

SEQ ID NO: 9168 - DNA, 172 bp, Artificial Sequence
  Synthetic polynucleotide
atcatctcaccttgcctcctgatctgtctgtatagggtcctgcagggttaattgctagagttaattgcttcggttaattgctgacgttaattgctctagttaattgctactgttaattgcttgcgttaattgctgtagttaattgctggcgcgccatgcttcatcagactct

SEQ ID NO: 9169 - DNA, 172 bp, Artificial Sequence; identical to SEQ ID NO: 9168
  Synthetic polynucleotide

SEQ ID NO: 9170 - DNA, 191 bp, Artificial Sequence
  Synthetic polynucleotide
atcatctcaccttgcctcctgagtgcagaagcggcaagcctgcaggaccggttgatcacctgaagaaccggttgatcacctgatcgaccggttgatcacctgagacaccggttgatcacctgactaaccggttgatcacctgaactaccggttgatcacctgatgcggcgcgccatgcttcatcagactct

SEQ ID NO: 9171 - DNA, 191 bp, Artificial Sequence; identical to SEQ ID NO: 9170
  Synthetic polynucleotide

SEQ ID NO: 9172 - DNA, 179 bp, Artificial Sequence
  Synthetic polynucleotide
atcatctcaccttgcctcctgaccaacgccgatattcccctgcaggctgaaagatgacgtgtcatttaatagactgaaagatgacgtgtcatttaattcgctgaaagatgacgtgtcatttaatgacctgaaagatgacgtgtcatttaatctaggcgcgccatgcttcatcagactct

SEQ ID NO: 9173 - DNA, 179 bp, Artificial Sequence; identical to SEQ ID NO: 9172
  Synthetic polynucleotide

SEQ ID NO: 9174 - DNA, 164 bp, Artificial Sequence
  Synthetic polynucleotide
atcatctcaccttgcctcctggacacccttgcagagttcctgcaggggcacgtgtagaggcacgtgttcgggcacgtgtgacggcacgtgtctaggcacgtgtactggcacgtgttgcggcacgtgtgtaggcacgtgtggcgcgccatgcttcatcagactct

SEQ ID NO: 9175 - DNA, 164 bp, Artificial Sequence; identical to SEQ ID NO: 9174
  Synthetic polynucleotide

SEQ ID NO: 9176 - DNA, 188 bp, Artificial Sequence
  Synthetic polynucleotide
atcatctcaccttgcctcctgtaatcgtgatccaggtccctgcaggtgtttgtttattagatgtttgtttatttcgtgtttgtttattgactgtttgtttattctatgtttgtttattacttgtttgtttatttgctgtttgtttattgtatgtttgtttattggcgcgccatgcttcatcagactct

SEQ ID NO: 9177 - DNA, 188 bp, Artificial Sequence; identical to SEQ ID NO: 9176
  Synthetic polynucleotide

SEQ ID NO: 9178 - DNA, 200 bp, Artificial Sequence
  Synthetic polynucleotide
atcatctcaccttgcctcctgggattgcggacatgtaacctgcaggtcacctgttgctaggcagaagatcacctgttgctaggcagatcgtcacctgttgctaggcagagactcacctgttgctaggcagactatcacctgttgctaggcagaacttcacctgttgctaggcagaggcgcgccatgcttcatcagactct

SEQ ID NO: 9179 - DNA, 200 bp, Artificial Sequence; identical to SEQ ID NO: 9178
  Synthetic polynucleotide

SEQ ID NO: 9180 - DNA, 156 bp, Artificial Sequence
  Synthetic polynucleotide
atcatctcaccttgcctcctgcgtcggattaattccgtcctgcaggcctgtcaaagacctgtcaatcgcctgtcaagaccctgtcaactacctgtcaaactcctgtcaatgccctgtcaagtacctgtcaaggcgcgccatgcttcatcagactct

SEQ ID NO: 9181 - DNA, 156 bp, Artificial Sequence; identical to SEQ ID NO: 9180
  Synthetic polynucleotide

SEQ ID NO: 9182 - DNA, 156 bp, Artificial Sequence
  Synthetic polynucleotide
atcatctcaccttgcctcctgtcaacgccctagagtaacctgcaggtcttatcaagatcttatcatcgtcttatcagactcttatcactatcttatcaacttcttatcatgctcttatcagtatcttatcaggcgcgccatgcttcatcagactct

SEQ ID NO: 9183 - DNA, 156 bp, Artificial Sequence; identical to SEQ ID NO: 9182
  Synthetic polynucleotide

SEQ ID NO: 9184 - DNA, 164 bp, Artificial Sequence
  Synthetic polynucleotide
atcatctcaccttgcctcctgcccactatcggaacgtccctgcaggttaattgccagattaattgcctcgttaattgccgacttaattgccctattaattgccactttaattgcctgcttaattgccgtattaattgccggcgcgccatgcttcatcagactct

SEQ ID NO: 9185 - DNA, 164 bp, Artificial Sequence; identical to SEQ ID NO: 9184
  Synthetic polynucleotide

SEQ ID NO: 9186 - DNA, 180 bp, Artificial Sequence
  Synthetic polynucleotide
atcatctcaccttgcctcctgtagttggatgtcggctccctgcagggataagcatctagagataagcatcttcggataagcatctgacgataagcatctctagataagcatctactgataagcatcttgcgataagcatctgtagataagcatctggcgcgccatgcttcatcagactct

SEQ ID NO: 9187 - DNA, 180 bp, Artificial Sequence; identical to SEQ ID NO: 9186
  Synthetic polynucleotide

SEQ ID NO: 9188 - DNA, 197 bp, Artificial Sequence
  Synthetic polynucleotide
atcatctcaccttgcctcctgccgattagcgttaaccgcctgcaggccagggtatcagccgagaccagggtatcagccgtcgccagggtatcagccggacccagggtatcagccgctaccagggtatcagccgactccagggtatcagccgtgcccagggtatcagccggtaggcgcgccatgcttcatcagactct

SEQ ID NO: 9189 - DNA, 197 bp, Artificial Sequence; identical to SEQ ID NO: 9188
  Synthetic polynucleotide

SEQ ID NO: 9190 - DNA, 196 bp, Artificial Sequence
  Synthetic polynucleotide
atcatctcaccttgcctcctgaggtgaacgagtttgtccctgcagggctactgtgtttcagagctactgtgtttctcggctactgtgtttcgacgctactgtgtttcctagctactgtgtttcactgctactgtgtttctgcgctactgtgtttcgtagctactgtgtttcggcgcgccatgcttcatcagactct

SEQ ID NO: 9191 - DNA, 196 bp, Artificial Sequence; identical to SEQ ID NO: 9190
  Synthetic polynucleotide

SEQ ID NO: 9192 - DNA, 180 bp, Artificial Sequence
  Synthetic polynucleotide
atcatctcaccttgcctcctgagacgtacatcttctcgcctgcaggggaggccggggagaggaggccggggtcgggaggccgggggacggaggccggggctaggaggccggggactggaggccggggtgcggaggccgggggtaggaggccggggggcgcgccatgcttcatcagactct

SEQ ID NO: 9193 - DNA, 180 bp, Artificial Sequence; identical to SEQ ID NO: 9192
  Synthetic polynucleotide

SEQ ID NO: 9194 - DNA, 191 bp, Artificial Sequence
  Synthetic polynucleotide
atcatctcaccttgcctcctgcgcaaatacgagttcgacctgcaggcttaaccacttaaggatagacttaaccacttaaggattcgcttaaccacttaaggatgaccttaaccacttaaggatctacttaaccacttaaggatactcttaaccacttaaggattgcggcgcgccatgcttcatcagactct

SEQ ID NO: 9195 - DNA, 191 bp, Artificial Sequence; identical to SEQ ID NO: 9194
  Synthetic polynucleotide

SEQ ID NO: 9196 - DNA, 188 bp, Artificial Sequence
  Synthetic polynucleotide
atcatctcaccttgcctcctgtcgctatggtcgtcgaacctgcaggaaagcaattaagagaaaagcaattaagtcgaaagcaattaaggacaaagcaattaagctaaaagcaattaagactaaagcaattaagtgcaaagcaattaaggtaaaagcaattaagggcgcgccatgcttcatcagactct

SEQ ID NO: 9197 - DNA, 188 bp, Artificial Sequence; identical to SEQ ID NO: 9196
  Synthetic polynucleotide

SEQ ID NO: 9198 - DNA, 185 bp, Artificial Sequence
  Synthetic polynucleotide
atcatctcaccttgcctcctgcgactcaaacctgaatacctgcaggtaagccacttgaatttagataagccacttgaattttcgtaagccacttgaatttgactaagccacttgaatttctataagccacttgaatttacttaagccacttgaattttgcggcgcgccatgcttcatcagactct

SEQ ID NO: 9199 - DNA, 185 bp, Artificial Sequence; identical to SEQ ID NO: 9198
  Synthetic polynucleotide

SEQ ID NO: 9200 - DNA, 180 bp, Artificial Sequence
  Synthetic polynucleotide
atcatctcaccttgcctcctggttcgtagatagttgtgcctgcagggccacaccctgagagccacaccctgtcggccacaccctggacgccacaccctgctagccacaccctgactgccacaccctgtgcgccacaccctggtagccacaccctgggcgcgccatgcttcatcagactct

SEQ ID NO: 9201 - DNA, 180 bp, Artificial Sequence; identical to SEQ ID NO: 9200
  Synthetic polynucleotide

SEQ ID NO: 9202 - DNA, 180 bp, Artificial Sequence
  Synthetic polynucleotide
atcatctcaccttgcctcctggtggcaaatgcaggacgcctgcaggtcccattggctagatcccattggcttcgtcccattggctgactcccattggctctatcccattggctacttcccattggcttgctcccattggctgtatcccattggctggcgcgccatgcttcatcagactct

SEQ ID NO: 9203 - DNA, 180 bp, Artificial Sequence; identical to SEQ ID NO: 9202
  Synthetic polynucleotide

SEQ ID NO: 9204 - DNA, 180 bp, Artificial Sequence
  Synthetic polynucleotide
atcatctcaccttgcctcctgtcttggattggcgaacccctgcaggaatgagtcacaagaaatgagtcacatcgaatgagtcacagacaatgagtcacactaaatgagtcacaactaatgagtcacatgcaatgagtcacagtaaatgagtcacaggcgcgccatgcttcatcagactct

SEQ ID NO: 9205 - DNA, 180 bp, Artificial Sequence; identical to SEQ ID NO: 9204
  Synthetic polynucleotide

SEQ ID NO: 9206 - DNA, 164 bp, Artificial Sequence
  Synthetic polynucleotide
atcatctcaccttgcctcctgagcaatctctgcatagacctgcaggggggtggtcagaggggtggtctcgggggtggtcgacggggtggtcctaggggtggtcactggggtggtctgcggggtggtcgtaggggtggtcggcgcgccatgcttcatcagactct

SEQ ID NO: 9207 - DNA, 164 bp, Artificial Sequence; identical to SEQ ID NO: 9206
  Synthetic polynucleotide

SEQ ID NO: 9208 - DNA, 172 bp, Artificial Sequence
  Synthetic polynucleotide
atcatctcaccttgcctcctgcacgcataaagacttggcctgcaggaggcatgtctagaaggcatgtcttcgaggcatgtctgacaggcatgtctctaaggcatgtctactaggcatgtcttgcaggcatgtctgtaaggcatgtctggcgcgccatgcttcatcagactct

SEQ ID NO: 9209 - DNA, 172 bp, Artificial Sequence; identical to SEQ ID NO: 9208
  Synthetic polynucleotide

SEQ ID NO: 9210 - DNA, 156 bp, Artificial Sequence
  Synthetic polynucleotide
atcatctcaccttgcctcctggagcggcgaatctgtctcctgcaggtttgatatagatttgatattcgtttgatatgactttgatatctatttgatatacttttgatattgctttgatatgtatttgatatggcgcgccatgcttcatcagactct

SEQ ID NO: 9211 - DNA, 156 bp, Artificial Sequence; identical to SEQ ID NO: 9210
  Synthetic polynucleotide

SEQ ID NO: 9212 - DNA, 188 bp, Artificial Sequence
  Synthetic polynucleotide
atcatctcaccttgcctcctgctggcttgggagagaatcctgcaggggtgacgtcattagaggtgacgtcatttcgggtgacgtcattgacggtgacgtcattctaggtgacgtcattactggtgacgtcatttgcggtgacgtcattgtaggtgacgtcattggcgcgccatgcttcatcagactct

SEQ ID NO: 9213 - DNA, 188 bp, Artificial Sequence; identical to SEQ ID NO: 9212
  Synthetic polynucleotide

SEQ ID NO: 9214 - DNA, 172 bp, Artificial Sequence
  Synthetic polynucleotide
atcatctcaccttgcctcctgtacagaagcgtcactcccctgcaggaggtaggtacagaaggtaggtactcgaggtaggtacgacaggtaggtacctaaggtaggtacactaggtaggtactgcaggtaggtacgtaaggtaggtacggcgcgccatgcttcatcagactct

SEQ ID NO: 9215 - DNA, 172 bp, Artificial Sequence; identical to SEQ ID NO: 9214
  Synthetic polynucleotide

SEQ ID NO: 9216 - DNA, 188 bp, Artificial Sequence
  Synthetic polynucleotide
atcatctcaccttgcctcctggcatacgaagaagctgacctgcaggttaaaaatagccagattaaaaatagcctcgttaaaaatagccgacttaaaaatagccctattaaaaatagccactttaaaaatagcctgcttaaaaatagccgtattaaaaatagccggcgcgccatgcttcatcagactct

SEQ ID NO: 9217 - DNA, 188 bp, Artificial Sequence; identical to SEQ ID NO: 9216
  Synthetic polynucleotide

SEQ ID NO: 9218 - DNA, 172 bp, Artificial Sequence
  Synthetic polynucleotide
atcatctcaccttgcctcctgaaggcctagtttagtgccctgcaggcagataagaaagacagataagaatcgcagataagaagaccagataagaactacagataagaaactcagataagaatgccagataagaagtacagataagaaggcgcgccatgcttcatcagactct

SEQ ID NO: 9219 - DNA, 172 bp, Artificial Sequence; identical to SEQ ID NO: 9218
  Synthetic polynucleotide

SEQ ID NO: 9220 - DNA, 172 bp, Artificial Sequence
  Synthetic polynucleotide
atcatctcaccttgcctcctgaaggtaaagcgctaagtcctgcagggccacgcgcgagagccacgcgcgtcggccacgcgcggacgccacgcgcgctagccacgcgcgactgccacgcgcgtgcgccacgcgcggtagccacgcgcgggcgcgccatgcttcatcagactct

SEQ ID NO: 9221 - DNA, 172 bp, Artificial Sequence; identical to SEQ ID NO: 9220
  Synthetic polynucleotide

SEQ ID NO: 9222 - DNA, 196 bp, Artificial Sequence
  Synthetic polynucleotide
atcatctcaccttgcctcctgacgggtgtgacatatgtcctgcagggatgactcacacaagagatgactcacacatcggatgactcacacagacgatgactcacacactagatgactcacacaactgatgactcacacatgcgatgactcacacagtagatgactcacacaggcgcgccatgcttcatcagactct

SEQ ID NO: 9223 - DNA, 196 bp, Artificial Sequence; identical to SEQ ID NO: 9222
  Synthetic polynucleotide

SEQ ID NO: 9224 - DNA, 197 bp, Artificial Sequence
  Synthetic polynucleotide
atcatctcaccttgcctcctggcgtcgattatcgaggacctgcaggccgttccgctctagatatagaccgttccgctctagatattcgccgttccgctctagatatgacccgttccgctctagatatctaccgttccgctctagatatactccgttccgctctagatattgcggcgcgccatgcttcatcagactct

SEQ ID NO: 9225 - DNA, 197 bp, Artificial Sequence; identical to SEQ ID NO: 9224
  Synthetic polynucleotide

SEQ ID NO: 9226 - DNA, 191 bp, Artificial Sequence
  Synthetic polynucleotide
atcatctcaccttgcctcctggctgctcattctgtgagcctgcaggttgtttaccgtaaacatagattgtttaccgtaaacattcgttgtttaccgtaaacatgacttgtttaccgtaaacatctattgtttaccgtaaacatactttgtttaccgtaaacattgcggcgcgccatgcttcatcagactct

SEQ ID NO: 9227 - DNA, 191 bp, Artificial Sequence; identical to SEQ ID NO: 9226
  Synthetic polynucleotide

SEQ ID NO: 9228 - DNA, 191 bp, Artificial Sequence
  Synthetic polynucleotide
atcatctcaccttgcctcctgcctctattccatctggtcctgcaggtattatgggatggataaagatattatgggatggataatcgtattatgggatggataagactattatgggatggataactatattatgggatggataaacttattatgggatggataatgcggcgcgccatgcttcatcagactct

SEQ ID NO: 9229 - DNA, 191 bp, Artificial Sequence; identical to SEQ ID NO: 9228
  Synthetic polynucleotide

SEQ ID NO: 9230 - DNA, 180 bp, Artificial Sequence
  Synthetic polynucleotide
atcatctcaccttgcctcctgagcttaagttgaagcaccctgcaggttgcgtcatcaagattgcgtcatcatcgttgcgtcatcagacttgcgtcatcactattgcgtcatcaactttgcgtcatcatgcttgcgtcatcagtattgcgtcatcaggcgcgccatgcttcatcagactct

SEQ ID NO: 9231 - DNA, 180 bp, Artificial Sequence; identical to SEQ ID NO: 9230
  Synthetic polynucleotide

SEQ ID NO: 9232 - DNA, 164 bp, Artificial Sequence
  Synthetic polynucleotide
atcatctcaccttgcctcctggagcttatagccgctgccctgcaggagccaaaccagaagccaaacctcgagccaaaccgacagccaaaccctaagccaaaccactagccaaacctgcagccaaaccgtaagccaaaccggcgcgccatgcttcatcagactct

SEQ ID NO: 9233 - DNA, 164 bp, Artificial Sequence; identical to SEQ ID NO: 9232
  Synthetic polynucleotide

SEQ ID NO: 9234 - DNA, 156 bp, Artificial Sequence
  Synthetic polynucleotide
atcatctcaccttgcctcctgtctttggttgttacgcacctgcaggattcaaatagaattcaaattcgattcaaatgacattcaaatctaattcaaatactattcaaattgcattcaaatgtaattcaaatggcgcgccatgcttcatcagactct

SEQ ID NO: 9235 - DNA, 156 bp, Artificial Sequence; identical to SEQ ID NO: 9234
  Synthetic polynucleotide

SEQ ID NO: 9236 - DNA, 156 bp, Artificial Sequence
  Synthetic polynucleotide
atcatctcaccttgcctcctgcgatatcggctcagagtcctgcagggcacttaaagagcacttaatcggcacttaagacgcacttaactagcacttaaactgcacttaatgcgcacttaagtagcacttaaggcgcgccatgcttcatcagactct

SEQ ID NO: 9237 - DNA, 156 bp, Artificial Sequence; identical to SEQ ID NO: 9236
  Synthetic polynucleotide

SEQ ID NO: 9238 - DNA, 191 bp, Artificial Sequence
  Synthetic polynucleotide
atcatctcaccttgcctcctgtcggttgtaaactcgtgcctgcaggccaccagggggcgccagagaccaccagggggcgccagtcgccaccagggggcgccaggacccaccagggggcgccagctaccaccagggggcgccagactccaccagggggcgccagtgcggcgcgccatgcttcatcagactct

SEQ ID NO: 9239 - DNA, 191 bp, Artificial Sequence; identical to SEQ ID NO: 9238
  Synthetic polynucleotide

SEQ ID NO: 9240 - DNA, 197 bp, Artificial Sequence
  Synthetic polynucleotide
atcatctcaccttgcctcctgaaggtgaaacgctctcgcctgcaggttgttgccatggctactaagattgttgccatggctactatcgttgttgccatggctactagacttgttgccatggctactactattgttgccatggctactaactttgttgccatggctactatgcggcgcgccatgcttcatcagactct

SEQ ID NO: 9241 - DNA, 197 bp, Artificial Sequence; identical to SEQ ID NO: 9240
  Synthetic polynucleotide

SEQ ID NO: 9242 - DNA, 190 bp, Artificial Sequence
  Synthetic polynucleotide
atcatctcaccttgcctcctgcgctctatttagtggttcctgcaggaagtgggcgtggccagaaagtgggcgtggcctcgaagtgggcgtggccgacaagtgggcgtggccctaaagtgggcgtggccactaagtgggcgtggcctgcaagtgggcgtggccgtaggcgcgccatgcttcatcagactct

SEQ ID NO: 9243 - DNA, 190 bp, Artificial Sequence; identical to SEQ ID NO: 9242
  Synthetic polynucleotide

SEQ ID NO: 9244 - DNA, 140 bp, Artificial Sequence
  Synthetic polynucleotide
atcatctcaccttgcctcctgacgacccggtatacctccctgcaggggattaagaggattatcgggattagacggattactaggattaactggattatgcggattagtaggattaggcgcgccatgcttcatcagactct

SEQ ID NO: 9245 - DNA, 140 bp, Artificial Sequence; identical to SEQ ID NO: 9244
  Synthetic polynucleotide

SEQ ID NO: 9246 - DNA, 197 bp, Artificial Sequence
  Synthetic polynucleotide
atcatctcaccttgcctcctgttgaatctgcaccctcacctgcaggagttttggcgccaaaattagaagttttggcgccaaaatttcgagttttggcgccaaaattgacagttttggcgccaaaattctaagttttggcgccaaaattactagttttggcgccaaaatttgcggcgcgccatgcttcatcagactct

SEQ ID NO: 9247 - DNA, 197 bp, Artificial Sequence; identical to SEQ ID NO: 9246
  Synthetic polynucleotide

SEQ ID NO: 9248 - DNA, 197 bp, Artificial Sequence
  Synthetic polynucleotide
atcatctcaccttgcctcctgagcatagcctagttcaacctgcaggacatgtccatggacatgtagaacatgtccatggacatgttcgacatgtccatggacatgtgacacatgtccatggacatgtctaacatgtccatggacatgtactacatgtccatggacatgttgcggcgcgccatgcttcatcagactct

SEQ ID NO: 9249 - DNA, 197 bp, Artificial Sequence; identical to SEQ ID NO: 9248
  Synthetic polynucleotide

SEQ ID NO: 9250 - DNA, 196 bp, Artificial Sequence
  Synthetic polynucleotide
atcatctcaccttgcctcctgctaagaaacgtaaggcgcctgcagggggggggggggtggtttggggtagagggggggggggtggtttggggttcggggggggggggtggtttggggtgacgggggggggggtggtttggggtctagggggggggggtggtttggggtactggcgcgccatgcttcatcagactct

SEQ ID NO: 9251 - DNA, 196 bp, Artificial Sequence; identical to SEQ ID NO: 9250
  Synthetic polynucleotide

SEQ ID NO: 9252 - DNA, 164 bp, Artificial Sequence
  Synthetic polynucleotide
atcatctcaccttgcctcctgagttacggtggcgctaacctgcaggaattttccaagaaattttccatcgaattttccagacaattttccactaaattttccaactaattttccatgcaattttccagtaaattttccaggcgcgccatgcttcatcagactct

SEQ ID NO: 9253 - DNA, 164 bp, Artificial Sequence; identical to SEQ ID NO: 9252
  Synthetic polynucleotide

SEQ ID NO: 9254 - DNA, 156 bp, Artificial Sequence
  Synthetic polynucleotide
atcatctcaccttgcctcctgactcgaggttctgtattcctgcaggtttgacagagatttgacagtcgtttgacaggactttgacagctatttgacagacttttgacagtgctttgacaggtatttgacagggcgcgccatgcttcatcagactct

SEQ ID NO: 9255 - DNA, 156 bp, Artificial Sequence; identical to SEQ ID NO: 9254
  Synthetic polynucleotide

SEQ ID NO: 9256 - DNA, 196 bp, Artificial Sequence
  Synthetic polynucleotide
atcatctcaccttgcctcctggtgacgtacgtagtttgcctgcagggcaaccaaccttgagagcaaccaaccttgtcggcaaccaaccttggacgcaaccaaccttgctagcaaccaaccttgactgcaaccaaccttgtgcgcaaccaaccttggtagcaaccaaccttgggcgcgccatgcttcatcagactct

SEQ ID NO: 9257 - DNA, 196 bp, Artificial Sequence; identical to SEQ ID NO: 9256
  Synthetic polynucleotide

SEQ ID NO: 9258 - DNA, 172 bp, Artificial Sequence
  Synthetic polynucleotide
atcatctcaccttgcctcctgagtgagagctgccgactcctgcaggtttaattaccagatttaattacctcgtttaattaccgactttaattaccctatttaattaccacttttaattacctgctttaattaccgtatttaattaccggcgcgccatgcttcatcagactct

SEQ ID NO: 9259 - DNA, 172 bp, Artificial Sequence; identical to SEQ ID NO: 9258
  Synthetic polynucleotide

SEQ ID NO: 9260 - DNA, 197 bp, Artificial Sequence
  Synthetic polynucleotide
atcatctcaccttgcctcctgtccgtaagaccggtacacctgcaggatttgcataacaaagagaatttgcataacaaagtcgatttgcataacaaaggacatttgcataacaaagctaatttgcataacaaagactatttgcataacaaagtgcatttgcataacaaaggtaggcgcgccatgcttcatcagactct

SEQ ID NO: 9261 - DNA, 197 bp, Artificial Sequence; identical to SEQ ID NO: 9260
  Synthetic polynucleotide

SEQ ID NO: 9262 - DNA, 191 bp, Artificial Sequence
  Synthetic polynucleotide
atcatctcaccttgcctcctggtccaaagtgcaggcagcctgcaggtagagggattaaatttcagatagagggattaaatttctcgtagagggattaaatttcgactagagggattaaatttcctatagagggattaaatttcacttagagggattaaatttctgcggcgcgccatgcttcatcagactct

SEQ ID NO: 9263 - DNA, 191 bp, Artificial Sequence; identical to SEQ ID NO: 9262
  Synthetic polynucleotide

SEQ ID NO: 9264 - DNA, 196 bp, Artificial Sequence
  Synthetic polynucleotide
atcatctcaccttgcctcctggctacccggatcgcaatcctgcaggttggaaatcccctagattggaaatccccttcgttggaaatcccctgacttggaaatcccctctattggaaatcccctactttggaaatccccttgcttggaaatcccctgtattggaaatcccctggcgcgccatgcttcatcagactct

SEQ ID NO: 9265 - DNA, 196 bp, Artificial Sequence; identical to SEQ ID NO: 9264
  Synthetic polynucleotide

SEQ ID NO: 9266 - DNA, 172 bp, Artificial Sequence
  Synthetic polynucleotide
atcatctcaccttgcctcctggccaactgatattactccctgcaggcggtcacgctagacggtcacgcttcgcggtcacgctgaccggtcacgctctacggtcacgctactcggtcacgcttgccggtcacgctgtacggtcacgctggcgcgccatgcttcatcagactct

SEQ ID NO: 9267 - DNA, 172 bp, Artificial Sequence; identical to SEQ ID NO: 9266
  Synthetic polynucleotide

SEQ ID NO: 9268 - DNA, 197 bp, Artificial Sequence
  Synthetic polynucleotide
atcatctcaccttgcctcctgagacaacactattgggtcctgcaggatatctagagcggaacggagaatatctagagcggaacggtcgatatctagagcggaacgggacatatctagagcggaacggctaatatctagagcggaacggactatatctagagcggaacggtgcggcgcgccatgcttcatcagactct

SEQ ID NO: 9269 - DNA, 197 bp, Artificial Sequence; identical to SEQ ID NO: 9268
  Synthetic polynucleotide

SEQ ID NO: 9270 - DNA, 185 bp, Artificial Sequence
  Synthetic polynucleotide
atcatctcaccttgcctcctgacgctgtcatttgctcgcctgcaggattgaacaatggaattagaattgaacaatggaatttcgattgaacaatggaattgacattgaacaatggaattctaattgaacaatggaattactattgaacaatggaatttgcggcgcgccatgcttcatcagactct

SEQ ID NO: 9271 - DNA, 185 bp, Artificial Sequence; identical to SEQ ID NO: 9270
  Synthetic polynucleotide

SEQ ID NO: 9272 - DNA, 183 bp, Artificial Sequence
  Synthetic polynucleotide
atcatctcaccttgcctcctgtgttggagatatgagaacctgcaggaacagatggtcgcccaaccactggaagaaacagatggtcgcccaaccactggatcgaacagatggtcgcccaaccactggagacaacagatggtcgcccaaccactggactaggcgcgccatgcttcatcagactct

SEQ ID NO: 9273 - DNA, 183 bp, Artificial Sequence; identical to SEQ ID NO: 9272
  Synthetic polynucleotide

SEQ ID NO: 9274 - DNA, 164 bp, Artificial Sequence
  Synthetic polynucleotide
atcatctcaccttgcctcctgctggatatcagattagccctgcagggtgactcagagagtgactcagtcggtgactcaggacgtgactcagctagtgactcagactgtgactcagtgcgtgactcaggtagtgactcagggcgcgccatgcttcatcagactct

SEQ ID NO: 9275 - DNA, 164 bp, Artificial Sequence; identical to SEQ ID NO: 9274
  Synthetic polynucleotide

SEQ ID NO: 9276 - DNA, 164 bp, Artificial Sequence
  Synthetic polynucleotide
atcatctcaccttgcctcctggatatcgattggagtcgcctgcaggcgataatgaagacgataatgatcgcgataatgagaccgataatgactacgataatgaactcgataatgatgccgataatgagtacgataatgaggcgcgccatgcttcatcagactct

SEQ ID NO: 9277 - DNA, 164 bp, Artificial Sequence; identical to SEQ ID NO: 9276
  Synthetic polynucleotide

SEQ ID NO: 9278 - DNA, 172 bp, Artificial Sequence
  Synthetic polynucleotide
atcatctcaccttgcctcctgtgcgagaatgtacaatacctgcaggtttaatcccaagatttaatcccatcgtttaatcccagactttaatcccactatttaatcccaacttttaatcccatgctttaatcccagtatttaatcccaggcgcgccatgcttcatcagactct

SEQ ID NO: 9279 - DNA, 172 bp, Artificial Sequence; identical to SEQ ID NO: 9278
  Synthetic polynucleotide

SEQ ID NO: 9280 - DNA, 172 bp, Artificial Sequence
  Synthetic polynucleotide
atcatctcaccttgcctcctgcctagtaaggagcttgccctgcaggcagcaccaggagacagcaccaggtcgcagcaccagggaccagcaccaggctacagcaccaggactcagcaccaggtgccagcaccagggtacagcaccaggggcgcgccatgcttcatcagactct

SEQ ID NO: 9281 - DNA, 172 bp, Artificial Sequence; identical to SEQ ID NO: 9280
  Synthetic polynucleotide

SEQ ID NO: 9282 - DNA, 190 bp, Artificial Sequence
  Synthetic polynucleotide
atcatctcaccttgcctcctggtgttggaggtcgcagtcctgcaggaaaaccaaaaaaatagaaaaaccaaaaaaattcgaaaaccaaaaaaatgacaaaaccaaaaaaatctaaaaaccaaaaaaatactaaaaccaaaaaaattgcaaaaccaaaaaaatgtaggcgcgccatgcttcatcagactct

SEQ ID NO: 9283 - DNA, 190 bp, Artificial Sequence; identical to SEQ ID NO: 9282
  Synthetic polynucleotide

SEQ ID NO: 9284 - DNA, 191 bp, Artificial Sequence
  Synthetic polynucleotide
atcatctcaccttgcctcctgttgtatcaaatcaggcgcctgcaggcaattaaataccgattaagacaattaaataccgattatcgcaattaaataccgattagaccaattaaataccgattactacaattaaataccgattaactcaattaaataccgattatgcggcgcgccatgcttcatcagactct

SEQ ID NO: 9285 - DNA, 191 bp, Artificial Sequence; identical to SEQ ID NO: 9284
  Synthetic polynucleotide

SEQ ID NO: 9286 - DNA, 191 bp, Artificial Sequence
  Synthetic polynucleotide
atcatctcaccttgcctcctgcgcctatgtccacaattcctgcaggcaccgttgattgggtcgagacaccgttgattgggtcgtcgcaccgttgattgggtcggaccaccgttgattgggtcgctacaccgttgattgggtcgactcaccgttgattgggtcgtgcggcgcgccatgcttcatcagactct

SEQ ID NO: 9287 - DNA, 191 bp, Artificial Sequence; identical to SEQ ID NO: 9286
  Synthetic polynucleotide

SEQ ID NO: 9288 - DNA, 190 bp, Artificial Sequence
  Synthetic polynucleotide
atcatctcaccttgcctcctggccgctgttatcccgatcctgcaggggttaatgattaacagaggttaatgattaactcgggttaatgattaacgacggttaatgattaacctaggttaatgattaacactggttaatgattaactgcggttaatgattaacgtaggcgcgccatgcttcatcagactct

SEQ ID NO: 9289 - DNA, 190 bp, Artificial Sequence; identical to SEQ ID NO: 9288
  Synthetic polynucleotide

SEQ ID NO: 9290 - DNA, 191 bp, Artificial Sequence
  Synthetic polynucleotide
atcatctcaccttgcctcctggcgccttgaagcactctcctgcaggatgctaaaaatagattgagaatgctaaaaatagattgtcgatgctaaaaatagattggacatgctaaaaatagattgctaatgctaaaaatagattgactatgctaaaaatagattgtgcggcgcgccatgcttcatcagactct

SEQ ID NO: 9291 - DNA, 191 bp, Artificial Sequence; identical to SEQ ID NO: 9290
  Synthetic polynucleotide

SEQ ID NO: 9292 - DNA, 185 bp, Artificial Sequence
  Synthetic polynucleotide
atcatctcaccttgcctcctgcggacagtcagggttaccctgcaggttaagaacaataatttagattaagaacaataattttcgttaagaacaataatttgacttaagaacaataatttctattaagaacaataatttactttaagaacaataattttgcggcgcgccatgcttcatcagactct

SEQ ID NO: 9293 - DNA, 185 bp, Artificial Sequence; identical to SEQ ID NO: 9292
  Synthetic polynucleotide

SEQ ID NO: 9294 - DNA, 164 bp, Artificial Sequence
  Synthetic polynucleotide
atcatctcaccttgcctcctgcgacctgtaggcagtgtcctgcaggccatatgttagaccatatgtttcgccatatgttgacccatatgttctaccatatgttactccatatgtttgcccatatgttgtaccatatgttggcgcgccatgcttcatcagactct

SEQ ID NO: 9295 - DNA, 164 bp, Artificial Sequence; identical to SEQ ID NO: 9294
  Synthetic polynucleotide

SEQ ID NO: 9296 - DNA, 188 bp, Artificial Sequence
  Synthetic polynucleotide
atcatctcaccttgcctcctgaaggcttctcgaagtttcctgcaggaaaatgaaactgagaaaaatgaaactgtcgaaaatgaaactggacaaaatgaaactgctaaaaatgaaactgactaaaatgaaactgtgcaaaatgaaactggtaaaaatgaaactgggcgcgccatgcttcatcagactct

SEQ ID NO: 9297 - DNA, 188 bp, Artificial Sequence; identical to SEQ ID NO: 9296
  Synthetic polynucleotide

SEQ ID NO: 9298 - DNA, 197 bp, Artificial Sequence
  Synthetic polynucleotide
atcatctcaccttgcctcctgcatgattggacgggatgcctgcaggtgacccggaagtactagatgacccggaagtacttcgtgacccggaagtactgactgacccggaagtactctatgacccggaagtactacttgacccggaagtacttgctgacccggaagtactgtaggcgcgccatgcttcatcagactct

SEQ ID NO: 9299 - DNA, 197 bp, Artificial Sequence; identical to SEQ ID NO: 9298
  Synthetic polynucleotide

SEQ ID NO: 9300 - DNA, 197 bp, Artificial Sequence
  Synthetic polynucleotide
atcatctcaccttgcctcctgctacttacggtaggacacctgcaggtgagtcatatcgagaagatgagtcatatcgagatcgtgagtcatatcgagagactgagtcatatcgagactatgagtcatatcgagaacttgagtcatatcgagatgctgagtcatatcgagagtaggcgcgccatgcttcatcagactct

SEQ ID NO: 9301 - DNA, 197 bp, Artificial Sequence; identical to SEQ ID NO: 9300
  Synthetic polynucleotide

SEQ ID NO: 9302 - DNA, 191 bp, Artificial Sequence
  Synthetic polynucleotide
atcatctcaccttgcctcctgtaacagtatggccgcctcctgcaggtggaatgcgaggaatgtagatggaatgcgaggaatgttcgtggaatgcgaggaatgtgactggaatgcgaggaatgtctatggaatgcgaggaatgtacttggaatgcgaggaatgttgcggcgcgccatgcttcatcagactct

SEQ ID NO: 9303 - DNA, 191 bp, Artificial Sequence; identical to SEQ ID NO: 9302
  Synthetic polynucleotide

SEQ ID NO: 9304 - DNA, 198 bp, Artificial Sequence
  Synthetic polynucleotide
atcatctcaccttgcctcctgaaccttaaggccaggaacctgcaggtgtgacccttagcaaccgattaaagatgtgacccttagcaaccgattaatcgtgtgacccttagcaaccgattaagactgtgacccttagcaaccgattaactatgtgacccttagcaaccgattaaggcgcgccatgcttcatcagactct

SEQ ID NO: 9305 - DNA, 198 bp, Artificial Sequence; identical to SEQ ID NO: 9304
  Synthetic polynucleotide

SEQ ID NO: 9306 - DNA, 196 bp, Artificial Sequence
  Synthetic polynucleotide
atcatctcaccttgcctcctgagaggcgttggcaatgccctgcaggttccccctcacccagattccccctcaccctcgttccccctcacccgacttccccctcacccctattccccctcacccactttccccctcaccctgcttccccctcacccgtattccccctcacccggcgcgccatgcttcatcagactct

SEQ ID NO: 9307 - DNA, 196 bp, Artificial Sequence; identical to SEQ ID NO: 9306
  Synthetic polynucleotide

SEQ ID NO: 9308 - DNA, 156 bp, Artificial Sequence
  Synthetic polynucleotide
atcatctcaccttgcctcctgagtggcataatgagtgtcctgcaggtagttaacagatagttaactcgtagttaacgactagttaacctatagttaacacttagttaactgctagttaacgtatagttaacggcgcgccatgcttcatcagactct

SEQ ID NO: 9309 - DNA, 156 bp, Artificial Sequence; identical to SEQ ID NO: 9308
  Synthetic polynucleotide

SEQ ID NO: 9310 - DNA, 156 bp, Artificial Sequence
  Synthetic polynucleotide
atcatctcaccttgcctcctggtatgaacaacttcgaacctgcaggataacggtagaataacggttcgataacggtgacataacggtctaataacggtactataacggttgcataacggtgtaataacggtggcgcgccatgcttcatcagactct

SEQ ID NO: 9311 - DNA, 156 bp, Artificial Sequence; identical to SEQ ID NO: 9310
  Synthetic polynucleotide

SEQ ID NO: 9312 - DNA, 172 bp, Artificial Sequence
  Synthetic polynucleotide
atcatctcaccttgcctcctgcttcctgcaactgggcacctgcagggatcgatcccagagatcgatccctcggatcgatcccgacgatcgatcccctagatcgatcccactgatcgatccctgcgatcgatcccgtagatcgatcccggcgcgccatgcttcatcagactct

SEQ ID NO: 9313 - DNA, 172 bp, Artificial Sequence; identical to SEQ ID NO: 9312
  Synthetic polynucleotide

SEQ ID NO: 9314 - DNA, 172 bp, Artificial Sequence
  Synthetic polynucleotide
atcatctcaccttgcctcctgtcgtccagcgaagtgtgcctgcagggtcgtaaaatagagtcgtaaaattcggtcgtaaaatgacgtcgtaaaatctagtcgtaaaatactgtcgtaaaattgcgtcgtaaaatgtagtcgtaaaatggcgcgccatgcttcatcagactct

SEQ ID NO: 9315 - DNA, 172 bp, Artificial Sequence; identical to SEQ ID NO: 9314
  Synthetic polynucleotide

SEQ ID NO: 9316 - DNA, 190 bp, Artificial Sequence
  Synthetic polynucleotide
atcatctcaccttgcctcctgatgacgtatgccctggtcctgcaggggggtttccctaccagaggggtttccctacctcgggggtttccctaccgacggggtttccctaccctaggggtttccctaccactggggtttccctacctgcggggtttccctaccgtaggcgcgccatgcttcatcagactct

SEQ ID NO: 9317 - DNA, 190 bp, Artificial Sequence; identical to SEQ ID NO: 9316
  Synthetic polynucleotide

SEQ ID NO: 9318 - DNA, 186 bp, Artificial Sequence
  Synthetic polynucleotide
atcatctcaccttgcctcctgtgagcatctagggtccccctgcaggccccaaaccaccccccccccagaccccaaaccacccccccccctcgccccaaaccaccccccccccgacccccaaaccaccccccccccctaccccaaaccaccccccccccactggcgcgccatgcttcatcagactct

SEQ ID NO: 9319 - DNA, 186 bp, Artificial Sequence; identical to SEQ ID NO: 9318
  Synthetic polynucleotide

SEQ ID NO: 9320 - DNA, 188 bp, Artificial Sequence
  Synthetic polynucleotide
atcatctcaccttgcctcctgacacgaccacaatgtttcctgcaggagtgacgcaattagaagtgacgcaatttcgagtgacgcaattgacagtgacgcaattctaagtgacgcaattactagtgacgcaatttgcagtgacgcaattgtaagtgacgcaattggcgcgccatgcttcatcagactct

SEQ ID NO: 9321 - DNA, 188 bp, Artificial Sequence; identical to SEQ ID NO: 9320
  Synthetic polynucleotide

SEQ ID NO: 9322 - DNA, 197 bp, Artificial Sequence
  Synthetic polynucleotide
atcatctcaccttgcctcctgctgggttccctctaatgcctgcaggcatttcccggaagtgagacatttcccggaagtgtcgcatttcccggaagtggaccatttcccggaagtgctacatttcccggaagtgactcatttcccggaagtgtgccatttcccggaagtggtaggcgcgccatgcttcatcagactct

SEQ ID NO: 9323 - DNA, 197 bp, Artificial Sequence; identical to SEQ ID NO: 9322
  Synthetic polynucleotide

SEQ ID NO: 9324 - DNA, 188 bp, Artificial Sequence
  Synthetic polynucleotide
atcatctcaccttgcctcctgcccaagagacgcttgcacctgcaggtcccttttatctagatcccttttatcttcgtcccttttatctgactcccttttatctctatcccttttatctacttcccttttatcttgctcccttttatctgtatcccttttatctggcgcgccatgcttcatcagactct

SEQ ID NO: 9325 - DNA, 188 bp, Artificial Sequence; identical to SEQ ID NO: 9324
  Synthetic polynucleotide

SEQ ID NO: 9326 - DNA, 172 bp, Artificial Sequence
  Synthetic polynucleotide
atcatctcaccttgcctcctgcattagattatgcctgccctgcaggtagtgtcattagatagtgtcatttcgtagtgtcattgactagtgtcattctatagtgtcattacttagtgtcatttgctagtgtcattgtatagtgtcattggcgcgccatgcttcatcagactct

SEQ ID NO: 9327 - DNA, 172 bp, Artificial Sequence; identical to SEQ ID NO: 9326
  Synthetic polynucleotide

SEQ ID NO: 9328 - DNA, 196 bp, Artificial Sequence
  Synthetic polynucleotide
atcatctcaccttgcctcctggaatgcatttacacatccctgcaggaaattcctgggaaagaaaattcctgggaatcgaaattcctgggaagacaaattcctgggaactaaaattcctgggaaactaaattcctgggaatgcaaattcctgggaagtaaaattcctgggaaggcgcgccatgcttcatcagactct

SEQ ID NO: 9329 - DNA, 196 bp, Artificial Sequence; identical to SEQ ID NO: 9328
  Synthetic polynucleotide

SEQ ID NO: 9330 - DNA, 164 bp, Artificial Sequence
  Synthetic polynucleotide
atcatctcaccttgcctcctgctcacgagtgagtgtaacctgcaggtgtctggccagatgtctggcctcgtgtctggccgactgtctggccctatgtctggccacttgtctggcctgctgtctggccgtatgtctggccggcgcgccatgcttcatcagactct

SEQ ID NO: 9331 - DNA, 164 bp, Artificial Sequence; identical to SEQ ID NO: 9330
  Synthetic polynucleotide

SEQ ID NO: 9332 - DNA, 180 bp, Artificial Sequence
  Synthetic polynucleotide
atcatctcaccttgcctcctggggactatctctatcatcctgcaggaaccggaagtgagaaaccggaagtgtcgaaccggaagtggacaaccggaagtgctaaaccggaagtgactaaccggaagtgtgcaaccggaagtggtaaaccggaagtgggcgcgccatgcttcatcagactct

SEQ ID NO: 9333 - DNA, 180 bp, Artificial Sequence; identical to SEQ ID NO: 9332
  Synthetic polynucleotide

SEQ ID NO: 9334 - DNA, 190 bp, Artificial Sequence
  Synthetic polynucleotide
atcatctcaccttgcctcctgactcagacgtcctcgatcctgcaggaattggcgggaaaaagaaattggcgggaaaatcgaattggcgggaaaagacaattggcgggaaaactaaattggcgggaaaaactaattggcgggaaaatgcaattggcgggaaaagtaggcgcgccatgcttcatcagactct

SEQ ID NO: 9335 - DNA, 190 bp, Artificial Sequence; identical to SEQ ID NO: 9334
  Synthetic polynucleotide

SEQ ID NO: 9336 - DNA, 156 bp, Artificial Sequence
  Synthetic polynucleotide
atcatctcaccttgcctcctgtgtaattgttgcattcgcctgcaggtatcatatagatatcatattcgtatcatatgactatcatatctatatcatatacttatcatattgctatcatatgtatatcatatggcgcgccatgcttcatcagactct

SEQ ID NO: 9337 - DNA, 156 bp, Artificial Sequence; identical to SEQ ID NO: 9336
  Synthetic polynucleotide

SEQ ID NO: 9338 - DNA, 185 bp, Artificial Sequence
  Synthetic polynucleotide
atcatctcaccttgcctcctggcttaagaatgtctcatcctgcaggcccccccccccacttgagacccccccccccacttgtcgcccccccccccacttggaccccccccccccacttgctacccccccccccacttgactcccccccccccacttgtgcggcgcgccatgcttcatcagactct

SEQ ID NO: 9339 - DNA, 185 bp, Artificial Sequence; identical to SEQ ID NO: 9338
  Synthetic polynucleotide

SEQ ID NO: 9340 - DNA, 172 bp, Artificial Sequence
  Synthetic polynucleotide
atcatctcaccttgcctcctgcaatttcaccagcgtagcctgcaggacttccggttagaacttccggtttcgacttccggttgacacttccggttctaacttccggttactacttccggtttgcacttccggttgtaacttccggttggcgcgccatgcttcatcagactct

SEQ ID NO: 9341 - DNA, 172 bp, Artificial Sequence; identical to SEQ ID NO: 9340
  Synthetic polynucleotide

SEQ ID NO: 9342 - DNA, 172 bp, Artificial Sequence
  Synthetic polynucleotide
atcatctcaccttgcctcctgcagttcgtggtattctccctgcagggtaataaaaaagagtaataaaaatcggtaataaaaagacgtaataaaaactagtaataaaaaactgtaataaaaatgcgtaataaaaagtagtaataaaaaggcgcgccatgcttcatcagactct

SEQ ID NO: 9343 - DNA, 172 bp, Artificial Sequence; identical to SEQ ID NO: 9342
  Synthetic polynucleotide

SEQ ID NO: 9344 - DNA, 186 bp, Artificial Sequence
  Synthetic polynucleotide
atcatctcaccttgcctcctgagccctagcgccttacacctgcaggtgacctttgacctagttttgagatgacctttgacctagttttgtcgtgacctttgacctagttttggactgacctttgacctagttttgctatgacctttgacctagttttgactggcgcgccatgcttcatcagactct

SEQ ID NO: 9345 - DNA, 186 bp, Artificial Sequence; identical to SEQ ID NO: 9344
  Synthetic polynucleotide

SEQ ID NO: 9346 - DNA, 186 bp, Artificial Sequence
  Synthetic polynucleotide
atcatctcaccttgcctcctgcctttattccgacccgccctgcaggccccaaaccacccccccccaagaccccaaaccacccccccccatcgccccaaaccacccccccccagacccccaaaccacccccccccactaccccaaaccacccccccccaactggcgcgccatgcttcatcagactct

SEQ ID NO: 9347 - DNA, 186 bp, Artificial Sequence; identical to SEQ ID NO: 9346
  Synthetic polynucleotide

SEQ ID NO: 9348 - DNA, 172 bp, Artificial Sequence
  Synthetic polynucleotide
atcatctcaccttgcctcctggccttaattgcaactcgcctgcagggccgtgatttagagccgtgattttcggccgtgatttgacgccgtgatttctagccgtgatttactgccgtgattttgcgccgtgatttgtagccgtgatttggcgcgccatgcttcatcagactct

SEQ ID NO: 9349 - DNA, 172 bp, Artificial Sequence; identical to SEQ ID NO: 9348
  Synthetic polynucleotide

SEQ ID NO: 9350 - DNA, 172 bp, Artificial Sequence
  Synthetic polynucleotide
atcatctcaccttgcctcctgttccctaatactacctgcctgcagggagccggaagagagagccggaagtcggagccggaaggacgagccggaagctagagccggaagactgagccggaagtgcgagccggaaggtagagccggaagggcgcgccatgcttcatcagactct

SEQ ID NO: 9351 - DNA, 172 bp, Artificial Sequence; identical to SEQ ID NO: 9350
  Synthetic polynucleotide

SEQ ID NO: 9352 - DNA, 197 bp, Artificial Sequence
  Synthetic polynucleotide
atcatctcaccttgcctcctggtatatcggtagaggtgcctgcaggggaaaacgaaactgaagaggaaaacgaaactgatcgggaaaacgaaactgagacggaaaacgaaactgactaggaaaacgaaactgaactggaaaacgaaactgatgcggaaaacgaaactgagtaggcgcgccatgcttcatcagactct

SEQ ID NO: 9353 - DNA, 197 bp, Artificial Sequence; identical to SEQ ID NO: 9352
  Synthetic polynucleotide

SEQ ID NO: 9354 - DNA, 156 bp, Artificial Sequence
  Synthetic polynucleotide
atcatctcaccttgcctcctgaaagatcatgtgcacttcctgcaggtgtggtttagatgtggttttcgtgtggtttgactgtggtttctatgtggtttacttgtggttttgctgtggtttgtatgtggtttggcgcgccatgcttcatcagactct

SEQ ID NO: 9355 - DNA, 156 bp, Artificial Sequence; identical to SEQ ID NO: 9354
  Synthetic polynucleotide

SEQ ID NO: 9356 - DNA, 156 bp, Artificial Sequence
  Synthetic polynucleotide
atcatctcaccttgcctcctgtgcgggcctattaaagtcctgcaggtgcgtgacagatgcgtgactcgtgcgtgacgactgcgtgacctatgcgtgacacttgcgtgactgctgcgtgacgtatgcgtgacggcgcgccatgcttcatcagactct

SEQ ID NO: 9357 - DNA, 156 bp, Artificial Sequence; identical to SEQ ID NO: 9356
  Synthetic polynucleotide

SEQ ID NO: 9358 - DNA, 172 bp, Artificial Sequence
  Synthetic polynucleotide
atcatctcaccttgcctcctgggccatttgactctaaacctgcaggccctgaggcaagaccctgaggcatcgccctgaggcagacccctgaggcactaccctgaggcaactccctgaggcatgcccctgaggcagtaccctgaggcaggcgcgccatgcttcatcagactct

SEQ ID NO: 9359 - DNA, 172 bp, Artificial Sequence; identical to SEQ ID NO: 9358
  Synthetic polynucleotide

SEQ ID NO: 9360 - DNA, 197 bp, Artificial Sequence
  Synthetic polynucleotide
atcatctcaccttgcctcctggaatggcaatagtatctcctgcaggggtcacgcttggctgagaggtcacgcttggctgtcgggtcacgcttggctggacggtcacgcttggctgctaggtcacgcttggctgactggtcacgcttggctgtgcggtcacgcttggctggtaggcgcgccatgcttcatcagactct

SEQ ID NO: 9361 - DNA, 197 bp, Artificial Sequence; identical to SEQ ID NO: 9360
  Synthetic polynucleotide

SEQ ID NO: 9362 - DNA, 188 bp, Artificial Sequence
  Synthetic polynucleotide
atcatctcaccttgcctcctgagaagatatagacacggcctgcaggggctatttttaaagaggctatttttaatcgggctatttttaagacggctatttttaactaggctatttttaaactggctatttttaatgcggctatttttaagtaggctatttttaaggcgcgccatgcttcatcagactct

SEQ ID NO: 9363 - DNA, 188 bp, Artificial Sequence; identical to SEQ ID NO: 9362
  Synthetic polynucleotide

SEQ ID NO: 9364 - DNA, 185 bp, Artificial Sequence
  Synthetic polynucleotide
atcatctcaccttgcctcctgcgtagccttggattctacctgcaggcgcggtcacgtgacccagacgcggtcacgtgaccctcgcgcggtcacgtgacccgaccgcggtcacgtgacccctacgcggtcacgtgacccactcgcggtcacgtgaccctgcggcgcgccatgcttcatcagactct

SEQ ID NO: 9365 - DNA, 185 bp, Artificial Sequence; identical to SEQ ID NO: 9364
  Synthetic polynucleotide

SEQ ID NO: 9366 - DNA, 190 bp, Artificial Sequence
  Synthetic polynucleotide
atcatctcaccttgcctcctgaagtagcatgaggagatcctgcaggcccgcccccgccccagacccgcccccgcccctcgcccgcccccgccccgaccccgcccccgccccctacccgcccccgccccactcccgcccccgcccctgccccgcccccgccccgtaggcgcgccatgcttcatcagactct

SEQ ID NO: 9367 - DNA, 190 bp, Artificial Sequence; identical to SEQ ID NO: 9366
  Synthetic polynucleotide

SEQ ID NO: 9368 - DNA, 164 bp, Artificial Sequence
  Synthetic polynucleotide
atcatctcaccttgcctcctgcacccaactagtatttacctgcagggcacgtgcaagagcacgtgcatcggcacgtgcagacgcacgtgcactagcacgtgcaactgcacgtgcatgcgcacgtgcagtagcacgtgcaggcgcgccatgcttcatcagactct

SEQ ID NO: 9369 - DNA, 164 bp, Artificial Sequence; identical to SEQ ID NO: 9368
  Synthetic polynucleotide

SEQ ID NO: 9370 - DNA, 180 bp, Artificial Sequence
  Synthetic polynucleotide
atcatctcaccttgcctcctgcgagagtcttgtgtgcacctgcaggaagtaaacaaaagaaagtaaacaaatcgaagtaaacaaagacaagtaaacaaactaaagtaaacaaaactaagtaaacaaatgcaagtaaacaaagtaaagtaaacaaaggcgcgccatgcttcatcagactct

SEQ ID NO: 9371 - DNA, 180 bp, Artificial Sequence; identical to SEQ ID NO: 9370
  Synthetic polynucleotide

SEQ ID NO: 9372 - DNA, 180 bp, Artificial Sequence
  Synthetic polynucleotide
atcatctcaccttgcctcctggagagctctgaaacgtacctgcaggctcaccccaccagactcaccccacctcgctcaccccaccgacctcaccccaccctactcaccccaccactctcaccccacctgcctcaccccaccgtactcaccccaccggcgcgccatgcttcatcagactct

SEQ ID NO: 9373 - DNA, 180 bp, Artificial Sequence; identical to SEQ ID NO: 9372
  Synthetic polynucleotide

SEQ ID NO: 9374 - DNA, 190 bp, Artificial Sequence
  Synthetic polynucleotide
atcatctcaccttgcctcctgcccattcgtaagagtaacctgcaggctaatttgcatattagactaatttgcatatttcgctaatttgcatattgacctaatttgcatattctactaatttgcatattactctaatttgcatatttgcctaatttgcatattgtaggcgcgccatgcttcatcagactct

SEQ ID NO: 9375 - DNA, 190 bp, Artificial Sequence; identical to SEQ ID NO: 9374
  Synthetic polynucleotide

SEQ ID NO: 9376 - DNA, 140 bp, Artificial Sequence
  Synthetic polynucleotide
atcatctcaccttgcctcctgggattgaggctatactgcctgcaggaattagagaaattagtcgaattaggacaattagctaaattagactaattagtgcaattaggtaaattagggcgcgccatgcttcatcagactct

SEQ ID NO: 9377 - DNA, 140 bp, Artificial Sequence; identical to SEQ ID NO: 9376
  Synthetic polynucleotide

SEQ ID NO: 9378 - DNA, 191 bp, Artificial Sequence
  Synthetic polynucleotide
atcatctcaccttgcctcctgccaatgcaatctgagtacctgcaggtaaatgtaaacaaaggtagataaatgtaaacaaaggttcgtaaatgtaaacaaaggtgactaaatgtaaacaaaggtctataaatgtaaacaaaggtacttaaatgtaaacaaaggttgcggcgcgccatgcttcatcagactct

SEQ ID NO: 9379 - DNA, 191 bp, Artificial Sequence; identical to SEQ ID NO: 9378
  Synthetic polynucleotide

SEQ ID NO: 9380 - DNA, 185 bp, Artificial Sequence
  Synthetic polynucleotide
atcatctcaccttgcctcctgactagacagacagaccccctgcaggaaattttacgagctttagaaaattttacgagcttttcgaaattttacgagctttgacaaattttacgagctttctaaaattttacgagctttactaaattttacgagcttttgcggcgcgccatgcttcatcagactct

SEQ ID NO: 9381 - DNA, 185 bp, Artificial Sequence; identical to SEQ ID NO: 9380
  Synthetic polynucleotide

SEQ ID NO: 9382 - DNA, 140 bp, Artificial Sequence
  Synthetic polynucleotide
atcatctcaccttgcctcctggtggtactaatcttgtacctgcaggaattaaagaaattaatcgaattaagacaattaactaaattaaactaattaatgcaattaagtaaattaaggcgcgccatgcttcatcagactct

SEQ ID NO: 9383 - DNA, 140 bp, Artificial Sequence; identical to SEQ ID NO: 9382
  Synthetic polynucleotide

SEQ ID NO: 9384 - DNA, 196 bp, Artificial Sequence
  Synthetic polynucleotide
atcatctcaccttgcctcctgtattggccaagtacattcctgcagggaaccaggaagtgagagaaccaggaagtgtcggaaccaggaagtggacgaaccaggaagtgctagaaccaggaagtgactgaaccaggaagtgtgcgaaccaggaagtggtagaaccaggaagtgggcgcgccatgcttcatcagactct

SEQ ID NO: 9385 - DNA, 196 bp, Artificial Sequence; identical to SEQ ID NO: 9384
  Synthetic polynucleotide

SEQ ID NO: 9386 - DNA, 188 bp, Artificial Sequence
  Synthetic polynucleotide
atcatctcaccttgcctcctgagaacggtccattggatcctgcaggaatccccaccccagaaatccccacccctcgaatccccaccccgacaatccccaccccctaaatccccaccccactaatccccacccctgcaatccccaccccgtaaatccccaccccggcgcgccatgcttcatcagactct

SEQ ID NO: 9387 - DNA, 188 bp, Artificial Sequence; identical to SEQ ID NO: 9386
  Synthetic polynucleotide

SEQ ID NO: 9388 - DNA, 156 bp, Artificial Sequence
  Synthetic polynucleotide
atcatctcaccttgcctcctggcggcattgttaccgtccctgcaggaaaacaatagaaaaacaattcgaaaacaatgacaaaacaatctaaaaacaatactaaaacaattgcaaaacaatgtaaaaacaatggcgcgccatgcttcatcagactct

SEQ ID NO: 9389 - DNA, 156 bp, Artificial Sequence; identical to SEQ ID NO: 9388
  Synthetic polynucleotide

SEQ ID NO: 9390 - DNA, 172 bp, Artificial Sequence
  Synthetic polynucleotide
atcatctcaccttgcctcctgaggatattatggtcagccctgcaggacttccggtcagaacttccggtctcgacttccggtcgacacttccggtcctaacttccggtcactacttccggtctgcacttccggtcgtaacttccggtcggcgcgccatgcttcatcagactct

SEQ ID NO: 9391 - DNA, 172 bp, Artificial Sequence; identical to SEQ ID NO: 9390
  Synthetic polynucleotide

SEQ ID NO: 9392 - DNA, 172 bp, Artificial Sequence
  Synthetic polynucleotide
atcatctcaccttgcctcctgtgggctataatacgcatcctgcaggagacatgcctagaagacatgccttcgagacatgcctgacagacatgcctctaagacatgcctactagacatgccttgcagacatgcctgtaagacatgcctggcgcgccatgcttcatcagactct

SEQ ID NO: 9393 - DNA, 172 bp, Artificial Sequence; identical to SEQ ID NO: 9392
  Synthetic polynucleotide

SEQ ID NO: 9394 - DNA, 140 bp, Artificial Sequence
  Synthetic polynucleotide
atcatctcaccttgcctcctgctgttacactaggacctcctgcaggaattatagaaattattcgaattatgacaattatctaaattatactaattattgcaattatgtaaattatggcgcgccatgcttcatcagactct

SEQ ID NO: 9395 - DNA, 140 bp, Artificial Sequence; identical to SEQ ID NO: 9394
  Synthetic polynucleotide

SEQ ID NO: 9396 - DNA, 188 bp, Artificial Sequence
  Synthetic polynucleotide
atcatctcaccttgcctcctgcgcggtcgtagttcctacctgcaggaatccccacccgagaaatccccacccgtcgaatccccacccggacaatccccacccgctaaatccccacccgactaatccccacccgtgcaatccccacccggtaaatccccacccgggcgcgccatgcttcatcagactct

SEQ ID NO: 9397 - DNA, 188 bp, Artificial Sequence; identical to SEQ ID NO: 9396
  Synthetic polynucleotide

SEQ ID NO: 9398 - DNA, 172 bp, Artificial Sequence
  Synthetic polynucleotide
atcatctcaccttgcctcctgtttcatctctacgaactcctgcaggaccatatggcagaaccatatggctcgaccatatggcgacaccatatggcctaaccatatggcactaccatatggctgcaccatatggcgtaaccatatggcggcgcgccatgcttcatcagactct

SEQ ID NO: 9399 - DNA, 172 bp, Artificial Sequence; identical to SEQ ID NO: 9398
  Synthetic polynucleotide

SEQ ID NO: 9400 - DNA, 200 bp, Artificial Sequence
  Synthetic polynucleotide
atcatctcaccttgcctcctgagcacatactgtggtaacctgcaggtcgggtcattggggtcaggagatcgggtcattggggtcaggtcgtcgggtcattggggtcagggactcgggtcattggggtcaggctatcgggtcattggggtcaggacttcgggtcattggggtcaggggcgcgccatgcttcatcagactct

SEQ ID NO: 9401 - DNA, 200 bp, Artificial Sequence; identical to SEQ ID NO: 9400
  Synthetic polynucleotide

SEQ ID NO: 9402 - DNA, 164 bp, Artificial Sequence
  Synthetic polynucleotide
atcatctcaccttgcctcctgctgtgcacaatccgtggcctgcaggacacgtcacagaacacgtcactcgacacgtcacgacacacgtcacctaacacgtcacactacacgtcactgcacacgtcacgtaacacgtcacggcgcgccatgcttcatcagactct

SEQ ID NO: 9403 - DNA, 164 bp, Artificial Sequence; identical to SEQ ID NO: 9402
  Synthetic polynucleotide

SEQ ID NO: 9404 - DNA, 196 bp, Artificial Sequence
  Synthetic polynucleotide
atcatctcaccttgcctcctgagagttatatagcccatcctgcaggagtcatactgaaaagaagtcatactgaaatcgagtcatactgaaagacagtcatactgaaactaagtcatactgaaaactagtcatactgaaatgcagtcatactgaaagtaagtcatactgaaaggcgcgccatgcttcatcagactct

SEQ ID NO: 9405 - DNA, 196 bp, Artificial Sequence; identical to SEQ ID NO: 9404
  Synthetic polynucleotide

SEQ ID NO: 9406 - DNA, 172 bp, Artificial Sequence
  Synthetic polynucleotide
atcatctcaccttgcctcctgatgaacacccgtcaaaccctgcagggtattgttaaagagtattgttaatcggtattgttaagacgtattgttaactagtattgttaaactgtattgttaatgcgtattgttaagtagtattgttaaggcgcgccatgcttcatcagactct

SEQ ID NO: 9407 - DNA, 172 bp, Artificial Sequence; identical to SEQ ID NO: 9406
  Synthetic polynucleotide

SEQ ID NO: 9408 - DNA, 164 bp, Artificial Sequence
  Synthetic polynucleotide
atcatctcaccttgcctcctggggaatttgcctgctgccctgcaggtaggatagaagataggatagatcgtaggatagagactaggatagactataggatagaacttaggatagatgctaggatagagtataggatagaggcgcgccatgcttcatcagactct

SEQ ID NO: 9409 - DNA, 164 bp, Artificial Sequence; identical to SEQ ID NO: 9408
  Synthetic polynucleotide

SEQ ID NO: 9410 - DNA, 180 bp, Artificial Sequence
  Synthetic polynucleotide
atcatctcaccttgcctcctggggaggagactggagaacctgcaggcttgcgtgagaagacttgcgtgagatcgcttgcgtgagagaccttgcgtgagactacttgcgtgagaactcttgcgtgagatgccttgcgtgagagtacttgcgtgagaggcgcgccatgcttcatcagactct

SEQ ID NO: 9411 - DNA, 180 bp, Artificial Sequence; identical to SEQ ID NO: 9410
  Synthetic polynucleotide

SEQ ID NO: 9412 - DNA, 197 bp, Artificial Sequence
  Synthetic polynucleotide
atcatctcaccttgcctcctgagttcggtgctagtgaacctgcaggggggagggcgcgcggagaggggagggcgcgcggtcgggggagggcgcgcgggacggggagggcgcgcggctaggggagggcgcgcggactggggagggcgcgcggtgcggggagggcgcgcgggtaggcgcgccatgcttcatcagactct

SEQ ID NO: 9413 - DNA, 197 bp, Artificial Sequence; identical to SEQ ID NO: 9412
  Synthetic polynucleotide

SEQ ID NO: 9414 - DNA, 172 bp, Artificial Sequence
  Synthetic polynucleotide
atcatctcaccttgcctcctgcatgatatcgaccctctcctgcaggaccatatggtagaaccatatggttcgaccatatggtgacaccatatggtctaaccatatggtactaccatatggttgcaccatatggtgtaaccatatggtggcgcgccatgcttcatcagactct

SEQ ID NO: 9415 - DNA, 172 bp, Artificial Sequence; identical to SEQ ID NO: 9414
  Synthetic polynucleotide

SEQ ID NO: 9416 - DNA, 156 bp, Artificial Sequence
  Synthetic polynucleotide
atcatctcaccttgcctcctgcgagggaacgatctaagcctgcagggtgaatgaagagtgaatgatcggtgaatgagacgtgaatgactagtgaatgaactgtgaatgatgcgtgaatgagtagtgaatgaggcgcgccatgcttcatcagactct

SEQ ID NO: 9417 - DNA, 156 bp, Artificial Sequence; identical to SEQ ID NO: 9416
  Synthetic polynucleotide

SEQ ID NO: 9418 - DNA, 190 bp, Artificial Sequence
  Synthetic polynucleotide
atcatctcaccttgcctcctgtctaatgtagcggttgccctgcagggaccccccgctgtgagagaccccccgctgtgtcggaccccccgctgtggacgaccccccgctgtgctagaccccccgctgtgactgaccccccgctgtgtgcgaccccccgctgtggtaggcgcgccatgcttcatcagactct

SEQ ID NO: 9419 - DNA, 190 bp, Artificial Sequence; identical to SEQ ID NO: 9418
  Synthetic polynucleotide

SEQ ID NO: 9420 - DNA, 180 bp, Artificial Sequence
  Synthetic polynucleotide
atcatctcaccttgcctcctgcaataacagttgggcctcctgcaggagtacatgtttagaagtacatgttttcgagtacatgtttgacagtacatgtttctaagtacatgtttactagtacatgttttgcagtacatgtttgtaagtacatgtttggcgcgccatgcttcatcagactct

SEQ ID NO: 9421 - DNA, 180 bp, Artificial Sequence; identical to SEQ ID NO: 9420
  Synthetic polynucleotide

SEQ ID NO: 9422 - DNA, 185 bp, Artificial Sequence
  Synthetic polynucleotide
atcatctcaccttgcctcctgtgactttgtctgagggtcctgcagggtattgacaggtctttagagtattgacaggtcttttcggtattgacaggtctttgacgtattgacaggtctttctagtattgacaggtctttactgtattgacaggtcttttgcggcgcgccatgcttcatcagactct

SEQ ID NO: 9423 - DNA, 185 bp, Artificial Sequence; identical to SEQ ID NO: 9422
  Synthetic polynucleotide

SEQ ID NO: 9424 - DNA, 185 bp, Artificial Sequence
  Synthetic polynucleotide
atcatctcaccttgcctcctgccttgcagctacttggccctgcaggacgtacttcctgttttagaacgtacttcctgtttttcgacgtacttcctgttttgacacgtacttcctgttttctaacgtacttcctgttttactacgtacttcctgtttttgcggcgcgccatgcttcatcagactct

SEQ ID NO: 9425 - DNA, 185 bp, Artificial Sequence; identical to SEQ ID NO: 9424
  Synthetic polynucleotide

SEQ ID NO: 9426 - DNA, 164 bp, Artificial Sequence
  Synthetic polynucleotide
atcatctcaccttgcctcctgctcgcgaagatcttcttcctgcagggcctgaggcagagcctgaggctcggcctgaggcgacgcctgaggcctagcctgaggcactgcctgaggctgcgcctgaggcgtagcctgaggcggcgcgccatgcttcatcagactct

SEQ ID NO: 9427 - DNA, 164 bp, Artificial Sequence; identical to SEQ ID NO: 9426
  Synthetic polynucleotide

SEQ ID NO: 9428 - DNA, 156 bp, Artificial Sequence
  Synthetic polynucleotide
atcatctcaccttgcctcctgtgtacgaaaggtacacacctgcagggacgctgtagagacgctgttcggacgctgtgacgacgctgtctagacgctgtactgacgctgttgcgacgctgtgtagacgctgtggcgcgccatgcttcatcagactct

SEQ ID NO: 9429 - DNA, 156 bp, Artificial Sequence; identical to SEQ ID NO: 9428
  Synthetic polynucleotide

SEQ ID NO: 9430 - DNA, 190 bp, Artificial Sequence
  Synthetic polynucleotide
atcatctcaccttgcctcctggaccatcacagatgcggcctgcaggcaggatgagtcaccagacaggatgagtcacctcgcaggatgagtcaccgaccaggatgagtcaccctacaggatgagtcaccactcaggatgagtcacctgccaggatgagtcaccgtaggcgcgccatgcttcatcagactct

SEQ ID NO: 9431 - DNA, 190 bp, Artificial Sequence; identical to SEQ ID NO: 9430
  Synthetic polynucleotide

SEQ ID NO: 9432 - DNA, 188 bp, Artificial Sequence
  Synthetic polynucleotide
atcatctcaccttgcctcctggatcatggtacttacaacctgcaggcattacgtaacaagacattacgtaacatcgcattacgtaacagaccattacgtaacactacattacgtaacaactcattacgtaacatgccattacgtaacagtacattacgtaacaggcgcgccatgcttcatcagactct

SEQ ID NO: 9433 - DNA, 188 bp, Artificial Sequence; identical to SEQ ID NO: 9432
  Synthetic polynucleotide

SEQ ID NO: 9434 - DNA, 188 bp, Artificial Sequence
  Synthetic polynucleotide
atcatctcaccttgcctcctgatcgatcagagatctggcctgcaggcattacgtaaccagacattacgtaacctcgcattacgtaaccgaccattacgtaaccctacattacgtaaccactcattacgtaacctgccattacgtaaccgtacattacgtaaccggcgcgccatgcttcatcagactct

SEQ ID NO: 9435 - DNA, 188 bp, Artificial Sequence; identical to SEQ ID NO: 9434
  Synthetic polynucleotide

SEQ ID NO: 9436 - DNA, 164 bp, Artificial Sequence
  Synthetic polynucleotide
atcatctcaccttgcctcctgtagcctcaattggcacacctgcagggcacgtgacagagcacgtgactcggcacgtgacgacgcacgtgacctagcacgtgacactgcacgtgactgcgcacgtgacgtagcacgtgacggcgcgccatgcttcatcagactct

SEQ ID NO: 9437 - DNA, 164 bp, Artificial Sequence; identical to SEQ ID NO: 9436
  Synthetic polynucleotide

SEQ ID NO: 9438 - DNA, 172 bp, Artificial Sequence
  Synthetic polynucleotide
atcatctcaccttgcctcctgtactagcattatcagcgcctgcagggccaattaagagagccaattaagtcggccaattaaggacgccaattaagctagccaattaagactgccaattaagtgcgccaattaaggtagccaattaagggcgcgccatgcttcatcagactct

SEQ ID NO: 9439 - DNA, 172 bp, Artificial Sequence; identical to SEQ ID NO: 9438
  Synthetic polynucleotide

SEQ ID NO: 9440 - DNA, 197 bp, Artificial Sequence
  Synthetic polynucleotide
atcatctcaccttgcctcctgtataagggcttcttggtcctgcagggccccctggtggccaagagccccctggtggccatcggccccctggtggccagacgccccctggtggccactagccccctggtggccaactgccccctggtggccatgcgccccctggtggccagtaggcgcgccatgcttcatcagactct

SEQ ID NO: 9441 - DNA, 197 bp, Artificial Sequence; identical to SEQ ID NO: 9440
  Synthetic polynucleotide

SEQ ID NO: 9442 - DNA, 172 bp, Artificial Sequence
  Synthetic polynucleotide
atcatctcaccttgcctcctgagaggtttccaggttatcctgcaggtgcgcatgcgagatgcgcatgcgtcgtgcgcatgcggactgcgcatgcgctatgcgcatgcgacttgcgcatgcgtgctgcgcatgcggtatgcgcatgcgggcgcgccatgcttcatcagactct

SEQ ID NO: 9443 - DNA, 172 bp, Artificial Sequence; identical to SEQ ID NO: 9442
  Synthetic polynucleotide

SEQ ID NO: 9444 - DNA, 190 bp, Artificial Sequence
  Synthetic polynucleotide
atcatctcaccttgcctcctgggactactgagatgctacctgcaggaggaagattaccgcagaaggaagattaccgctcgaggaagattaccgcgacaggaagattaccgcctaaggaagattaccgcactaggaagattaccgctgcaggaagattaccgcgtaggcgcgccatgcttcatcagactct

SEQ ID NO: 9445 - DNA, 190 bp, Artificial Sequence; identical to SEQ ID NO: 9444
  Synthetic polynucleotide

SEQ ID NO: 9446 - DNA, 197 bp, Artificial Sequence
  Synthetic polynucleotide
atcatctcaccttgcctcctgctctacaatctcaggaacctgcaggcatttcctgagaaatagacatttcctgagaaattcgcatttcctgagaaatgaccatttcctgagaaatctacatttcctgagaaatactcatttcctgagaaattgccatttcctgagaaatgtaggcgcgccatgcttcatcagactct

SEQ ID NO: 9447 - DNA, 197 bp, Artificial Sequence; identical to SEQ ID NO: 9446
  Synthetic polynucleotide

SEQ ID NO: 9448 - DNA, 140 bp, Artificial Sequence
  Synthetic polynucleotide
atcatctcaccttgcctcctgtacagatactaccagatcctgcaggtgtcaaagatgtcaatcgtgtcaagactgtcaactatgtcaaacttgtcaatgctgtcaagtatgtcaaggcgcgccatgcttcatcagactct

SEQ ID NO: 9449 - DNA, 140 bp, Artificial Sequence; identical to SEQ ID NO: 9448
  Synthetic polynucleotide

SEQ ID NO: 9450 - DNA, 164 bp, Artificial Sequence
  Synthetic polynucleotide
atcatctcaccttgcctcctgtagcactgacgtacccgcctgcagggtggtgtctagagtggtgtcttcggtggtgtctgacgtggtgtctctagtggtgtctactgtggtgtcttgcgtggtgtctgtagtggtgtctggcgcgccatgcttcatcagactct

SEQ ID NO: 9451 - DNA, 164 bp, Artificial Sequence; identical to SEQ ID NO: 9450
  Synthetic polynucleotide

SEQ ID NO: 9452 - DNA, 156 bp, Artificial Sequence
  Synthetic polynucleotide
atcatctcaccttgcctcctgttgtgaaggattgtttccctgcagggtaccctaagagtaccctatcggtaccctagacgtaccctactagtaccctaactgtaccctatgcgtaccctagtagtaccctaggcgcgccatgcttcatcagactct

SEQ ID NO: 9453 - DNA, 156 bp, Artificial Sequence; identical to SEQ ID NO: 9452
  Synthetic polynucleotide

SEQ ID NO: 9454 - DNA, 180 bp, Artificial Sequence
  Synthetic polynucleotide
atcatctcaccttgcctcctgaagcgggattataaccgcctgcaggtgcctgaggctagatgcctgaggcttcgtgcctgaggctgactgcctgaggctctatgcctgaggctacttgcctgaggcttgctgcctgaggctgtatgcctgaggctggcgcgccatgcttcatcagactct

SEQ ID NO: 9455 - DNA, 180 bp, Artificial Sequence; identical to SEQ ID NO: 9454
  Synthetic polynucleotide

SEQ ID NO: 9456 - DNA, 172 bp, Artificial Sequence
  Synthetic polynucleotide
atcatctcaccttgcctcctgtttacaagaaaccgatgcctgcaggttgatacattagattgatacatttcgttgatacattgacttgatacattctattgatacattactttgatacatttgcttgatacattgtattgatacattggcgcgccatgcttcatcagactct

SEQ ID NO: 9457 - DNA, 172 bp, Artificial Sequence; identical to SEQ ID NO: 9456
  Synthetic polynucleotide

SEQ ID NO: 9458 - DNA, 180 bp, Artificial Sequence
  Synthetic polynucleotide
atcatctcaccttgcctcctgcacatcatctgggtaagcctgcaggggacatgtctcagaggacatgtctctcgggacatgtctcgacggacatgtctcctaggacatgtctcactggacatgtctctgcggacatgtctcgtaggacatgtctcggcgcgccatgcttcatcagactct

SEQ ID NO: 9459 - DNA, 180 bp, Artificial Sequence; identical to SEQ ID NO: 9458
  Synthetic polynucleotide

SEQ ID NO: 9460 - DNA, 172 bp, Artificial Sequence
  Synthetic polynucleotide
atcatctcaccttgcctcctgccgactgcacacctatgcctgcagggcggcggaggagagcggcggaggtcggcggcggagggacgcggcggaggctagcggcggaggactgcggcggaggtgcgcggcggagggtagcggcggaggggcgcgccatgcttcatcagactct

SEQ ID NO: 9461 - DNA, 172 bp, Artificial Sequence; identical to SEQ ID NO: 9460
  Synthetic polynucleotide

SEQ ID NO: 9462 - DNA, 164 bp, Artificial Sequence
  Synthetic polynucleotide
atcatctcaccttgcctcctgtccatggacccggtattcctgcaggagtaaacaaagaagtaaacaatcgagtaaacaagacagtaaacaactaagtaaacaaactagtaaacaatgcagtaaacaagtaagtaaacaaggcgcgccatgcttcatcagactct

SEQ ID NO: 9463 - DNA, 164 bp, Artificial Sequence; identical to SEQ ID NO: 9462
  Synthetic polynucleotide

SEQ ID NO: 9464 - DNA, 172 bp, Artificial Sequence
  Synthetic polynucleotide
atcatctcaccttgcctcctgagcacattggactcagccctgcagggtgtctggccagagtgtctggcctcggtgtctggccgacgtgtctggccctagtgtctggccactgtgtctggcctgcgtgtctggccgtagtgtctggccggcgcgccatgcttcatcagactct

SEQ ID NO: 9465 - DNA, 172 bp, Artificial Sequence; identical to SEQ ID NO: 9464
  Synthetic polynucleotide

SEQ ID NO: 9466 - DNA, 148 bp, Artificial Sequence
  Synthetic polynucleotide
atcatctcaccttgcctcctggccatactagataatgacctgcagggtataaaagagtataaatcggtataaagacgtataaactagtataaaactgtataaatgcgtataaagtagtataaaggcgcgccatgcttcatcagactct

SEQ ID NO: 9467 - DNA, 148 bp, Artificial Sequence; identical to SEQ ID NO: 9466
  Synthetic polynucleotide

SEQ ID NO: 9468 - DNA, 197 bp, Artificial Sequence
  Synthetic polynucleotide
atcatctcaccttgcctcctgtccgggataccttggaccctgcagggccccctggtggccgagagccccctggtggccgtcggccccctggtggccggacgccccctggtggccgctagccccctggtggccgactgccccctggtggccgtgcgccccctggtggccggtaggcgcgccatgcttcatcagactct

SEQ ID NO: 9469 - DNA, 197 bp, Artificial Sequence; identical to SEQ ID NO: 9468
  Synthetic polynucleotide

SEQ ID NO: 9470 - DNA, 185 bp, Artificial Sequence
  Synthetic polynucleotide
atcatctcaccttgcctcctgactcattcccagtgtgccctgcaggaaaaagtaaacaaaccagaaaaaagtaaacaaacctcgaaaaagtaaacaaaccgacaaaaagtaaacaaaccctaaaaaagtaaacaaaccactaaaaagtaaacaaacctgcggcgcgccatgcttcatcagactct

SEQ ID NO: 9471 - DNA, 185 bp, Artificial Sequence; identical to SEQ ID NO: 9470
  Synthetic polynucleotide

SEQ ID NO: 9472 - DNA, 180 bp, Artificial Sequence
  Synthetic polynucleotide
atcatctcaccttgcctcctgtaattgcttgtcgtgctcctgcaggcacttccgggtagacacttccgggttcgcacttccgggtgaccacttccgggtctacacttccgggtactcacttccgggttgccacttccgggtgtacacttccgggtggcgcgccatgcttcatcagactct

SEQ ID NO: 9473 - DNA, 180 bp, Artificial Sequence; identical to SEQ ID NO: 9472
  Synthetic polynucleotide

SEQ ID NO: 9474 - DNA, 191 bp, Artificial Sequence
  Synthetic polynucleotide
atcatctcaccttgcctcctgatgcgccataattctaacctgcaggccaccagggggcgccggagaccaccagggggcgccggtcgccaccagggggcgccgggacccaccagggggcgccggctaccaccagggggcgccggactccaccagggggcgccggtgcggcgcgccatgcttcatcagactct

SEQ ID NO: 9475 - DNA, 191 bp, Artificial Sequence; identical to SEQ ID NO: 9474
  Synthetic polynucleotide

SEQ ID NO: 9476 - DNA, 197 bp, Artificial Sequence
  Synthetic polynucleotide
atcatctcaccttgcctcctgcaccgacccagtacgaacctgcaggcccgcatacaacgaaagacccgcatacaacgaatcgcccgcatacaacgaagaccccgcatacaacgaactacccgcatacaacgaaactcccgcatacaacgaatgccccgcatacaacgaagtaggcgcgccatgcttcatcagactct

SEQ ID NO: 9477 - DNA, 197 bp, Artificial Sequence; identical to SEQ ID NO: 9476
  Synthetic polynucleotide

SEQ ID NO: 9478 - DNA, 191 bp, Artificial Sequence
  Synthetic polynucleotide
atcatctcaccttgcctcctgagaccctcggattcgtacctgcaggtcccaaagtagctgggaagatcccaaagtagctgggatcgtcccaaagtagctgggagactcccaaagtagctgggactatcccaaagtagctgggaacttcccaaagtagctgggatgcggcgcgccatgcttcatcagactct

SEQ ID NO: 9479 - DNA, 191 bp, Artificial Sequence; identical to SEQ ID NO: 9478
  Synthetic polynucleotide

SEQ ID NO: 9480 - DNA, 164 bp, Artificial Sequence
  Synthetic polynucleotide
atcatctcaccttgcctcctgtaaagtcagtgagtgaccctgcagggtgcgcgcgagagtgcgcgcgtcggtgcgcgcggacgtgcgcgcgctagtgcgcgcgactgtgcgcgcgtgcgtgcgcgcggtagtgcgcgcgggcgcgccatgcttcatcagactct

SEQ ID NO: 9481 - DNA, 164 bp, Artificial Sequence; identical to SEQ ID NO: 9480
  Synthetic polynucleotide

SEQ ID NO: 9482 - DNA, 197 bp, Artificial Sequence
  Synthetic polynucleotide
atcatctcaccttgcctcctgtgtgtgctgtacaggagcctgcaggttccaatttcccgccagattccaatttcccgcctcgttccaatttcccgccgacttccaatttcccgccctattccaatttcccgccactttccaatttcccgcctgcttccaatttcccgccgtaggcgcgccatgcttcatcagactct

SEQ ID NO: 9483 - DNA, 197 bp, Artificial Sequence; identical to SEQ ID NO: 9482
  Synthetic polynucleotide

SEQ ID NO: 9484 - DNA, 190 bp, Artificial Sequence
  Synthetic polynucleotide
atcatctcaccttgcctcctgtgtatagaggttgtagacctgcaggacaacagctgttgcagaacaacagctgttgctcgacaacagctgttgcgacacaacagctgttgcctaacaacagctgttgcactacaacagctgttgctgcacaacagctgttgcgtaggcgcgccatgcttcatcagactct

SEQ ID NO: 9485 - DNA, 190 bp, Artificial Sequence; identical to SEQ ID NO: 9484
  Synthetic polynucleotide

SEQ ID NO: 9486 - DNA, 164 bp, Artificial Sequence
  Synthetic polynucleotide
atcatctcaccttgcctcctgaggtcagactagaggcccctgcaggattacatgaagaattacatgatcgattacatgagacattacatgactaattacatgaactattacatgatgcattacatgagtaattacatgaggcgcgccatgcttcatcagactct

SEQ ID NO: 9487 - DNA, 164 bp, Artificial Sequence; identical to SEQ ID NO: 9486
  Synthetic polynucleotide

SEQ ID NO: 9488 - DNA, 172 bp, Artificial Sequence
  Synthetic polynucleotide
atcatctcaccttgcctcctgagtctgccaatgttggtcctgcaggtcatgcgggtagatcatgcgggttcgtcatgcgggtgactcatgcgggtctatcatgcgggtacttcatgcgggttgctcatgcgggtgtatcatgcgggtggcgcgccatgcttcatcagactct

SEQ ID NO: 9489 - DNA, 172 bp, Artificial Sequence; identical to SEQ ID NO: 9488
  Synthetic polynucleotide

SEQ ID NO: 9490 - DNA, 190 bp, Artificial Sequence
  Synthetic polynucleotide
atcatctcaccttgcctcctgtcaacttgtcatggactcctgcagggaggtcatgaccccagagaggtcatgacccctcggaggtcatgaccccgacgaggtcatgaccccctagaggtcatgaccccactgaggtcatgacccctgcgaggtcatgaccccgtaggcgcgccatgcttcatcagactct

SEQ ID NO: 9491 - DNA, 190 bp, Artificial Sequence; identical to SEQ ID NO: 9490
  Synthetic polynucleotide

SEQ ID NO: 9492 - DNA, 148 bp, Artificial Sequence
  Synthetic polynucleotide
atcatctcaccttgcctcctggacaaatgcggactggacctgcagggccattaagagccattatcggccattagacgccattactagccattaactgccattatgcgccattagtagccattaggcgcgccatgcttcatcagactct

SEQ ID NO: 9493 - DNA, 148 bp, Artificial Sequence; identical to SEQ ID NO: 9492
  Synthetic polynucleotide

SEQ ID NO: 9494 - DNA, 172 bp, Artificial Sequence
  Synthetic polynucleotide
atcatctcaccttgcctcctggtggagtcgattagtggcctgcaggtaatgtattaagataatgtattatcgtaatgtattagactaatgtattactataatgtattaacttaatgtattatgctaatgtattagtataatgtattaggcgcgccatgcttcatcagactct

SEQ ID NO: 9495 - DNA, 172 bp, Artificial Sequence; identical to SEQ ID NO: 9494
  Synthetic polynucleotide

SEQ ID NO: 9496 - DNA, 164 bp, Artificial Sequence
  Synthetic polynucleotide
atcatctcaccttgcctcctgatatgcggttggcgcaacctgcaggtaattaattagataattaatttcgtaattaattgactaattaattctataattaattacttaattaatttgctaattaattgtataattaattggcgcgccatgcttcatcagactct

SEQ ID NO: 9497 - DNA, 164 bp, Artificial Sequence; identical to SEQ ID NO: 9496
  Synthetic polynucleotide

SEQ ID NO: 9498 - DNA, 140 bp, Artificial Sequence
  Synthetic polynucleotide
atcatctcaccttgcctcctgcaatccatagagatagccctgcaggtgttatagatgttattcgtgttatgactgttatctatgttatacttgttattgctgttatgtatgttatggcgcgccatgcttcatcagactct

SEQ ID NO: 9499 - DNA, 140 bp, Artificial Sequence; identical to SEQ ID NO: 9498
  Synthetic polynucleotide

SEQ ID NO: 9500 - DNA, 156 bp, Artificial Sequence
  Synthetic polynucleotide
atcatctcaccttgcctcctgagtaaagtctgtgagtccctgcaggaacctcgcagaaacctcgctcgaacctcgcgacaacctcgcctaaacctcgcactaacctcgctgcaacctcgcgtaaacctcgcggcgcgccatgcttcatcagactct

SEQ ID NO: 9501 - DNA, 156 bp, Artificial Sequence; identical to SEQ ID NO: 9500
  Synthetic polynucleotide

SEQ ID NO: 9502 - DNA, 191 bp, Artificial Sequence
  Synthetic polynucleotide
atcatctcaccttgcctcctgtgttaaccggagagggtcctgcagggaggggggcggggctaaagagaggggggcggggctaatcggaggggggcggggctaagacgaggggggcggggctaactagaggggggcggggctaaactgaggggggcggggctaatgcggcgcgccatgcttcatcagactct

SEQ ID NO: 9503 - DNA, 191 bp, Artificial Sequence; identical to SEQ ID NO: 9502
  Synthetic polynucleotide

SEQ ID NO: 9504 - DNA, 197 bp, Artificial Sequence
  Synthetic polynucleotide
atcatctcaccttgcctcctggaggcaccttcacggatcctgcaggaaataaatcacagcaagaaaataaatcacagcatcgaaataaatcacagcagacaaataaatcacagcactaaaataaatcacagcaactaaataaatcacagcatgcaaataaatcacagcagtaggcgcgccatgcttcatcagactct

SEQ ID NO: 9505 - DNA, 197 bp, Artificial Sequence; identical to SEQ ID NO: 9504
  Synthetic polynucleotide

SEQ ID NO: 9506 - DNA, 172 bp, Artificial Sequence
  Synthetic polynucleotide
atcatctcaccttgcctcctgcctttgacgccgacttacctgcaggcggtaattggagacggtaattggtcgcggtaattgggaccggtaattggctacggtaattggactcggtaattggtgccggtaattgggtacggtaattggggcgcgccatgcttcatcagactct

SEQ ID NO: 9507 - DNA, 172 bp, Artificial Sequence; identical to SEQ ID NO: 9506
  Synthetic polynucleotide

SEQ ID NO: 9508 - DNA, 164 bp, Artificial Sequence
  Synthetic polynucleotide
atcatctcaccttgcctcctggatgtcgtcgcatgagacctgcaggagaggtcaaagaagaggtcaatcgagaggtcaagacagaggtcaactaagaggtcaaactagaggtcaatgcagaggtcaagtaagaggtcaaggcgcgccatgcttcatcagactct

SEQ ID NO: 9509 - DNA, 164 bp, Artificial Sequence; identical to SEQ ID NO: 9508
  Synthetic polynucleotide

SEQ ID NO: 9510 - DNA, 172 bp, Artificial Sequence
  Synthetic polynucleotide
atcatctcaccttgcctcctgtgacccaatggagatgccctgcagggtggggtgatagagtggggtgattcggtggggtgatgacgtggggtgatctagtggggtgatactgtggggtgattgcgtggggtgatgtagtggggtgatggcgcgccatgcttcatcagactct

SEQ ID NO: 9511 - DNA, 172 bp, Artificial Sequence; identical to SEQ ID NO: 9510
  Synthetic polynucleotide

SEQ ID NO: 9512 - DNA, 164 bp, Artificial Sequence
  Synthetic polynucleotide
atcatctcaccttgcctcctgaaatacgtatatcgggccctgcaggagaggtcacagaagaggtcactcgagaggtcacgacagaggtcacctaagaggtcacactagaggtcactgcagaggtcacgtaagaggtcacggcgcgccatgcttcatcagactct

SEQ ID NO: 9513 - DNA, 164 bp, Artificial Sequence; identical to SEQ ID NO: 9512
  Synthetic polynucleotide

SEQ ID NO: 9514 - DNA, 196 bp, Artificial Sequence
  Synthetic polynucleotide
atcatctcaccttgcctcctggattccgacatgtcgaacctgcaggtttttaattggttagatttttaattggtttcgtttttaattggttgactttttaattggttctatttttaattggttacttttttaattggtttgctttttaattggttgtatttttaattggttggcgcgccatgcttcatcagactct

SEQ ID NO: 9515 - DNA, 196 bp, Artificial Sequence; identical to SEQ ID NO: 9514
  Synthetic polynucleotide

SEQ ID NO: 9516 - DNA, 148 bp, Artificial Sequence
  Synthetic polynucleotide
atcatctcaccttgcctcctggcccgtcttagtaaattcctgcaggcgttggcagacgttggctcgcgttggcgaccgttggcctacgttggcactcgttggctgccgttggcgtacgttggcggcgcgccatgcttcatcagactct

SEQ ID NO: 9517 - DNA, 148 bp, Artificial Sequence; identical to SEQ ID NO: 9516
  Synthetic polynucleotide

SEQ ID NO: 9518 - DNA, 190 bp, Artificial Sequence
  Synthetic polynucleotide
atcatctcaccttgcctcctgcttagggacgctcagatcctgcaggggggcaaagttcaaagaggggcaaagttcaatcgggggcaaagttcaagacggggcaaagttcaactaggggcaaagttcaaactggggcaaagttcaatgcggggcaaagttcaagtaggcgcgccatgcttcatcagactct

SEQ ID NO: 9519 - DNA, 190 bp, Artificial Sequence; identical to SEQ ID NO: 9518
  Synthetic polynucleotide

SEQ ID NO: 9520 - DNA, 172 bp, Artificial Sequence
  Synthetic polynucleotide
atcatctcaccttgcctcctggtcattagtcgtctggtcctgcaggggtgactcatagaggtgactcattcgggtgactcatgacggtgactcatctaggtgactcatactggtgactcattgcggtgactcatgtaggtgactcatggcgcgccatgcttcatcagactct

SEQ ID NO: 9521 - DNA, 172 bp, Artificial Sequence; identical to SEQ ID NO: 9520
  Synthetic polynucleotide

SEQ ID NO: 9522 - DNA, 180 bp, Artificial Sequence
  Synthetic polynucleotide
atcatctcaccttgcctcctgaatctaccggcattacccctgcagggccacgtggccagagccacgtggcctcggccacgtggccgacgccacgtggccctagccacgtggccactgccacgtggcctgcgccacgtggccgtagccacgtggccggcgcgccatgcttcatcagactct

SEQ ID NO: 9523 - DNA, 180 bp, Artificial Sequence; identical to SEQ ID NO: 9522
  Synthetic polynucleotide

SEQ ID NO: 9524 - DNA, 172 bp, Artificial Sequence
  Synthetic polynucleotide
atcatctcaccttgcctcctggaactagcagacgaccccctgcaggggtgactcagagaggtgactcagtcgggtgactcaggacggtgactcagctaggtgactcagactggtgactcagtgcggtgactcaggtaggtgactcagggcgcgccatgcttcatcagactct

SEQ ID NO: 9525 - DNA, 172 bp, Artificial Sequence; identical to SEQ ID NO: 9524
  Synthetic polynucleotide

SEQ ID NO: 9526 - DNA, 164 bp, Artificial Sequence
  Synthetic polynucleotide
atcatctcaccttgcctcctgttcaaacgcggaatcaccctgcaggtcattagggagatcattagggtcgtcattaggggactcattagggctatcattagggacttcattagggtgctcattaggggtatcattagggggcgcgccatgcttcatcagactct

SEQ ID NO: 9527 - DNA, 164 bp, Artificial Sequence; identical to SEQ ID NO: 9526
  Synthetic polynucleotide

SEQ ID NO: 9528 - DNA, 164 bp, Artificial Sequence
  Synthetic polynucleotide
atcatctcaccttgcctcctgtattaccctctagctaacctgcaggcccaaaattagacccaaaatttcgcccaaaattgaccccaaaattctacccaaaattactcccaaaatttgccccaaaattgtacccaaaattggcgcgccatgcttcatcagactct

SEQ ID NO: 9529 - DNA, 164 bp, Artificial Sequence; identical to SEQ ID NO: 9528
  Synthetic polynucleotide

SEQ ID NO: 9530 - DNA, 190 bp, Artificial Sequence
  Synthetic polynucleotide
atcatctcaccttgcctcctgggttgatccttctattgcctgcaggttgccctagggcatagattgccctagggcattcgttgccctagggcatgacttgccctagggcatctattgccctagggcatactttgccctagggcattgcttgccctagggcatgtaggcgcgccatgcttcatcagactct

SEQ ID NO: 9531 - DNA, 190 bp, Artificial Sequence; identical to SEQ ID NO: 9530
  Synthetic polynucleotide

SEQ ID NO: 9532 - DNA, 172 bp, Artificial Sequence
  Synthetic polynucleotide
atcatctcaccttgcctcctgctagtgagccatcgatccctgcagggtcgtaaaaaagagtcgtaaaaatcggtcgtaaaaagacgtcgtaaaaactagtcgtaaaaaactgtcgtaaaaatgcgtcgtaaaaagtagtcgtaaaaaggcgcgccatgcttcatcagactct

SEQ ID NO: 9533 - DNA, 172 bp, Artificial Sequence; identical to SEQ ID NO: 9532
  Synthetic polynucleotide

SEQ ID NO: 9534 - DNA, 156 bp, Artificial Sequence
  Synthetic polynucleotide
atcatctcaccttgcctcctgaagaccgaatatggctgcctgcaggatgcatatagaatgcatattcgatgcatatgacatgcatatctaatgcatatactatgcatattgcatgcatatgtaatgcatatggcgcgccatgcttcatcagactct

SEQ ID NO: 9535 - DNA, 156 bp, Artificial Sequence; identical to SEQ ID NO: 9534
  Synthetic polynucleotide

SEQ ID NO: 9536 - DNA, 179 bp, Artificial Sequence
  Synthetic polynucleotide
atcatctcaccttgcctcctgttagtcctgatttacagcctgcaggattggccagcgtggctgtcagtcaagaattggccagcgtggctgtcagtcatcgattggccagcgtggctgtcagtcagacattggccagcgtggctgtcagtcactaggcgcgccatgcttcatcagactct

SEQ ID NO: 9537 - DNA, 179 bp, Artificial Sequence; identical to SEQ ID NO: 9536
  Synthetic polynucleotide

SEQ ID NO: 9538 - DNA, 191 bp, Artificial Sequence
  Synthetic polynucleotide
atcatctcaccttgcctcctgtgatcctatcacccggacctgcaggatccacaggtgcgaaaaagaatccacaggtgcgaaaatcgatccacaggtgcgaaaagacatccacaggtgcgaaaactaatccacaggtgcgaaaaactatccacaggtgcgaaaatgcggcgcgccatgcttcatcagactct

SEQ ID NO: 9539 - DNA, 191 bp, Artificial Sequence; identical to SEQ ID NO: 9538
  Synthetic polynucleotide

SEQ ID NO: 9540 - DNA, 196 bp, Artificial Sequence
  Synthetic polynucleotide
atcatctcaccttgcctcctgcaaggcgcgacttattccctgcaggtggaaatttccatagatggaaatttccattcgtggaaatttccatgactggaaatttccatctatggaaatttccatacttggaaatttccattgctggaaatttccatgtatggaaatttccatggcgcgccatgcttcatcagactct

SEQ ID NO: 9541 - DNA, 196 bp, Artificial Sequence; identical to SEQ ID NO: 9540
  Synthetic polynucleotide

SEQ ID NO: 9542 - DNA, 180 bp, Artificial Sequence
  Synthetic polynucleotide
atcatctcaccttgcctcctggcaggttggcctaaagtcctgcaggttaacggttatagattaacggttattcgttaacggttatgacttaacggttatctattaacggttatactttaacggttattgcttaacggttatgtattaacggttatggcgcgccatgcttcatcagactct

SEQ ID NO: 9543 - DNA, 180 bp, Artificial Sequence; identical to SEQ ID NO: 9542
  Synthetic polynucleotide

SEQ ID NO: 9544 - DNA, 172 bp, Artificial Sequence
  Synthetic polynucleotide
atcatctcaccttgcctcctgcagagggtaaatattgtcctgcagggccaattaacagagccaattaactcggccaattaacgacgccaattaacctagccaattaacactgccaattaactgcgccaattaacgtagccaattaacggcgcgccatgcttcatcagactct

SEQ ID NO: 9545 - DNA, 172 bp, Artificial Sequence; identical to SEQ ID NO: 9544
  Synthetic polynucleotide

SEQ ID NO: 9546 - DNA, 185 bp, Artificial Sequence
  Synthetic polynucleotide
atcatctcaccttgcctcctggaacgtgatatatcctacctgcaggatcattcattcatagtagaatcattcattcatagttcgatcattcattcatagtgacatcattcattcatagtctaatcattcattcatagtactatcattcattcatagttgcggcgcgccatgcttcatcagactct

SEQ ID NO: 9547 - DNA, 185 bp, Artificial Sequence; identical to SEQ ID NO: 9546
  Synthetic polynucleotide

SEQ ID NO: 9548 - DNA, 191 bp, Artificial Sequence
  Synthetic polynucleotide
atcatctcaccttgcctcctgaacacgtagcacgtttacctgcaggtggcgccccctggtggcagatggcgccccctggtggctcgtggcgccccctggtggcgactggcgccccctggtggcctatggcgccccctggtggcacttggcgccccctggtggctgcggcgcgccatgcttcatcagactct

SEQ ID NO: 9549 - DNA, 191 bp, Artificial Sequence; identical to SEQ ID NO: 9548
  Synthetic polynucleotide

SEQ ID NO: 9550 - DNA, 156 bp, Artificial Sequence
  Synthetic polynucleotide
atcatctcaccttgcctcctgactctaagaaagttccacctgcaggatcacgtgagaatcacgtgtcgatcacgtggacatcacgtgctaatcacgtgactatcacgtgtgcatcacgtggtaatcacgtgggcgcgccatgcttcatcagactct

SEQ ID NO: 9551 - DNA, 156 bp, Artificial Sequence; identical to SEQ ID NO: 9550
  Synthetic polynucleotide

SEQ ID NO: 9552 - DNA, 164 bp, Artificial Sequence
  Synthetic polynucleotide
atcatctcaccttgcctcctgtatgtttgtgtgccacgcctgcaggtctaacggcagatctaacggctcgtctaacggcgactctaacggcctatctaacggcacttctaacggctgctctaacggcgtatctaacggcggcgcgccatgcttcatcagactct

SEQ ID NO: 9553 - DNA, 164 bp, Artificial Sequence; identical to SEQ ID NO: 9552
  Synthetic polynucleotide

SEQ ID NO: 9554 - DNA, 197 bp, Artificial Sequence
  Synthetic polynucleotide
atcatctcaccttgcctcctgaggcagtcgtcgtattgcctgcaggaagtgcttccgggtcagaaagtgcttccgggtctcgaagtgcttccgggtcgacaagtgcttccgggtcctaaagtgcttccgggtcactaagtgcttccgggtctgcaagtgcttccgggtcgtaggcgcgccatgcttcatcagactct

SEQ ID NO: 9555 - DNA, 197 bp, Artificial Sequence; identical to SEQ ID NO: 9554
  Synthetic polynucleotide

SEQ ID NO: 9556 - DNA, 190 bp, Artificial Sequence
  Synthetic polynucleotide
atcatctcaccttgcctcctgatctgtgtgcaaatcttcctgcaggacgcgcctcgggcgagaacgcgcctcgggcgtcgacgcgcctcgggcggacacgcgcctcgggcgctaacgcgcctcgggcgactacgcgcctcgggcgtgcacgcgcctcgggcggtaggcgcgccatgcttcatcagactct

SEQ ID NO: 9557 - DNA, 190 bp, Artificial Sequence; identical to SEQ ID NO: 9556
  Synthetic polynucleotide

SEQ ID NO: 9558 - DNA, 185 bp, Artificial Sequence
  Synthetic polynucleotide
atcatctcaccttgcctcctgtagactcctagctgattcctgcaggtgaccttttgacctttagatgaccttttgaccttttcgtgaccttttgacctttgactgaccttttgacctttctatgaccttttgacctttacttgaccttttgaccttttgcggcgcgccatgcttcatcagactct

SEQ ID NO: 9559 - DNA, 185 bp, Artificial Sequence; identical to SEQ ID NO: 9558
  Synthetic polynucleotide

SEQ ID NO: 9560 - DNA, 172 bp, Artificial Sequence
  Synthetic polynucleotide
atcatctcaccttgcctcctggtcgtttcaaggccagccctgcaggggtaattaacagaggtaattaactcgggtaattaacgacggtaattaacctaggtaattaacactggtaattaactgcggtaattaacgtaggtaattaacggcgcgccatgcttcatcagactct

SEQ ID NO: 9561 - DNA, 172 bp, Artificial Sequence; identical to SEQ ID NO: 9560
  Synthetic polynucleotide

SEQ ID NO: 9562 - DNA, 197 bp, Artificial Sequence
  Synthetic polynucleotide
atcatctcaccttgcctcctgtgactaccctattcgaccctgcaggggcgggaaattggaaagaggcgggaaattggaatcgggcgggaaattggaagacggcgggaaattggaactaggcgggaaattggaaactggcgggaaattggaatgcggcgggaaattggaagtaggcgcgccatgcttcatcagactct

SEQ ID NO: 9563 - DNA, 197 bp, Artificial Sequence; identical to SEQ ID NO: 9562
  Synthetic polynucleotide

SEQ ID NO: 9564 - DNA, 172 bp, Artificial Sequence
  Synthetic polynucleotide
atcatctcaccttgcctcctgggttacgagattcttctcctgcaggggtaattaaaagaggtaattaaatcgggtaattaaagacggtaattaaactaggtaattaaaactggtaattaaatgcggtaattaaagtaggtaattaaaggcgcgccatgcttcatcagactct

SEQ ID NO: 9565 - DNA, 172 bp, Artificial Sequence; identical to SEQ ID NO: 9564
  Synthetic polynucleotide

SEQ ID NO: 9566 - DNA, 172 bp, Artificial Sequence
  Synthetic polynucleotide
atcatctcaccttgcctcctgcaagttcattctcattccctgcaggggtaattaagagaggtaattaagtcgggtaattaaggacggtaattaagctaggtaattaagactggtaattaagtgcggtaattaaggtaggtaattaagggcgcgccatgcttcatcagactct

SEQ ID NO: 9567 - DNA, 172 bp, Artificial Sequence; identical to SEQ ID NO: 9566
  Synthetic polynucleotide

SEQ ID NO: 9568 - DNA, 185 bp, Artificial Sequence
  Synthetic polynucleotide
atcatctcaccttgcctcctgtctgtccagttagagctcctgcaggtttcattttcttttttagatttcattttctttttttcgtttcattttcttttttgactttcattttcttttttctatttcattttcttttttacttttcattttctttttttgcggcgcgccatgcttcatcagactct

SEQ ID NO: 9569 - DNA, 185 bp, Artificial Sequence; identical to SEQ ID NO: 9568
  Synthetic polynucleotide

SEQ ID NO: 9570 - DNA, 185 bp, Artificial Sequence
  Synthetic polynucleotide
atcatctcaccttgcctcctgcacctggagaaggctctcctgcaggaacaatgaatattgttagaaacaatgaatattgtttcgaacaatgaatattgttgacaacaatgaatattgttctaaacaatgaatattgttactaacaatgaatattgtttgcggcgcgccatgcttcatcagactct

SEQ ID NO: 9571 - DNA, 185 bp, Artificial Sequence; identical to SEQ ID NO: 9570
  Synthetic polynucleotide

SEQ ID NO: 9572 - DNA, 156 bp, Artificial Sequence
  Synthetic polynucleotide
atcatctcaccttgcctcctgatagaggccctcaggagcctgcaggacagcgctagaacagcgcttcgacagcgctgacacagcgctctaacagcgctactacagcgcttgcacagcgctgtaacagcgctggcgcgccatgcttcatcagactct

SEQ ID NO: 9573 - DNA, 156 bp, Artificial Sequence; identical to SEQ ID NO: 9572
  Synthetic polynucleotide

SEQ ID NO: 9574 - DNA, 185 bp, Artificial Sequence
  Synthetic polynucleotide
atcatctcaccttgcctcctgaactgttggacagattgcctgcaggggtttgtttactttttagaggtttgtttacttttttcgggtttgtttactttttgacggtttgtttactttttctaggtttgtttactttttactggtttgtttacttttttgcggcgcgccatgcttcatcagactct

SEQ ID NO: 9575 - DNA, 185 bp, Artificial Sequence; identical to SEQ ID NO: 9574
  Synthetic polynucleotide

SEQ ID NO: 9576 - DNA, 185 bp, Artificial Sequence
  Synthetic polynucleotide
atcatctcaccttgcctcctgatacgccttcagcgtcccctgcaggatgagctaattaccttagaatgagctaattacctttcgatgagctaattaccttgacatgagctaattaccttctaatgagctaattaccttactatgagctaattacctttgcggcgcgccatgcttcatcagactct

SEQ ID NO: 9577 - DNA, 185 bp, Artificial Sequence; identical to SEQ ID NO: 9576
  Synthetic polynucleotide

SEQ ID NO: 9578 - DNA, 172 bp, Artificial Sequence
  Synthetic polynucleotide
atcatctcaccttgcctcctgttaagcaggacgtagatcctgcaggggggtcacggagaggggtcacggtcgggggtcacgggacggggtcacggctaggggtcacggactggggtcacggtgcggggtcacgggtaggggtcacggggcgcgccatgcttcatcagactct

SEQ ID NO: 9579 - DNA, 172 bp, Artificial Sequence; identical to SEQ ID NO: 9578
  Synthetic polynucleotide

SEQ ID NO: 9580 - DNA, 188 bp, Artificial Sequence
  Synthetic polynucleotide
atcatctcaccttgcctcctgtcagcgattctacggatcctgcaggtatagacgcgcaagatatagacgcgcatcgtatagacgcgcagactatagacgcgcactatatagacgcgcaacttatagacgcgcatgctatagacgcgcagtatatagacgcgcaggcgcgccatgcttcatcagactct

SEQ ID NO: 9581 - DNA, 188 bp, Artificial Sequence; identical to SEQ ID NO: 9580
  Synthetic polynucleotide

SEQ ID NO: 9582 - DNA, 180 bp, Artificial Sequence
  Synthetic polynucleotide
atcatctcaccttgcctcctgacagtggcctactccaccctgcagggtcatgtgaccagagtcatgtgacctcggtcatgtgaccgacgtcatgtgaccctagtcatgtgaccactgtcatgtgacctgcgtcatgtgaccgtagtcatgtgaccggcgcgccatgcttcatcagactct

SEQ ID NO: 9583 - DNA, 180 bp, Artificial Sequence; identical to SEQ ID NO: 9582
  Synthetic polynucleotide

SEQ ID NO: 9584 - DNA, 190 bp, Artificial Sequence
  Synthetic polynucleotide
atcatctcaccttgcctcctggagcgttcgggaacgatcctgcaggtgacagttttacgaagatgacagttttacgatcgtgacagttttacgagactgacagttttacgactatgacagttttacgaacttgacagttttacgatgctgacagttttacgagtaggcgcgccatgcttcatcagactct

SEQ ID NO: 9585 - DNA, 190 bp, Artificial Sequence; identical to SEQ ID NO: 9584
  Synthetic polynucleotide

SEQ ID NO: 9586 - DNA, 156 bp, Artificial Sequence
  Synthetic polynucleotide
atcatctcaccttgcctcctggatactgggaacactcccctgcaggctagttaaagactagttaatcgctagttaagacctagttaactactagttaaactctagttaatgcctagttaagtactagttaaggcgcgccatgcttcatcagactct

SEQ ID NO: 9587 - DNA, 156 bp, Artificial Sequence; identical to SEQ ID NO: 9586
  Synthetic polynucleotide

SEQ ID NO: 9588 - DNA, 191 bp, Artificial Sequence
  Synthetic polynucleotide
atcatctcaccttgcctcctggctgtgtcagttgcaaacctgcaggaggtcaactaaaggtcaagaaggtcaactaaaggtcatcgaggtcaactaaaggtcagacaggtcaactaaaggtcactaaggtcaactaaaggtcaactaggtcaactaaaggtcatgcggcgcgccatgcttcatcagactct

SEQ ID NO: 9589 - DNA, 191 bp, Artificial Sequence; identical to SEQ ID NO: 9588
  Synthetic polynucleotide

SEQ ID NO: 9590 - DNA, 185 bp, Artificial Sequence
  Synthetic polynucleotide
atcatctcaccttgcctcctgctggttccaactcacgccctgcaggtctaatttgcatacaaagatctaatttgcatacaatcgtctaatttgcatacaagactctaatttgcatacaactatctaatttgcatacaaacttctaatttgcatacaatgcggcgcgccatgcttcatcagactct

SEQ ID NO: 9591 - DNA, 185 bp, Artificial Sequence; identical to SEQ ID NO: 9590
  Synthetic polynucleotide

SEQ ID NO: 9592 - DNA, 188 bp, Artificial Sequence
  Synthetic polynucleotide
atcatctcaccttgcctcctgattctgctgatgagtcacctgcaggtaaggaagaaggagataaggaagaaggtcgtaaggaagaagggactaaggaagaaggctataaggaagaaggacttaaggaagaaggtgctaaggaagaagggtataaggaagaaggggcgcgccatgcttcatcagactct

SEQ ID NO: 9593 - DNA, 188 bp, Artificial Sequence; identical to SEQ ID NO: 9592
  Synthetic polynucleotide

SEQ ID NO: 9594 - DNA, 196 bp, Artificial Sequence
  Synthetic polynucleotide
atcatctcaccttgcctcctgtgctagccacgcatgtacctgcaggccaccggaaattaagaccaccggaaattatcgccaccggaaattagacccaccggaaattactaccaccggaaattaactccaccggaaattatgcccaccggaaattagtaccaccggaaattaggcgcgccatgcttcatcagactct

SEQ ID NO: 9595 - DNA, 196 bp, Artificial Sequence; identical to SEQ ID NO: 9594
  Synthetic polynucleotide

SEQ ID NO: 9596 - DNA, 190 bp, Artificial Sequence
  Synthetic polynucleotide
atcatctcaccttgcctcctgagttagctatgcgatgccctgcaggaaccacaataccaaagaaaccacaataccaatcgaaccacaataccaagacaaccacaataccaactaaaccacaataccaaactaaccacaataccaatgcaaccacaataccaagtaggcgcgccatgcttcatcagactct

SEQ ID NO: 9597 - DNA, 190 bp, Artificial Sequence; identical to SEQ ID NO: 9596
  Synthetic polynucleotide

SEQ ID NO: 9598 - DNA, 188 bp, Artificial Sequence
  Synthetic polynucleotide
atcatctcaccttgcctcctgccatcattctgcttcttcctgcaggggggcaggtctgagaggggcaggtctgtcgggggcaggtctggacggggcaggtctgctaggggcaggtctgactggggcaggtctgtgcggggcaggtctggtaggggcaggtctgggcgcgccatgcttcatcagactct

SEQ ID NO: 9599 - DNA, 188 bp, Artificial Sequence; identical to SEQ ID NO: 9598
  Synthetic polynucleotide

SEQ ID NO: 9600 - DNA, 196 bp, Artificial Sequence
  Synthetic polynucleotide
atcatctcaccttgcctcctggaggtacggttcattaccctgcagggattacgtaacagagagattacgtaacagtcggattacgtaacaggacgattacgtaacagctagattacgtaacagactgattacgtaacagtgcgattacgtaacaggtagattacgtaacagggcgcgccatgcttcatcagactct

SEQ ID NO: 9601 - DNA, 196 bp, Artificial Sequence; identical to SEQ ID NO: 9600
  Synthetic polynucleotide

SEQ ID NO: 9602 - DNA, 190 bp, Artificial Sequence
  Synthetic polynucleotide
atcatctcaccttgcctcctgtggaactagtcactgtgcctgcaggttaccatggcaaccagattaccatggcaacctcgttaccatggcaaccgacttaccatggcaaccctattaccatggcaaccactttaccatggcaacctgcttaccatggcaaccgtaggcgcgccatgcttcatcagactct

SEQ ID NO: 9603 - DNA, 190 bp, Artificial Sequence; identical to SEQ ID NO: 9602
  Synthetic polynucleotide

SEQ ID NO: 9604 - DNA, 172 bp, Artificial Sequence
  Synthetic polynucleotide
atcatctcaccttgcctcctgagattaagccatgctcacctgcaggtgtctagacgagatgtctagacgtcgtgtctagacggactgtctagacgctatgtctagacgacttgtctagacgtgctgtctagacggtatgtctagacgggcgcgccatgcttcatcagactct

SEQ ID NO: 9605 - DNA, 172 bp, Artificial Sequence; identical to SEQ ID NO: 9604
  Synthetic polynucleotide

SEQ ID NO: 9606 - DNA, 188 bp, Artificial Sequence
  Synthetic polynucleotide
atcatctcaccttgcctcctgacgaatttccgaagcaacctgcaggaaacatatgtttagaaaacatatgttttcgaaacatatgtttgacaaacatatgtttctaaaacatatgtttactaaacatatgttttgcaaacatatgtttgtaaaacatatgtttggcgcgccatgcttcatcagactct

SEQ ID NO: 9607 - DNA, 188 bp, Artificial Sequence; identical to SEQ ID NO: 9606
  Synthetic polynucleotide

SEQ ID NO: 9608 - DNA, 164 bp, Artificial Sequence
  Synthetic polynucleotide
atcatctcaccttgcctcctgcagcaatcaaccgttcgcctgcaggtgataccctagatgatacccttcgtgataccctgactgataccctctatgataccctacttgatacccttgctgataccctgtatgataccctggcgcgccatgcttcatcagactct

SEQ ID NO: 9609 - DNA, 164 bp, Artificial Sequence; identical to SEQ ID NO: 9608
  Synthetic polynucleotide

SEQ ID NO: 9610 - DNA, 185 bp, Artificial Sequence
  Synthetic polynucleotide
atcatctcaccttgcctcctgctcttgcaagaacaccccctgcaggtcgaccccgcccctatagatcgaccccgcccctattcgtcgaccccgcccctatgactcgaccccgcccctatctatcgaccccgcccctatacttcgaccccgcccctattgcggcgcgccatgcttcatcagactct

SEQ ID NO: 9611 - DNA, 185 bp, Artificial Sequence; identical to SEQ ID NO: 9610
  Synthetic polynucleotide

SEQ ID NO: 9612 - DNA, 197 bp, Artificial Sequence
  Synthetic polynucleotide
atcatctcaccttgcctcctgactataagttggtccttcctgcaggggggacacctgccgtagaggggacacctgccgttcgggggacacctgccgtgacggggacacctgccgtctaggggacacctgccgtactggggacacctgccgttgcggggacacctgccgtgtaggcgcgccatgcttcatcagactct

SEQ ID NO: 9613 - DNA, 197 bp, Artificial Sequence; identical to SEQ ID NO: 9612
  Synthetic polynucleotide

SEQ ID NO: 9614 - DNA, 185 bp, Artificial Sequence
  Synthetic polynucleotide
atcatctcaccttgcctcctgacactattgagatcgaacctgcaggttcctagaaagcttttagattcctagaaagctttttcgttcctagaaagcttttgacttcctagaaagcttttctattcctagaaagcttttactttcctagaaagctttttgcggcgcgccatgcttcatcagactct

SEQ ID NO: 9615 - DNA, 185 bp, Artificial Sequence; identical to SEQ ID NO: 9614
  Synthetic polynucleotide

SEQ ID NO: 9616 - DNA, 156 bp, Artificial Sequence
  Synthetic polynucleotide
atcatctcaccttgcctcctgcatgccacctctttccgcctgcaggaattagtgagaaattagtgtcgaattagtggacaattagtgctaaattagtgactaattagtgtgcaattagtggtaaattagtgggcgcgccatgcttcatcagactct

SEQ ID NO: 9617 - DNA, 156 bp, Artificial Sequence; identical to SEQ ID NO: 9616
  Synthetic polynucleotide

SEQ ID NO: 9618 - DNA, 180 bp, Artificial Sequence
  Synthetic polynucleotide
atcatctcaccttgcctcctgagattgtagcggtcgagcctgcaggtttgtttacttagatttgtttactttcgtttgtttacttgactttgtttacttctatttgtttacttacttttgtttactttgctttgtttacttgtatttgtttacttggcgcgccatgcttcatcagactct

SEQ ID NO: 9619 - DNA, 180 bp, Artificial Sequence; identical to SEQ ID NO: 9618
  Synthetic polynucleotide

SEQ ID NO: 9620 - DNA, 185 bp, Artificial Sequence
  Synthetic polynucleotide
atcatctcaccttgcctcctgactgttgaacctgactgcctgcaggtaagtaattagttataagataagtaattagttatatcgtaagtaattagttatagactaagtaattagttatactataagtaattagttataacttaagtaattagttatatgcggcgcgccatgcttcatcagactct

SEQ ID NO: 9621 - DNA, 185 bp, Artificial Sequence; identical to SEQ ID NO: 9620
  Synthetic polynucleotide

SEQ ID NO: 9622 - DNA, 180 bp, Artificial Sequence
  Synthetic polynucleotide
atcatctcaccttgcctcctgattataagctcgaaccacctgcaggccctctggtggagaccctctggtggtcgccctctggtgggacccctctggtggctaccctctggtggactccctctggtggtgcccctctggtgggtaccctctggtggggcgcgccatgcttcatcagactct

SEQ ID NO: 9623 - DNA, 180 bp, Artificial Sequence; identical to SEQ ID NO: 9622
  Synthetic polynucleotide

SEQ ID NO: 9624 - DNA, 179 bp, Artificial Sequence
  Synthetic polynucleotide
atcatctcaccttgcctcctgctgtattcagcctccctcctgcaggggcatatgctgtgatttattttgtagaggcatatgctgtgatttattttgttcgggcatatgctgtgatttattttgtgacggcatatgctgtgatttattttgtctaggcgcgccatgcttcatcagactct

SEQ ID NO: 9625 - DNA, 179 bp, Artificial Sequence; identical to SEQ ID NO: 9624
  Synthetic polynucleotide

SEQ ID NO: 9626 - DNA, 188 bp, Artificial Sequence
  Synthetic polynucleotide
atcatctcaccttgcctcctgtcgtggtgagaagacatcctgcaggcagacctgccccagacagacctgcccctcgcagacctgccccgaccagacctgccccctacagacctgccccactcagacctgcccctgccagacctgccccgtacagacctgccccggcgcgccatgcttcatcagactct

SEQ ID NO: 9627 - DNA, 188 bp, Artificial Sequence; identical to SEQ ID NO: 9626
  Synthetic polynucleotide

SEQ ID NO: 9628 - DNA, 188 bp, Artificial Sequence
  Synthetic polynucleotide
atcatctcaccttgcctcctggcaaggaacacataccccctgcaggagttacgtcaccagaagttacgtcacctcgagttacgtcaccgacagttacgtcaccctaagttacgtcaccactagttacgtcacctgcagttacgtcaccgtaagttacgtcaccggcgcgccatgcttcatcagactct

SEQ ID NO: 9629 - DNA, 188 bp, Artificial Sequence; identical to SEQ ID NO: 9628
  Synthetic polynucleotide

SEQ ID NO: 9630 - DNA, 172 bp, Artificial Sequence
  Synthetic polynucleotide
atcatctcaccttgcctcctgatatattgggcaccgcgcctgcaggtctttgtttaagatctttgtttatcgtctttgtttagactctttgtttactatctttgtttaacttctttgtttatgctctttgtttagtatctttgtttaggcgcgccatgcttcatcagactct

SEQ ID NO: 9631 - DNA, 172 bp, Artificial Sequence; identical to SEQ ID NO: 9630
  Synthetic polynucleotide

SEQ ID NO: 9632 - DNA, 185 bp, Artificial Sequence
  Synthetic polynucleotide
atcatctcaccttgcctcctgcttatgtttagcctcaccctgcaggataaatcacagcactcagaataaatcacagcactctcgataaatcacagcactcgacataaatcacagcactcctaataaatcacagcactcactataaatcacagcactctgcggcgcgccatgcttcatcagactct

SEQ ID NO: 9633 - DNA, 185 bp, Artificial Sequence; identical to SEQ ID NO: 9632
  Synthetic polynucleotide

SEQ ID NO: 9634 - DNA, 164 bp, Artificial Sequence
  Synthetic polynucleotide
atcatctcaccttgcctcctggaaggaccgaatgataacctgcaggacggtagcaagaacggtagcatcgacggtagcagacacggtagcactaacggtagcaactacggtagcatgcacggtagcagtaacggtagcaggcgcgccatgcttcatcagactct

SEQ ID NO: 9635 - DNA, 164 bp, Artificial Sequence; identical to SEQ ID NO: 9634
  Synthetic polynucleotide

SEQ ID NO: 9636 - DNA, 188 bp, Artificial Sequence
  Synthetic polynucleotide
atcatctcaccttgcctcctgtttctaatataagccggcctgcaggtttggcgccattagatttggcgccatttcgtttggcgccattgactttggcgccattctatttggcgccattacttttggcgccatttgctttggcgccattgtatttggcgccattggcgcgccatgcttcatcagactct

SEQ ID NO: 9637 - DNA, 188 bp, Artificial Sequence; identical to SEQ ID NO: 9636
  Synthetic polynucleotide

SEQ ID NO: 9638 - DNA, 172 bp, Artificial Sequence
  Synthetic polynucleotide
atcatctcaccttgcctcctgacgtgcaggctagcattcctgcaggcataaataatagacataaataattcgcataaataatgaccataaataatctacataaataatactcataaataattgccataaataatgtacataaataatggcgcgccatgcttcatcagactct

SEQ ID NO: 9639 - DNA, 172 bp, Artificial Sequence; identical to SEQ ID NO: 9638
  Synthetic polynucleotide

SEQ ID NO: 9640 - DNA, 140 bp, Artificial Sequence
  Synthetic polynucleotide
atcatctcaccttgcctcctgaaagacaaatcacaggccctgcaggttgacaagattgacatcgttgacagacttgacactattgacaactttgacatgcttgacagtattgacaggcgcgccatgcttcatcagactct

SEQ ID NO: 9641 - DNA, 140 bp, Artificial Sequence; identical to SEQ ID NO: 9640
  Synthetic polynucleotide

SEQ ID NO: 9642 - DNA, 156 bp, Artificial Sequence
  Synthetic polynucleotide
atcatctcaccttgcctcctggggtttgttcgaggagccctgcagggcaggtgcagagcaggtgctcggcaggtgcgacgcaggtgcctagcaggtgcactgcaggtgctgcgcaggtgcgtagcaggtgcggcgcgccatgcttcatcagactct

SEQ ID NO: 9643 - DNA, 156 bp, Artificial Sequence; identical to SEQ ID NO: 9642
  Synthetic polynucleotide

SEQ ID NO: 9644 - DNA, 197 bp, Artificial Sequence
  Synthetic polynucleotide
atcatctcaccttgcctcctgctgtgacgtagtacgggcctgcaggctctgattggccggcagactctgattggccggctcgctctgattggccggcgacctctgattggccggcctactctgattggccggcactctctgattggccggctgcctctgattggccggcgtaggcgcgccatgcttcatcagactct

SEQ ID NO: 9645 - DNA, 197 bp, Artificial Sequence; identical to SEQ ID NO: 9644
  Synthetic polynucleotide

SEQ ID NO: 9646 - DNA, 191 bp, Artificial Sequence
  Synthetic polynucleotide
atcatctcaccttgcctcctgctagtgagagcagacaacctgcaggcatgaataccattcatcagacatgaataccattcatctcgcatgaataccattcatcgaccatgaataccattcatcctacatgaataccattcatcactcatgaataccattcatctgcggcgcgccatgcttcatcagactct

SEQ ID NO: 9647 - DNA, 191 bp, Artificial Sequence; identical to SEQ ID NO: 9646
  Synthetic polynucleotide

SEQ ID NO: 9648 - DNA, 191 bp, Artificial Sequence
  Synthetic polynucleotide
atcatctcaccttgcctcctgaattcgccgttctatagcctgcaggaaagtgaaagtgaaagtaaaaagaaaagtgaaagtgaaagtaaaatcgaaagtgaaagtgaaagtaaaagacaaagtgaaagtgaaagtaaaactaaaagtgaaagtgaaagtaaaaactggcgcgccatgcttcatcagactct

SEQ ID NO: 9649 - DNA, 191 bp, Artificial Sequence; identical to SEQ ID NO: 9648
  Synthetic polynucleotide

SEQ ID NO: 9650 - DNA, 180 bp, Artificial Sequence
  Synthetic polynucleotide
atcatctcaccttgcctcctgtcggtcatggtagcgtacctgcaggtgctgtgatttagatgctgtgattttcgtgctgtgatttgactgctgtgatttctatgctgtgatttacttgctgtgattttgctgctgtgatttgtatgctgtgatttggcgcgccatgcttcatcagactct

SEQ ID NO: 9651 - DNA, 180 bp, Artificial Sequence; identical to SEQ ID NO: 9650
  Synthetic polynucleotide

SEQ ID NO: 9652 - DNA, 191 bp, Artificial Sequence
  Synthetic polynucleotide
atcatctcaccttgcctcctgaaagagacaggtcaaatcctgcagggtctttgtttactttttagagtctttgtttacttttttcggtctttgtttactttttgacgtctttgtttactttttctagtctttgtttactttttactgtctttgtttacttttttgcggcgcgccatgcttcatcagactct

SEQ ID NO: 9653 - DNA, 191 bp, Artificial Sequence; identical to SEQ ID NO: 9652
  Synthetic polynucleotide

SEQ ID NO: 9654 - DNA, 156 bp, Artificial Sequence
  Synthetic polynucleotide
atcatctcaccttgcctcctgggcgtgaggtgtgacttcctgcagggcaggtggagagcaggtggtcggcaggtgggacgcaggtggctagcaggtggactgcaggtggtgcgcaggtgggtagcaggtggggcgcgccatgcttcatcagactct

SEQ ID NO: 9655 - DNA, 156 bp, Artificial Sequence; identical to SEQ ID NO: 9654
  Synthetic polynucleotide

SEQ ID NO: 9656 - DNA, 196 bp, Artificial Sequence
  Synthetic polynucleotide
atcatctcaccttgcctcctggcctaaccaattcaggacctgcaggaaaggcgcgaaaaagaaaaggcgcgaaaatcgaaaggcgcgaaaagacaaaggcgcgaaaactaaaaggcgcgaaaaactaaaggcgcgaaaatgcaaaggcgcgaaaagtaaaaggcgcgaaaaggcgcgccatgcttcatcagactct

SEQ ID NO: 9657 - DNA, 196 bp, Artificial Sequence; identical to SEQ ID NO: 9656
  Synthetic polynucleotide

SEQ ID NO: 9658 - DNA, 196 bp, Artificial Sequence
  Synthetic polynucleotide
atcatctcaccttgcctcctgacgtttatcccgcatgacctgcagggtgactcatcctcagagtgactcatcctctcggtgactcatcctcgacgtgactcatcctcctagtgactcatcctcactgtgactcatcctctgcgtgactcatcctcgtagtgactcatcctcggcgcgccatgcttcatcagactct

SEQ ID NO: 9659 - DNA, 196 bp, Artificial Sequence; identical to SEQ ID NO: 9658
  Synthetic polynucleotide

SEQ ID NO: 9660 - DNA, 180 bp, Artificial Sequence
  Synthetic polynucleotide
atcatctcaccttgcctcctgcccgataatacattggacctgcaggagagcacgtggagaagagcacgtggtcgagagcacgtgggacagagcacgtggctaagagcacgtggactagagcacgtggtgcagagcacgtgggtaagagcacgtggggcgcgccatgcttcatcagactct

SEQ ID NO: 9661 - DNA, 180 bp, Artificial Sequence; identical to SEQ ID NO: 9660
  Synthetic polynucleotide

SEQ ID NO: 9662 - DNA, 197 bp, Artificial Sequence
  Synthetic polynucleotide
atcatctcaccttgcctcctgtgtgacgaatcgtgacacctgcaggcggtttaaaaataacccaagacggtttaaaaataacccatcgcggtttaaaaataacccagaccggtttaaaaataacccactacggtttaaaaataacccaactcggtttaaaaataacccatgcggcgcgccatgcttcatcagactct

SEQ ID NO: 9663 - DNA, 197 bp, Artificial Sequence; identical to SEQ ID NO: 9662
  Synthetic polynucleotide

SEQ ID NO: 9664 - DNA, 185 bp, Artificial Sequence
  Synthetic polynucleotide
atcatctcaccttgcctcctgaaggaccagacacaagtcctgcaggccctccgcctgggggcagaccctccgcctgggggctcgccctccgcctgggggcgacccctccgcctgggggcctaccctccgcctgggggcactccctccgcctgggggctgcggcgcgccatgcttcatcagactct

SEQ ID NO: 9665 - DNA, 185 bp, Artificial Sequence; identical to SEQ ID NO: 9664
  Synthetic polynucleotide

SEQ ID NO: 9666 - DNA, 172 bp, Artificial Sequence
  Synthetic polynucleotide
atcatctcaccttgcctcctgatatgctttcgagggcgcctgcaggattggcgcgcagaattggcgcgctcgattggcgcgcgacattggcgcgcctaattggcgcgcactattggcgcgctgcattggcgcgcgtaattggcgcgcggcgcgccatgcttcatcagactct

SEQ ID NO: 9667 - DNA, 172 bp, Artificial Sequence; identical to SEQ ID NO: 9666
  Synthetic polynucleotide

SEQ ID NO: 9668 - DNA, 172 bp, Artificial Sequence
  Synthetic polynucleotide
atcatctcaccttgcctcctgaggtatattcaagctggcctgcagggccaattagcagagccaattagctcggccaattagcgacgccaattagcctagccaattagcactgccaattagctgcgccaattagcgtagccaattagcggcgcgccatgcttcatcagactct

SEQ ID NO: 9669 - DNA, 172 bp, Artificial Sequence; identical to SEQ ID NO: 9668
  Synthetic polynucleotide

SEQ ID NO: 9670 - DNA, 198 bp, Artificial Sequence
  Synthetic polynucleotide
atcatctcaccttgcctcctggagttgactcgcatctccctgcaggttatgattatgcaaattaaaagaagattatgattatgcaaattaaaagatcgttatgattatgcaaattaaaagagacttatgattatgcaaattaaaagactattatgattatgcaaattaaaagaggcgcgccatgcttcatcagactct

SEQ ID NO: 9671 - DNA, 198 bp, Artificial Sequence; identical to SEQ ID NO: 9670
  Synthetic polynucleotide

SEQ ID NO: 9672 - DNA, 190 bp, Artificial Sequence
  Synthetic polynucleotide
atcatctcaccttgcctcctgaagtacagatcgtagagcctgcaggggtagggaaaccccagaggtagggaaacccctcgggtagggaaaccccgacggtagggaaaccccctaggtagggaaaccccactggtagggaaacccctgcggtagggaaaccccgtaggcgcgccatgcttcatcagactct

SEQ ID NO: 9673 - DNA, 190 bp, Artificial Sequence; identical to SEQ ID NO: 9672
  Synthetic polynucleotide

SEQ ID NO: 9674 - DNA, 172 bp, Artificial Sequence
  Synthetic polynucleotide
atcatctcaccttgcctcctgacccttgttcagaagtccctgcaggcacgtggcccagacacgtggccctcgcacgtggcccgaccacgtggcccctacacgtggcccactcacgtggccctgccacgtggcccgtacacgtggcccggcgcgccatgcttcatcagactct

SEQ ID NO: 9675 - DNA, 172 bp, Artificial Sequence; identical to SEQ ID NO: 9674
  Synthetic polynucleotide

SEQ ID NO: 9676 - DNA, 156 bp, Artificial Sequence
  Synthetic polynucleotide
atcatctcaccttgcctcctggcctattactgattgctcctgcaggagtggggaagaagtggggatcgagtggggagacagtggggactaagtggggaactagtggggatgcagtggggagtaagtggggaggcgcgccatgcttcatcagactct

SEQ ID NO: 9677 - DNA, 156 bp, Artificial Sequence; identical to SEQ ID NO: 9676
  Synthetic polynucleotide

SEQ ID NO: 9678 - DNA, 180 bp, Artificial Sequence
  Synthetic polynucleotide
atcatctcaccttgcctcctgagtgtcgcatgcttcgacctgcaggcacttccggcgagacacttccggcgtcgcacttccggcggaccacttccggcgctacacttccggcgactcacttccggcgtgccacttccggcggtacacttccggcgggcgcgccatgcttcatcagactct

SEQ ID NO: 9679 - DNA, 180 bp, Artificial Sequence; identical to SEQ ID NO: 9678
  Synthetic polynucleotide

SEQ ID NO: 9680 - DNA, 172 bp, Artificial Sequence
  Synthetic polynucleotide
atcatctcaccttgcctcctgttgagaggactcgctggcctgcaggccgtaccaccagaccgtaccacctcgccgtaccaccgacccgtaccaccctaccgtaccaccactccgtaccacctgcccgtaccaccgtaccgtaccaccggcgcgccatgcttcatcagactct

SEQ ID NO: 9681 - DNA, 172 bp, Artificial Sequence; identical to SEQ ID NO: 9680
  Synthetic polynucleotide

SEQ ID NO: 9682 - DNA, 156 bp, Artificial Sequence
  Synthetic polynucleotide
atcatctcaccttgcctcctgagagttccttgcggtcccctgcagggcaggtgtagagcaggtgttcggcaggtgtgacgcaggtgtctagcaggtgtactgcaggtgttgcgcaggtgtgtagcaggtgtggcgcgccatgcttcatcagactct

SEQ ID NO: 9683 - DNA, 156 bp, Artificial Sequence; identical to SEQ ID NO: 9682
  Synthetic polynucleotide

SEQ ID NO: 9684 - DNA, 172 bp, Artificial Sequence
  Synthetic polynucleotide
atcatctcaccttgcctcctgtgcaaatgacgaggcgacctgcaggatgataccccagaatgatacccctcgatgataccccgacatgataccccctaatgataccccactatgatacccctgcatgataccccgtaatgataccccggcgcgccatgcttcatcagactct

SEQ ID NO: 9685 - DNA, 172 bp, Artificial Sequence; identical to SEQ ID NO: 9684
  Synthetic polynucleotide

SEQ ID NO: 9686 - DNA, 196 bp, Artificial Sequence
  Synthetic polynucleotide
atcatctcaccttgcctcctgagactgataccatcaaccctgcaggaataaagaacaatagaatttcaagaaataaagaacaatagaatttcatcgaataaagaacaatagaatttcagacaataaagaacaatagaatttcactaaataaagaacaatagaatttcaactggcgcgccatgcttcatcagactct

SEQ ID NO: 9687 - DNA, 196 bp, Artificial Sequence; identical to SEQ ID NO: 9686
  Synthetic polynucleotide

SEQ ID NO: 9688 - DNA, 180 bp, Artificial Sequence
  Synthetic polynucleotide
atcatctcaccttgcctcctgtatttctacgcaagatccctgcaggcacttccggccagacacttccggcctcgcacttccggccgaccacttccggccctacacttccggccactcacttccggcctgccacttccggccgtacacttccggccggcgcgccatgcttcatcagactct

SEQ ID NO: 9689 - DNA, 180 bp, Artificial Sequence; identical to SEQ ID NO: 9688
  Synthetic polynucleotide

SEQ ID NO: 9690 - DNA, 190 bp, Artificial Sequence
  Synthetic polynucleotide
atcatctcaccttgcctcctgaagacgcccttcagaatcctgcaggtgacagttttatggagatgacagttttatggtcgtgacagttttatgggactgacagttttatggctatgacagttttatggacttgacagttttatggtgctgacagttttatgggtaggcgcgccatgcttcatcagactct

SEQ ID NO: 9691 - DNA, 190 bp, Artificial Sequence; identical to SEQ ID NO: 9690
  Synthetic polynucleotide

SEQ ID NO: 9692 - DNA, 190 bp, Artificial Sequence
  Synthetic polynucleotide
atcatctcaccttgcctcctgaagtgcttgccatagcgcctgcagggaccccccgcgaagagagaccccccgcgaagtcggaccccccgcgaaggacgaccccccgcgaagctagaccccccgcgaagactgaccccccgcgaagtgcgaccccccgcgaaggtaggcgcgccatgcttcatcagactct

SEQ ID NO: 9693 - DNA, 190 bp, Artificial Sequence; identical to SEQ ID NO: 9692
  Synthetic polynucleotide

SEQ ID NO: 9694 - DNA, 191 bp, Artificial Sequence
  Synthetic polynucleotide
atcatctcaccttgcctcctggcagcgcaatactgttacctgcaggttttaagtacttaaattagattttaagtacttaaatttcgttttaagtacttaaattgacttttaagtacttaaattctattttaagtacttaaattactttttaagtacttaaatttgcggcgcgccatgcttcatcagactct

SEQ ID NO: 9695 - DNA, 191 bp, Artificial Sequence; identical to SEQ ID NO: 9694
  Synthetic polynucleotide

SEQ ID NO: 9696 - DNA, 196 bp, Artificial Sequence
  Synthetic polynucleotide
atcatctcaccttgcctcctgcaatgttgtgttcgctccctgcaggaatatgcgggtttagaaatatgcgggttttcgaatatgcgggtttgacaatatgcgggtttctaaatatgcgggtttactaatatgcgggttttgcaatatgcgggtttgtaaatatgcgggtttggcgcgccatgcttcatcagactct

SEQ ID NO: 9697 - DNA, 196 bp, Artificial Sequence; identical to SEQ ID NO: 9696
  Synthetic polynucleotide

SEQ ID NO: 9698 - DNA, 156 bp, Artificial Sequence
  Synthetic polynucleotide
atcatctcaccttgcctcctgcagagccttgtctaggccctgcaggaaaaacaaagaaaaaacaatcgaaaaacaagacaaaaacaactaaaaaacaaactaaaaacaatgcaaaaacaagtaaaaaacaaggcgcgccatgcttcatcagactct

SEQ ID NO: 9699 - DNA, 156 bp, Artificial Sequence; identical to SEQ ID NO: 9698
  Synthetic polynucleotide

SEQ ID NO: 9700 - DNA, 196 bp, Artificial Sequence
  Synthetic polynucleotide
atcatctcaccttgcctcctgctgctgagataagatggcctgcaggcagctcattaataagacagctcattaatatcgcagctcattaatagaccagctcattaatactacagctcattaataactcagctcattaatatgccagctcattaatagtacagctcattaataggcgcgccatgcttcatcagactct

SEQ ID NO: 9701 - DNA, 196 bp, Artificial Sequence; identical to SEQ ID NO: 9700
  Synthetic polynucleotide

SEQ ID NO: 9702 - DNA, 164 bp, Artificial Sequence
  Synthetic polynucleotide
atcatctcaccttgcctcctgatgtgtcctgaatccttcctgcaggattacatcaagaattacatcatcgattacatcagacattacatcactaattacatcaactattacatcatgcattacatcagtaattacatcaggcgcgccatgcttcatcagactct

SEQ ID NO: 9703 - DNA, 164 bp, Artificial Sequence; identical to SEQ ID NO: 9702
  Synthetic polynucleotide

SEQ ID NO: 9704 - DNA, 164 bp, Artificial Sequence
  Synthetic polynucleotide
atcatctcaccttgcctcctgaatggaggtatagcgcgcctgcagggctaatcccagagctaatccctcggctaatcccgacgctaatcccctagctaatcccactgctaatccctgcgctaatcccgtagctaatcccggcgcgccatgcttcatcagactct

SEQ ID NO: 9705 - DNA, 164 bp, Artificial Sequence; identical to SEQ ID NO: 9704
  Synthetic polynucleotide

SEQ ID NO: 9706 - DNA, 180 bp, Artificial Sequence
  Synthetic polynucleotide
atcatctcaccttgcctcctgcacctacattccaattacctgcaggttatccctataagattatccctatatcgttatccctatagacttatccctatactattatccctataactttatccctatatgcttatccctatagtattatccctataggcgcgccatgcttcatcagactct

SEQ ID NO: 9707 - DNA, 180 bp, Artificial Sequence; identical to SEQ ID NO: 9706
  Synthetic polynucleotide

SEQ ID NO: 9708 - DNA, 190 bp, Artificial Sequence
  Synthetic polynucleotide
atcatctcaccttgcctcctgatccgaataagtcgcatcctgcaggtgacagttttatgaagatgacagttttatgatcgtgacagttttatgagactgacagttttatgactatgacagttttatgaacttgacagttttatgatgctgacagttttatgagtaggcgcgccatgcttcatcagactct

SEQ ID NO: 9709 - DNA, 190 bp, Artificial Sequence; identical to SEQ ID NO: 9708
  Synthetic polynucleotide

SEQ ID NO: 9710 - DNA, 197 bp, Artificial Sequence
  Synthetic polynucleotide
atcatctcaccttgcctcctggattgatggttgcgtaacctgcagggagaaactgaaactgagagagaaactgaaactgtcggagaaactgaaactggacgagaaactgaaactgctagagaaactgaaactgactgagaaactgaaactgtgcgagaaactgaaactggtaggcgcgccatgcttcatcagactct

SEQ ID NO: 9711 - DNA, 197 bp, Artificial Sequence; identical to SEQ ID NO: 9710
  Synthetic polynucleotide

SEQ ID NO: 9712 - DNA, 196 bp, Artificial Sequence
  Synthetic polynucleotide
atcatctcaccttgcctcctgctagcttatatcacctgcctgcaggggtattcccagtaagaggtattcccagtatcgggtattcccagtagacggtattcccagtactaggtattcccagtaactggtattcccagtatgcggtattcccagtagtaggtattcccagtaggcgcgccatgcttcatcagactct

SEQ ID NO: 9713 - DNA, 196 bp, Artificial Sequence; identical to SEQ ID NO: 9712
  Synthetic polynucleotide

SEQ ID NO: 9714 - DNA, 188 bp, Artificial Sequence
  Synthetic polynucleotide
atcatctcaccttgcctcctgacccactgatacgagctcctgcaggtgcccgggggcaagatgcccgggggcatcgtgcccgggggcagactgcccgggggcactatgcccgggggcaacttgcccgggggcatgctgcccgggggcagtatgcccgggggcaggcgcgccatgcttcatcagactct

SEQ ID NO: 9715 - DNA, 188 bp, Artificial Sequence; identical to SEQ ID NO: 9714
  Synthetic polynucleotide

SEQ ID NO: 9716 - DNA, 190 bp, Artificial Sequence
  Synthetic polynucleotide
atcatctcaccttgcctcctgtcaacgccgcaacaaggcctgcaggataatttgcatattagaataatttgcatatttcgataatttgcatattgacataatttgcatattctaataatttgcatattactataatttgcatatttgcataatttgcatattgtaggcgcgccatgcttcatcagactct

SEQ ID NO: 9717 - DNA, 190 bp, Artificial Sequence; identical to SEQ ID NO: 9716
  Synthetic polynucleotide

SEQ ID NO: 9718 - DNA, 164 bp, Artificial Sequence
  Synthetic polynucleotide
atcatctcaccttgcctcctgttgtgtgaggtgatagacctgcaggcaggtgaggagacaggtgaggtcgcaggtgagggaccaggtgaggctacaggtgaggactcaggtgaggtgccaggtgagggtacaggtgaggggcgcgccatgcttcatcagactct

SEQ ID NO: 9719 - DNA, 164 bp, Artificial Sequence; identical to SEQ ID NO: 9718
  Synthetic polynucleotide

SEQ ID NO: 9720 - DNA, 164 bp, Artificial Sequence
  Synthetic polynucleotide
atcatctcaccttgcctcctgtcatgatgggcagccgacctgcaggttacgcaaaagattacgcaaatcgttacgcaaagacttacgcaaactattacgcaaaactttacgcaaatgcttacgcaaagtattacgcaaaggcgcgccatgcttcatcagactct

SEQ ID NO: 9721 - DNA, 164 bp, Artificial Sequence; identical to SEQ ID NO: 9720
  Synthetic polynucleotide

SEQ ID NO: 9722 - DNA, 164 bp, Artificial Sequence
  Synthetic polynucleotide
atcatctcaccttgcctcctgaaatacatgccaacgttcctgcaggtgcgtgcggagatgcgtgcggtcgtgcgtgcgggactgcgtgcggctatgcgtgcggacttgcgtgcggtgctgcgtgcgggtatgcgtgcggggcgcgccatgcttcatcagactct

SEQ ID NO: 9723 - DNA, 164 bp, Artificial Sequence; identical to SEQ ID NO: 9722
  Synthetic polynucleotide

SEQ ID NO: 9724 - DNA, 148 bp, Artificial Sequence
  Synthetic polynucleotide
atcatctcaccttgcctcctgatgtctcaccttagacccctgcaggcacgtggagacacgtggtcgcacgtgggaccacgtggctacacgtggactcacgtggtgccacgtgggtacacgtggggcgcgccatgcttcatcagactct

SEQ ID NO: 9725 - DNA, 148 bp, Artificial Sequence; identical to SEQ ID NO: 9724
  Synthetic polynucleotide

SEQ ID NO: 9726 - DNA, 156 bp, Artificial Sequence
  Synthetic polynucleotide
atcatctcaccttgcctcctgaaattgcgtcatggtcccctgcaggcgtgacctagacgtgaccttcgcgtgacctgaccgtgacctctacgtgacctactcgtgaccttgccgtgacctgtacgtgacctggcgcgccatgcttcatcagactct

SEQ ID NO: 9727 - DNA, 156 bp, Artificial Sequence; identical to SEQ ID NO: 9726
  Synthetic polynucleotide

SEQ ID NO: 9728 - DNA, 191 bp, Artificial Sequence
  Synthetic polynucleotide
atcatctcaccttgcctcctggttagaccggaagttgccctgcaggggacagctgttcagtttcctgagaggacagctgttcagtttcctgtcgggacagctgttcagtttcctggacggacagctgttcagtttcctgctaggacagctgttcagtttcctgactggcgcgccatgcttcatcagactct

SEQ ID NO: 9729 - DNA, 191 bp, Artificial Sequence; identical to SEQ ID NO: 9728
  Synthetic polynucleotide

SEQ ID NO: 9730 - DNA, 188 bp, Artificial Sequence
  Synthetic polynucleotide
atcatctcaccttgcctcctgtcgtaagtccggtcctccctgcagggattgtttgtttagagattgtttgttttcggattgtttgtttgacgattgtttgtttctagattgtttgtttactgattgtttgttttgcgattgtttgtttgtagattgtttgtttggcgcgccatgcttcatcagactct

SEQ ID NO: 9731 - DNA, 188 bp, Artificial Sequence; identical to SEQ ID NO: 9730
  Synthetic polynucleotide

SEQ ID NO: 9732 - DNA, 172 bp, Artificial Sequence
  Synthetic polynucleotide
atcatctcaccttgcctcctgacgttcgggagtttaaccctgcaggaatttaaattagaaatttaaatttcgaatttaaattgacaatttaaattctaaatttaaattactaatttaaatttgcaatttaaattgtaaatttaaattggcgcgccatgcttcatcagactct

SEQ ID NO: 9733 - DNA, 172 bp, Artificial Sequence; identical to SEQ ID NO: 9732
  Synthetic polynucleotide

SEQ ID NO: 9734 - DNA, 148 bp, Artificial Sequence
  Synthetic polynucleotide
atcatctcaccttgcctcctgattccgtcggtctacatcctgcaggcacgtgcagacacgtgctcgcacgtgcgaccacgtgcctacacgtgcactcacgtgctgccacgtgcgtacacgtgcggcgcgccatgcttcatcagactct

SEQ ID NO: 9735 - DNA, 148 bp, Artificial Sequence; identical to SEQ ID NO: 9734
  Synthetic polynucleotide

SEQ ID NO: 9736 - DNA, 148 bp, Artificial Sequence
  Synthetic polynucleotide
atcatctcaccttgcctcctgttgagggtgggtaactacctgcaggcacgtgaagacacgtgatcgcacgtgagaccacgtgactacacgtgaactcacgtgatgccacgtgagtacacgtgaggcgcgccatgcttcatcagactct

SEQ ID NO: 9737 - DNA, 148 bp, Artificial Sequence; identical to SEQ ID NO: 9736
  Synthetic polynucleotide

SEQ ID NO: 9738 - DNA, 180 bp, Artificial Sequence
  Synthetic polynucleotide
atcatctcaccttgcctcctgtggaggatcggacttggcctgcaggtgcctgaggcgagatgcctgaggcgtcgtgcctgaggcggactgcctgaggcgctatgcctgaggcgacttgcctgaggcgtgctgcctgaggcggtatgcctgaggcgggcgcgccatgcttcatcagactct

SEQ ID NO: 9739 - DNA, 180 bp, Artificial Sequence; identical to SEQ ID NO: 9738
  Synthetic polynucleotide

SEQ ID NO: 9740 - DNA, 164 bp, Artificial Sequence
  Synthetic polynucleotide
atcatctcaccttgcctcctgtctccatccagcaatgccctgcaggaaacaaattagaaaacaaatttcgaaacaaattgacaaacaaattctaaaacaaattactaaacaaatttgcaaacaaattgtaaaacaaattggcgcgccatgcttcatcagactct

SEQ ID NO: 9741 - DNA, 164 bp, Artificial Sequence; identical to SEQ ID NO: 9740
  Synthetic polynucleotide

SEQ ID NO: 9742 - DNA, 172 bp, Artificial Sequence
  Synthetic polynucleotide
atcatctcaccttgcctcctgaaatgttggcctacaaacctgcaggatggaatgtgagaatggaatgtgtcgatggaatgtggacatggaatgtgctaatggaatgtgactatggaatgtgtgcatggaatgtggtaatggaatgtgggcgcgccatgcttcatcagactct

SEQ ID NO: 9743 - DNA, 172 bp, Artificial Sequence; identical to SEQ ID NO: 9742
  Synthetic polynucleotide

SEQ ID NO: 9744 - DNA, 172 bp, Artificial Sequence
  Synthetic polynucleotide
atcatctcaccttgcctcctgtgaaggccatagttgtacctgcagggggcaatagaagagggcaatagatcggggcaatagagacgggcaatagactagggcaatagaactgggcaatagatgcgggcaatagagtagggcaatagaggcgcgccatgcttcatcagactct

SEQ ID NO: 9745 - DNA, 172 bp, Artificial Sequence; identical to SEQ ID NO: 9744
  Synthetic polynucleotide

SEQ ID NO: 9746 - DNA, 172 bp, Artificial Sequence
  Synthetic polynucleotide
atcatctcaccttgcctcctgtggttagctgagagtggcctgcaggtgtttatttaagatgtttatttatcgtgtttatttagactgtttatttactatgtttatttaacttgtttatttatgctgtttatttagtatgtttatttaggcgcgccatgcttcatcagactct

SEQ ID NO: 9747 - DNA, 172 bp, Artificial Sequence; identical to SEQ ID NO: 9746
  Synthetic polynucleotide

SEQ ID NO: 9748 - DNA, 185 bp, Artificial Sequence
  Synthetic polynucleotide
atcatctcaccttgcctcctgtgggacctaatagcaatcctgcaggactcctaattagtcgtagaactcctaattagtcgttcgactcctaattagtcgtgacactcctaattagtcgtctaactcctaattagtcgtactactcctaattagtcgttgcggcgcgccatgcttcatcagactct

SEQ ID NO: 9749 - DNA, 185 bp, Artificial Sequence; identical to SEQ ID NO: 9748
  Synthetic polynucleotide

SEQ ID NO: 9750 - DNA, 191 bp, Artificial Sequence
  Synthetic polynucleotide
atcatctcaccttgcctcctgctcttgtcaggtgtgtacctgcaggcagatgtgcacatacgtagacagatgtgcacatacgttcgcagatgtgcacatacgtgaccagatgtgcacatacgtctacagatgtgcacatacgtactcagatgtgcacatacgttgcggcgcgccatgcttcatcagactct

SEQ ID NO: 9751 - DNA, 191 bp, Artificial Sequence; identical to SEQ ID NO: 9750
  Synthetic polynucleotide

SEQ ID NO: 9752 - DNA, 185 bp, Artificial Sequence
  Synthetic polynucleotide
atcatctcaccttgcctcctgtgctactggaggagggtcctgcaggggtgtgaattcacaccagaggtgtgaattcacacctcgggtgtgaattcacaccgacggtgtgaattcacaccctaggtgtgaattcacaccactggtgtgaattcacacctgcggcgcgccatgcttcatcagactct

SEQ ID NO: 9753 - DNA, 185 bp, Artificial Sequence; identical to SEQ ID NO: 9752
  Synthetic polynucleotide

SEQ ID NO: 9754 - DNA, 164 bp, Artificial Sequence
  Synthetic polynucleotide
atcatctcaccttgcctcctgtccaggccataatgtctcctgcaggttacgcaatagattacgcaattcgttacgcaatgacttacgcaatctattacgcaatactttacgcaattgcttacgcaatgtattacgcaatggcgcgccatgcttcatcagactct

SEQ ID NO: 9755 - DNA, 164 bp, Artificial Sequence; identical to SEQ ID NO: 9754
  Synthetic polynucleotide

SEQ ID NO: 9756 - DNA, 172 bp, Artificial Sequence
  Synthetic polynucleotide
atcatctcaccttgcctcctgtcggttaacccaaccaacctgcaggggccgcggggagaggccgcggggtcgggccgcgggggacggccgcggggctaggccgcggggactggccgcggggtgcggccgcgggggtaggccgcggggggcgcgccatgcttcatcagactct

SEQ ID NO: 9757 - DNA, 172 bp, Artificial Sequence; identical to SEQ ID NO: 9756
  Synthetic polynucleotide

SEQ ID NO: 9758 - DNA, 172 bp, Artificial Sequence
  Synthetic polynucleotide
atcatctcaccttgcctcctgtaaagccgaagcctccgcctgcaggtgatggatggagatgatggatggtcgtgatggatgggactgatggatggctatgatggatggacttgatggatggtgctgatggatgggtatgatggatggggcgcgccatgcttcatcagactct

SEQ ID NO: 9759 - DNA, 172 bp, Artificial Sequence; identical to SEQ ID NO: 9758
  Synthetic polynucleotide

SEQ ID NO: 9760 - DNA, 164 bp, Artificial Sequence
  Synthetic polynucleotide
atcatctcaccttgcctcctgtcagaaggatcacgaatcctgcagggctaattggagagctaattggtcggctaattgggacgctaattggctagctaattggactgctaattggtgcgctaattgggtagctaattggggcgcgccatgcttcatcagactct

SEQ ID NO: 9761 - DNA, 164 bp, Artificial Sequence; identical to SEQ ID NO: 9760
  Synthetic polynucleotide

SEQ ID NO: 9762 - DNA, 196 bp, Artificial Sequence
  Synthetic polynucleotide
atcatctcaccttgcctcctgagatgggatagcccgcacctgcaggtcaataacattgaagatcaataacattgatcgtcaataacattgagactcaataacattgactatcaataacattgaacttcaataacattgatgctcaataacattgagtatcaataacattgaggcgcgccatgcttcatcagactct

SEQ ID NO: 9763 - DNA, 196 bp, Artificial Sequence; identical to SEQ ID NO: 9762
  Synthetic polynucleotide

SEQ ID NO: 9764 - DNA, 188 bp, Artificial Sequence
  Synthetic polynucleotide
atcatctcaccttgcctcctgccggagtactgaatactcctgcaggctgcgcatgcgcagactgcgcatgcgctcgctgcgcatgcgcgacctgcgcatgcgcctactgcgcatgcgcactctgcgcatgcgctgcctgcgcatgcgcgtactgcgcatgcgcggcgcgccatgcttcatcagactct

SEQ ID NO: 9765 - DNA, 188 bp, Artificial Sequence; identical to SEQ ID NO: 9764
  Synthetic polynucleotide

SEQ ID NO: 9766 - DNA, 172 bp, Artificial Sequence
  Synthetic polynucleotide
atcatctcaccttgcctcctgagtcacgccaagaaggtcctgcaggggcacgtgtcagaggcacgtgtctcgggcacgtgtcgacggcacgtgtcctaggcacgtgtcactggcacgtgtctgcggcacgtgtcgtaggcacgtgtcggcgcgccatgcttcatcagactct

SEQ ID NO: 9767 - DNA, 172 bp, Artificial Sequence; identical to SEQ ID NO: 9766
  Synthetic polynucleotide

SEQ ID NO: 9768 - DNA, 185 bp, Artificial Sequence
  Synthetic polynucleotide
atcatctcaccttgcctcctgtagcaatgcgcctcctccctgcaggctgaggtaattacctcagactgaggtaattacctctcgctgaggtaattacctcgacctgaggtaattacctcctactgaggtaattacctcactctgaggtaattacctctgcggcgcgccatgcttcatcagactct

SEQ ID NO: 9769 - DNA, 185 bp, Artificial Sequence; identical to SEQ ID NO: 9768
  Synthetic polynucleotide

SEQ ID NO: 9770 - DNA, 164 bp, Artificial Sequence
  Synthetic polynucleotide
atcatctcaccttgcctcctggcgtagcaaattatcgacctgcaggagatggccgagaagatggccgtcgagatggccggacagatggccgctaagatggccgactagatggccgtgcagatggccggtaagatggccgggcgcgccatgcttcatcagactct

SEQ ID NO: 9771 - DNA, 164 bp, Artificial Sequence; identical to SEQ ID NO: 9770
  Synthetic polynucleotide

SEQ ID NO: 9772 - DNA, 172 bp, Artificial Sequence
  Synthetic polynucleotide
atcatctcaccttgcctcctgaactccgtctatggccccctgcagggccatatgttagagccatatgtttcggccatatgttgacgccatatgttctagccatatgttactgccatatgtttgcgccatatgttgtagccatatgttggcgcgccatgcttcatcagactct

SEQ ID NO: 9773 - DNA, 172 bp, Artificial Sequence; identical to SEQ ID NO: 9772
  Synthetic polynucleotide

SEQ ID NO: 9774 - DNA, 185 bp, Artificial Sequence
  Synthetic polynucleotide
atcatctcaccttgcctcctgagagggtagggttgcagcctgcaggctgaggtaattacctgagactgaggtaattacctgtcgctgaggtaattacctggacctgaggtaattacctgctactgaggtaattacctgactctgaggtaattacctgtgcggcgcgccatgcttcatcagactct

SEQ ID NO: 9775 - DNA, 185 bp, Artificial Sequence; identical to SEQ ID NO: 9774
  Synthetic polynucleotide

SEQ ID NO: 9776 - DNA, 172 bp, Artificial Sequence
  Synthetic polynucleotide
atcatctcaccttgcctcctgtttactcatgcatttgccctgcagggtcagcaattagagtcagcaatttcggtcagcaattgacgtcagcaattctagtcagcaattactgtcagcaatttgcgtcagcaattgtagtcagcaattggcgcgccatgcttcatcagactct

SEQ ID NO: 9777 - DNA, 172 bp, Artificial Sequence; identical to SEQ ID NO: 9776
  Synthetic polynucleotide

SEQ ID NO: 9778 - DNA, 188 bp, Artificial Sequence
  Synthetic polynucleotide
atcatctcaccttgcctcctgctacacccatcgtcgaccctgcaggtggggatttcccagatggggatttccctcgtggggatttcccgactggggatttcccctatggggatttcccacttggggatttccctgctggggatttcccgtatggggatttcccggcgcgccatgcttcatcagactct

SEQ ID NO: 9779 - DNA, 188 bp, Artificial Sequence; identical to SEQ ID NO: 9778
  Synthetic polynucleotide

SEQ ID NO: 9780 - DNA, 191 bp, Artificial Sequence
  Synthetic polynucleotide
atcatctcaccttgcctcctgagggttactagcacacgcctgcaggaaaatgctgagtcagcattttagaaaaatgctgagtcagcatttttcgaaaatgctgagtcagcattttgacaaaatgctgagtcagcattttctaaaaatgctgagtcagcattttactggcgcgccatgcttcatcagactct

SEQ ID NO: 9781 - DNA, 191 bp, Artificial Sequence; identical to SEQ ID NO: 9780
  Synthetic polynucleotide

SEQ ID NO: 9782 - DNA, 156 bp, Artificial Sequence
  Synthetic polynucleotide
atcatctcaccttgcctcctgaattatcaaccctcggacctgcaggaccgcttcagaaccgcttctcgaccgcttcgacaccgcttcctaaccgcttcactaccgcttctgcaccgcttcgtaaccgcttcggcgcgccatgcttcatcagactct

SEQ ID NO: 9783 - DNA, 156 bp, Artificial Sequence; identical to SEQ ID NO: 9782
  Synthetic polynucleotide

SEQ ID NO: 9784 - DNA, 199 bp, Artificial Sequence
  Synthetic polynucleotide
atcatctcaccttgcctcctgccgggatacgcgatatacctgcaggttgtattgaagctaaagtttgatctgttcagattgtattgaagctaaagtttgatctgttctcgttgtattgaagctaaagtttgatctgttcgacttgtattgaagctaaagtttgatctgttcctaggcgcgccatgcttcatcagactct

SEQ ID NO: 9785 - DNA, 199 bp, Artificial Sequence; identical to SEQ ID NO: 9784
  Synthetic polynucleotide

SEQ ID NO: 9786 - DNA, 188 bp, Artificial Sequence
  Synthetic polynucleotide
atcatctcaccttgcctcctgaggacaagaaatgcgagcctgcagggcgaccaccgaaagagcgaccaccgaatcggcgaccaccgaagacgcgaccaccgaactagcgaccaccgaaactgcgaccaccgaatgcgcgaccaccgaagtagcgaccaccgaaggcgcgccatgcttcatcagactct

SEQ ID NO: 9787 - DNA, 188 bp, Artificial Sequence; identical to SEQ ID NO: 9786
  Synthetic polynucleotide

SEQ ID NO: 9788 - DNA, 190 bp, Artificial Sequence
  Synthetic polynucleotide
atcatctcaccttgcctcctggagtcgaaacgactccgcctgcaggaatgcgtgggcgtaagaaatgcgtgggcgtatcgaatgcgtgggcgtagacaatgcgtgggcgtactaaatgcgtgggcgtaactaatgcgtgggcgtatgcaatgcgtgggcgtagtaggcgcgccatgcttcatcagactct

SEQ ID NO: 9789 - DNA, 190 bp, Artificial Sequence; identical to SEQ ID NO: 9788
  Synthetic polynucleotide

SEQ ID NO: 9790 - DNA, 172 bp, Artificial Sequence
  Synthetic polynucleotide
atcatctcaccttgcctcctgcactcagaagaagtattcctgcaggcatccatcaaagacatccatcaatcgcatccatcaagaccatccatcaactacatccatcaaactcatccatcaatgccatccatcaagtacatccatcaaggcgcgccatgcttcatcagactct

SEQ ID NO: 9791 - DNA, 172 bp, Artificial Sequence; identical to SEQ ID NO: 9790
  Synthetic polynucleotide

SEQ ID NO: 9792 - DNA, 172 bp, Artificial Sequence
  Synthetic polynucleotide
atcatctcaccttgcctcctgtggagttatccgtcgcccctgcaggcttcctggaaagacttcctggaatcgcttcctggaagaccttcctggaactacttcctggaaactcttcctggaatgccttcctggaagtacttcctggaaggcgcgccatgcttcatcagactct

SEQ ID NO: 9793 - DNA, 172 bp, Artificial Sequence; identical to SEQ ID NO: 9792
  Synthetic polynucleotide

SEQ ID NO: 9794 - DNA, 172 bp, Artificial Sequence
  Synthetic polynucleotide
atcatctcaccttgcctcctgtgagtggtgagtctatccctgcaggagcaattagcagaagcaattagctcgagcaattagcgacagcaattagcctaagcaattagcactagcaattagctgcagcaattagcgtaagcaattagcggcgcgccatgcttcatcagactct

SEQ ID NO: 9795 - DNA, 172 bp, Artificial Sequence; identical to SEQ ID NO: 9794
  Synthetic polynucleotide

SEQ ID NO: 9796 - DNA, 172 bp, Artificial Sequence
  Synthetic polynucleotide
atcatctcaccttgcctcctgagagcttctatgtctaccctgcaggaaggtgtgagagaaaggtgtgagtcgaaggtgtgaggacaaggtgtgagctaaaggtgtgagactaaggtgtgagtgcaaggtgtgaggtaaaggtgtgagggcgcgccatgcttcatcagactct

SEQ ID NO: 9797 - DNA, 172 bp, Artificial Sequence; identical to SEQ ID NO: 9796
  Synthetic polynucleotide

SEQ ID NO: 9798 - DNA, 188 bp, Artificial Sequence
  Synthetic polynucleotide
atcatctcaccttgcctcctgtatgttgtgctgcttaccctgcagggctatttttagcagagctatttttagctcggctatttttagcgacgctatttttagcctagctatttttagcactgctatttttagctgcgctatttttagcgtagctatttttagcggcgcgccatgcttcatcagactct

SEQ ID NO: 9799 - DNA, 188 bp, Artificial Sequence; identical to SEQ ID NO: 9798
  Synthetic polynucleotide

SEQ ID NO: 9800 - DNA, 172 bp, Artificial Sequence
  Synthetic polynucleotide
atcatctcaccttgcctcctgctcattgctgcttaacccctgcaggtattacgtaaagatattacgtaatcgtattacgtaagactattacgtaactatattacgtaaacttattacgtaatgctattacgtaagtatattacgtaaggcgcgccatgcttcatcagactct

SEQ ID NO: 9801 - DNA, 172 bp, Artificial Sequence; identical to SEQ ID NO: 9800
  Synthetic polynucleotide

SEQ ID NO: 9802 - DNA, 188 bp, Artificial Sequence
  Synthetic polynucleotide
atcatctcaccttgcctcctgcagccctagataactaccctgcaggggtgacgtaaggagaggtgacgtaaggtcgggtgacgtaagggacggtgacgtaaggctaggtgacgtaaggactggtgacgtaaggtgcggtgacgtaagggtaggtgacgtaaggggcgcgccatgcttcatcagactct

SEQ ID NO: 9803 - DNA, 188 bp, Artificial Sequence; identical to SEQ ID NO: 9802
  Synthetic polynucleotide

SEQ ID NO: 9804 - DNA, 188 bp, Artificial Sequence
  Synthetic polynucleotide
atcatctcaccttgcctcctggaaccattagattagcccctgcaggaatgccagacccagaaatgccagaccctcgaatgccagacccgacaatgccagacccctaaatgccagacccactaatgccagaccctgcaatgccagacccgtaaatgccagacccggcgcgccatgcttcatcagactct

SEQ ID NO: 9805 - DNA, 188 bp, Artificial Sequence; identical to SEQ ID NO: 9804
  Synthetic polynucleotide

SEQ ID NO: 9806 - DNA, 191 bp, Artificial Sequence
  Synthetic polynucleotide
atcatctcaccttgcctcctgtggcgaatcagaacatccctgcaggctgccctcatccaagatggcgagactgccctcatccaagatggcgtcgctgccctcatccaagatggcggacctgccctcatccaagatggcgctactgccctcatccaagatggcgactggcgcgccatgcttcatcagactct

SEQ ID NO: 9807 - DNA, 191 bp, Artificial Sequence; identical to SEQ ID NO: 9806
  Synthetic polynucleotide

SEQ ID NO: 9808 - DNA, 190 bp, Artificial Sequence
  Synthetic polynucleotide
atcatctcaccttgcctcctgtctacatgctttcaaggcctgcagggtaaagataggggaagagtaaagataggggatcggtaaagataggggagacgtaaagataggggactagtaaagataggggaactgtaaagataggggatgcgtaaagataggggagtaggcgcgccatgcttcatcagactct

SEQ ID NO: 9809 - DNA, 190 bp, Artificial Sequence; identical to SEQ ID NO: 9808
  Synthetic polynucleotide

SEQ ID NO: 9810 - DNA, 172 bp, Artificial Sequence
  Synthetic polynucleotide
atcatctcaccttgcctcctgacggtttgcggatcctacctgcaggaaggtgtgaaagaaaggtgtgaatcgaaggtgtgaagacaaggtgtgaactaaaggtgtgaaactaaggtgtgaatgcaaggtgtgaagtaaaggtgtgaaggcgcgccatgcttcatcagactct

SEQ ID NO: 9811 - DNA, 172 bp, Artificial Sequence; identical to SEQ ID NO: 9810
  Synthetic polynucleotide

SEQ ID NO: 9812 - DNA, 180 bp, Artificial Sequence
  Synthetic polynucleotide
atcatctcaccttgcctcctgcactggaatgagtatgtcctgcaggtgcgggggcggagatgcgggggcggtcgtgcgggggcgggactgcgggggcggctatgcgggggcggacttgcgggggcggtgctgcgggggcgggtatgcgggggcggggcgcgccatgcttcatcagactct

SEQ ID NO: 9813 - DNA, 180 bp, Artificial Sequence; identical to SEQ ID NO: 9812
  Synthetic polynucleotide

SEQ ID NO: 9814 - DNA, 164 bp, Artificial Sequence
  Synthetic polynucleotide
atcatctcaccttgcctcctgcaggcagctttcttgctcctgcaggggtggggaaagaggtggggaatcgggtggggaagacggtggggaactaggtggggaaactggtggggaatgcggtggggaagtaggtggggaaggcgcgccatgcttcatcagactct

SEQ ID NO: 9815 - DNA, 164 bp, Artificial Sequence; identical to SEQ ID NO: 9814
  Synthetic polynucleotide

SEQ ID NO: 9816 - DNA, 188 bp, Artificial Sequence
  Synthetic polynucleotide
atcatctcaccttgcctcctgtagaggctgggagaggacctgcaggtattacataacaagatattacataacatcgtattacataacagactattacataacactatattacataacaacttattacataacatgctattacataacagtatattacataacaggcgcgccatgcttcatcagactct

SEQ ID NO: 9817 - DNA, 188 bp, Artificial Sequence; identical to SEQ ID NO: 9816
  Synthetic polynucleotide

SEQ ID NO: 9818 - DNA, 191 bp, Artificial Sequence
  Synthetic polynucleotide
atcatctcaccttgcctcctgatgatggcacaggttaacctgcaggtcttggcaagtatccaaagatcttggcaagtatccaatcgtcttggcaagtatccaagactcttggcaagtatccaactatcttggcaagtatccaaacttcttggcaagtatccaatgcggcgcgccatgcttcatcagactct

SEQ ID NO: 9819 - DNA, 191 bp, Artificial Sequence; identical to SEQ ID NO: 9818
  Synthetic polynucleotide

SEQ ID NO: 9820 - DNA, 172 bp, Artificial Sequence
  Synthetic polynucleotide
atcatctcaccttgcctcctgaacgctcattcccaggccctgcaggtgggcgtggcagatgggcgtggctcgtgggcgtggcgactgggcgtggcctatgggcgtggcacttgggcgtggctgctgggcgtggcgtatgggcgtggcggcgcgccatgcttcatcagactct

SEQ ID NO: 9821 - DNA, 172 bp, Artificial Sequence; identical to SEQ ID NO: 9820
  Synthetic polynucleotide

SEQ ID NO: 9822 - DNA, 164 bp, Artificial Sequence
  Synthetic polynucleotide
atcatctcaccttgcctcctgccctttccgttaacccgcctgcaggcactgcattagacactgcatttcgcactgcattgaccactgcattctacactgcattactcactgcatttgccactgcattgtacactgcattggcgcgccatgcttcatcagactct

SEQ ID NO: 9823 - DNA, 164 bp, Artificial Sequence; identical to SEQ ID NO: 9822
  Synthetic polynucleotide

SEQ ID NO: 9824 - DNA, 191 bp, Artificial Sequence
  Synthetic polynucleotide
atcatctcaccttgcctcctgaaccctagctgaccaaacctgcaggcccattaattaatcaccagacccattaattaatcacctcgcccattaattaatcaccgaccccattaattaatcaccctacccattaattaatcaccactcccattaattaatcacctgcggcgcgccatgcttcatcagactct

SEQ ID NO: 9825 - DNA, 191 bp, Artificial Sequence; identical to SEQ ID NO: 9824
  Synthetic polynucleotide

SEQ ID NO: 9826 - DNA, 197 bp, Artificial Sequence
  Synthetic polynucleotide
atcatctcaccttgcctcctggcccgcaagtttaagtccctgcaggaactaattaccattatcgagaaactaattaccattatcgtcgaactaattaccattatcggacaactaattaccattatcgctaaactaattaccattatcgactaactaattaccattatcgtgcggcgcgccatgcttcatcagactct

SEQ ID NO: 9827 - DNA, 197 bp, Artificial Sequence; identical to SEQ ID NO: 9826
  Synthetic polynucleotide

SEQ ID NO: 9828 - DNA, 172 bp, Artificial Sequence
  Synthetic polynucleotide
atcatctcaccttgcctcctggtgacgtatgcgtctcgcctgcaggacccaggtggagaacccaggtggtcgacccaggtgggacacccaggtggctaacccaggtggactacccaggtggtgcacccaggtgggtaacccaggtggggcgcgccatgcttcatcagactct

SEQ ID NO: 9829 - DNA, 172 bp, Artificial Sequence; identical to SEQ ID NO: 9828
  Synthetic polynucleotide

SEQ ID NO: 9830 - DNA, 156 bp, Artificial Sequence
  Synthetic polynucleotide
atcatctcaccttgcctcctgtccaggttacttgaacgcctgcaggccattaaaagaccattaaatcgccattaaagacccattaaactaccattaaaactccattaaatgcccattaaagtaccattaaaggcgcgccatgcttcatcagactct

SEQ ID NO: 9831 - DNA, 156 bp, Artificial Sequence; identical to SEQ ID NO: 9830
  Synthetic polynucleotide

SEQ ID NO: 9832 - DNA, 172 bp, Artificial Sequence
  Synthetic polynucleotide
atcatctcaccttgcctcctgtccaatgtagaagcgcgcctgcaggtgacctctgaagatgacctctgatcgtgacctctgagactgacctctgactatgacctctgaacttgacctctgatgctgacctctgagtatgacctctgaggcgcgccatgcttcatcagactct

SEQ ID NO: 9833 - DNA, 172 bp, Artificial Sequence; identical to SEQ ID NO: 9832
  Synthetic polynucleotide

SEQ ID NO: 9834 - DNA, 190 bp, Artificial Sequence
  Synthetic polynucleotide
atcatctcaccttgcctcctgtcaatgcacaatcttgccctgcaggtcccattgttcttaagatcccattgttcttatcgtcccattgttcttagactcccattgttcttactatcccattgttcttaacttcccattgttcttatgctcccattgttcttagtaggcgcgccatgcttcatcagactct

SEQ ID NO: 9835 - DNA, 190 bp, Artificial Sequence; identical to SEQ ID NO: 9834
  Synthetic polynucleotide

SEQ ID NO: 9836 - DNA, 172 bp, Artificial Sequence
  Synthetic polynucleotide
atcatctcaccttgcctcctgtggtcccatgctatatgcctgcaggcttagcaacgagacttagcaacgtcgcttagcaacggaccttagcaacgctacttagcaacgactcttagcaacgtgccttagcaacggtacttagcaacgggcgcgccatgcttcatcagactct

SEQ ID NO: 9837 - DNA, 172 bp, Artificial Sequence; identical to SEQ ID NO: 9836
  Synthetic polynucleotide

SEQ ID NO: 9838 - DNA, 196 bp, Artificial Sequence
  Synthetic polynucleotide
atcatctcaccttgcctcctgatcaaccactactgttacctgcaggatattaattggttagaatattaattggtttcgatattaattggttgacatattaattggttctaatattaattggttactatattaattggtttgcatattaattggttgtaatattaattggttggcgcgccatgcttcatcagactct

SEQ ID NO: 9839 - DNA, 196 bp, Artificial Sequence; identical to SEQ ID NO: 9838
  Synthetic polynucleotide

SEQ ID NO: 9840 - DNA, 164 bp, Artificial Sequence
  Synthetic polynucleotide
atcatctcaccttgcctcctggtacaggatggtagttgcctgcaggaattgacatagaaattgacattcgaattgacatgacaattgacatctaaattgacatactaattgacattgcaattgacatgtaaattgacatggcgcgccatgcttcatcagactct

SEQ ID NO: 9841 - DNA, 164 bp, Artificial Sequence; identical to SEQ ID NO: 9840
  Synthetic polynucleotide

SEQ ID NO: 9842 - DNA, 188 bp, Artificial Sequence
  Synthetic polynucleotide
atcatctcaccttgcctcctgtacaagtccacaatacacctgcaggaaataattaacgagaaaataattaacgtcgaaataattaacggacaaataattaacgctaaaataattaacgactaaataattaacgtgcaaataattaacggtaaaataattaacgggcgcgccatgcttcatcagactct

SEQ ID NO: 9843 - DNA, 188 bp, Artificial Sequence; identical to SEQ ID NO: 9842
  Synthetic polynucleotide

SEQ ID NO: 9844 - DNA, 180 bp, Artificial Sequence
  Synthetic polynucleotide
atcatctcaccttgcctcctgtttctccaagtcatctacctgcaggtttcaagtggtagatttcaagtggttcgtttcaagtggtgactttcaagtggtctatttcaagtggtacttttcaagtggttgctttcaagtggtgtatttcaagtggtggcgcgccatgcttcatcagactct

SEQ ID NO: 9845 - DNA, 180 bp, Artificial Sequence; identical to SEQ ID NO: 9844
  Synthetic polynucleotide

SEQ ID NO: 9846 - DNA, 172 bp, Artificial Sequence
  Synthetic polynucleotide
atcatctcaccttgcctcctgttcgggccctatcataacctgcaggcgcccacgcaagacgcccacgcatcgcgcccacgcagaccgcccacgcactacgcccacgcaactcgcccacgcatgccgcccacgcagtacgcccacgcaggcgcgccatgcttcatcagactct

SEQ ID NO: 9847 - DNA, 172 bp, Artificial Sequence; identical to SEQ ID NO: 9846
  Synthetic polynucleotide

SEQ ID NO: 9848 - DNA, 197 bp, Artificial Sequence
  Synthetic polynucleotide
atcatctcaccttgcctcctggaaactctcccatgcgccctgcaggattatgttaaatcacagaattatgttaaatcactcgattatgttaaatcacgacattatgttaaatcacctaattatgttaaatcacactattatgttaaatcactgcattatgttaaatcacgtaggcgcgccatgcttcatcagactct

SEQ ID NO: 9849 - DNA, 197 bp, Artificial Sequence; identical to SEQ ID NO: 9848
  Synthetic polynucleotide

SEQ ID NO: 9850 - DNA, 156 bp, Artificial Sequence
  Synthetic polynucleotide
atcatctcaccttgcctcctgaaccatacgttgcaatacctgcaggaggaatttagaaggaattttcgaggaatttgacaggaatttctaaggaatttactaggaattttgcaggaatttgtaaggaatttggcgcgccatgcttcatcagactct

SEQ ID NO: 9851 - DNA, 156 bp, Artificial Sequence; identical to SEQ ID NO: 9850
  Synthetic polynucleotide

SEQ ID NO: 9852 - DNA, 191 bp, Artificial Sequence
  Synthetic polynucleotide
atcatctcaccttgcctcctgaccacgcaatcgacgaccctgcaggcggaatgcagtgcgattagacggaatgcagtgcgatttcgcggaatgcagtgcgattgaccggaatgcagtgcgattctacggaatgcagtgcgattactcggaatgcagtgcgatttgcggcgcgccatgcttcatcagactct

SEQ ID NO: 9853 - DNA, 191 bp, Artificial Sequence; identical to SEQ ID NO: 9852
  Synthetic polynucleotide

SEQ ID NO: 9854 - DNA, 172 bp, Artificial Sequence
  Synthetic polynucleotide
atcatctcaccttgcctcctgatctgccagctgcaaaccctgcagggtataattagagagtataattagtcggtataattaggacgtataattagctagtataattagactgtataattagtgcgtataattaggtagtataattagggcgcgccatgcttcatcagactct

SEQ ID NO: 9855 - DNA, 172 bp, Artificial Sequence; identical to SEQ ID NO: 9854
  Synthetic polynucleotide

SEQ ID NO: 9856 - DNA, 164 bp, Artificial Sequence
  Synthetic polynucleotide
atcatctcaccttgcctcctgatgccgcagttacccatcctgcaggctagggttaagactagggttatcgctagggttagacctagggttactactagggttaactctagggttatgcctagggttagtactagggttaggcgcgccatgcttcatcagactct

SEQ ID NO: 9857 - DNA, 164 bp, Artificial Sequence; identical to SEQ ID NO: 9856
  Synthetic polynucleotide

SEQ ID NO: 9858 - DNA, 196 bp, Artificial Sequence
  Synthetic polynucleotide
atcatctcaccttgcctcctgagctttaggctcagacgcctgcaggtgttgctagggaaagatgttgctagggaatcgtgttgctagggaagactgttgctagggaactatgttgctagggaaacttgttgctagggaatgctgttgctagggaagtatgttgctagggaaggcgcgccatgcttcatcagactct

SEQ ID NO: 9859 - DNA, 196 bp, Artificial Sequence; identical to SEQ ID NO: 9858
  Synthetic polynucleotide

SEQ ID NO: 9860 - DNA, 196 bp, Artificial Sequence
  Synthetic polynucleotide
atcatctcaccttgcctcctgacttgtacggcctaagacctgcaggccgccacgagcccagaccgccacgagccctcgccgccacgagcccgacccgccacgagcccctaccgccacgagcccactccgccacgagccctgcccgccacgagcccgtaccgccacgagcccggcgcgccatgcttcatcagactct

SEQ ID NO: 9861 - DNA, 196 bp, Artificial Sequence; identical to SEQ ID NO: 9860
  Synthetic polynucleotide

SEQ ID NO: 9862 - DNA, 191 bp, Artificial Sequence
  Synthetic polynucleotide
atcatctcaccttgcctcctgtttatctccaaccgacgcctgcaggtaggtcagtcaaggtcaagataggtcagtcaaggtcatcgtaggtcagtcaaggtcagactaggtcagtcaaggtcactataggtcagtcaaggtcaacttaggtcagtcaaggtcatgcggcgcgccatgcttcatcagactct

SEQ ID NO: 9863 - DNA, 191 bp, Artificial Sequence; identical to SEQ ID NO: 9862
  Synthetic polynucleotide

SEQ ID NO: 9864 - DNA, 197 bp, Artificial Sequence
  Synthetic polynucleotide
atcatctcaccttgcctcctgtggcttcgccggacattcctgcaggctttcactttcacttagactttcactttcactttcgctttcactttcacttgacctttcactttcacttctactttcactttcacttactctttcactttcactttgcctttcactttcacttgtaggcgcgccatgcttcatcagactct

SEQ ID NO: 9865 - DNA, 197 bp, Artificial Sequence; identical to SEQ ID NO: 9864
  Synthetic polynucleotide

SEQ ID NO: 9866 - DNA, 172 bp, Artificial Sequence
  Synthetic polynucleotide
atcatctcaccttgcctcctggtccatacaggtgcgaacctgcaggtatgttcctaagatatgttcctatcgtatgttcctagactatgttcctactatatgttcctaacttatgttcctatgctatgttcctagtatatgttcctaggcgcgccatgcttcatcagactct

SEQ ID NO: 9867 - DNA, 172 bp, Artificial Sequence; identical to SEQ ID NO: 9866
  Synthetic polynucleotide

SEQ ID NO: 9868 - DNA, 190 bp, Artificial Sequence
  Synthetic polynucleotide
atcatctcaccttgcctcctgaccatatcgccgagtggcctgcaggatttcgtatccccgagaatttcgtatccccgtcgatttcgtatccccggacatttcgtatccccgctaatttcgtatccccgactatttcgtatccccgtgcatttcgtatccccggtaggcgcgccatgcttcatcagactct

SEQ ID NO: 9869 - DNA, 190 bp, Artificial Sequence; identical to SEQ ID NO: 9868
  Synthetic polynucleotide

SEQ ID NO: 9870 - DNA, 191 bp, Artificial Sequence
  Synthetic polynucleotide
atcatctcaccttgcctcctgcatccgatctgttcgctcctgcagggtttcttaattaattcgagagtttcttaattaattcgtcggtttcttaattaattcggacgtttcttaattaattcgctagtttcttaattaattcgactgtttcttaattaattcgtgcggcgcgccatgcttcatcagactct

SEQ ID NO: 9871 - DNA, 191 bp, Artificial Sequence; identical to SEQ ID NO: 9870
  Synthetic polynucleotide

SEQ ID NO: 9872 - DNA, 148 bp, Artificial Sequence
  Synthetic polynucleotide
atcatctcaccttgcctcctgtcactcaagacatttggcctgcaggacaaagaagaacaaagatcgacaaagagacacaaagactaacaaagaactacaaagatgcacaaagagtaacaaagaggcgcgccatgcttcatcagactct

SEQ ID NO: 9873 - DNA, 148 bp, Artificial Sequence; identical to SEQ ID NO: 9872
  Synthetic polynucleotide

SEQ ID NO: 9874 - DNA, 172 bp, Artificial Sequence
  Synthetic polynucleotide
atcatctcaccttgcctcctggcgccaattatgaaacgcctgcaggttgtaaacaaagattgtaaacaatcgttgtaaacaagacttgtaaacaactattgtaaacaaactttgtaaacaatgcttgtaaacaagtattgtaaacaaggcgcgccatgcttcatcagactct

SEQ ID NO: 9875 - DNA, 172 bp, Artificial Sequence; identical to SEQ ID NO: 9874
  Synthetic polynucleotide

SEQ ID NO: 9876 - DNA, 188 bp, Artificial Sequence
  Synthetic polynucleotide
atcatctcaccttgcctcctgttggtatcctaaccgatcctgcagggctatttatagcagagctatttatagctcggctatttatagcgacgctatttatagcctagctatttatagcactgctatttatagctgcgctatttatagcgtagctatttatagcggcgcgccatgcttcatcagactct

SEQ ID NO: 9877 - DNA, 188 bp, Artificial Sequence; identical to SEQ ID NO: 9876
  Synthetic polynucleotide

SEQ ID NO: 9878 - DNA, 200 bp, Artificial Sequence
  Synthetic polynucleotide
atcatctcaccttgcctcctggtgactggcactacagtcctgcaggctagaacacagtgtacccaagactagaacacagtgtacccatcgctagaacacagtgtacccagacctagaacacagtgtacccactactagaacacagtgtacccaactctagaacacagtgtacccaggcgcgccatgcttcatcagactct

SEQ ID NO: 9879 - DNA, 200 bp, Artificial Sequence; identical to SEQ ID NO: 9878
  Synthetic polynucleotide

SEQ ID NO: 9880 - DNA, 172 bp, Artificial Sequence
  Synthetic polynucleotide
atcatctcaccttgcctcctgatcagtaatggtgggttcctgcagggaaagtgaaaagagaaagtgaaatcggaaagtgaaagacgaaagtgaaactagaaagtgaaaactgaaagtgaaatgcgaaagtgaaagtagaaagtgaaaggcgcgccatgcttcatcagactct

SEQ ID NO: 9881 - DNA, 172 bp, Artificial Sequence; identical to SEQ ID NO: 9880
  Synthetic polynucleotide

SEQ ID NO: 9882 - DNA, 172 bp, Artificial Sequence
  Synthetic polynucleotide
atcatctcaccttgcctcctggatgcagtgtggtcccacctgcaggatgactcaccagaatgactcacctcgatgactcaccgacatgactcaccctaatgactcaccactatgactcacctgcatgactcaccgtaatgactcaccggcgcgccatgcttcatcagactct

SEQ ID NO: 9883 - DNA, 172 bp, Artificial Sequence; identical to SEQ ID NO: 9882
  Synthetic polynucleotide

SEQ ID NO: 9884 - DNA, 190 bp, Artificial Sequence
  Synthetic polynucleotide
atcatctcaccttgcctcctgagcgagcttcaacacgccctgcaggaggaagggaaaggaagaaggaagggaaaggatcgaggaagggaaaggagacaggaagggaaaggactaaggaagggaaaggaactaggaagggaaaggatgcaggaagggaaaggagtaggcgcgccatgcttcatcagactct

SEQ ID NO: 9885 - DNA, 190 bp, Artificial Sequence; identical to SEQ ID NO: 9884
  Synthetic polynucleotide

SEQ ID NO: 9886 - DNA, 172 bp, Artificial Sequence
  Synthetic polynucleotide
atcatctcaccttgcctcctgacgagtcactgcatgctcctgcaggagcaattaacagaagcaattaactcgagcaattaacgacagcaattaacctaagcaattaacactagcaattaactgcagcaattaacgtaagcaattaacggcgcgccatgcttcatcagactct

SEQ ID NO: 9887 - DNA, 172 bp, Artificial Sequence; identical to SEQ ID NO: 9886
  Synthetic polynucleotide

SEQ ID NO: 9888 - DNA, 172 bp, Artificial Sequence
  Synthetic polynucleotide
atcatctcaccttgcctcctgtttcggttgacgcagcccctgcaggcaagatggcgagacaagatggcgtcgcaagatggcggaccaagatggcgctacaagatggcgactcaagatggcgtgccaagatggcggtacaagatggcgggcgcgccatgcttcatcagactct

SEQ ID NO: 9889 - DNA, 172 bp, Artificial Sequence; identical to SEQ ID NO: 9888
  Synthetic polynucleotide

SEQ ID NO: 9890 - DNA, 190 bp, Artificial Sequence
  Synthetic polynucleotide
atcatctcaccttgcctcctgccttagttggtcgcttacctgcaggcggccacgtgacccagacggccacgtgaccctcgcggccacgtgacccgaccggccacgtgacccctacggccacgtgacccactcggccacgtgaccctgccggccacgtgacccgtaggcgcgccatgcttcatcagactct

SEQ ID NO: 9891 - DNA, 190 bp, Artificial Sequence; identical to SEQ ID NO: 9890
  Synthetic polynucleotide

SEQ ID NO: 9892 - DNA, 172 bp, Artificial Sequence
  Synthetic polynucleotide
atcatctcaccttgcctcctgtggaatcgtaagggcgacctgcaggagaatgttcgagaagaatgttcgtcgagaatgttcggacagaatgttcgctaagaatgttcgactagaatgttcgtgcagaatgttcggtaagaatgttcgggcgcgccatgcttcatcagactct

SEQ ID NO: 9893 - DNA, 172 bp, Artificial Sequence; identical to SEQ ID NO: 9892
  Synthetic polynucleotide

SEQ ID NO: 9894 - DNA, 188 bp, Artificial Sequence
  Synthetic polynucleotide
atcatctcaccttgcctcctgcagtgtttgaaaggtctcctgcaggagtcagcattttagaagtcagcatttttcgagtcagcattttgacagtcagcattttctaagtcagcattttactagtcagcatttttgcagtcagcattttgtaagtcagcattttggcgcgccatgcttcatcagactct

SEQ ID NO: 9895 - DNA, 188 bp, Artificial Sequence; identical to SEQ ID NO: 9894
  Synthetic polynucleotide

SEQ ID NO: 9896 - DNA, 190 bp, Artificial Sequence
  Synthetic polynucleotide
atcatctcaccttgcctcctgcttagaccgcgtatttccctgcaggataataatatttttagaataataatattttttcgataataatatttttgacataataatatttttctaataataatatttttactataataatattttttgcataataatatttttgtaggcgcgccatgcttcatcagactct

SEQ ID NO: 9897 - DNA, 190 bp, Artificial Sequence; identical to SEQ ID NO: 9896
  Synthetic polynucleotide

SEQ ID NO: 9898 - DNA, 172 bp, Artificial Sequence
  Synthetic polynucleotide
atcatctcaccttgcctcctggggtcttatgcattggacctgcaggccaccaggggagaccaccaggggtcgccaccagggggacccaccaggggctaccaccaggggactccaccaggggtgcccaccagggggtaccaccaggggggcgcgccatgcttcatcagactct

SEQ ID NO: 9899 - DNA, 172 bp, Artificial Sequence; identical to SEQ ID NO: 9898
  Synthetic polynucleotide

SEQ ID NO: 9900 - DNA, 172 bp, Artificial Sequence
  Synthetic polynucleotide
atcatctcaccttgcctcctgaagtaggacagaaggaacctgcagggtgactcaccagagtgactcacctcggtgactcaccgacgtgactcaccctagtgactcaccactgtgactcacctgcgtgactcaccgtagtgactcaccggcgcgccatgcttcatcagactct

SEQ ID NO: 9901 - DNA, 172 bp, Artificial Sequence; identical to SEQ ID NO: 9900
  Synthetic polynucleotide

SEQ ID NO: 9902 - DNA, 190 bp, Artificial Sequence
  Synthetic polynucleotide
atcatctcaccttgcctcctgatccagcaagtgatttccctgcaggttttggcgccaaaaagattttggcgccaaaatcgttttggcgccaaaagacttttggcgccaaaactattttggcgccaaaaactttttggcgccaaaatgcttttggcgccaaaagtaggcgcgccatgcttcatcagactct

SEQ ID NO: 9903 - DNA, 190 bp, Artificial Sequence; identical to SEQ ID NO: 9902
  Synthetic polynucleotide

SEQ ID NO: 9904 - DNA, 164 bp, Artificial Sequence
  Synthetic polynucleotide
atcatctcaccttgcctcctggcagctagcagccatttcctgcaggtggaaaactagatggaaaacttcgtggaaaactgactggaaaactctatggaaaactacttggaaaacttgctggaaaactgtatggaaaactggcgcgccatgcttcatcagactct

SEQ ID NO: 9905 - DNA, 164 bp, Artificial Sequence; identical to SEQ ID NO: 9904
  Synthetic polynucleotide

SEQ ID NO: 9906 - DNA, 197 bp, Artificial Sequence
  Synthetic polynucleotide
atcatctcaccttgcctcctggcaattagtatgtaccccctgcaggatgaatttcattcatagaatgaatttcattcattcgatgaatttcattcatgacatgaatttcattcatctaatgaatttcattcatactatgaatttcattcattgcatgaatttcattcatgtaggcgcgccatgcttcatcagactct

SEQ ID NO: 9907 - DNA, 197 bp, Artificial Sequence; identical to SEQ ID NO: 9906
  Synthetic polynucleotide

SEQ ID NO: 9908 - DNA, 196 bp, Artificial Sequence
  Synthetic polynucleotide
atcatctcaccttgcctcctggaattacgacggcggaccctgcaggctaattaaaagtgagactaattaaaagtgtcgctaattaaaagtggacctaattaaaagtgctactaattaaaagtgactctaattaaaagtgtgcctaattaaaagtggtactaattaaaagtgggcgcgccatgcttcatcagactct

SEQ ID NO: 9909 - DNA, 196 bp, Artificial Sequence; identical to SEQ ID NO: 9908
  Synthetic polynucleotide

SEQ ID NO: 9910 - DNA, 191 bp, Artificial Sequence
  Synthetic polynucleotide
atcatctcaccttgcctcctgaaccatgaccgcatgaccctgcaggtgaaccggattaatgaaagatgaaccggattaatgaatcgtgaaccggattaatgaagactgaaccggattaatgaactatgaaccggattaatgaaacttgaaccggattaatgaatgcggcgcgccatgcttcatcagactct

SEQ ID NO: 9911 - DNA, 191 bp, Artificial Sequence; identical to SEQ ID NO: 9910
  Synthetic polynucleotide

SEQ ID NO: 9912 - DNA, 180 bp, Artificial Sequence
  Synthetic polynucleotide
atcatctcaccttgcctcctggcagaataactcgagctcctgcaggtttcccagaagagatttcccagaagtcgtttcccagaaggactttcccagaagctatttcccagaagacttttcccagaagtgctttcccagaaggtatttcccagaagggcgcgccatgcttcatcagactct

SEQ ID NO: 9913 - DNA, 180 bp, Artificial Sequence; identical to SEQ ID NO: 9912
  Synthetic polynucleotide

SEQ ID NO: 9914 - DNA, 196 bp, Artificial Sequence
  Synthetic polynucleotide
atcatctcaccttgcctcctgatgcgcgaaacttgtctcctgcaggccccttatctgatagaccccttatctgattcgccccttatctgatgacccccttatctgatctaccccttatctgatactccccttatctgattgcccccttatctgatgtaccccttatctgatggcgcgccatgcttcatcagactct

SEQ ID NO: 9915 - DNA, 196 bp, Artificial Sequence; identical to SEQ ID NO: 9914
  Synthetic polynucleotide

SEQ ID NO: 9916 - DNA, 185 bp, Artificial Sequence
  Synthetic polynucleotide
atcatctcaccttgcctcctgcgtatgtcggacacagacctgcagggggatgacgtcatcggagagggatgacgtcatcggtcggggatgacgtcatcgggacgggatgacgtcatcggctagggatgacgtcatcggactgggatgacgtcatcggtgcggcgcgccatgcttcatcagactct

SEQ ID NO: 9917 - DNA, 185 bp, Artificial Sequence; identical to SEQ ID NO: 9916
  Synthetic polynucleotide

SEQ ID NO: 9918 - DNA, 164 bp, Artificial Sequence
  Synthetic polynucleotide
atcatctcaccttgcctcctgacgtcacgctccgttctcctgcaggtgatgtaatagatgatgtaattcgtgatgtaatgactgatgtaatctatgatgtaatacttgatgtaattgctgatgtaatgtatgatgtaatggcgcgccatgcttcatcagactct

SEQ ID NO: 9919 - DNA, 164 bp, Artificial Sequence; identical to SEQ ID NO: 9918
  Synthetic polynucleotide

SEQ ID NO: 9920 - DNA, 197 bp, Artificial Sequence
  Synthetic polynucleotide
atcatctcaccttgcctcctgcgtacatgttgcccgtgcctgcaggatgaattgcagtcatagaatgaattgcagtcattcgatgaattgcagtcatgacatgaattgcagtcatctaatgaattgcagtcatactatgaattgcagtcattgcatgaattgcagtcatgtaggcgcgccatgcttcatcagactct

SEQ ID NO: 9921 - DNA, 197 bp, Artificial Sequence; identical to SEQ ID NO: 9920
  Synthetic polynucleotide

SEQ ID NO: 9922 - DNA, 164 bp, Artificial Sequence
  Synthetic polynucleotide
atcatctcaccttgcctcctgacctcctcctcaatattcctgcaggggcaataaaagaggcaataaatcgggcaataaagacggcaataaactaggcaataaaactggcaataaatgcggcaataaagtaggcaataaaggcgcgccatgcttcatcagactct

SEQ ID NO: 9923 - DNA, 164 bp, Artificial Sequence; identical to SEQ ID NO: 9922
  Synthetic polynucleotide

SEQ ID NO: 9924 - DNA, 172 bp, Artificial Sequence
  Synthetic polynucleotide
atcatctcaccttgcctcctgtcacgaatcaccagcttcctgcagggggggcgtaaagagggggcgtaatcggggggcgtaagacgggggcgtaactagggggcgtaaactgggggcgtaatgcgggggcgtaagtagggggcgtaaggcgcgccatgcttcatcagactct

SEQ ID NO: 9925 - DNA, 172 bp, Artificial Sequence; identical to SEQ ID NO: 9924
  Synthetic polynucleotide

SEQ ID NO: 9926 - DNA, 156 bp, Artificial Sequence
  Synthetic polynucleotide
atcatctcaccttgcctcctggtgggcgtgccgaatttcctgcaggcaattaaaagacaattaaatcgcaattaaagaccaattaaactacaattaaaactcaattaaatgccaattaaagtacaattaaaggcgcgccatgcttcatcagactct

SEQ ID NO: 9927 - DNA, 156 bp, Artificial Sequence; identical to SEQ ID NO: 9926
  Synthetic polynucleotide

SEQ ID NO: 9928 - DNA, 188 bp, Artificial Sequence
  Synthetic polynucleotide
atcatctcaccttgcctcctgctacgtgtggtgacctacctgcagggaacacaacaaaagagaacacaacaaatcggaacacaacaaagacgaacacaacaaactagaacacaacaaaactgaacacaacaaatgcgaacacaacaaagtagaacacaacaaaggcgcgccatgcttcatcagactct

SEQ ID NO: 9929 - DNA, 188 bp, Artificial Sequence; identical to SEQ ID NO: 9928
  Synthetic polynucleotide

SEQ ID NO: 9930 - DNA, 190 bp, Artificial Sequence
  Synthetic polynucleotide
atcatctcaccttgcctcctgcccttacctcgtgagatcctgcaggctgacctggaactcagactgacctggaactctcgctgacctggaactcgacctgacctggaactcctactgacctggaactcactctgacctggaactctgcctgacctggaactcgtaggcgcgccatgcttcatcagactct

SEQ ID NO: 9931 - DNA, 190 bp, Artificial Sequence; identical to SEQ ID NO: 9930
  Synthetic polynucleotide

SEQ ID NO: 9932 - DNA, 156 bp, Artificial Sequence
  Synthetic polynucleotide
atcatctcaccttgcctcctggtagaaacgataccaggcctgcaggtctaattaagatctaattatcgtctaattagactctaattactatctaattaacttctaattatgctctaattagtatctaattaggcgcgccatgcttcatcagactct

SEQ ID NO: 9933 - DNA, 156 bp, Artificial Sequence; identical to SEQ ID NO: 9932
  Synthetic polynucleotide

SEQ ID NO: 9934 - DNA, 172 bp, Artificial Sequence
  Synthetic polynucleotide
atcatctcaccttgcctcctgtaactccgttcaagagacctgcaggaattaaagcaagaaattaaagcatcgaattaaagcagacaattaaagcactaaattaaagcaactaattaaagcatgcaattaaagcagtaaattaaagcaggcgcgccatgcttcatcagactct

SEQ ID NO: 9935 - DNA, 172 bp, Artificial Sequence; identical to SEQ ID NO: 9934
  Synthetic polynucleotide

SEQ ID NO: 9936 - DNA, 190 bp, Artificial Sequence
  Synthetic polynucleotide
atcatctcaccttgcctcctggactggtcgccttatctcctgcaggggttaatgaccttgagaggttaatgaccttgtcgggttaatgaccttggacggttaatgaccttgctaggttaatgaccttgactggttaatgaccttgtgcggttaatgaccttggtaggcgcgccatgcttcatcagactct

SEQ ID NO: 9937 - DNA, 190 bp, Artificial Sequence; identical to SEQ ID NO: 9936
  Synthetic polynucleotide

SEQ ID NO: 9938 - DNA, 156 bp, Artificial Sequence
  Synthetic polynucleotide
atcatctcaccttgcctcctgtagaggcacatatttctcctgcaggatatgcatagaatatgcattcgatatgcatgacatatgcatctaatatgcatactatatgcattgcatatgcatgtaatatgcatggcgcgccatgcttcatcagactct

SEQ ID NO: 9939 - DNA, 156 bp, Artificial Sequence; identical to SEQ ID NO: 9938
  Synthetic polynucleotide

SEQ ID NO: 9940 - DNA, 196 bp, Artificial Sequence
  Synthetic polynucleotide
atcatctcaccttgcctcctgttagccggagatacatgcctgcaggtgccctgagggcaagatgccctgagggcatcgtgccctgagggcagactgccctgagggcactatgccctgagggcaacttgccctgagggcatgctgccctgagggcagtatgccctgagggcaggcgcgccatgcttcatcagactct

SEQ ID NO: 9941 - DNA, 196 bp, Artificial Sequence; identical to SEQ ID NO: 9940
  Synthetic polynucleotide

SEQ ID NO: 9942 - DNA, 191 bp, Artificial Sequence
  Synthetic polynucleotide
atcatctcaccttgcctcctggagtgacggacgaatcacctgcaggggggaggagggaggggaggagagaggggaggagggaggggaggagtcgggggaggagggaggggaggaggacggggaggagggaggggaggagctaggggaggagggaggggaggagactggcgcgccatgcttcatcagactct

SEQ ID NO: 9943 - DNA, 191 bp, Artificial Sequence; identical to SEQ ID NO: 9942
  Synthetic polynucleotide

SEQ ID NO: 9944 - DNA, 197 bp, Artificial Sequence
  Synthetic polynucleotide
atcatctcaccttgcctcctgttgaagggtagagggaacctgcaggtgctgtgatttatttagatgctgtgatttattttcgtgctgtgatttatttgactgctgtgatttatttctatgctgtgatttatttacttgctgtgatttattttgctgctgtgatttatttgtaggcgcgccatgcttcatcagactct

SEQ ID NO: 9945 - DNA, 197 bp, Artificial Sequence; identical to SEQ ID NO: 9944
  Synthetic polynucleotide

SEQ ID NO: 9946 - DNA, 164 bp, Artificial Sequence
  Synthetic polynucleotide
atcatctcaccttgcctcctgaggtacagattccgtgccctgcaggcacatggccagacacatggcctcgcacatggccgaccacatggccctacacatggccactcacatggcctgccacatggccgtacacatggccggcgcgccatgcttcatcagactct

SEQ ID NO: 9947 - DNA, 164 bp, Artificial Sequence; identical to SEQ ID NO: 9946
  Synthetic polynucleotide

SEQ ID NO: 9948 - DNA, 191 bp, Artificial Sequence
  Synthetic polynucleotide
atcatctcaccttgcctcctgagatagacttccttgttcctgcaggaggtcaaactgtgacctagaaggtcaaactgtgaccttcgaggtcaaactgtgacctgacaggtcaaactgtgacctctaaggtcaaactgtgacctactaggtcaaactgtgaccttgcggcgcgccatgcttcatcagactct

SEQ ID NO: 9949 - DNA, 191 bp, Artificial Sequence; identical to SEQ ID NO: 9948
  Synthetic polynucleotide

SEQ ID NO: 9950 - DNA, 188 bp, Artificial Sequence
  Synthetic polynucleotide
atcatctcaccttgcctcctgctagtgttgcgggagttcctgcaggcgttatgtaacgagacgttatgtaacgtcgcgttatgtaacggaccgttatgtaacgctacgttatgtaacgactcgttatgtaacgtgccgttatgtaacggtacgttatgtaacgggcgcgccatgcttcatcagactct

SEQ ID NO: 9951 - DNA, 188 bp, Artificial Sequence; identical to SEQ ID NO: 9950
  Synthetic polynucleotide

SEQ ID NO: 9952 - DNA, 190 bp, Artificial Sequence
  Synthetic polynucleotide
atcatctcaccttgcctcctgggttcctttaagctacccctgcaggaaagtcaaaagtcaagaaaagtcaaaagtcatcgaaagtcaaaagtcagacaaagtcaaaagtcactaaaagtcaaaagtcaactaaagtcaaaagtcatgcaaagtcaaaagtcagtaggcgcgccatgcttcatcagactct

SEQ ID NO: 9953 - DNA, 190 bp, Artificial Sequence; identical to SEQ ID NO: 9952
  Synthetic polynucleotide

SEQ ID NO: 9954 - DNA, 197 bp, Artificial Sequence
  Synthetic polynucleotide
atcatctcaccttgcctcctgcgggatatgcgggtaagcctgcagggacagatggtgcggtagagacagatggtgcggttcggacagatggtgcggtgacgacagatggtgcggtctagacagatggtgcggtactgacagatggtgcggttgcgacagatggtgcggtgtaggcgcgccatgcttcatcagactct

SEQ ID NO: 9955 - DNA, 197 bp, Artificial Sequence; identical to SEQ ID NO: 9954
  Synthetic polynucleotide

SEQ ID NO: 9956 - DNA, 185 bp, Artificial Sequence
  Synthetic polynucleotide
atcatctcaccttgcctcctgatctcttcccgaattgtcctgcaggattctatttatagcttagaattctatttatagctttcgattctatttatagcttgacattctatttatagcttctaattctatttatagcttactattctatttatagctttgcggcgcgccatgcttcatcagactct

SEQ ID NO: 9957 - DNA, 185 bp, Artificial Sequence; identical to SEQ ID NO: 9956
  Synthetic polynucleotide

SEQ ID NO: 9958 - DNA, 190 bp, Artificial Sequence
  Synthetic polynucleotide
atcatctcaccttgcctcctgtatgaagggtggaatctcctgcaggcacccccgggggggagacacccccgggggggtcgcacccccggggggggaccacccccgggggggctacacccccgggggggactcacccccgggggggtgccacccccggggggggtaggcgcgccatgcttcatcagactct

SEQ ID NO: 9959 - DNA, 190 bp, Artificial Sequence; identical to SEQ ID NO: 9958
  Synthetic polynucleotide

SEQ ID NO: 9960 - DNA, 197 bp, Artificial Sequence
  Synthetic polynucleotide
atcatctcaccttgcctcctgtgtcctaggctaccaaccctgcaggtaaataaacatttcaagataaataaacatttcatcgtaaataaacatttcagactaaataaacatttcactataaataaacatttcaacttaaataaacatttcatgctaaataaacatttcagtaggcgcgccatgcttcatcagactct

SEQ ID NO: 9961 - DNA, 197 bp, Artificial Sequence; identical to SEQ ID NO: 9960
  Synthetic polynucleotide

SEQ ID NO: 9962 - DNA, 172 bp, Artificial Sequence
  Synthetic polynucleotide
atcatctcaccttgcctcctgcagataaagaccggtaacctgcaggtcacgtggccagatcacgtggcctcgtcacgtggccgactcacgtggccctatcacgtggccacttcacgtggcctgctcacgtggccgtatcacgtggccggcgcgccatgcttcatcagactct

SEQ ID NO: 9963 - DNA, 172 bp, Artificial Sequence; identical to SEQ ID NO: 9962
  Synthetic polynucleotide

SEQ ID NO: 9964 - DNA, 172 bp, Artificial Sequence
  Synthetic polynucleotide
atcatctcaccttgcctcctgagattccaccacgggttcctgcaggacttggcaccagaacttggcacctcgacttggcaccgacacttggcaccctaacttggcaccactacttggcacctgcacttggcaccgtaacttggcaccggcgcgccatgcttcatcagactct

SEQ ID NO: 9965 - DNA, 172 bp, Artificial Sequence; identical to SEQ ID NO: 9964
  Synthetic polynucleotide

SEQ ID NO: 9966 - DNA, 190 bp, Artificial Sequence
  Synthetic polynucleotide
atcatctcaccttgcctcctgtcctgtgaggaaggaaacctgcaggtggtctagcctcgaagatggtctagcctcgatcgtggtctagcctcgagactggtctagcctcgactatggtctagcctcgaacttggtctagcctcgatgctggtctagcctcgagtaggcgcgccatgcttcatcagactct

SEQ ID NO: 9967 - DNA, 190 bp, Artificial Sequence; identical to SEQ ID NO: 9966
  Synthetic polynucleotide

SEQ ID NO: 9968 - DNA, 188 bp, Artificial Sequence
  Synthetic polynucleotide
atcatctcaccttgcctcctgtagaggttaaaccttcacctgcaggagaacaaagcgcagaagaacaaagcgctcgagaacaaagcgcgacagaacaaagcgcctaagaacaaagcgcactagaacaaagcgctgcagaacaaagcgcgtaagaacaaagcgcggcgcgccatgcttcatcagactct

SEQ ID NO: 9969 - DNA, 188 bp, Artificial Sequence; identical to SEQ ID NO: 9968
  Synthetic polynucleotide

SEQ ID NO: 9970 - DNA, 185 bp, Artificial Sequence
  Synthetic polynucleotide
atcatctcaccttgcctcctgaggtggtcggaccttaccctgcaggtgaattttattacctaagatgaattttattacctatcgtgaattttattacctagactgaattttattacctactatgaattttattacctaacttgaattttattacctatgcggcgcgccatgcttcatcagactct

SEQ ID NO: 9971 - DNA, 185 bp, Artificial Sequence; identical to SEQ ID NO: 9970
  Synthetic polynucleotide

SEQ ID NO: 9972 - DNA, 156 bp, Artificial Sequence
  Synthetic polynucleotide
atcatctcaccttgcctcctgtccgcagtactaacgaccctgcaggcaattaagagacaattaagtcgcaattaaggaccaattaagctacaattaagactcaattaagtgccaattaaggtacaattaagggcgcgccatgcttcatcagactct

SEQ ID NO: 9973 - DNA, 156 bp, Artificial Sequence; identical to SEQ ID NO: 9972
  Synthetic polynucleotide

SEQ ID NO: 9974 - DNA, 197 bp, Artificial Sequence
  Synthetic polynucleotide
atcatctcaccttgcctcctggatttgcgaagtttgcacctgcaggagctgtcactcacctagaagctgtcactcaccttcgagctgtcactcacctgacagctgtcactcacctctaagctgtcactcacctactagctgtcactcaccttgcagctgtcactcacctgtaggcgcgccatgcttcatcagactct

SEQ ID NO: 9975 - DNA, 197 bp, Artificial Sequence; identical to SEQ ID NO: 9974
  Synthetic polynucleotide

SEQ ID NO: 9976 - DNA, 197 bp, Artificial Sequence
  Synthetic polynucleotide
atcatctcaccttgcctcctgcgttgagcgtatgaatacctgcaggaaatctcgcgagaacagaaaatctcgcgagaactcgaaatctcgcgagaacgacaaatctcgcgagaacctaaaatctcgcgagaacactaaatctcgcgagaactgcaaatctcgcgagaacgtaggcgcgccatgcttcatcagactct

SEQ ID NO: 9977 - DNA, 197 bp, Artificial Sequence; identical to SEQ ID NO: 9976
  Synthetic polynucleotide

SEQ ID NO: 9978 - DNA, 156 bp, Artificial Sequence
  Synthetic polynucleotide
atcatctcaccttgcctcctgctggatctctcgaactgcctgcaggccttcctgagaccttcctgtcgccttcctggacccttcctgctaccttcctgactccttcctgtgcccttcctggtaccttcctgggcgcgccatgcttcatcagactct

SEQ ID NO: 9979 - DNA, 156 bp, Artificial Sequence; identical to SEQ ID NO: 9978
  Synthetic polynucleotide

SEQ ID NO: 9980 - DNA, 172 bp, Artificial Sequence
  Synthetic polynucleotide
atcatctcaccttgcctcctgtctctcaggtgtggatgcctgcaggagtttcgtttagaagtttcgttttcgagtttcgtttgacagtttcgtttctaagtttcgtttactagtttcgttttgcagtttcgtttgtaagtttcgtttggcgcgccatgcttcatcagactct

SEQ ID NO: 9981 - DNA, 172 bp, Artificial Sequence; identical to SEQ ID NO: 9980
  Synthetic polynucleotide

SEQ ID NO: 9982 - DNA, 172 bp, Artificial Sequence
  Synthetic polynucleotide
atcatctcaccttgcctcctgcactttgaccagtagcccctgcaggtaagtaaacaagataagtaaacatcgtaagtaaacagactaagtaaacactataagtaaacaacttaagtaaacatgctaagtaaacagtataagtaaacaggcgcgccatgcttcatcagactct

SEQ ID NO: 9983 - DNA, 172 bp, Artificial Sequence; identical to SEQ ID NO: 9982
  Synthetic polynucleotide

SEQ ID NO: 9984 - DNA, 197 bp, Artificial Sequence
  Synthetic polynucleotide
atcatctcaccttgcctcctgtagctaatcgtctatcgcctgcaggtggtaattattaaccagatggtaattattaacctcgtggtaattattaaccgactggtaattattaaccctatggtaattattaaccacttggtaattattaacctgctggtaattattaaccgtaggcgcgccatgcttcatcagactct

SEQ ID NO: 9985 - DNA, 197 bp, Artificial Sequence; identical to SEQ ID NO: 9984
  Synthetic polynucleotide

SEQ ID NO: 9986 - DNA, 180 bp, Artificial Sequence
  Synthetic polynucleotide
atcatctcaccttgcctcctgttattcgagcgcgatgacctgcaggtatagggataaagatatagggataatcgtatagggataagactatagggataactatatagggataaacttatagggataatgctatagggataagtatatagggataaggcgcgccatgcttcatcagactct

SEQ ID NO: 9987 - DNA, 180 bp, Artificial Sequence; identical to SEQ ID NO: 9986
  Synthetic polynucleotide

SEQ ID NO: 9988 - DNA, 196 bp, Artificial Sequence
  Synthetic polynucleotide
atcatctcaccttgcctcctgccagagtagggatccatcctgcagggccactagagggcagagccactagagggctcggccactagagggcgacgccactagagggcctagccactagagggcactgccactagagggctgcgccactagagggcgtagccactagagggcggcgcgccatgcttcatcagactct

SEQ ID NO: 9989 - DNA, 196 bp, Artificial Sequence; identical to SEQ ID NO: 9988
  Synthetic polynucleotide

SEQ ID NO: 9990 - DNA, 190 bp, Artificial Sequence
  Synthetic polynucleotide
atcatctcaccttgcctcctgttaggtaaggccttcagcctgcagggggagctgtagtccagagggagctgtagtcctcggggagctgtagtccgacgggagctgtagtccctagggagctgtagtccactgggagctgtagtcctgcgggagctgtagtccgtaggcgcgccatgcttcatcagactct

SEQ ID NO: 9991 - DNA, 190 bp, Artificial Sequence; identical to SEQ ID NO: 9990
  Synthetic polynucleotide

SEQ ID NO: 9992 - DNA, 180 bp, Artificial Sequence
  Synthetic polynucleotide
atcatctcaccttgcctcctgtgcgtgcgtgtaatttacctgcaggcttaagtggttagacttaagtggtttcgcttaagtggttgaccttaagtggttctacttaagtggttactcttaagtggtttgccttaagtggttgtacttaagtggttggcgcgccatgcttcatcagactct

SEQ ID NO: 9993 - DNA, 180 bp, Artificial Sequence; identical to SEQ ID NO: 9992
  Synthetic polynucleotide

SEQ ID NO: 9994 - DNA, 185 bp, Artificial Sequence
  Synthetic polynucleotide
atcatctcaccttgcctcctgtttgtattcgacgggtacctgcaggttatcttatcttatctagattatcttatcttatcttcgttatcttatcttatctgacttatcttatcttatctctattatcttatcttatctactttatcttatcttatcttgcggcgcgccatgcttcatcagactct

SEQ ID NO: 9995 - DNA, 185 bp, Artificial Sequence; identical to SEQ ID NO: 9994
  Synthetic polynucleotide

SEQ ID NO: 9996 - DNA, 172 bp, Artificial Sequence
  Synthetic polynucleotide
atcatctcaccttgcctcctgtgaccgcattatccatgcctgcagggtttcgcgcgagagtttcgcgcgtcggtttcgcgcggacgtttcgcgcgctagtttcgcgcgactgtttcgcgcgtgcgtttcgcgcggtagtttcgcgcgggcgcgccatgcttcatcagactct

SEQ ID NO: 9997 - DNA, 172 bp, Artificial Sequence; identical to SEQ ID NO: 9996
  Synthetic polynucleotide

SEQ ID NO: 9998 - DNA, 200 bp, Artificial Sequence
  Synthetic polynucleotide
atcatctcaccttgcctcctgtctcaagcttcgatttccctgcaggtgccaactcccccattagtgctcgactccaagatgccaactcccccattagtgctcgactccatcgtgccaactcccccattagtgctcgactccagactgccaactcccccattagtgctcgactccaggcgcgccatgcttcatcagactct

SEQ ID NO: 9999 - DNA, 200 bp, Artificial Sequence; identical to SEQ ID NO: 9998
  Synthetic polynucleotide

SEQ ID NO: 10000 - DNA, 180 bp, Artificial Sequence
  Synthetic polynucleotide
atcatctcaccttgcctcctgttgctggcatcgaactccctgcaggactgagtcatcagaactgagtcatctcgactgagtcatcgacactgagtcatcctaactgagtcatcactactgagtcatctgcactgagtcatcgtaactgagtcatcggcgcgccatgcttcatcagactct

SEQ ID NO: 10001 - DNA, 180 bp, Artificial Sequence; identical to SEQ ID NO: 10000
  Synthetic polynucleotide

SEQ ID NO: 10002 - DNA, 164 bp, Artificial Sequence
  Synthetic polynucleotide
atcatctcaccttgcctcctgcgcgtatctcatagcaacctgcaggatcacgcgaagaatcacgcgatcgatcacgcgagacatcacgcgactaatcacgcgaactatcacgcgatgcatcacgcgagtaatcacgcgaggcgcgccatgcttcatcagactct

SEQ ID NO: 10003 - DNA, 164 bp, Artificial Sequence; identical to SEQ ID NO: 10002
  Synthetic polynucleotide

SEQ ID NO: 10004 - DNA, 172 bp, Artificial Sequence
  Synthetic polynucleotide
atcatctcaccttgcctcctgacggacaagtacatattcctgcagggtttcgcgccagagtttcgcgcctcggtttcgcgccgacgtttcgcgccctagtttcgcgccactgtttcgcgcctgcgtttcgcgccgtagtttcgcgccggcgcgccatgcttcatcagactct

SEQ ID NO: 10005 - DNA, 172 bp, Artificial Sequence; identical to SEQ ID NO: 10004
  Synthetic polynucleotide

SEQ ID NO: 10006 - DNA, 188 bp, Artificial Sequence
  Synthetic polynucleotide
atcatctcaccttgcctcctgtaacagcagccctggagcctgcaggtgctgagtcatgagatgctgagtcatgtcgtgctgagtcatggactgctgagtcatgctatgctgagtcatgacttgctgagtcatgtgctgctgagtcatggtatgctgagtcatgggcgcgccatgcttcatcagactct

SEQ ID NO: 10007 - DNA, 188 bp, Artificial Sequence; identical to SEQ ID NO: 10006
  Synthetic polynucleotide

SEQ ID NO: 10008 - DNA, 156 bp, Artificial Sequence
  Synthetic polynucleotide
atcatctcaccttgcctcctgtagatctgccaacagctcctgcagggaagcggtagagaagcggttcggaagcggtgacgaagcggtctagaagcggtactgaagcggttgcgaagcggtgtagaagcggtggcgcgccatgcttcatcagactct

SEQ ID NO: 10009 - DNA, 156 bp, Artificial Sequence; identical to SEQ ID NO: 10008
  Synthetic polynucleotide

SEQ ID NO: 10010 - DNA, 196 bp, Artificial Sequence
  Synthetic polynucleotide
atcatctcaccttgcctcctggcttacttatcctcgcacctgcaggtacaaggaagtaaagatacaaggaagtaatcgtacaaggaagtaagactacaaggaagtaactatacaaggaagtaaacttacaaggaagtaatgctacaaggaagtaagtatacaaggaagtaaggcgcgccatgcttcatcagactct

SEQ ID NO: 10011 - DNA, 196 bp, Artificial Sequence; identical to SEQ ID NO: 10010
  Synthetic polynucleotide

SEQ ID NO: 10012 - DNA, 180 bp, Artificial Sequence
  Synthetic polynucleotide
atcatctcaccttgcctcctgttcccagcgggattctgcctgcaggtgcagtgatttagatgcagtgattttcgtgcagtgatttgactgcagtgatttctatgcagtgatttacttgcagtgattttgctgcagtgatttgtatgcagtgatttggcgcgccatgcttcatcagactct

SEQ ID NO: 10013 - DNA, 180 bp, Artificial Sequence; identical to SEQ ID NO: 10012
  Synthetic polynucleotide

SEQ ID NO: 10014 - DNA, 180 bp, Artificial Sequence
  Synthetic polynucleotide
atcatctcaccttgcctcctgacgtgacacgctagtggcctgcaggtttaaaggtcaagatttaaaggtcatcgtttaaaggtcagactttaaaggtcactatttaaaggtcaacttttaaaggtcatgctttaaaggtcagtatttaaaggtcaggcgcgccatgcttcatcagactct

SEQ ID NO: 10015 - DNA, 180 bp, Artificial Sequence; identical to SEQ ID NO: 10014
  Synthetic polynucleotide

SEQ ID NO: 10016 - DNA, 185 bp, Artificial Sequence
  Synthetic polynucleotide
atcatctcaccttgcctcctggcggcggtacgttaatgcctgcaggaataacaggtgttcacagaaataacaggtgttcactcgaataacaggtgttcacgacaataacaggtgttcacctaaataacaggtgttcacactaataacaggtgttcactgcggcgcgccatgcttcatcagactct

SEQ ID NO: 10017 - DNA, 185 bp, Artificial Sequence; identical to SEQ ID NO: 10016
  Synthetic polynucleotide

SEQ ID NO: 10018 - DNA, 172 bp, Artificial Sequence
  Synthetic polynucleotide
atcatctcaccttgcctcctgcagcatggagatcactgcctgcaggtttgctgactagatttgctgacttcgtttgctgactgactttgctgactctatttgctgactacttttgctgacttgctttgctgactgtatttgctgactggcgcgccatgcttcatcagactct

SEQ ID NO: 10019 - DNA, 172 bp, Artificial Sequence; identical to SEQ ID NO: 10018
  Synthetic polynucleotide

SEQ ID NO: 10020 - DNA, 172 bp, Artificial Sequence
  Synthetic polynucleotide
atcatctcaccttgcctcctgagattcccgcttggcgtcctgcaggttgatacagtagattgatacagttcgttgatacagtgacttgatacagtctattgatacagtactttgatacagttgcttgatacagtgtattgatacagtggcgcgccatgcttcatcagactct

SEQ ID NO: 10021 - DNA, 172 bp, Artificial Sequence; identical to SEQ ID NO: 10020
  Synthetic polynucleotide

SEQ ID NO: 10022 - DNA, 197 bp, Artificial Sequence
  Synthetic polynucleotide
atcatctcaccttgcctcctgcaaattaccactaggcacctgcagggaggatgacgtcatcagagaggatgacgtcatctcggaggatgacgtcatcgacgaggatgacgtcatcctagaggatgacgtcatcactgaggatgacgtcatctgcgaggatgacgtcatcgtaggcgcgccatgcttcatcagactct

SEQ ID NO: 10023 - DNA, 197 bp, Artificial Sequence; identical to SEQ ID NO: 10022
  Synthetic polynucleotide

SEQ ID NO: 10024 - DNA, 191 bp, Artificial Sequence
  Synthetic polynucleotide
atcatctcaccttgcctcctgagtggtactcagtcgaacctgcaggatggaaaccgttattttagaatggaaaccgttatttttcgatggaaaccgttattttgacatggaaaccgttattttctaatggaaaccgttattttactatggaaaccgttatttttgcggcgcgccatgcttcatcagactct

SEQ ID NO: 10025 - DNA, 191 bp, Artificial Sequence; identical to SEQ ID NO: 10024
  Synthetic polynucleotide

SEQ ID NO: 10026 - DNA, 185 bp, Artificial Sequence
  Synthetic polynucleotide
atcatctcaccttgcctcctgttggcctattatggagacctgcaggaacaatattcattgttagaaacaatattcattgtttcgaacaatattcattgttgacaacaatattcattgttctaaacaatattcattgttactaacaatattcattgtttgcggcgcgccatgcttcatcagactct

SEQ ID NO: 10027 - DNA, 185 bp, Artificial Sequence; identical to SEQ ID NO: 10026
  Synthetic polynucleotide

SEQ ID NO: 10028 - DNA, 190 bp, Artificial Sequence
  Synthetic polynucleotide
atcatctcaccttgcctcctgacctggtacagctcaaccctgcaggaggttcaaaggtcaagaaggttcaaaggtcatcgaggttcaaaggtcagacaggttcaaaggtcactaaggttcaaaggtcaactaggttcaaaggtcatgcaggttcaaaggtcagtaggcgcgccatgcttcatcagactct

SEQ ID NO: 10029 - DNA, 190 bp, Artificial Sequence; identical to SEQ ID NO: 10028
  Synthetic polynucleotide

SEQ ID NO: 10030 - DNA, 164 bp, Artificial Sequence
  Synthetic polynucleotide
atcatctcaccttgcctcctggtgcgtgtaactttaaccctgcagggtaataaaaagagtaataaaatcggtaataaaagacgtaataaaactagtaataaaaactgtaataaaatgcgtaataaaagtagtaataaaaggcgcgccatgcttcatcagactct

SEQ ID NO: 10031 - DNA, 164 bp, Artificial Sequence; identical to SEQ ID NO: 10030
  Synthetic polynucleotide

SEQ ID NO: 10032 - DNA, 180 bp, Artificial Sequence
  Synthetic polynucleotide
atcatctcaccttgcctcctgcccaaatatcatgcaaccctgcaggccgcccacgcaagaccgcccacgcatcgccgcccacgcagacccgcccacgcactaccgcccacgcaactccgcccacgcatgcccgcccacgcagtaccgcccacgcaggcgcgccatgcttcatcagactct

SEQ ID NO: 10033 - DNA, 180 bp, Artificial Sequence; identical to SEQ ID NO: 10032
  Synthetic polynucleotide

SEQ ID NO: 10034 - DNA, 185 bp, Artificial Sequence
  Synthetic polynucleotide
atcatctcaccttgcctcctgcactcaccatttggatgcctgcaggacaatgtatcaatttgagaacaatgtatcaatttgtcgacaatgtatcaatttggacacaatgtatcaatttgctaacaatgtatcaatttgactacaatgtatcaatttgtgcggcgcgccatgcttcatcagactct

SEQ ID NO: 10035 - DNA, 185 bp, Artificial Sequence; identical to SEQ ID NO: 10034
  Synthetic polynucleotide

SEQ ID NO: 10036 - DNA, 180 bp, Artificial Sequence
  Synthetic polynucleotide
atcatctcaccttgcctcctgtactcatataacgatcgcctgcaggatatttacataagaatatttacatatcgatatttacatagacatatttacatactaatatttacataactatatttacatatgcatatttacatagtaatatttacataggcgcgccatgcttcatcagactct

SEQ ID NO: 10037 - DNA, 180 bp, Artificial Sequence; identical to SEQ ID NO: 10036
  Synthetic polynucleotide

SEQ ID NO: 10038 - DNA, 172 bp, Artificial Sequence
  Synthetic polynucleotide
atcatctcaccttgcctcctgtatacatagctaccgttcctgcaggcctaattaaaagacctaattaaatcgcctaattaaagaccctaattaaactacctaattaaaactcctaattaaatgccctaattaaagtacctaattaaaggcgcgccatgcttcatcagactct

SEQ ID NO: 10039 - DNA, 172 bp, Artificial Sequence; identical to SEQ ID NO: 10038
  Synthetic polynucleotide

SEQ ID NO: 10040 - DNA, 191 bp, Artificial Sequence
  Synthetic polynucleotide
atcatctcaccttgcctcctgctgtcctaagcagctttcctgcaggcataattaattaacgcgagacataattaattaacgcgtcgcataattaattaacgcggaccataattaattaacgcgctacataattaattaacgcgactcataattaattaacgcgtgcggcgcgccatgcttcatcagactct

SEQ ID NO: 10041 - DNA, 191 bp, Artificial Sequence; identical to SEQ ID NO: 10040
  Synthetic polynucleotide

SEQ ID NO: 10042 - DNA, 156 bp, Artificial Sequence
  Synthetic polynucleotide
atcatctcaccttgcctcctggtgcagtcctactaggacctgcaggtagaaatgagatagaaatgtcgtagaaatggactagaaatgctatagaaatgacttagaaatgtgctagaaatggtatagaaatgggcgcgccatgcttcatcagactct

SEQ ID NO: 10043 - DNA, 156 bp, Artificial Sequence; identical to SEQ ID NO: 10042
  Synthetic polynucleotide

SEQ ID NO: 10044 - DNA, 164 bp, Artificial Sequence
  Synthetic polynucleotide
atcatctcaccttgcctcctgcaagacacgcgagcgaacctgcaggaaaggtcaaagaaaaggtcaatcgaaaggtcaagacaaaggtcaactaaaaggtcaaactaaaggtcaatgcaaaggtcaagtaaaaggtcaaggcgcgccatgcttcatcagactct

SEQ ID NO: 10045 - DNA, 164 bp, Artificial Sequence; identical to SEQ ID NO: 10044
  Synthetic polynucleotide

SEQ ID NO: 10046 - DNA, 172 bp, Artificial Sequence
  Synthetic polynucleotide
atcatctcaccttgcctcctgctaaatgactcgtataccctgcaggtcgattaataagatcgattaatatcgtcgattaatagactcgattaatactatcgattaataacttcgattaatatgctcgattaatagtatcgattaataggcgcgccatgcttcatcagactct

SEQ ID NO: 10047 - DNA, 172 bp, Artificial Sequence; identical to SEQ ID NO: 10046
  Synthetic polynucleotide

SEQ ID NO: 10048 - DNA, 172 bp, Artificial Sequence
  Synthetic polynucleotide
atcatctcaccttgcctcctgagaggattcagccctagcctgcagggcgcacgcgcagagcgcacgcgctcggcgcacgcgcgacgcgcacgcgcctagcgcacgcgcactgcgcacgcgctgcgcgcacgcgcgtagcgcacgcgcggcgcgccatgcttcatcagactct

SEQ ID NO: 10049 - DNA, 172 bp, Artificial Sequence; identical to SEQ ID NO: 10048
  Synthetic polynucleotide

SEQ ID NO: 10050 - DNA, 186 bp, Artificial Sequence
  Synthetic polynucleotide
atcatctcaccttgcctcctgacagtaaatgccgagcccctgcaggacatgcccgggcatgtccggagaacatgcccgggcatgtccggtcgacatgcccgggcatgtccgggacacatgcccgggcatgtccggctaacatgcccgggcatgtccggactggcgcgccatgcttcatcagactct

SEQ ID NO: 10051 - DNA, 186 bp, Artificial Sequence; identical to SEQ ID NO: 10050
  Synthetic polynucleotide

SEQ ID NO: 10052 - DNA, 191 bp, Artificial Sequence
  Synthetic polynucleotide
atcatctcaccttgcctcctgacatgtggctcagaggccctgcaggtaaactgataagaagatagataaactgataagaagattcgtaaactgataagaagatgactaaactgataagaagatctataaactgataagaagatacttaaactgataagaagattgcggcgcgccatgcttcatcagactct

SEQ ID NO: 10053 - DNA, 191 bp, Artificial Sequence; identical to SEQ ID NO: 10052
  Synthetic polynucleotide

SEQ ID NO: 10054 - DNA, 197 bp, Artificial Sequence
  Synthetic polynucleotide
atcatctcaccttgcctcctggcgccaacgtgagatagcctgcaggtccgttgctatgcggagatccgttgctatgcggtcgtccgttgctatgcgggactccgttgctatgcggctatccgttgctatgcggacttccgttgctatgcggtgctccgttgctatgcgggtaggcgcgccatgcttcatcagactct

SEQ ID NO: 10055 - DNA, 197 bp, Artificial Sequence; identical to SEQ ID NO: 10054
  Synthetic polynucleotide

SEQ ID NO: 10056 - DNA, 164 bp, Artificial Sequence
  Synthetic polynucleotide
atcatctcaccttgcctcctggtttctggctcctctaacctgcaggaaaggtcacagaaaaggtcactcgaaaggtcacgacaaaggtcacctaaaaggtcacactaaaggtcactgcaaaggtcacgtaaaaggtcacggcgcgccatgcttcatcagactct

SEQ ID NO: 10057 - DNA, 164 bp, Artificial Sequence; identical to SEQ ID NO: 10056
  Synthetic polynucleotide

SEQ ID NO: 10058 - DNA, 180 bp, Artificial Sequence
  Synthetic polynucleotide
atcatctcaccttgcctcctgccgtcggctatgtaatacctgcaggccgcccacgccagaccgcccacgcctcgccgcccacgccgacccgcccacgccctaccgcccacgccactccgcccacgcctgcccgcccacgccgtaccgcccacgccggcgcgccatgcttcatcagactct

SEQ ID NO: 10059 - DNA, 180 bp, Artificial Sequence; identical to SEQ ID NO: 10058
  Synthetic polynucleotide

SEQ ID NO: 10060 - DNA, 197 bp, Artificial Sequence
  Synthetic polynucleotide
atcatctcaccttgcctcctgcctatgacaggaaatatcctgcagggagcaacaggtggttagagagcaacaggtggtttcggagcaacaggtggttgacgagcaacaggtggttctagagcaacaggtggttactgagcaacaggtggtttgcgagcaacaggtggttgtaggcgcgccatgcttcatcagactct

SEQ ID NO: 10061 - DNA, 197 bp, Artificial Sequence; identical to SEQ ID NO: 10060
  Synthetic polynucleotide

SEQ ID NO: 10062 - DNA, 180 bp, Artificial Sequence
  Synthetic polynucleotide
atcatctcaccttgcctcctgttcgtccagcgtttatacctgcaggatattaattaaagaatattaattaatcgatattaattaagacatattaattaactaatattaattaaactatattaattaatgcatattaattaagtaatattaattaaggcgcgccatgcttcatcagactct

SEQ ID NO: 10063 - DNA, 180 bp, Artificial Sequence; identical to SEQ ID NO: 10062
  Synthetic polynucleotide

SEQ ID NO: 10064 - DNA, 172 bp, Artificial Sequence
  Synthetic polynucleotide
atcatctcaccttgcctcctggggtacttcaatataagcctgcaggagggggcgggagaagggggcgggtcgagggggcggggacagggggcgggctaagggggcgggactagggggcgggtgcagggggcggggtaagggggcgggggcgcgccatgcttcatcagactct

SEQ ID NO: 10065 - DNA, 172 bp, Artificial Sequence; identical to SEQ ID NO: 10064
  Synthetic polynucleotide

SEQ ID NO: 10066 - DNA, 164 bp, Artificial Sequence
  Synthetic polynucleotide
atcatctcaccttgcctcctgtgcgtaccttccggtgacctgcaggactgttactagaactgttacttcgactgttactgacactgttactctaactgttactactactgttacttgcactgttactgtaactgttactggcgcgccatgcttcatcagactct

SEQ ID NO: 10067 - DNA, 164 bp, Artificial Sequence; identical to SEQ ID NO: 10066
  Synthetic polynucleotide

SEQ ID NO: 10068 - DNA, 188 bp, Artificial Sequence
  Synthetic polynucleotide
atcatctcaccttgcctcctgtggtggctccattccaacctgcaggagataaaagggaagaagataaaagggatcgagataaaagggagacagataaaagggactaagataaaagggaactagataaaagggatgcagataaaagggagtaagataaaagggaggcgcgccatgcttcatcagactct

SEQ ID NO: 10069 - DNA, 188 bp, Artificial Sequence; identical to SEQ ID NO: 10068
  Synthetic polynucleotide

SEQ ID NO: 10070 - DNA, 197 bp, Artificial Sequence
  Synthetic polynucleotide
atcatctcaccttgcctcctgaatgtccgcaaatgctacctgcaggccgaagcaggtggcgaagagaccgaagcaggtggcgaagtcgccgaagcaggtggcgaaggacccgaagcaggtggcgaagctaccgaagcaggtggcgaagactccgaagcaggtggcgaagtgcggcgcgccatgcttcatcagactct

SEQ ID NO: 10071 - DNA, 197 bp, Artificial Sequence; identical to SEQ ID NO: 10070
  Synthetic polynucleotide

SEQ ID NO: 10072 - DNA, 196 bp, Artificial Sequence
  Synthetic polynucleotide
atcatctcaccttgcctcctgagtctatcattccggatcctgcagggtcattttggccgagagtcattttggccgtcggtcattttggccggacgtcattttggccgctagtcattttggccgactgtcattttggccgtgcgtcattttggccggtagtcattttggccgggcgcgccatgcttcatcagactct

SEQ ID NO: 10073 - DNA, 196 bp, Artificial Sequence; identical to SEQ ID NO: 10072
  Synthetic polynucleotide

SEQ ID NO: 10074 - DNA, 172 bp, Artificial Sequence
  Synthetic polynucleotide
atcatctcaccttgcctcctggagcttgcaatccttggcctgcagggaccggaagtagagaccggaagttcggaccggaagtgacgaccggaagtctagaccggaagtactgaccggaagttgcgaccggaagtgtagaccggaagtggcgcgccatgcttcatcagactct

SEQ ID NO: 10075 - DNA, 172 bp, Artificial Sequence; identical to SEQ ID NO: 10074
  Synthetic polynucleotide

SEQ ID NO: 10076 - DNA, 180 bp, Artificial Sequence
  Synthetic polynucleotide
atcatctcaccttgcctcctgtctactcccaaggtgctcctgcaggtgatgacgcaaagatgatgacgcaatcgtgatgacgcaagactgatgacgcaactatgatgacgcaaacttgatgacgcaatgctgatgacgcaagtatgatgacgcaaggcgcgccatgcttcatcagactct

SEQ ID NO: 10077 - DNA, 180 bp, Artificial Sequence; identical to SEQ ID NO: 10076
  Synthetic polynucleotide

SEQ ID NO: 10078 - DNA, 185 bp, Artificial Sequence
  Synthetic polynucleotide
atcatctcaccttgcctcctgggttagaacatatcggacctgcaggtttttgcacacggcccagatttttgcacacggccctcgtttttgcacacggcccgactttttgcacacggcccctatttttgcacacggcccacttttttgcacacggccctgcggcgcgccatgcttcatcagactct

SEQ ID NO: 10079 - DNA, 185 bp, Artificial Sequence; identical to SEQ ID NO: 10078
  Synthetic polynucleotide

SEQ ID NO: 10080 - DNA, 185 bp, Artificial Sequence
  Synthetic polynucleotide
atcatctcaccttgcctcctgctacactgaagccgctccctgcaggttttgctactgtaaaaagattttgctactgtaaaatcgttttgctactgtaaaagacttttgctactgtaaaactattttgctactgtaaaaactttttgctactgtaaaatgcggcgcgccatgcttcatcagactct

SEQ ID NO: 10081 - DNA, 185 bp, Artificial Sequence; identical to SEQ ID NO: 10080
  Synthetic polynucleotide

SEQ ID NO: 10082 - DNA, 172 bp, Artificial Sequence
  Synthetic polynucleotide
atcatctcaccttgcctcctggcctcggatttaacgggcctgcaggctgtcactcaagactgtcactcatcgctgtcactcagacctgtcactcactactgtcactcaactctgtcactcatgcctgtcactcagtactgtcactcaggcgcgccatgcttcatcagactct

SEQ ID NO: 10083 - DNA, 172 bp, Artificial Sequence; identical to SEQ ID NO: 10082
  Synthetic polynucleotide

SEQ ID NO: 10084 - DNA, 156 bp, Artificial Sequence
  Synthetic polynucleotide
atcatctcaccttgcctcctgattcaccttaccgtctacctgcaggtttcccgcagatttcccgctcgtttcccgcgactttcccgcctatttcccgcacttttcccgctgctttcccgcgtatttcccgcggcgcgccatgcttcatcagactct

SEQ ID NO: 10085 - DNA, 156 bp, Artificial Sequence; identical to SEQ ID NO: 10084
  Synthetic polynucleotide

SEQ ID NO: 10086 - DNA, 180 bp, Artificial Sequence
  Synthetic polynucleotide
atcatctcaccttgcctcctggtattacggcaatgaatcctgcaggcaaagtaaacaagacaaagtaaacatcgcaaagtaaacagaccaaagtaaacactacaaagtaaacaactcaaagtaaacatgccaaagtaaacagtacaaagtaaacaggcgcgccatgcttcatcagactct

SEQ ID NO: 10087 - DNA, 180 bp, Artificial Sequence; identical to SEQ ID NO: 10086
  Synthetic polynucleotide

SEQ ID NO: 10088 - DNA, 197 bp, Artificial Sequence
  Synthetic polynucleotide
atcatctcaccttgcctcctgaactaagccaccttccgcctgcaggaccgcctgaggcggtagaaccgcctgaggcggttcgaccgcctgaggcggtgacaccgcctgaggcggtctaaccgcctgaggcggtactaccgcctgaggcggttgcaccgcctgaggcggtgtaggcgcgccatgcttcatcagactct

SEQ ID NO: 10089 - DNA, 197 bp, Artificial Sequence; identical to SEQ ID NO: 10088
  Synthetic polynucleotide

SEQ ID NO: 10090 - DNA, 196 bp, Artificial Sequence
  Synthetic polynucleotide
atcatctcaccttgcctcctgaaatcttaggatgccaccctgcagggggggcgggaaagagagggggcgggaaagtcggggggcgggaaaggacgggggcgggaaagctagggggcgggaaagactgggggcgggaaagtgcgggggcgggaaaggtagggggcgggaaagggcgcgccatgcttcatcagactct

SEQ ID NO: 10091 - DNA, 196 bp, Artificial Sequence; identical to SEQ ID NO: 10090
  Synthetic polynucleotide

SEQ ID NO: 10092 - DNA, 197 bp, Artificial Sequence
  Synthetic polynucleotide
atcatctcaccttgcctcctgtctcattaacgtgtgaacctgcaggataatccgggaccacagaataatccgggaccactcgataatccgggaccacgacataatccgggaccacctaataatccgggaccacactataatccgggaccactgcataatccgggaccacgtaggcgcgccatgcttcatcagactct

SEQ ID NO: 10093 - DNA, 197 bp, Artificial Sequence; identical to SEQ ID NO: 10092
  Synthetic polynucleotide

SEQ ID NO: 10094 - DNA, 156 bp, Artificial Sequence
  Synthetic polynucleotide
atcatctcaccttgcctcctggatgttcacctgcattgcctgcaggcagataagagacagataagtcgcagataaggaccagataagctacagataagactcagataagtgccagataaggtacagataagggcgcgccatgcttcatcagactct

SEQ ID NO: 10095 - DNA, 156 bp, Artificial Sequence; identical to SEQ ID NO: 10094
  Synthetic polynucleotide

SEQ ID NO: 10096 - DNA, 172 bp, Artificial Sequence
  Synthetic polynucleotide
atcatctcaccttgcctcctgtgggacattgcatgctccctgcaggttgatggatgagattgatggatgtcgttgatggatggacttgatggatgctattgatggatgactttgatggatgtgcttgatggatggtattgatggatgggcgcgccatgcttcatcagactct

SEQ ID NO: 10097 - DNA, 172 bp, Artificial Sequence; identical to SEQ ID NO: 10096
  Synthetic polynucleotide

SEQ ID NO: 10098 - DNA, 196 bp, Artificial Sequence
  Synthetic polynucleotide
atcatctcaccttgcctcctgtcttctatatggcattgcctgcaggattttcacaccttagaattttcacacctttcgattttcacaccttgacattttcacaccttctaattttcacaccttactattttcacacctttgcattttcacaccttgtaattttcacaccttggcgcgccatgcttcatcagactct

SEQ ID NO: 10099 - DNA, 196 bp, Artificial Sequence; identical to SEQ ID NO: 10098
  Synthetic polynucleotide

SEQ ID NO: 10100 - DNA, 156 bp, Artificial Sequence
  Synthetic polynucleotide
atcatctcaccttgcctcctgtgggtgctccacaatcccctgcaggtatttccaagatatttccatcgtatttccagactatttccactatatttccaacttatttccatgctatttccagtatatttccaggcgcgccatgcttcatcagactct

SEQ ID NO: 10101 - DNA, 156 bp, Artificial Sequence; identical to SEQ ID NO: 10100
  Synthetic polynucleotide

SEQ ID NO: 10102 - DNA, 188 bp, Artificial Sequence
  Synthetic polynucleotide
atcatctcaccttgcctcctgctaagaacaactgggcgcctgcaggtctattgtttacagatctattgtttactcgtctattgtttacgactctattgtttacctatctattgtttacacttctattgtttactgctctattgtttacgtatctattgtttacggcgcgccatgcttcatcagactct

SEQ ID NO: 10103 - DNA, 188 bp, Artificial Sequence; identical to SEQ ID NO: 10102
  Synthetic polynucleotide

SEQ ID NO: 10104 - DNA, 190 bp, Artificial Sequence
  Synthetic polynucleotide
atcatctcaccttgcctcctgatttctgttcggacctgcctgcaggtttcctagaaagcaagatttcctagaaagcatcgtttcctagaaagcagactttcctagaaagcactatttcctagaaagcaacttttcctagaaagcatgctttcctagaaagcagtaggcgcgccatgcttcatcagactct

SEQ ID NO: 10105 - DNA, 190 bp, Artificial Sequence; identical to SEQ ID NO: 10104
  Synthetic polynucleotide

SEQ ID NO: 10106 - DNA, 164 bp, Artificial Sequence
  Synthetic polynucleotide
atcatctcaccttgcctcctggaagccaggtaatgaatcctgcaggaccaattagagaaccaattagtcgaccaattaggacaccaattagctaaccaattagactaccaattagtgcaccaattaggtaaccaattagggcgcgccatgcttcatcagactct

SEQ ID NO: 10107 - DNA, 164 bp, Artificial Sequence; identical to SEQ ID NO: 10106
  Synthetic polynucleotide

SEQ ID NO: 10108 - DNA, 197 bp, Artificial Sequence
  Synthetic polynucleotide
atcatctcaccttgcctcctggttcggccttatgggctcctgcaggaccggatgtacttccggtagaaccggatgtacttccggttcgaccggatgtacttccggtgacaccggatgtacttccggtctaaccggatgtacttccggtactaccggatgtacttccggttgcggcgcgccatgcttcatcagactct

SEQ ID NO: 10109 - DNA, 197 bp, Artificial Sequence; identical to SEQ ID NO: 10108
  Synthetic polynucleotide

SEQ ID NO: 10110 - DNA, 180 bp, Artificial Sequence
  Synthetic polynucleotide
atcatctcaccttgcctcctggacgcttggagtgtgaccctgcaggcgccatatggtagacgccatatggttcgcgccatatggtgaccgccatatggtctacgccatatggtactcgccatatggttgccgccatatggtgtacgccatatggtggcgcgccatgcttcatcagactct

SEQ ID NO: 10111 - DNA, 180 bp, Artificial Sequence; identical to SEQ ID NO: 10110
  Synthetic polynucleotide

SEQ ID NO: 10112 - DNA, 197 bp, Artificial Sequence
  Synthetic polynucleotide
atcatctcaccttgcctcctgtgatctcaaacttcggtcctgcaggttaattgccaattagagattaattgccaattagtcgttaattgccaattaggacttaattgccaattagctattaattgccaattagactttaattgccaattagtgcttaattgccaattaggtaggcgcgccatgcttcatcagactct

SEQ ID NO: 10113 - DNA, 197 bp, Artificial Sequence; identical to SEQ ID NO: 10112
  Synthetic polynucleotide

SEQ ID NO: 10114 - DNA, 164 bp, Artificial Sequence
  Synthetic polynucleotide
atcatctcaccttgcctcctgagatcagataacctctacctgcaggtatgcaaatagatatgcaaattcgtatgcaaatgactatgcaaatctatatgcaaatacttatgcaaattgctatgcaaatgtatatgcaaatggcgcgccatgcttcatcagactct

SEQ ID NO: 10115 - DNA, 164 bp, Artificial Sequence; identical to SEQ ID NO: 10114
  Synthetic polynucleotide

SEQ ID NO: 10116 - DNA, 172 bp, Artificial Sequence
  Synthetic polynucleotide
atcatctcaccttgcctcctggttggcgaataccatgtcctgcaggcctttgatctagacctttgatcttcgcctttgatctgaccctttgatctctacctttgatctactcctttgatcttgccctttgatctgtacctttgatctggcgcgccatgcttcatcagactct

SEQ ID NO: 10117 - DNA, 172 bp, Artificial Sequence; identical to SEQ ID NO: 10116
  Synthetic polynucleotide

SEQ ID NO: 10118 - DNA, 172 bp, Artificial Sequence
  Synthetic polynucleotide
atcatctcaccttgcctcctgggatcagcacttgcactcctgcaggagacaagtccagaagacaagtcctcgagacaagtccgacagacaagtccctaagacaagtccactagacaagtcctgcagacaagtccgtaagacaagtccggcgcgccatgcttcatcagactct

SEQ ID NO: 10119 - DNA, 172 bp, Artificial Sequence; identical to SEQ ID NO: 10118
  Synthetic polynucleotide

SEQ ID NO: 10120 - DNA, 197 bp, Artificial Sequence
  Synthetic polynucleotide
atcatctcaccttgcctcctgcacagtctgaacatacgcctgcaggaacaatgcaattgttagaaacaatgcaattgtttcgaacaatgcaattgttgacaacaatgcaattgttctaaacaatgcaattgttactaacaatgcaattgtttgcaacaatgcaattgttgtaggcgcgccatgcttcatcagactct

SEQ ID NO: 10121 - DNA, 197 bp, Artificial Sequence; identical to SEQ ID NO: 10120
  Synthetic polynucleotide

SEQ ID NO: 10122 - DNA, 180 bp, Artificial Sequence
  Synthetic polynucleotide
atcatctcaccttgcctcctggcgacttacaatatctacctgcagggtgcacgtgagagagtgcacgtgagtcggtgcacgtgaggacgtgcacgtgagctagtgcacgtgagactgtgcacgtgagtgcgtgcacgtgaggtagtgcacgtgagggcgcgccatgcttcatcagactct

SEQ ID NO: 10123 - DNA, 180 bp, Artificial Sequence; identical to SEQ ID NO: 10122
  Synthetic polynucleotide

SEQ ID NO: 10124 - DNA, 185 bp, Artificial Sequence
  Synthetic polynucleotide
atcatctcaccttgcctcctggctcagttagggtttagcctgcaggtagagggaagttgcctagatagagggaagttgccttcgtagagggaagttgcctgactagagggaagttgcctctatagagggaagttgcctacttagagggaagttgccttgcggcgcgccatgcttcatcagactct

SEQ ID NO: 10125 - DNA, 185 bp, Artificial Sequence; identical to SEQ ID NO: 10124
  Synthetic polynucleotide

SEQ ID NO: 10126 - DNA, 196 bp, Artificial Sequence
  Synthetic polynucleotide
atcatctcaccttgcctcctgtggacacttatacggcgcctgcaggtaaacaaaaacaaagataaacaaaaacaatcgtaaacaaaaacaagactaaacaaaaacaactataaacaaaaacaaacttaaacaaaaacaatgctaaacaaaaacaagtataaacaaaaacaaggcgcgccatgcttcatcagactct

SEQ ID NO: 10127 - DNA, 196 bp, Artificial Sequence; identical to SEQ ID NO: 10126
  Synthetic polynucleotide

SEQ ID NO: 10128 - DNA, 185 bp, Artificial Sequence
  Synthetic polynucleotide
atcatctcaccttgcctcctggcaagatcgtttaactgcctgcaggttccattaattactacagattccattaattactactcgttccattaattactacgacttccattaattactacctattccattaattactacactttccattaattactactgcggcgcgccatgcttcatcagactct

SEQ ID NO: 10129 - DNA, 185 bp, Artificial Sequence; identical to SEQ ID NO: 10128
  Synthetic polynucleotide

SEQ ID NO: 10130 - DNA, 197 bp, Artificial Sequence
  Synthetic polynucleotide
atcatctcaccttgcctcctgtcaactgcaattcttgtcctgcaggcattttggcgccaaaattagacattttggcgccaaaatttcgcattttggcgccaaaattgaccattttggcgccaaaattctacattttggcgccaaaattactcattttggcgccaaaatttgcggcgcgccatgcttcatcagactct

SEQ ID NO: 10131 - DNA, 197 bp, Artificial Sequence; identical to SEQ ID NO: 10130
  Synthetic polynucleotide

SEQ ID NO: 10132 - DNA, 196 bp, Artificial Sequence
  Synthetic polynucleotide
atcatctcaccttgcctcctgcttcagagaaagctcgacctgcaggtattaatgagctgagatattaatgagctgtcgtattaatgagctggactattaatgagctgctatattaatgagctgacttattaatgagctgtgctattaatgagctggtatattaatgagctgggcgcgccatgcttcatcagactct

SEQ ID NO: 10133 - DNA, 196 bp, Artificial Sequence; identical to SEQ ID NO: 10132
  Synthetic polynucleotide

SEQ ID NO: 10134 - DNA, 156 bp, Artificial Sequence
  Synthetic polynucleotide
atcatctcaccttgcctcctgttggcatcctgtacgtacctgcaggccacctgcagaccacctgctcgccacctgcgacccacctgcctaccacctgcactccacctgctgcccacctgcgtaccacctgcggcgcgccatgcttcatcagactct

SEQ ID NO: 10135 - DNA, 156 bp, Artificial Sequence; identical to SEQ ID NO: 10134
  Synthetic polynucleotide

SEQ ID NO: 10136 - DNA, 180 bp, Artificial Sequence
  Synthetic polynucleotide
atcatctcaccttgcctcctggtagggtttccgtgcaacctgcaggctaagtaaacaagactaagtaaacatcgctaagtaaacagacctaagtaaacactactaagtaaacaactctaagtaaacatgcctaagtaaacagtactaagtaaacaggcgcgccatgcttcatcagactct

SEQ ID NO: 10137 - DNA, 180 bp, Artificial Sequence; identical to SEQ ID NO: 10136
  Synthetic polynucleotide

SEQ ID NO: 10138 - DNA, 172 bp, Artificial Sequence
  Synthetic polynucleotide
atcatctcaccttgcctcctgctaatggaatagcactccctgcagggcgtgggagaagagcgtgggagatcggcgtgggagagacgcgtgggagactagcgtgggagaactgcgtgggagatgcgcgtgggagagtagcgtgggagaggcgcgccatgcttcatcagactct

SEQ ID NO: 10139 - DNA, 172 bp, Artificial Sequence; identical to SEQ ID NO: 10138
  Synthetic polynucleotide

SEQ ID NO: 10140 - DNA, 172 bp, Artificial Sequence
  Synthetic polynucleotide
atcatctcaccttgcctcctgcagaccgctgagttgtccctgcaggttcacaccttagattcacacctttcgttcacaccttgacttcacaccttctattcacaccttactttcacacctttgcttcacaccttgtattcacaccttggcgcgccatgcttcatcagactct

SEQ ID NO: 10141 - DNA, 172 bp, Artificial Sequence; identical to SEQ ID NO: 10140
  Synthetic polynucleotide

SEQ ID NO: 10142 - DNA, 172 bp, Artificial Sequence
  Synthetic polynucleotide
atcatctcaccttgcctcctgtcgatcgcctaccaactcctgcaggcctaattaccagacctaattacctcgcctaattaccgaccctaattaccctacctaattaccactcctaattacctgccctaattaccgtacctaattaccggcgcgccatgcttcatcagactct

SEQ ID NO: 10143 - DNA, 172 bp, Artificial Sequence; identical to SEQ ID NO: 10142
  Synthetic polynucleotide

SEQ ID NO: 10144 - DNA, 200 bp, Artificial Sequence
  Synthetic polynucleotide
atcatctcaccttgcctcctggtgggaaacagctccgacctgcaggcctgaccccaatgacccgaagacctgaccccaatgacccgatcgcctgaccccaatgacccgagaccctgaccccaatgacccgactacctgaccccaatgacccgaactcctgaccccaatgacccgaggcgcgccatgcttcatcagactct

SEQ ID NO: 10145 - DNA, 200 bp, Artificial Sequence; identical to SEQ ID NO: 10144
  Synthetic polynucleotide

SEQ ID NO: 10146 - DNA, 188 bp, Artificial Sequence
  Synthetic polynucleotide
atcatctcaccttgcctcctggtgggttctccacacagcctgcaggcaacaggtggtgagacaacaggtggtgtcgcaacaggtggtggaccaacaggtggtgctacaacaggtggtgactcaacaggtggtgtgccaacaggtggtggtacaacaggtggtgggcgcgccatgcttcatcagactct

SEQ ID NO: 10147 - DNA, 188 bp, Artificial Sequence; identical to SEQ ID NO: 10146
  Synthetic polynucleotide

SEQ ID NO: 10148 - DNA, 172 bp, Artificial Sequence
  Synthetic polynucleotide
atcatctcaccttgcctcctgtgagaagttaaatagcccctgcaggagtgaaagtgagaagtgaaagtgtcgagtgaaagtggacagtgaaagtgctaagtgaaagtgactagtgaaagtgtgcagtgaaagtggtaagtgaaagtgggcgcgccatgcttcatcagactct

SEQ ID NO: 10149 - DNA, 172 bp, Artificial Sequence; identical to SEQ ID NO: 10148
  Synthetic polynucleotide

SEQ ID NO: 10150 - DNA, 191 bp, Artificial Sequence
  Synthetic polynucleotide
atcatctcaccttgcctcctgagtcacggtgaaacgcgcctgcagggtccaaaaatggagatcagagtccaaaaatggagatctcggtccaaaaatggagatcgacgtccaaaaatggagatcctagtccaaaaatggagatcactgtccaaaaatggagatctgcggcgcgccatgcttcatcagactct

SEQ ID NO: 10151 - DNA, 191 bp, Artificial Sequence; identical to SEQ ID NO: 10150
  Synthetic polynucleotide

SEQ ID NO: 10152 - DNA, 164 bp, Artificial Sequence
  Synthetic polynucleotide
atcatctcaccttgcctcctggtcaacctgcaaggcttcctgcaggaccggaaatagaaccggaaattcgaccggaaatgacaccggaaatctaaccggaaatactaccggaaattgcaccggaaatgtaaccggaaatggcgcgccatgcttcatcagactct

SEQ ID NO: 10153 - DNA, 164 bp, Artificial Sequence; identical to SEQ ID NO: 10152
  Synthetic polynucleotide

SEQ ID NO: 10154 - DNA, 132 bp, Artificial Sequence
  Synthetic polynucleotide
atcatctcaccttgcctcctgggcaaatccctatcattcctgcaggtaacaagataacatcgtaacagactaacactataacaacttaacatgctaacagtataacaggcgcgccatgcttcatcagactct

SEQ ID NO: 10155 - DNA, 132 bp, Artificial Sequence; identical to SEQ ID NO: 10154
  Synthetic polynucleotide

SEQ ID NO: 10156 - DNA, 191 bp, Artificial Sequence
  Synthetic polynucleotide
atcatctcaccttgcctcctgaagaatatccacgttctcctgcaggaaaaagaggaagtgaaaagaaaaaagaggaagtgaaatcgaaaaagaggaagtgaaagacaaaaagaggaagtgaaactaaaaaagaggaagtgaaaactaaaaagaggaagtgaaatgcggcgcgccatgcttcatcagactct

SEQ ID NO: 10157 - DNA, 191 bp, Artificial Sequence; identical to SEQ ID NO: 10156
  Synthetic polynucleotide

SEQ ID NO: 10158 - DNA, 196 bp, Artificial Sequence
  Synthetic polynucleotide
atcatctcaccttgcctcctgaggtctccttgattgttcctgcaggctaaaatgactcagcaattatgagactaaaatgactcagcaattatgtcgctaaaatgactcagcaattatggacctaaaatgactcagcaattatgctactaaaatgactcagcaattatgactggcgcgccatgcttcatcagactct

SEQ ID NO: 10159 - DNA, 196 bp, Artificial Sequence; identical to SEQ ID NO: 10158
  Synthetic polynucleotide

SEQ ID NO: 10160 - DNA, 172 bp, Artificial Sequence
  Synthetic polynucleotide
atcatctcaccttgcctcctggacttgaagcgtaggtccctgcaggagcgcgcgcgagaagcgcgcgcgtcgagcgcgcgcggacagcgcgcgcgctaagcgcgcgcgactagcgcgcgcgtgcagcgcgcgcggtaagcgcgcgcgggcgcgccatgcttcatcagactct

SEQ ID NO: 10161 - DNA, 172 bp, Artificial Sequence; identical to SEQ ID NO: 10160
  Synthetic polynucleotide

SEQ ID NO: 10162 - DNA, 172 bp, Artificial Sequence
  Synthetic polynucleotide
atcatctcaccttgcctcctgtttagtgaaatgtggtgcctgcaggttcacacctcagattcacacctctcgttcacacctcgacttcacacctcctattcacacctcactttcacacctctgcttcacacctcgtattcacacctcggcgcgccatgcttcatcagactct

SEQ ID NO: 10163 - DNA, 172 bp, Artificial Sequence; identical to SEQ ID NO: 10162
  Synthetic polynucleotide

SEQ ID NO: 10164 - DNA, 156 bp, Artificial Sequence
  Synthetic polynucleotide
atcatctcaccttgcctcctggccctagcataacggcacctgcaggactcatgcagaactcatgctcgactcatgcgacactcatgcctaactcatgcactactcatgctgcactcatgcgtaactcatgcggcgcgccatgcttcatcagactct

SEQ ID NO: 10165 - DNA, 156 bp, Artificial Sequence; identical to SEQ ID NO: 10164
  Synthetic polynucleotide

SEQ ID NO: 10166 - DNA, 190 bp, Artificial Sequence
  Synthetic polynucleotide
atcatctcaccttgcctcctggacatgccgacatgttccctgcaggtaattggtcaattaagataattggtcaattatcgtaattggtcaattagactaattggtcaattactataattggtcaattaacttaattggtcaattatgctaattggtcaattagtaggcgcgccatgcttcatcagactct

SEQ ID NO: 10167 - DNA, 190 bp, Artificial Sequence; identical to SEQ ID NO: 10166
  Synthetic polynucleotide

SEQ ID NO: 10168 - DNA, 196 bp, Artificial Sequence
  Synthetic polynucleotide
atcatctcaccttgcctcctgtttgtgctggcggcacacctgcaggcgtcagctgtcgtagacgtcagctgtcgttcgcgtcagctgtcgtgaccgtcagctgtcgtctacgtcagctgtcgtactcgtcagctgtcgttgccgtcagctgtcgtgtacgtcagctgtcgtggcgcgccatgcttcatcagactct

SEQ ID NO: 10169 - DNA, 196 bp, Artificial Sequence; identical to SEQ ID NO: 10168
  Synthetic polynucleotide

SEQ ID NO: 10170 - DNA, 156 bp, Artificial Sequence
  Synthetic polynucleotide
atcatctcaccttgcctcctgttcgggaatcgccaatgcctgcaggccacctggagaccacctggtcgccacctgggacccacctggctaccacctggactccacctggtgcccacctgggtaccacctggggcgcgccatgcttcatcagactct

SEQ ID NO: 10171 - DNA, 156 bp, Artificial Sequence; identical to SEQ ID NO: 10170
  Synthetic polynucleotide

SEQ ID NO: 10172 - DNA, 196 bp, Artificial Sequence
  Synthetic polynucleotide
atcatctcaccttgcctcctggtatcgctaagtcggcacctgcaggaggggaatcccctagaaggggaatccccttcgaggggaatcccctgacaggggaatcccctctaaggggaatcccctactaggggaatccccttgcaggggaatcccctgtaaggggaatcccctggcgcgccatgcttcatcagactct

SEQ ID NO: 10173 - DNA, 196 bp, Artificial Sequence; identical to SEQ ID NO: 10172
  Synthetic polynucleotide

SEQ ID NO: 10174 - DNA, 180 bp, Artificial Sequence
  Synthetic polynucleotide
atcatctcaccttgcctcctgcaaacgtataatagccgcctgcaggggggcgaggagagaggggcgaggagtcgggggcgaggaggacggggcgaggagctaggggcgaggagactggggcgaggagtgcggggcgaggaggtaggggcgaggagggcgcgccatgcttcatcagactct

SEQ ID NO: 10175 - DNA, 180 bp, Artificial Sequence; identical to SEQ ID NO: 10174
  Synthetic polynucleotide

SEQ ID NO: 10176 - DNA, 172 bp, Artificial Sequence
  Synthetic polynucleotide
atcatctcaccttgcctcctgatttgtataccacgctccctgcaggggcgctgtccagaggcgctgtcctcgggcgctgtccgacggcgctgtccctaggcgctgtccactggcgctgtcctgcggcgctgtccgtaggcgctgtccggcgcgccatgcttcatcagactct

SEQ ID NO: 10177 - DNA, 172 bp, Artificial Sequence; identical to SEQ ID NO: 10176
  Synthetic polynucleotide

SEQ ID NO: 10178 - DNA, 190 bp, Artificial Sequence
  Synthetic polynucleotide
atcatctcaccttgcctcctgccagtcaaggcgttggtcctgcaggtgacctttgaacctagatgacctttgaaccttcgtgacctttgaacctgactgacctttgaacctctatgacctttgaacctacttgacctttgaaccttgctgacctttgaacctgtaggcgcgccatgcttcatcagactct

SEQ ID NO: 10179 - DNA, 190 bp, Artificial Sequence; identical to SEQ ID NO: 10178
  Synthetic polynucleotide

SEQ ID NO: 10180 - DNA, 172 bp, Artificial Sequence
  Synthetic polynucleotide
atcatctcaccttgcctcctgatcattgtgatctatgccctgcaggttggcgccaaagattggcgccaatcgttggcgccaagacttggcgccaactattggcgccaaactttggcgccaatgcttggcgccaagtattggcgccaaggcgcgccatgcttcatcagactct

SEQ ID NO: 10181 - DNA, 172 bp, Artificial Sequence; identical to SEQ ID NO: 10180
  Synthetic polynucleotide

SEQ ID NO: 10182 - DNA, 148 bp, Artificial Sequence
  Synthetic polynucleotide
atcatctcaccttgcctcctgagtttatacccgtacagcctgcagggcagagaagagcagagatcggcagagagacgcagagactagcagagaactgcagagatgcgcagagagtagcagagaggcgcgccatgcttcatcagactct

SEQ ID NO: 10183 - DNA, 148 bp, Artificial Sequence; identical to SEQ ID NO: 10182
  Synthetic polynucleotide

SEQ ID NO: 10184 - DNA, 190 bp, Artificial Sequence
  Synthetic polynucleotide
atcatctcaccttgcctcctgtttgggttatccctcgtcctgcaggtccgcccccgcattagatccgcccccgcatttcgtccgcccccgcattgactccgcccccgcattctatccgcccccgcattacttccgcccccgcatttgctccgcccccgcattgtaggcgcgccatgcttcatcagactct

SEQ ID NO: 10185 - DNA, 190 bp, Artificial Sequence; identical to SEQ ID NO: 10184
  Synthetic polynucleotide

SEQ ID NO: 10186 - DNA, 188 bp, Artificial Sequence
  Synthetic polynucleotide
atcatctcaccttgcctcctgcgatgttgtggtatattcctgcaggatgcataaattaagaatgcataaattatcgatgcataaattagacatgcataaattactaatgcataaattaactatgcataaattatgcatgcataaattagtaatgcataaattaggcgcgccatgcttcatcagactct

SEQ ID NO: 10187 - DNA, 188 bp, Artificial Sequence; identical to SEQ ID NO: 10186
  Synthetic polynucleotide

SEQ ID NO: 10188 - DNA, 180 bp, Artificial Sequence
  Synthetic polynucleotide
atcatctcaccttgcctcctgagacgataacgactcaacctgcaggttttatggcttagattttatggctttcgttttatggcttgacttttatggcttctattttatggcttactttttatggctttgcttttatggcttgtattttatggcttggcgcgccatgcttcatcagactct

SEQ ID NO: 10189 - DNA, 180 bp, Artificial Sequence; identical to SEQ ID NO: 10188
  Synthetic polynucleotide

SEQ ID NO: 10190 - DNA, 180 bp, Artificial Sequence
  Synthetic polynucleotide
atcatctcaccttgcctcctgtcgtaacataacctcaccctgcaggtcaaggtcataagatcaaggtcatatcgtcaaggtcatagactcaaggtcatactatcaaggtcataacttcaaggtcatatgctcaaggtcatagtatcaaggtcataggcgcgccatgcttcatcagactct

SEQ ID NO: 10191 - DNA, 180 bp, Artificial Sequence; identical to SEQ ID NO: 10190
  Synthetic polynucleotide

SEQ ID NO: 10192 - DNA, 185 bp, Artificial Sequence
  Synthetic polynucleotide
atcatctcaccttgcctcctgagctctgagtagtgtggcctgcaggctttaagtacttaatgagactttaagtacttaatgtcgctttaagtacttaatggacctttaagtacttaatgctactttaagtacttaatgactctttaagtacttaatgtgcggcgcgccatgcttcatcagactct

SEQ ID NO: 10193 - DNA, 185 bp, Artificial Sequence; identical to SEQ ID NO: 10192
  Synthetic polynucleotide

SEQ ID NO: 10194 - DNA, 180 bp, Artificial Sequence
  Synthetic polynucleotide
atcatctcaccttgcctcctgtattccataaccacccacctgcaggcttccaggaagagacttccaggaagtcgcttccaggaaggaccttccaggaagctacttccaggaagactcttccaggaagtgccttccaggaaggtacttccaggaagggcgcgccatgcttcatcagactct

SEQ ID NO: 10195 - DNA, 180 bp, Artificial Sequence; identical to SEQ ID NO: 10194
  Synthetic polynucleotide

SEQ ID NO: 10196 - DNA, 188 bp, Artificial Sequence
  Synthetic polynucleotide
atcatctcaccttgcctcctgacgctctattaacgaatcctgcagggctgagtcagcaagagctgagtcagcatcggctgagtcagcagacgctgagtcagcactagctgagtcagcaactgctgagtcagcatgcgctgagtcagcagtagctgagtcagcaggcgcgccatgcttcatcagactct

SEQ ID NO: 10197 - DNA, 188 bp, Artificial Sequence; identical to SEQ ID NO: 10196
  Synthetic polynucleotide

SEQ ID NO: 10198 - DNA, 190 bp, Artificial Sequence
  Synthetic polynucleotide
atcatctcaccttgcctcctggtaaaggaccacccgtccctgcagggttatgtaatgcatagagttatgtaatgcattcggttatgtaatgcatgacgttatgtaatgcatctagttatgtaatgcatactgttatgtaatgcattgcgttatgtaatgcatgtaggcgcgccatgcttcatcagactct

SEQ ID NO: 10199 - DNA, 190 bp, Artificial Sequence; identical to SEQ ID NO: 10198
  Synthetic polynucleotide

SEQ ID NO: 10200 - DNA, 197 bp, Artificial Sequence
  Synthetic polynucleotide
atcatctcaccttgcctcctggcatcctacacataagtcctgcagggaggtcaaaaggtcaagagaggtcaaaaggtcatcggaggtcaaaaggtcagacgaggtcaaaaggtcactagaggtcaaaaggtcaactgaggtcaaaaggtcatgcgaggtcaaaaggtcagtaggcgcgccatgcttcatcagactct

SEQ ID NO: 10201 - DNA, 197 bp, Artificial Sequence; identical to SEQ ID NO: 10200
  Synthetic polynucleotide

SEQ ID NO: 10202 - DNA, 200 bp, Artificial Sequence
  Synthetic polynucleotide
atcatctcaccttgcctcctggtagtcccacgcaaccacctgcagggcggacgttcaacgtccgcagagcggacgttcaacgtccgctcggcggacgttcaacgtccgcgacgcggacgttcaacgtccgcctagcggacgttcaacgtccgcactgcggacgttcaacgtccgcggcgcgccatgcttcatcagactct

SEQ ID NO: 10203 - DNA, 200 bp, Artificial Sequence; identical to SEQ ID NO: 10202
  Synthetic polynucleotide

SEQ ID NO: 10204 - DNA, 180 bp, Artificial Sequence
  Synthetic polynucleotide
atcatctcaccttgcctcctgaaggaagggaaccacgccctgcaggaccgtgggaaaagaaccgtgggaaatcgaccgtgggaaagacaccgtgggaaactaaccgtgggaaaactaccgtgggaaatgcaccgtgggaaagtaaccgtgggaaaggcgcgccatgcttcatcagactct

SEQ ID NO: 10205 - DNA, 180 bp, Artificial Sequence; identical to SEQ ID NO: 10204
  Synthetic polynucleotide

SEQ ID NO: 10206 - DNA, 191 bp, Artificial Sequence
  Synthetic polynucleotide
atcatctcaccttgcctcctgcgaggttggttgatatacctgcaggtcacccatcaataatcaagatcacccatcaataatcatcgtcacccatcaataatcagactcacccatcaataatcactatcacccatcaataatcaacttcacccatcaataatcatgcggcgcgccatgcttcatcagactct

SEQ ID NO: 10207 - DNA, 191 bp, Artificial Sequence; identical to SEQ ID NO: 10206
  Synthetic polynucleotide

SEQ ID NO: 10208 - DNA, 156 bp, Artificial Sequence
  Synthetic polynucleotide
atcatctcaccttgcctcctgcttggttaagtttgacgcctgcaggcgatattgagacgatattgtcgcgatattggaccgatattgctacgatattgactcgatattgtgccgatattggtacgatattgggcgcgccatgcttcatcagactct

SEQ ID NO: 10209 - DNA, 156 bp, Artificial Sequence; identical to SEQ ID NO: 10208
  Synthetic polynucleotide

SEQ ID NO: 10210 - DNA, 164 bp, Artificial Sequence
  Synthetic polynucleotide
atcatctcaccttgcctcctggcctacctcaaagaccgcctgcaggcacctgttgagacacctgttgtcgcacctgttggaccacctgttgctacacctgttgactcacctgttgtgccacctgttggtacacctgttgggcgcgccatgcttcatcagactct

SEQ ID NO: 10211 - DNA, 164 bp, Artificial Sequence; identical to SEQ ID NO: 10210
  Synthetic polynucleotide

SEQ ID NO: 10212 - DNA, 190 bp, Artificial Sequence
  Synthetic polynucleotide
atcatctcaccttgcctcctggcggaatcagatccgtacctgcaggattatcgattttttagaattatcgatttttttcgattatcgattttttgacattatcgattttttctaattatcgattttttactattatcgatttttttgcattatcgattttttgtaggcgcgccatgcttcatcagactct

SEQ ID NO: 10213 - DNA, 190 bp, Artificial Sequence; identical to SEQ ID NO: 10212
  Synthetic polynucleotide

SEQ ID NO: 10214 - DNA, 172 bp, Artificial Sequence
  Synthetic polynucleotide
atcatctcaccttgcctcctgtgttccttctgttcgtccctgcaggttggggggctagattggggggcttcgttggggggctgacttggggggctctattggggggctactttggggggcttgcttggggggctgtattggggggctggcgcgccatgcttcatcagactct

SEQ ID NO: 10215 - DNA, 172 bp, Artificial Sequence; identical to SEQ ID NO: 10214
  Synthetic polynucleotide

SEQ ID NO: 10216 - DNA, 191 bp, Artificial Sequence
  Synthetic polynucleotide
atcatctcaccttgcctcctgtggtttctttgggtgggcctgcagggattattaattaacttgagagattattaattaacttgtcggattattaattaacttggacgattattaattaacttgctagattattaattaacttgactgattattaattaacttgtgcggcgcgccatgcttcatcagactct

SEQ ID NO: 10217 - DNA, 191 bp, Artificial Sequence; identical to SEQ ID NO: 10216
  Synthetic polynucleotide

SEQ ID NO: 10218 - DNA, 185 bp, Artificial Sequence
  Synthetic polynucleotide
atcatctcaccttgcctcctgtggttctcgtactctggcctgcaggtgttacttctttctgcagatgttacttctttctgctcgtgttacttctttctgcgactgttacttctttctgcctatgttacttctttctgcacttgttacttctttctgctgcggcgcgccatgcttcatcagactct

SEQ ID NO: 10219 - DNA, 185 bp, Artificial Sequence; identical to SEQ ID NO: 10218
  Synthetic polynucleotide

SEQ ID NO: 10220 - DNA, 172 bp, Artificial Sequence
  Synthetic polynucleotide
atcatctcaccttgcctcctgagccctaatttgatgtgcctgcagggacgtgggcgagagacgtgggcgtcggacgtgggcggacgacgtgggcgctagacgtgggcgactgacgtgggcgtgcgacgtgggcggtagacgtgggcgggcgcgccatgcttcatcagactct

SEQ ID NO: 10221 - DNA, 172 bp, Artificial Sequence; identical to SEQ ID NO: 10220
  Synthetic polynucleotide

SEQ ID NO: 10222 - DNA, 156 bp, Artificial Sequence
  Synthetic polynucleotide
atcatctcaccttgcctcctgactacagcatatgagtacctgcaggtgacaggtagatgacaggttcgtgacaggtgactgacaggtctatgacaggtacttgacaggttgctgacaggtgtatgacaggtggcgcgccatgcttcatcagactct

SEQ ID NO: 10223 - DNA, 156 bp, Artificial Sequence; identical to SEQ ID NO: 10222
  Synthetic polynucleotide

SEQ ID NO: 10224 - DNA, 191 bp, Artificial Sequence
  Synthetic polynucleotide
atcatctcaccttgcctcctgctttcaggatggtacggcctgcaggttaaggggattaactacagattaaggggattaactactcgttaaggggattaactacgacttaaggggattaactacctattaaggggattaactacactttaaggggattaactactgcggcgcgccatgcttcatcagactct

SEQ ID NO: 10225 - DNA, 191 bp, Artificial Sequence; identical to SEQ ID NO: 10224
  Synthetic polynucleotide

SEQ ID NO: 10226 - DNA, 172 bp, Artificial Sequence
  Synthetic polynucleotide
atcatctcaccttgcctcctgaggactcgggtctccaacctgcaggtcttaattagagatcttaattagtcgtcttaattaggactcttaattagctatcttaattagacttcttaattagtgctcttaattaggtatcttaattagggcgcgccatgcttcatcagactct

SEQ ID NO: 10227 - DNA, 172 bp, Artificial Sequence; identical to SEQ ID NO: 10226
  Synthetic polynucleotide

SEQ ID NO: 10228 - DNA, 185 bp, Artificial Sequence
  Synthetic polynucleotide
atcatctcaccttgcctcctgatgatgcagatgcagagcctgcaggaacaatgtgcagtgttagaaacaatgtgcagtgtttcgaacaatgtgcagtgttgacaacaatgtgcagtgttctaaacaatgtgcagtgttactaacaatgtgcagtgtttgcggcgcgccatgcttcatcagactct

SEQ ID NO: 10229 - DNA, 185 bp, Artificial Sequence; identical to SEQ ID NO: 10228
  Synthetic polynucleotide

SEQ ID NO: 10230 - DNA, 172 bp, Artificial Sequence
  Synthetic polynucleotide
atcatctcaccttgcctcctgcgaccgaaatagcaaagcctgcaggtgtttacataagatgtttacatatcgtgtttacatagactgtttacatactatgtttacataacttgtttacatatgctgtttacatagtatgtttacataggcgcgccatgcttcatcagactct

SEQ ID NO: 10231 - DNA, 172 bp, Artificial Sequence; identical to SEQ ID NO: 10230
  Synthetic polynucleotide

SEQ ID NO: 10232 - DNA, 190 bp, Artificial Sequence
  Synthetic polynucleotide
atcatctcaccttgcctcctggaccgtgtggcgtataacctgcaggaggagatgactcatagaaggagatgactcattcgaggagatgactcatgacaggagatgactcatctaaggagatgactcatactaggagatgactcattgcaggagatgactcatgtaggcgcgccatgcttcatcagactct

SEQ ID NO: 10233 - DNA, 190 bp, Artificial Sequence; identical to SEQ ID NO: 10232
  Synthetic polynucleotide

SEQ ID NO: 10234 - DNA, 197 bp, Artificial Sequence
  Synthetic polynucleotide
atcatctcaccttgcctcctgagggaggcgatacatgccctgcaggcatggagttttccacagacatggagttttccactcgcatggagttttccacgaccatggagttttccacctacatggagttttccacactcatggagttttccactgccatggagttttccacgtaggcgcgccatgcttcatcagactct

SEQ ID NO: 10235 - DNA, 197 bp, Artificial Sequence; identical to SEQ ID NO: 10234
  Synthetic polynucleotide

SEQ ID NO: 10236 - DNA, 156 bp, Artificial Sequence
  Synthetic polynucleotide
atcatctcaccttgcctcctgagtggctatccaatctccctgcagggccacgtgagagccacgtgtcggccacgtggacgccacgtgctagccacgtgactgccacgtgtgcgccacgtggtagccacgtgggcgcgccatgcttcatcagactct

SEQ ID NO: 10237 - DNA, 156 bp, Artificial Sequence; identical to SEQ ID NO: 10236
  Synthetic polynucleotide

SEQ ID NO: 10238 - DNA, 172 bp, Artificial Sequence
  Synthetic polynucleotide
atcatctcaccttgcctcctgctgatgcgtcgagacttcctgcaggtgactcagcaagatgactcagcatcgtgactcagcagactgactcagcactatgactcagcaacttgactcagcatgctgactcagcagtatgactcagcaggcgcgccatgcttcatcagactct

SEQ ID NO: 10239 - DNA, 172 bp, Artificial Sequence; identical to SEQ ID NO: 10238
  Synthetic polynucleotide

SEQ ID NO: 10240 - DNA, 164 bp, Artificial Sequence
  Synthetic polynucleotide
atcatctcaccttgcctcctgaacatacctagcttactcctgcaggccagctgatagaccagctgattcgccagctgatgacccagctgatctaccagctgatactccagctgattgcccagctgatgtaccagctgatggcgcgccatgcttcatcagactct

SEQ ID NO: 10241 - DNA, 164 bp, Artificial Sequence; identical to SEQ ID NO: 10240
  Synthetic polynucleotide

SEQ ID NO: 10242 - DNA, 164 bp, Artificial Sequence
  Synthetic polynucleotide
atcatctcaccttgcctcctgtggcgaccatcctgttacctgcaggcacttgaaaagacacttgaaatcgcacttgaaagaccacttgaaactacacttgaaaactcacttgaaatgccacttgaaagtacacttgaaaggcgcgccatgcttcatcagactct

SEQ ID NO: 10243 - DNA, 164 bp, Artificial Sequence; identical to SEQ ID NO: 10242
  Synthetic polynucleotide

SEQ ID NO: 10244 - DNA, 200 bp, Artificial Sequence
  Synthetic polynucleotide
atcatctcaccttgcctcctgcctatcatgtcccgatacctgcaggcttaatctacatttaacatagacttaatctacatttaacattcgcttaatctacatttaacatgaccttaatctacatttaacatctacttaatctacatttaacatactcttaatctacatttaacatggcgcgccatgcttcatcagactct

SEQ ID NO: 10245 - DNA, 200 bp, Artificial Sequence; identical to SEQ ID NO: 10244
  Synthetic polynucleotide

SEQ ID NO: 10246 - DNA, 197 bp, Artificial Sequence
  Synthetic polynucleotide
atcatctcaccttgcctcctggacaggtaggctgcatacctgcaggtagtagccatggcaacaaagatagtagccatggcaacaatcgtagtagccatggcaacaagactagtagccatggcaacaactatagtagccatggcaacaaacttagtagccatggcaacaatgcggcgcgccatgcttcatcagactct

SEQ ID NO: 10247 - DNA, 197 bp, Artificial Sequence; identical to SEQ ID NO: 10246
  Synthetic polynucleotide

SEQ ID NO: 10248 - DNA, 172 bp, Artificial Sequence
  Synthetic polynucleotide
atcatctcaccttgcctcctgttattcaccacaccgcccctgcaggtgtttacattagatgtttacatttcgtgtttacattgactgtttacattctatgtttacattacttgtttacatttgctgtttacattgtatgtttacattggcgcgccatgcttcatcagactct

SEQ ID NO: 10249 - DNA, 172 bp, Artificial Sequence; identical to SEQ ID NO: 10248
  Synthetic polynucleotide

SEQ ID NO: 10250 - DNA, 172 bp, Artificial Sequence
  Synthetic polynucleotide
atcatctcaccttgcctcctgtgcctacgtcgttgtttcctgcagggttgctaaggagagttgctaaggtcggttgctaagggacgttgctaaggctagttgctaaggactgttgctaaggtgcgttgctaagggtagttgctaaggggcgcgccatgcttcatcagactct

SEQ ID NO: 10251 - DNA, 172 bp, Artificial Sequence; identical to SEQ ID NO: 10250
  Synthetic polynucleotide

SEQ ID NO: 10252 - DNA, 185 bp, Artificial Sequence
  Synthetic polynucleotide
atcatctcaccttgcctcctgcatgacggatattcaaccctgcaggagggttatttttagagagaagggttatttttagagtcgagggttatttttagaggacagggttatttttagagctaagggttatttttagagactagggttatttttagagtgcggcgcgccatgcttcatcagactct

SEQ ID NO: 10253 - DNA, 185 bp, Artificial Sequence; identical to SEQ ID NO: 10252
  Synthetic polynucleotide

SEQ ID NO: 10254 - DNA, 191 bp, Artificial Sequence
  Synthetic polynucleotide
atcatctcaccttgcctcctggcacacccaaacctctccctgcagggagtgtacgtacgatggagagagtgtacgtacgatggtcggagtgtacgtacgatgggacgagtgtacgtacgatggctagagtgtacgtacgatggactgagtgtacgtacgatggtgcggcgcgccatgcttcatcagactct

SEQ ID NO: 10255 - DNA, 191 bp, Artificial Sequence; identical to SEQ ID NO: 10254
  Synthetic polynucleotide

SEQ ID NO: 10256 - DNA, 164 bp, Artificial Sequence
  Synthetic polynucleotide
atcatctcaccttgcctcctggcgtgggaatctagagtcctgcaggagcgtgacgagaagcgtgacgtcgagcgtgacggacagcgtgacgctaagcgtgacgactagcgtgacgtgcagcgtgacggtaagcgtgacgggcgcgccatgcttcatcagactct

SEQ ID NO: 10257 - DNA, 164 bp, Artificial Sequence; identical to SEQ ID NO: 10256
  Synthetic polynucleotide

SEQ ID NO: 10258 - DNA, 196 bp, Artificial Sequence
  Synthetic polynucleotide
atcatctcaccttgcctcctgattgatctaggtggtgtcctgcaggttttctgggaattagattttctgggaatttcgttttctgggaattgacttttctgggaattctattttctgggaattactttttctgggaatttgcttttctgggaattgtattttctgggaattggcgcgccatgcttcatcagactct

SEQ ID NO: 10259 - DNA, 196 bp, Artificial Sequence; identical to SEQ ID NO: 10258
  Synthetic polynucleotide

SEQ ID NO: 10260 - DNA, 172 bp, Artificial Sequence
  Synthetic polynucleotide
atcatctcaccttgcctcctgggacggagcaaagttggcctgcaggtcagaggtcaagatcagaggtcatcgtcagaggtcagactcagaggtcactatcagaggtcaacttcagaggtcatgctcagaggtcagtatcagaggtcaggcgcgccatgcttcatcagactct

SEQ ID NO: 10261 - DNA, 172 bp, Artificial Sequence; identical to SEQ ID NO: 10260
  Synthetic polynucleotide

SEQ ID NO: 10262 - DNA, 191 bp, Artificial Sequence
  Synthetic polynucleotide
atcatctcaccttgcctcctggtgaaagctttattcaccctgcaggatccttaagtggttaagagaatccttaagtggttaagtcgatccttaagtggttaaggacatccttaagtggttaagctaatccttaagtggttaagactatccttaagtggttaagtgcggcgcgccatgcttcatcagactct

SEQ ID NO: 10263 - DNA, 191 bp, Artificial Sequence; identical to SEQ ID NO: 10262
  Synthetic polynucleotide

SEQ ID NO: 10264 - DNA, 164 bp, Artificial Sequence
  Synthetic polynucleotide
atcatctcaccttgcctcctgtctctcattagcgtagacctgcaggcagatagggagacagatagggtcgcagataggggaccagatagggctacagatagggactcagatagggtgccagataggggtacagatagggggcgcgccatgcttcatcagactct

SEQ ID NO: 10265 - DNA, 164 bp, Artificial Sequence; identical to SEQ ID NO: 10264
  Synthetic polynucleotide

SEQ ID NO: 10266 - DNA, 191 bp, Artificial Sequence
  Synthetic polynucleotide
atcatctcaccttgcctcctgtcaaacacgtgagtattcctgcaggcctgctgggagttgtagtcccagacctgctgggagttgtagtccctcgcctgctgggagttgtagtcccgaccctgctgggagttgtagtcccctacctgctgggagttgtagtcccactggcgcgccatgcttcatcagactct

SEQ ID NO: 10267 - DNA, 191 bp, Artificial Sequence; identical to SEQ ID NO: 10266
  Synthetic polynucleotide

SEQ ID NO: 10268 - DNA, 164 bp, Artificial Sequence
  Synthetic polynucleotide
atcatctcaccttgcctcctgcgatatctgttgaacgacctgcaggacctgcaggagaacctgcaggtcgacctgcagggacacctgcaggctaacctgcaggactacctgcaggtgcacctgcagggtaacctgcaggggcgcgccatgcttcatcagactct

SEQ ID NO: 10269 - DNA, 164 bp, Artificial Sequence; identical to SEQ ID NO: 10268
  Synthetic polynucleotide

SEQ ID NO: 10270 - DNA, 196 bp, Artificial Sequence
  Synthetic polynucleotide
atcatctcaccttgcctcctgggaagtctgtaccaactcctgcaggtgtttatttacttagatgtttatttactttcgtgtttatttacttgactgtttatttacttctatgtttatttacttacttgtttatttactttgctgtttatttacttgtatgtttatttacttggcgcgccatgcttcatcagactct

SEQ ID NO: 10271 - DNA, 196 bp, Artificial Sequence; identical to SEQ ID NO: 10270
  Synthetic polynucleotide

SEQ ID NO: 10272 - DNA, 164 bp, Artificial Sequence
  Synthetic polynucleotide
atcatctcaccttgcctcctgtatcaatatcggtatggcctgcaggacccgcatcagaacccgcatctcgacccgcatcgacacccgcatcctaacccgcatcactacccgcatctgcacccgcatcgtaacccgcatcggcgcgccatgcttcatcagactct

SEQ ID NO: 10273 - DNA, 164 bp, Artificial Sequence; identical to SEQ ID NO: 10272
  Synthetic polynucleotide

SEQ ID NO: 10274 - DNA, 197 bp, Artificial Sequence
  Synthetic polynucleotide
atcatctcaccttgcctcctgcattcagcaagtttgagcctgcaggatgatccgggaccacagaatgatccgggaccactcgatgatccgggaccacgacatgatccgggaccacctaatgatccgggaccacactatgatccgggaccactgcatgatccgggaccacgtaggcgcgccatgcttcatcagactct

SEQ ID NO: 10275 - DNA, 197 bp, Artificial Sequence; identical to SEQ ID NO: 10274
  Synthetic polynucleotide

SEQ ID NO: 10276 - DNA, 197 bp, Artificial Sequence
  Synthetic polynucleotide
atcatctcaccttgcctcctggtagtgtcgattctcaacctgcaggtagagcagaaatatcagatagagcagaaatatctcgtagagcagaaatatcgactagagcagaaatatcctatagagcagaaatatcacttagagcagaaatatctgctagagcagaaatatcgtaggcgcgccatgcttcatcagactct

SEQ ID NO: 10277 - DNA, 197 bp, Artificial Sequence; identical to SEQ ID NO: 10276
  Synthetic polynucleotide

SEQ ID NO: 10278 - DNA, 196 bp, Artificial Sequence
  Synthetic polynucleotide
atcatctcaccttgcctcctgctgtcctagaacgagctcctgcaggcgccccctggtggagacgccccctggtggtcgcgccccctggtgggaccgccccctggtggctacgccccctggtggactcgccccctggtggtgccgccccctggtgggtacgccccctggtggggcgcgccatgcttcatcagactct

SEQ ID NO: 10279 - DNA, 196 bp, Artificial Sequence; identical to SEQ ID NO: 10278
  Synthetic polynucleotide

SEQ ID NO: 10280 - DNA, 172 bp, Artificial Sequence
  Synthetic polynucleotide
atcatctcaccttgcctcctgcaagtacacccaagactcctgcagggtaacagctgagagtaacagctgtcggtaacagctggacgtaacagctgctagtaacagctgactgtaacagctgtgcgtaacagctggtagtaacagctgggcgcgccatgcttcatcagactct

SEQ ID NO: 10281 - DNA, 172 bp, Artificial Sequence; identical to SEQ ID NO: 10280
  Synthetic polynucleotide

SEQ ID NO: 10282 - DNA, 180 bp, Artificial Sequence
  Synthetic polynucleotide
atcatctcaccttgcctcctggaagagggttgtgacggcctgcagggtctgtggtttagagtctgtggttttcggtctgtggtttgacgtctgtggtttctagtctgtggtttactgtctgtggttttgcgtctgtggtttgtagtctgtggtttggcgcgccatgcttcatcagactct

SEQ ID NO: 10283 - DNA, 180 bp, Artificial Sequence; identical to SEQ ID NO: 10282
  Synthetic polynucleotide

SEQ ID NO: 10284 - DNA, 197 bp, Artificial Sequence
  Synthetic polynucleotide
atcatctcaccttgcctcctggcatatttgggtcatatcctgcaggtatagcgccctctggtggagatatagcgccctctggtggtcgtatagcgccctctggtgggactatagcgccctctggtggctatatagcgccctctggtggacttatagcgccctctggtggtgcggcgcgccatgcttcatcagactct

SEQ ID NO: 10285 - DNA, 197 bp, Artificial Sequence; identical to SEQ ID NO: 10284
  Synthetic polynucleotide

SEQ ID NO: 10286 - DNA, 190 bp, Artificial Sequence
  Synthetic polynucleotide
atcatctcaccttgcctcctgactgaagtgccgcacatcctgcaggtgggagttgtagttagatgggagttgtagtttcgtgggagttgtagttgactgggagttgtagttctatgggagttgtagttacttgggagttgtagtttgctgggagttgtagttgtaggcgcgccatgcttcatcagactct

SEQ ID NO: 10287 - DNA, 190 bp, Artificial Sequence; identical to SEQ ID NO: 10286
  Synthetic polynucleotide

SEQ ID NO: 10288 - DNA, 156 bp, Artificial Sequence
  Synthetic polynucleotide
atcatctcaccttgcctcctgcctagcgtcttgaaggtcctgcaggaggattaaagaaggattaatcgaggattaagacaggattaactaaggattaaactaggattaatgcaggattaagtaaggattaaggcgcgccatgcttcatcagactct

SEQ ID NO: 10289 - DNA, 156 bp, Artificial Sequence; identical to SEQ ID NO: 10288
  Synthetic polynucleotide

SEQ ID NO: 10290 - DNA, 188 bp, Artificial Sequence
  Synthetic polynucleotide
atcatctcaccttgcctcctggtaaacgctagccttgacctgcaggggccacttgagaagaggccacttgagatcgggccacttgagagacggccacttgagactaggccacttgagaactggccacttgagatgcggccacttgagagtaggccacttgagaggcgcgccatgcttcatcagactct

SEQ ID NO: 10291 - DNA, 188 bp, Artificial Sequence; identical to SEQ ID NO: 10290
  Synthetic polynucleotide

SEQ ID NO: 10292 - DNA, 156 bp, Artificial Sequence
  Synthetic polynucleotide
atcatctcaccttgcctcctgctcgagtgggtcaagcacctgcaggaggattagagaaggattagtcgaggattaggacaggattagctaaggattagactaggattagtgcaggattaggtaaggattagggcgcgccatgcttcatcagactct

SEQ ID NO: 10293 - DNA, 156 bp, Artificial Sequence; identical to SEQ ID NO: 10292
  Synthetic polynucleotide

SEQ ID NO: 10294 - DNA, 172 bp, Artificial Sequence
  Synthetic polynucleotide
atcatctcaccttgcctcctgcgcgaatacactgtaatcctgcaggtatccggtttagatatccggttttcgtatccggtttgactatccggtttctatatccggtttacttatccggttttgctatccggtttgtatatccggtttggcgcgccatgcttcatcagactct

SEQ ID NO: 10295 - DNA, 172 bp, Artificial Sequence; identical to SEQ ID NO: 10294
  Synthetic polynucleotide

SEQ ID NO: 10296 - DNA, 191 bp, Artificial Sequence
  Synthetic polynucleotide
atcatctcaccttgcctcctgggtgactcgttagagcccctgcaggagtgccgtgtgcaaaacagaagtgccgtgtgcaaaactcgagtgccgtgtgcaaaacgacagtgccgtgtgcaaaacctaagtgccgtgtgcaaaacactagtgccgtgtgcaaaactgcggcgcgccatgcttcatcagactct

SEQ ID NO: 10297 - DNA, 191 bp, Artificial Sequence; identical to SEQ ID NO: 10296
  Synthetic polynucleotide

SEQ ID NO: 10298 - DNA, 188 bp, Artificial Sequence
  Synthetic polynucleotide
atcatctcaccttgcctcctgcgcttagctcaatgggtcctgcaggtggggtgatcgcagatggggtgatcgctcgtggggtgatcgcgactggggtgatcgcctatggggtgatcgcacttggggtgatcgctgctggggtgatcgcgtatggggtgatcgcggcgcgccatgcttcatcagactct

SEQ ID NO: 10299 - DNA, 188 bp, Artificial Sequence; identical to SEQ ID NO: 10298
  Synthetic polynucleotide

SEQ ID NO: 10300 - DNA, 188 bp, Artificial Sequence
  Synthetic polynucleotide
atcatctcaccttgcctcctgcgttagtactcgggtgacctgcagggattgatggtagagagattgatggtagtcggattgatggtaggacgattgatggtagctagattgatggtagactgattgatggtagtgcgattgatggtaggtagattgatggtagggcgcgccatgcttcatcagactct

SEQ ID NO: 10301 - DNA, 188 bp, Artificial Sequence; identical to SEQ ID NO: 10300
  Synthetic polynucleotide

SEQ ID NO: 10302 - DNA, 190 bp, Artificial Sequence
  Synthetic polynucleotide
atcatctcaccttgcctcctgctcgaatgctgcctcctcctgcaggctcgaacccgtgccagactcgaacccgtgcctcgctcgaacccgtgccgacctcgaacccgtgccctactcgaacccgtgccactctcgaacccgtgcctgcctcgaacccgtgccgtaggcgcgccatgcttcatcagactct

SEQ ID NO: 10303 - DNA, 190 bp, Artificial Sequence; identical to SEQ ID NO: 10302
  Synthetic polynucleotide

SEQ ID NO: 10304 - DNA, 188 bp, Artificial Sequence
  Synthetic polynucleotide
atcatctcaccttgcctcctgtacattgtacggaattgcctgcagggcgtacgtgcggagagcgtacgtgcggtcggcgtacgtgcgggacgcgtacgtgcggctagcgtacgtgcggactgcgtacgtgcggtgcgcgtacgtgcgggtagcgtacgtgcggggcgcgccatgcttcatcagactct

SEQ ID NO: 10305 - DNA, 188 bp, Artificial Sequence; identical to SEQ ID NO: 10304
  Synthetic polynucleotide

SEQ ID NO: 10306 - DNA, 190 bp, Artificial Sequence
  Synthetic polynucleotide
atcatctcaccttgcctcctgcaacgatagaatcgctacctgcaggttcagcaccatggaagattcagcaccatggatcgttcagcaccatggagacttcagcaccatggactattcagcaccatggaactttcagcaccatggatgcttcagcaccatggagtaggcgcgccatgcttcatcagactct

SEQ ID NO: 10307 - DNA, 190 bp, Artificial Sequence; identical to SEQ ID NO: 10306
  Synthetic polynucleotide

SEQ ID NO: 10308 - DNA, 190 bp, Artificial Sequence
  Synthetic polynucleotide
atcatctcaccttgcctcctgtatctatttgtgggtcccctgcaggcgatgacgtcatcaagacgatgacgtcatcatcgcgatgacgtcatcagaccgatgacgtcatcactacgatgacgtcatcaactcgatgacgtcatcatgccgatgacgtcatcagtaggcgcgccatgcttcatcagactct

SEQ ID NO: 10309 - DNA, 190 bp, Artificial Sequence; identical to SEQ ID NO: 10308
  Synthetic polynucleotide

SEQ ID NO: 10310 - DNA, 180 bp, Artificial Sequence
  Synthetic polynucleotide
atcatctcaccttgcctcctgcgtatcaaagataggaacctgcaggggaatctccctagaggaatctcccttcgggaatctccctgacggaatctccctctaggaatctccctactggaatctcccttgcggaatctccctgtaggaatctccctggcgcgccatgcttcatcagactct

SEQ ID NO: 10311 - DNA, 180 bp, Artificial Sequence; identical to SEQ ID NO: 10310
  Synthetic polynucleotide

SEQ ID NO: 10312 - DNA, 164 bp, Artificial Sequence
  Synthetic polynucleotide
atcatctcaccttgcctcctgggaatcgctccgcataacctgcaggattcatcctagaattcatccttcgattcatcctgacattcatcctctaattcatcctactattcatccttgcattcatcctgtaattcatcctggcgcgccatgcttcatcagactct

SEQ ID NO: 10313 - DNA, 164 bp, Artificial Sequence; identical to SEQ ID NO: 10312
  Synthetic polynucleotide

SEQ ID NO: 10314 - DNA, 164 bp, Artificial Sequence
  Synthetic polynucleotide
atcatctcaccttgcctcctgtacctttggattcgagccctgcaggcttacgtcaagacttacgtcatcgcttacgtcagaccttacgtcactacttacgtcaactcttacgtcatgccttacgtcagtacttacgtcaggcgcgccatgcttcatcagactct

SEQ ID NO: 10315 - DNA, 164 bp, Artificial Sequence; identical to SEQ ID NO: 10314
  Synthetic polynucleotide

SEQ ID NO: 10316 - DNA, 164 bp, Artificial Sequence
  Synthetic polynucleotide
atcatctcaccttgcctcctggtcatccatcgccttctcctgcaggcctaatgagagacctaatgagtcgcctaatgaggaccctaatgagctacctaatgagactcctaatgagtgccctaatgaggtacctaatgagggcgcgccatgcttcatcagactct

SEQ ID NO: 10317 - DNA, 164 bp, Artificial Sequence; identical to SEQ ID NO: 10316
  Synthetic polynucleotide

SEQ ID NO: 10318 - DNA, 196 bp, Artificial Sequence
  Synthetic polynucleotide
atcatctcaccttgcctcctgtggttgtggtcaactgtcctgcaggtaaataaacaatcagataaataaacaatctcgtaaataaacaatcgactaaataaacaatcctataaataaacaatcacttaaataaacaatctgctaaataaacaatcgtataaataaacaatcggcgcgccatgcttcatcagactct

SEQ ID NO: 10319 - DNA, 196 bp, Artificial Sequence; identical to SEQ ID NO: 10318
  Synthetic polynucleotide

SEQ ID NO: 10320 - DNA, 197 bp, Artificial Sequence
  Synthetic polynucleotide
atcatctcaccttgcctcctgttagattaggcacctgtcctgcaggcacttccgcttccggagacacttccgcttccggtcgcacttccgcttccgggaccacttccgcttccggctacacttccgcttccggactcacttccgcttccggtgccacttccgcttccgggtaggcgcgccatgcttcatcagactct

SEQ ID NO: 10321 - DNA, 197 bp, Artificial Sequence; identical to SEQ ID NO: 10320
  Synthetic polynucleotide

SEQ ID NO: 10322 - DNA, 188 bp, Artificial Sequence
  Synthetic polynucleotide
atcatctcaccttgcctcctgttaacgccgacgcagtgcctgcaggggtgacgtaactagaggtgacgtaacttcgggtgacgtaactgacggtgacgtaactctaggtgacgtaactactggtgacgtaacttgcggtgacgtaactgtaggtgacgtaactggcgcgccatgcttcatcagactct

SEQ ID NO: 10323 - DNA, 188 bp, Artificial Sequence; identical to SEQ ID NO: 10322
  Synthetic polynucleotide

SEQ ID NO: 10324 - DNA, 156 bp, Artificial Sequence
  Synthetic polynucleotide
atcatctcaccttgcctcctgcatgcgttcttcccgcacctgcaggcaataaatagacaataaattcgcaataaatgaccaataaatctacaataaatactcaataaattgccaataaatgtacaataaatggcgcgccatgcttcatcagactct

SEQ ID NO: 10325 - DNA, 156 bp, Artificial Sequence; identical to SEQ ID NO: 10324
  Synthetic polynucleotide

SEQ ID NO: 10326 - DNA, 198 bp, Artificial Sequence
  Synthetic polynucleotide
atcatctcaccttgcctcctgataccaatagggaattgcctgcaggccccctgacctttgccctctgccagaccccctgacctttgccctctgcctcgccccctgacctttgccctctgccgacccccctgacctttgccctctgccctaccccctgacctttgccctctgccggcgcgccatgcttcatcagactct

SEQ ID NO: 10327 - DNA, 198 bp, Artificial Sequence; identical to SEQ ID NO: 10326
  Synthetic polynucleotide

SEQ ID NO: 10328 - DNA, 190 bp, Artificial Sequence
  Synthetic polynucleotide
atcatctcaccttgcctcctgcctaagtatcacgtcttcctgcaggcgatgacgtcatcgagacgatgacgtcatcgtcgcgatgacgtcatcggaccgatgacgtcatcgctacgatgacgtcatcgactcgatgacgtcatcgtgccgatgacgtcatcggtaggcgcgccatgcttcatcagactct

SEQ ID NO: 10329 - DNA, 190 bp, Artificial Sequence; identical to SEQ ID NO: 10328
  Synthetic polynucleotide

SEQ ID NO: 10330 - DNA, 148 bp, Artificial Sequence
  Synthetic polynucleotide
atcatctcaccttgcctcctgacggaggaacatctagccctgcaggtaataaaagataataaatcgtaataaagactaataaactataataaaacttaataaatgctaataaagtataataaaggcgcgccatgcttcatcagactct

SEQ ID NO: 10331 - DNA, 148 bp, Artificial Sequence; identical to SEQ ID NO: 10330
  Synthetic polynucleotide

SEQ ID NO: 10332 - DNA, 191 bp, Artificial Sequence
  Synthetic polynucleotide
atcatctcaccttgcctcctgaagtgggttggagcacccctgcaggaaaggtcaaaggtcaacagaaaaggtcaaaggtcaactcgaaaggtcaaaggtcaacgacaaaggtcaaaggtcaacctaaaaggtcaaaggtcaacactaaaggtcaaaggtcaactgcggcgcgccatgcttcatcagactct

SEQ ID NO: 10333 - DNA, 191 bp, Artificial Sequence; identical to SEQ ID NO: 10332
  Synthetic polynucleotide

SEQ ID NO: 10334 - DNA, 191 bp, Artificial Sequence
  Synthetic polynucleotide
atcatctcaccttgcctcctgggtggattcagacgaaccctgcaggtgccttatctgccccccccagagatgccttatctgccccccccagtcgtgccttatctgccccccccaggactgccttatctgccccccccagctatgccttatctgccccccccagactggcgcgccatgcttcatcagactct

SEQ ID NO: 10335 - DNA, 191 bp, Artificial Sequence; identical to SEQ ID NO: 10334
  Synthetic polynucleotide

SEQ ID NO: 10336 - DNA, 164 bp, Artificial Sequence
  Synthetic polynucleotide
atcatctcaccttgcctcctgaacctgcatggatagtacctgcaggcttacgcaaagacttacgcaatcgcttacgcaagaccttacgcaactacttacgcaaactcttacgcaatgccttacgcaagtacttacgcaaggcgcgccatgcttcatcagactct

SEQ ID NO: 10337 - DNA, 164 bp, Artificial Sequence; identical to SEQ ID NO: 10336
  Synthetic polynucleotide

SEQ ID NO: 10338 - DNA, 200 bp, Artificial Sequence
  Synthetic polynucleotide
atcatctcaccttgcctcctgttgcgcaaggttggagtcctgcaggccatggccaaataaggcaaagaccatggccaaataaggcaatcgccatggccaaataaggcaagacccatggccaaataaggcaactaccatggccaaataaggcaaactccatggccaaataaggcaaggcgcgccatgcttcatcagactct

SEQ ID NO: 10339 - DNA, 200 bp, Artificial Sequence; identical to SEQ ID NO: 10338
  Synthetic polynucleotide

SEQ ID NO: 10340 - DNA, 172 bp, Artificial Sequence
  Synthetic polynucleotide
atcatctcaccttgcctcctgcgatcttcacaccctttcctgcaggatgtaaacaaagaatgtaaacaatcgatgtaaacaagacatgtaaacaactaatgtaaacaaactatgtaaacaatgcatgtaaacaagtaatgtaaacaaggcgcgccatgcttcatcagactct

SEQ ID NO: 10341 - DNA, 172 bp, Artificial Sequence; identical to SEQ ID NO: 10340
  Synthetic polynucleotide

SEQ ID NO: 10342 - DNA, 172 bp, Artificial Sequence
  Synthetic polynucleotide
atcatctcaccttgcctcctgacgaagccaacttcgcgcctgcagggggggggtggagagggggggtggtcggggggggtgggacgggggggtggctagggggggtggactgggggggtggtgcgggggggtgggtagggggggtggggcgcgccatgcttcatcagactct

SEQ ID NO: 10343 - DNA, 172 bp, Artificial Sequence; identical to SEQ ID NO: 10342
  Synthetic polynucleotide

SEQ ID NO: 10344 - DNA, 191 bp, Artificial Sequence
  Synthetic polynucleotide
atcatctcaccttgcctcctgtacaaagctagcgcggtcctgcagggatattgacagctgcgtagagatattgacagctgcgttcggatattgacagctgcgtgacgatattgacagctgcgtctagatattgacagctgcgtactgatattgacagctgcgttgcggcgcgccatgcttcatcagactct

SEQ ID NO: 10345 - DNA, 191 bp, Artificial Sequence; identical to SEQ ID NO: 10344
  Synthetic polynucleotide

SEQ ID NO: 10346 - DNA, 164 bp, Artificial Sequence
  Synthetic polynucleotide
atcatctcaccttgcctcctgtatggacgccattgtggcctgcaggccttatatgagaccttatatgtcgccttatatggacccttatatgctaccttatatgactccttatatgtgcccttatatggtaccttatatgggcgcgccatgcttcatcagactct

SEQ ID NO: 10347 - DNA, 164 bp, Artificial Sequence; identical to SEQ ID NO: 10346
  Synthetic polynucleotide

SEQ ID NO: 10348 - DNA, 190 bp, Artificial Sequence
  Synthetic polynucleotide
atcatctcaccttgcctcctggacaggtcatgtttctgcctgcaggaggggaatttccccagaaggggaatttcccctcgaggggaatttccccgacaggggaatttccccctaaggggaatttccccactaggggaatttcccctgcaggggaatttccccgtaggcgcgccatgcttcatcagactct

SEQ ID NO: 10349 - DNA, 190 bp, Artificial Sequence; identical to SEQ ID NO: 10348
  Synthetic polynucleotide

SEQ ID NO: 10350 - DNA, 156 bp, Artificial Sequence
  Synthetic polynucleotide
atcatctcaccttgcctcctgttgtaaccctgtgtcgtcctgcaggtggaatgtagatggaatgttcgtggaatgtgactggaatgtctatggaatgtacttggaatgttgctggaatgtgtatggaatgtggcgcgccatgcttcatcagactct

SEQ ID NO: 10351 - DNA, 156 bp, Artificial Sequence; identical to SEQ ID NO: 10350
  Synthetic polynucleotide

SEQ ID NO: 10352 - DNA, 191 bp, Artificial Sequence
  Synthetic polynucleotide
atcatctcaccttgcctcctggtaacaatccatatacccctgcaggaatcatttccgggaaatgccaagaaatcatttccgggaaatgccatcgaatcatttccgggaaatgccagacaatcatttccgggaaatgccactaaatcatttccgggaaatgccaactggcgcgccatgcttcatcagactct

SEQ ID NO: 10353 - DNA, 191 bp, Artificial Sequence; identical to SEQ ID NO: 10352
  Synthetic polynucleotide

SEQ ID NO: 10354 - DNA, 188 bp, Artificial Sequence
  Synthetic polynucleotide
atcatctcaccttgcctcctgcatcagccggagttcaacctgcaggggtgacgtaaccagaggtgacgtaacctcgggtgacgtaaccgacggtgacgtaaccctaggtgacgtaaccactggtgacgtaacctgcggtgacgtaaccgtaggtgacgtaaccggcgcgccatgcttcatcagactct

SEQ ID NO: 10355 - DNA, 188 bp, Artificial Sequence; identical to SEQ ID NO: 10354
  Synthetic polynucleotide

SEQ ID NO: 10356 - DNA, 172 bp, Artificial Sequence
  Synthetic polynucleotide
atcatctcaccttgcctcctgcagaaatgggtattatgcctgcagggccatatggtagagccatatggttcggccatatggtgacgccatatggtctagccatatggtactgccatatggttgcgccatatggtgtagccatatggtggcgcgccatgcttcatcagactct

SEQ ID NO: 10357 - DNA, 172 bp, Artificial Sequence; identical to SEQ ID NO: 10356
  Synthetic polynucleotide

SEQ ID NO: 10358 - DNA, 191 bp, Artificial Sequence
  Synthetic polynucleotide
atcatctcaccttgcctcctgcgtggatttactccggccctgcaggggccaccagggggcgcccgagagaggccaccagggggcgcccgagtcgggccaccagggggcgcccgaggacggccaccagggggcgcccgagctaggccaccagggggcgcccgagactggcgcgccatgcttcatcagactct

SEQ ID NO: 10359 - DNA, 191 bp, Artificial Sequence; identical to SEQ ID NO: 10358
  Synthetic polynucleotide

SEQ ID NO: 10360 - DNA, 156 bp, Artificial Sequence
  Synthetic polynucleotide
atcatctcaccttgcctcctgaagggtctatgcataaacctgcaggggttgccaagaggttgccatcgggttgccagacggttgccactaggttgccaactggttgccatgcggttgccagtaggttgccaggcgcgccatgcttcatcagactct

SEQ ID NO: 10361 - DNA, 156 bp, Artificial Sequence; identical to SEQ ID NO: 10360
  Synthetic polynucleotide

SEQ ID NO: 10362 - DNA, 185 bp, Artificial Sequence
  Synthetic polynucleotide
atcatctcaccttgcctcctggatagcgacagtcaacgcctgcaggaattacctgtcaatacagaaattacctgtcaatactcgaattacctgtcaatacgacaattacctgtcaatacctaaattacctgtcaatacactaattacctgtcaatactgcggcgcgccatgcttcatcagactct

SEQ ID NO: 10363 - DNA, 185 bp, Artificial Sequence; identical to SEQ ID NO: 10362
  Synthetic polynucleotide

SEQ ID NO: 10364 - DNA, 156 bp, Artificial Sequence
  Synthetic polynucleotide
atcatctcaccttgcctcctgtctaggctttaccgcaacctgcaggcaataacaagacaataacatcgcaataacagaccaataacactacaataacaactcaataacatgccaataacagtacaataacaggcgcgccatgcttcatcagactct

SEQ ID NO: 10365 - DNA, 156 bp, Artificial Sequence; identical to SEQ ID NO: 10364
  Synthetic polynucleotide

SEQ ID NO: 10366 - DNA, 188 bp, Artificial Sequence
  Synthetic polynucleotide
atcatctcaccttgcctcctgagtctctaccttaagcgcctgcagggaaataattaccagagaaataattacctcggaaataattaccgacgaaataattaccctagaaataattaccactgaaataattacctgcgaaataattaccgtagaaataattaccggcgcgccatgcttcatcagactct

SEQ ID NO: 10367 - DNA, 188 bp, Artificial Sequence; identical to SEQ ID NO: 10366
  Synthetic polynucleotide

SEQ ID NO: 10368 - DNA, 188 bp, Artificial Sequence
  Synthetic polynucleotide
atcatctcaccttgcctcctgttctggatgcacgagatcctgcaggtgacacgtgggaagatgacacgtgggatcgtgacacgtgggagactgacacgtgggactatgacacgtgggaacttgacacgtgggatgctgacacgtgggagtatgacacgtgggaggcgcgccatgcttcatcagactct

SEQ ID NO: 10369 - DNA, 188 bp, Artificial Sequence; identical to SEQ ID NO: 10368
  Synthetic polynucleotide

SEQ ID NO: 10370 - DNA, 164 bp, Artificial Sequence
  Synthetic polynucleotide
atcatctcaccttgcctcctgcgtgggctttcaacctgcctgcaggttacgtcacagattacgtcactcgttacgtcacgacttacgtcacctattacgtcacactttacgtcactgcttacgtcacgtattacgtcacggcgcgccatgcttcatcagactct

SEQ ID NO: 10371 - DNA, 164 bp, Artificial Sequence; identical to SEQ ID NO: 10370
  Synthetic polynucleotide

SEQ ID NO: 10372 - DNA, 172 bp, Artificial Sequence
  Synthetic polynucleotide
atcatctcaccttgcctcctgtcctgactttgtgaaagcctgcaggaaccggaagtagaaaccggaagttcgaaccggaagtgacaaccggaagtctaaaccggaagtactaaccggaagttgcaaccggaagtgtaaaccggaagtggcgcgccatgcttcatcagactct

SEQ ID NO: 10373 - DNA, 172 bp, Artificial Sequence; identical to SEQ ID NO: 10372
  Synthetic polynucleotide

SEQ ID NO: 10374 - DNA, 164 bp, Artificial Sequence
  Synthetic polynucleotide
atcatctcaccttgcctcctggcgctttggcactttggcctgcaggtaaccggttagataaccggtttcgtaaccggttgactaaccggttctataaccggttacttaaccggtttgctaaccggttgtataaccggttggcgcgccatgcttcatcagactct

SEQ ID NO: 10375 - DNA, 164 bp, Artificial Sequence; identical to SEQ ID NO: 10374
  Synthetic polynucleotide

SEQ ID NO: 10376 - DNA, 148 bp, Artificial Sequence
  Synthetic polynucleotide
atcatctcaccttgcctcctgccatgttccggcaactgcctgcaggagaggaaagaagaggaatcgagaggaagacagaggaactaagaggaaactagaggaatgcagaggaagtaagaggaaggcgcgccatgcttcatcagactct

SEQ ID NO: 10377 - DNA, 148 bp, Artificial Sequence; identical to SEQ ID NO: 10376
  Synthetic polynucleotide

SEQ ID NO: 10378 - DNA, 186 bp, Artificial Sequence
  Synthetic polynucleotide
atcatctcaccttgcctcctgtacgtcgagtggagggacctgcagggtgaccttatgtaaggtcacagagtgaccttatgtaaggtcactcggtgaccttatgtaaggtcacgacgtgaccttatgtaaggtcacctagtgaccttatgtaaggtcacactggcgcgccatgcttcatcagactct

SEQ ID NO: 10379 - DNA, 186 bp, Artificial Sequence; identical to SEQ ID NO: 10378
  Synthetic polynucleotide

SEQ ID NO: 10380 - DNA, 196 bp, Artificial Sequence
  Synthetic polynucleotide
atcatctcaccttgcctcctgcacctggtgtcttcgtacctgcagggaaacctctggaaagagaaacctctggaatcggaaacctctggaagacgaaacctctggaactagaaacctctggaaactgaaacctctggaatgcgaaacctctggaagtagaaacctctggaaggcgcgccatgcttcatcagactct

SEQ ID NO: 10381 - DNA, 196 bp, Artificial Sequence; identical to SEQ ID NO: 10380
  Synthetic polynucleotide

SEQ ID NO: 10382 - DNA, 197 bp, Artificial Sequence
  Synthetic polynucleotide
atcatctcaccttgcctcctgacctggatgaaccgaaccctgcaggaagaggaagtgaaacagaaagaggaagtgaaactcgaagaggaagtgaaacgacaagaggaagtgaaacctaaagaggaagtgaaacactaagaggaagtgaaactgcaagaggaagtgaaacgtaggcgcgccatgcttcatcagactct

SEQ ID NO: 10383 - DNA, 197 bp, Artificial Sequence; identical to SEQ ID NO: 10382
  Synthetic polynucleotide

SEQ ID NO: 10384 - DNA, 185 bp, Artificial Sequence
  Synthetic polynucleotide
atcatctcaccttgcctcctgttgaatctatcgtgtgtcctgcaggttgtatgcaaattagaagattgtatgcaaattagatcgttgtatgcaaattagagacttgtatgcaaattagactattgtatgcaaattagaactttgtatgcaaattagatgcggcgcgccatgcttcatcagactct

SEQ ID NO: 10385 - DNA, 185 bp, Artificial Sequence; identical to SEQ ID NO: 10384
  Synthetic polynucleotide

SEQ ID NO: 10386 - DNA, 156 bp, Artificial Sequence
  Synthetic polynucleotide
atcatctcaccttgcctcctgtgaggtggcctatcctccctgcaggcatttcttagacatttctttcgcatttcttgaccatttcttctacatttcttactcatttctttgccatttcttgtacatttcttggcgcgccatgcttcatcagactct

SEQ ID NO: 10387 - DNA, 156 bp, Artificial Sequence; identical to SEQ ID NO: 10386
  Synthetic polynucleotide

SEQ ID NO: 10388 - DNA, 156 bp, Artificial Sequence
  Synthetic polynucleotide
atcatctcaccttgcctcctgaaactgactggaccggtcctgcaggaccgcccaagaaccgcccatcgaccgcccagacaccgcccactaaccgcccaactaccgcccatgcaccgcccagtaaccgcccaggcgcgccatgcttcatcagactct

SEQ ID NO: 10389 - DNA, 156 bp, Artificial Sequence; identical to SEQ ID NO: 10388
  Synthetic polynucleotide

SEQ ID NO: 10390 - DNA, 197 bp, Artificial Sequence
  Synthetic polynucleotide
atcatctcaccttgcctcctggcttatacaagccaatgcctgcaggacagattcttatctgagaacagattcttatctgtcgacagattcttatctggacacagattcttatctgctaacagattcttatctgactacagattcttatctgtgcacagattcttatctggtaggcgcgccatgcttcatcagactct

SEQ ID NO: 10391 - DNA, 197 bp, Artificial Sequence; identical to SEQ ID NO: 10390
  Synthetic polynucleotide

SEQ ID NO: 10392 - DNA, 197 bp, Artificial Sequence
  Synthetic polynucleotide
atcatctcaccttgcctcctgagaacagggactatgagcctgcaggtttgcataacaatggagatttgcataacaatggtcgtttgcataacaatgggactttgcataacaatggctatttgcataacaatggacttttgcataacaatggtgctttgcataacaatgggtaggcgcgccatgcttcatcagactct

SEQ ID NO: 10393 - DNA, 197 bp, Artificial Sequence; identical to SEQ ID NO: 10392
  Synthetic polynucleotide

SEQ ID NO: 10394 - DNA, 179 bp, Artificial Sequence
  Synthetic polynucleotide
atcatctcaccttgcctcctgaagacttacccgcagatcctgcaggtgttttgattgacaacaaaaggccagatgttttgattgacaacaaaaggcctcgtgttttgattgacaacaaaaggccgactgttttgattgacaacaaaaggccctaggcgcgccatgcttcatcagactct

SEQ ID NO: 10395 - DNA, 179 bp, Artificial Sequence; identical to SEQ ID NO: 10394
  Synthetic polynucleotide

SEQ ID NO: 10396 - DNA, 180 bp, Artificial Sequence
  Synthetic polynucleotide
atcatctcaccttgcctcctgccaggaccatgtttggccctgcagggaccagctgatagagaccagctgattcggaccagctgatgacgaccagctgatctagaccagctgatactgaccagctgattgcgaccagctgatgtagaccagctgatggcgcgccatgcttcatcagactct

SEQ ID NO: 10397 - DNA, 180 bp, Artificial Sequence; identical to SEQ ID NO: 10396
  Synthetic polynucleotide

SEQ ID NO: 10398 - DNA, 191 bp, Artificial Sequence
  Synthetic polynucleotide
atcatctcaccttgcctcctggtatattgtcgtagggacctgcaggcaccgctaattagcgttagacaccgctaattagcgtttcgcaccgctaattagcgttgaccaccgctaattagcgttctacaccgctaattagcgttactcaccgctaattagcgtttgcggcgcgccatgcttcatcagactct

SEQ ID NO: 10399 - DNA, 191 bp, Artificial Sequence; identical to SEQ ID NO: 10398
  Synthetic polynucleotide

SEQ ID NO: 10400 - DNA, 156 bp, Artificial Sequence
  Synthetic polynucleotide
atcatctcaccttgcctcctgaaccgaagtttcgccttcctgcagggcgccaaaagagcgccaaatcggcgccaaagacgcgccaaactagcgccaaaactgcgccaaatgcgcgccaaagtagcgccaaaggcgcgccatgcttcatcagactct

SEQ ID NO: 10401 - DNA, 156 bp, Artificial Sequence; identical to SEQ ID NO: 10400
  Synthetic polynucleotide

SEQ ID NO: 10402 - DNA, 197 bp, Artificial Sequence
  Synthetic polynucleotide
atcatctcaccttgcctcctgtgagtcccacacgcttccctgcaggatcactgcaattgatagaatcactgcaattgattcgatcactgcaattgatgacatcactgcaattgatctaatcactgcaattgatactatcactgcaattgattgcatcactgcaattgatgtaggcgcgccatgcttcatcagactct

SEQ ID NO: 10403 - DNA, 197 bp, Artificial Sequence; identical to SEQ ID NO: 10402
  Synthetic polynucleotide

SEQ ID NO: 10404 - DNA, 196 bp, Artificial Sequence
  Synthetic polynucleotide
atcatctcaccttgcctcctggccatgcataacaaatacctgcaggttgtttgctttgcagattgtttgctttgctcgttgtttgctttgcgacttgtttgctttgcctattgtttgctttgcactttgtttgctttgctgcttgtttgctttgcgtattgtttgctttgcggcgcgccatgcttcatcagactct

SEQ ID NO: 10405 - DNA, 196 bp, Artificial Sequence; identical to SEQ ID NO: 10404
  Synthetic polynucleotide

SEQ ID NO: 10406 - DNA, 197 bp, Artificial Sequence
  Synthetic polynucleotide
atcatctcaccttgcctcctgcagcatcatgggttaagcctgcagggtattttaattcctcagagtattttaattcctctcggtattttaattcctcgacgtattttaattcctcctagtattttaattcctcactgtattttaattcctctgcgtattttaattcctcgtaggcgcgccatgcttcatcagactct

SEQ ID NO: 10407 - DNA, 197 bp, Artificial Sequence; identical to SEQ ID NO: 10406
  Synthetic polynucleotide

SEQ ID NO: 10408 - DNA, 196 bp, Artificial Sequence
  Synthetic polynucleotide
atcatctcaccttgcctcctgatcctgctcagcagcctcctgcaggacctttgatttttagaacctttgattttttcgacctttgatttttgacacctttgatttttctaacctttgatttttactacctttgattttttgcacctttgatttttgtaacctttgatttttggcgcgccatgcttcatcagactct

SEQ ID NO: 10409 - DNA, 196 bp, Artificial Sequence; identical to SEQ ID NO: 10408
  Synthetic polynucleotide

SEQ ID NO: 10410 - DNA, 180 bp, Artificial Sequence
  Synthetic polynucleotide
atcatctcaccttgcctcctggctgttccaatttcttacctgcaggcaccatatggcagacaccatatggctcgcaccatatggcgaccaccatatggcctacaccatatggcactcaccatatggctgccaccatatggcgtacaccatatggcggcgcgccatgcttcatcagactct

SEQ ID NO: 10411 - DNA, 180 bp, Artificial Sequence; identical to SEQ ID NO: 10410
  Synthetic polynucleotide

SEQ ID NO: 10412 - DNA, 180 bp, Artificial Sequence
  Synthetic polynucleotide
atcatctcaccttgcctcctgcacaacagactgctcgtcctgcaggtaaccaatcacagataaccaatcactcgtaaccaatcacgactaaccaatcacctataaccaatcacacttaaccaatcactgctaaccaatcacgtataaccaatcacggcgcgccatgcttcatcagactct

SEQ ID NO: 10413 - DNA, 180 bp, Artificial Sequence; identical to SEQ ID NO: 10412
  Synthetic polynucleotide

SEQ ID NO: 10414 - DNA, 188 bp, Artificial Sequence
  Synthetic polynucleotide
atcatctcaccttgcctcctgccaaggcatgagacctccctgcaggtggaaagtccccagatggaaagtcccctcgtggaaagtccccgactggaaagtccccctatggaaagtccccacttggaaagtcccctgctggaaagtccccgtatggaaagtccccggcgcgccatgcttcatcagactct

SEQ ID NO: 10415 - DNA, 188 bp, Artificial Sequence; identical to SEQ ID NO: 10414
  Synthetic polynucleotide

SEQ ID NO: 10416 - DNA, 164 bp, Artificial Sequence
  Synthetic polynucleotide
atcatctcaccttgcctcctgggcctcgagaaattacccctgcaggccaggtggtagaccaggtggttcgccaggtggtgacccaggtggtctaccaggtggtactccaggtggttgcccaggtggtgtaccaggtggtggcgcgccatgcttcatcagactct

SEQ ID NO: 10417 - DNA, 164 bp, Artificial Sequence; identical to SEQ ID NO: 10416
  Synthetic polynucleotide

SEQ ID NO: 10418 - DNA, 191 bp, Artificial Sequence
  Synthetic polynucleotide
atcatctcaccttgcctcctgaacctcggcctgatgctcctgcaggcgcgttaattaattgtgagacgcgttaattaattgtgtcgcgcgttaattaattgtggaccgcgttaattaattgtgctacgcgttaattaattgtgactcgcgttaattaattgtgtgcggcgcgccatgcttcatcagactct

SEQ ID NO: 10419 - DNA, 191 bp, Artificial Sequence; identical to SEQ ID NO: 10418
  Synthetic polynucleotide

SEQ ID NO: 10420 - DNA, 172 bp, Artificial Sequence
  Synthetic polynucleotide
atcatctcaccttgcctcctgagccgtctggaggatagcctgcaggaaagtaaacaagaaaagtaaacatcgaaagtaaacagacaaagtaaacactaaaagtaaacaactaaagtaaacatgcaaagtaaacagtaaaagtaaacaggcgcgccatgcttcatcagactct

SEQ ID NO: 10421 - DNA, 172 bp, Artificial Sequence; identical to SEQ ID NO: 10420
  Synthetic polynucleotide

SEQ ID NO: 10422 - DNA, 191 bp, Artificial Sequence
  Synthetic polynucleotide
atcatctcaccttgcctcctggaaagctgcgaagtggtcctgcaggcgaattaattaatcaccagacgaattaattaatcacctcgcgaattaattaatcaccgaccgaattaattaatcaccctacgaattaattaatcaccactcgaattaattaatcacctgcggcgcgccatgcttcatcagactct

SEQ ID NO: 10423 - DNA, 191 bp, Artificial Sequence; identical to SEQ ID NO: 10422
  Synthetic polynucleotide

SEQ ID NO: 10424 - DNA, 185 bp, Artificial Sequence
  Synthetic polynucleotide
atcatctcaccttgcctcctgatccgatcgttgtttatcctgcaggaacaatgttcattgttagaaacaatgttcattgtttcgaacaatgttcattgttgacaacaatgttcattgttctaaacaatgttcattgttactaacaatgttcattgtttgcggcgcgccatgcttcatcagactct

SEQ ID NO: 10425 - DNA, 185 bp, Artificial Sequence; identical to SEQ ID NO: 10424
  Synthetic polynucleotide

SEQ ID NO: 10426 - DNA, 197 bp, Artificial Sequence
  Synthetic polynucleotide
atcatctcaccttgcctcctgtaaagtaccacgcgactcctgcagggttttggtttcgctttccagagttttggtttcgctttcctcggttttggtttcgctttccgacgttttggtttcgctttccctagttttggtttcgctttccactgttttggtttcgctttcctgcggcgcgccatgcttcatcagactct

SEQ ID NO: 10427 - DNA, 197 bp, Artificial Sequence; identical to SEQ ID NO: 10426
  Synthetic polynucleotide

SEQ ID NO: 10428 - DNA, 164 bp, Artificial Sequence
  Synthetic polynucleotide
atcatctcaccttgcctcctgcagacgacacctacaggcctgcaggaccggaagtagaaccggaagttcgaccggaagtgacaccggaagtctaaccggaagtactaccggaagttgcaccggaagtgtaaccggaagtggcgcgccatgcttcatcagactct

SEQ ID NO: 10429 - DNA, 164 bp, Artificial Sequence; identical to SEQ ID NO: 10428
  Synthetic polynucleotide

SEQ ID NO: 10430 - DNA, 180 bp, Artificial Sequence
  Synthetic polynucleotide
atcatctcaccttgcctcctgcatgtcggttcttctttcctgcaggttcttatctgtagattcttatctgttcgttcttatctgtgacttcttatctgtctattcttatctgtactttcttatctgttgcttcttatctgtgtattcttatctgtggcgcgccatgcttcatcagactct

SEQ ID NO: 10431 - DNA, 180 bp, Artificial Sequence; identical to SEQ ID NO: 10430
  Synthetic polynucleotide

SEQ ID NO: 10432 - DNA, 172 bp, Artificial Sequence
  Synthetic polynucleotide
atcatctcaccttgcctcctgattcaggttcgtcccaccctgcaggttccaggaaaagattccaggaaatcgttccaggaaagacttccaggaaactattccaggaaaactttccaggaaatgcttccaggaaagtattccaggaaaggcgcgccatgcttcatcagactct

SEQ ID NO: 10433 - DNA, 172 bp, Artificial Sequence; identical to SEQ ID NO: 10432
  Synthetic polynucleotide

SEQ ID NO: 10434 - DNA, 172 bp, Artificial Sequence
  Synthetic polynucleotide
atcatctcaccttgcctcctgacatcaggtgatactttcctgcagggtggaaaattagagtggaaaatttcggtggaaaattgacgtggaaaattctagtggaaaattactgtggaaaatttgcgtggaaaattgtagtggaaaattggcgcgccatgcttcatcagactct

SEQ ID NO: 10435 - DNA, 172 bp, Artificial Sequence; identical to SEQ ID NO: 10434
  Synthetic polynucleotide

SEQ ID NO: 10436 - DNA, 156 bp, Artificial Sequence
  Synthetic polynucleotide
atcatctcaccttgcctcctgttcagggacgtgttgggcctgcagggcccctttagagccccttttcggcccctttgacgcccctttctagcccctttactgccccttttgcgcccctttgtagcccctttggcgcgccatgcttcatcagactct

SEQ ID NO: 10437 - DNA, 156 bp, Artificial Sequence; identical to SEQ ID NO: 10436
  Synthetic polynucleotide

SEQ ID NO: 10438 - DNA, 172 bp, Artificial Sequence
  Synthetic polynucleotide
atcatctcaccttgcctcctggatttccgaaaccctggcctgcaggttccaggaagagattccaggaagtcgttccaggaaggacttccaggaagctattccaggaagactttccaggaagtgcttccaggaaggtattccaggaagggcgcgccatgcttcatcagactct

SEQ ID NO: 10439 - DNA, 172 bp, Artificial Sequence; identical to SEQ ID NO: 10438
  Synthetic polynucleotide

SEQ ID NO: 10440 - DNA, 156 bp, Artificial Sequence
  Synthetic polynucleotide
atcatctcaccttgcctcctgcattctaaaggtaccaacctgcagggctgcatgagagctgcatgtcggctgcatggacgctgcatgctagctgcatgactgctgcatgtgcgctgcatggtagctgcatgggcgcgccatgcttcatcagactct

SEQ ID NO: 10441 - DNA, 156 bp, Artificial Sequence; identical to SEQ ID NO: 10440
  Synthetic polynucleotide

SEQ ID NO: 10442 - DNA, 164 bp, Artificial Sequence
  Synthetic polynucleotide
atcatctcaccttgcctcctgccggattctatctcagccctgcaggaaacaaacaagaaaacaaacatcgaaacaaacagacaaacaaacactaaaacaaacaactaaacaaacatgcaaacaaacagtaaaacaaacaggcgcgccatgcttcatcagactct

SEQ ID NO: 10443 - DNA, 164 bp, Artificial Sequence; identical to SEQ ID NO: 10442
  Synthetic polynucleotide

SEQ ID NO: 10444 - DNA, 197 bp, Artificial Sequence
  Synthetic polynucleotide
atcatctcaccttgcctcctgaagcgggaaagcgatgccctgcaggccctgacctttgcccagaccctgacctttgccctcgccctgacctttgcccgacccctgacctttgcccctaccctgacctttgcccactccctgacctttgccctgcccctgacctttgcccgtaggcgcgccatgcttcatcagactct

SEQ ID NO: 10445 - DNA, 197 bp, Artificial Sequence; identical to SEQ ID NO: 10444
  Synthetic polynucleotide

SEQ ID NO: 10446 - DNA, 172 bp, Artificial Sequence
  Synthetic polynucleotide
atcatctcaccttgcctcctggatattgatcgcgatcccctgcaggaaccggaagcagaaaccggaagctcgaaccggaagcgacaaccggaagcctaaaccggaagcactaaccggaagctgcaaccggaagcgtaaaccggaagcggcgcgccatgcttcatcagactct

SEQ ID NO: 10447 - DNA, 172 bp, Artificial Sequence; identical to SEQ ID NO: 10446
  Synthetic polynucleotide

SEQ ID NO: 10448 - DNA, 190 bp, Artificial Sequence
  Synthetic polynucleotide
atcatctcaccttgcctcctgtactgctcctcgaataccctgcaggctaatattgctaaaagactaatattgctaaatcgctaatattgctaaagacctaatattgctaaactactaatattgctaaaactctaatattgctaaatgcctaatattgctaaagtaggcgcgccatgcttcatcagactct

SEQ ID NO: 10449 - DNA, 190 bp, Artificial Sequence; identical to SEQ ID NO: 10448
  Synthetic polynucleotide

SEQ ID NO: 10450 - DNA, 191 bp, Artificial Sequence
  Synthetic polynucleotide
atcatctcaccttgcctcctgcgtcaaacgagaaactgcctgcaggcgccatcttggatgagggcagagacgccatcttggatgagggcagtcgcgccatcttggatgagggcaggaccgccatcttggatgagggcagctacgccatcttggatgagggcagactggcgcgccatgcttcatcagactct

SEQ ID NO: 10451 - DNA, 191 bp, Artificial Sequence; identical to SEQ ID NO: 10450
  Synthetic polynucleotide

SEQ ID NO: 10452 - DNA, 172 bp, Artificial Sequence
  Synthetic polynucleotide
atcatctcaccttgcctcctgcgtcagacaagagaactcctgcaggaacggtagcaagaaacggtagcatcgaacggtagcagacaacggtagcactaaacggtagcaactaacggtagcatgcaacggtagcagtaaacggtagcaggcgcgccatgcttcatcagactct

SEQ ID NO: 10453 - DNA, 172 bp, Artificial Sequence; identical to SEQ ID NO: 10452
  Synthetic polynucleotide

SEQ ID NO: 10454 - DNA, 190 bp, Artificial Sequence
  Synthetic polynucleotide
atcatctcaccttgcctcctgtatgataagcacacctgcctgcaggttttcccgccaaaaagattttcccgccaaaatcgttttcccgccaaaagacttttcccgccaaaactattttcccgccaaaaactttttcccgccaaaatgcttttcccgccaaaagtaggcgcgccatgcttcatcagactct

SEQ ID NO: 10455 - DNA, 190 bp, Artificial Sequence; identical to SEQ ID NO: 10454
  Synthetic polynucleotide

SEQ ID NO: 10456 - DNA, 164 bp, Artificial Sequence
  Synthetic polynucleotide
atcatctcaccttgcctcctgatggcacctacgtcaggcctgcagggccctttgtagagccctttgttcggccctttgtgacgccctttgtctagccctttgtactgccctttgttgcgccctttgtgtagccctttgtggcgcgccatgcttcatcagactct

SEQ ID NO: 10457 - DNA, 164 bp, Artificial Sequence; identical to SEQ ID NO: 10456
  Synthetic polynucleotide

SEQ ID NO: 10458 - DNA, 197 bp, Artificial Sequence
  Synthetic polynucleotide
atcatctcaccttgcctcctgacaaacaaggctgaaatcctgcaggagtgggcggggccaaagaagtgggcggggccaatcgagtgggcggggccaagacagtgggcggggccaactaagtgggcggggccaaactagtgggcggggccaatgcagtgggcggggccaagtaggcgcgccatgcttcatcagactct

SEQ ID NO: 10459 - DNA, 197 bp, Artificial Sequence; identical to SEQ ID NO: 10458
  Synthetic polynucleotide

SEQ ID NO: 10460 - DNA, 197 bp, Artificial Sequence
  Synthetic polynucleotide
atcatctcaccttgcctcctgacttacaatcaggagtgcctgcagggtaattaacggtaattaaagagtaattaacggtaattaatcggtaattaacggtaattaagacgtaattaacggtaattaactagtaattaacggtaattaaactgtaattaacggtaattaatgcggcgcgccatgcttcatcagactct

SEQ ID NO: 10461 - DNA, 197 bp, Artificial Sequence; identical to SEQ ID NO: 10460
  Synthetic polynucleotide

SEQ ID NO: 10462 - DNA, 172 bp, Artificial Sequence
  Synthetic polynucleotide
atcatctcaccttgcctcctgttgggccattagaaatccctgcaggctaattagtaagactaattagtatcgctaattagtagacctaattagtactactaattagtaactctaattagtatgcctaattagtagtactaattagtaggcgcgccatgcttcatcagactct

SEQ ID NO: 10463 - DNA, 172 bp, Artificial Sequence; identical to SEQ ID NO: 10462
  Synthetic polynucleotide

SEQ ID NO: 10464 - DNA, 196 bp, Artificial Sequence
  Synthetic polynucleotide
atcatctcaccttgcctcctgtctgattgctgctgcaacctgcagggggggccttgaaaagagggggccttgaaatcggggggccttgaaagacgggggccttgaaactagggggccttgaaaactgggggccttgaaatgcgggggccttgaaagtagggggccttgaaaggcgcgccatgcttcatcagactct

SEQ ID NO: 10465 - DNA, 196 bp, Artificial Sequence; identical to SEQ ID NO: 10464
  Synthetic polynucleotide

SEQ ID NO: 10466 - DNA, 191 bp, Artificial Sequence
  Synthetic polynucleotide
atcatctcaccttgcctcctgtgcaagaactttctcagcctgcaggaaagggggcgtggcttaagaaaagggggcgtggcttatcgaaagggggcgtggcttagacaaagggggcgtggcttactaaaagggggcgtggcttaactaaagggggcgtggcttatgcggcgcgccatgcttcatcagactct

SEQ ID NO: 10467 - DNA, 191 bp, Artificial Sequence; identical to SEQ ID NO: 10466
  Synthetic polynucleotide

SEQ ID NO: 10468 - DNA, 191 bp, Artificial Sequence
  Synthetic polynucleotide
atcatctcaccttgcctcctgtctgaaagcactggagccctgcaggataagaacaaaggactaagaataagaacaaaggactatcgataagaacaaaggactagacataagaacaaaggactactaataagaacaaaggactaactataagaacaaaggactatgcggcgcgccatgcttcatcagactct

SEQ ID NO: 10469 - DNA, 191 bp, Artificial Sequence; identical to SEQ ID NO: 10468
  Synthetic polynucleotide

SEQ ID NO: 10470 - DNA, 172 bp, Artificial Sequence
  Synthetic polynucleotide
atcatctcaccttgcctcctgacacgctctcgcgtaaccctgcaggattgtgtccgagaattgtgtccgtcgattgtgtccggacattgtgtccgctaattgtgtccgactattgtgtccgtgcattgtgtccggtaattgtgtccgggcgcgccatgcttcatcagactct

SEQ ID NO: 10471 - DNA, 172 bp, Artificial Sequence; identical to SEQ ID NO: 10470
  Synthetic polynucleotide

SEQ ID NO: 10472 - DNA, 172 bp, Artificial Sequence
  Synthetic polynucleotide
atcatctcaccttgcctcctgaatcgttagatatagggcctgcaggcttgacctttagacttgaccttttcgcttgacctttgaccttgacctttctacttgacctttactcttgaccttttgccttgacctttgtacttgacctttggcgcgccatgcttcatcagactct

SEQ ID NO: 10473 - DNA, 172 bp, Artificial Sequence; identical to SEQ ID NO: 10472
  Synthetic polynucleotide

SEQ ID NO: 10474 - DNA, 180 bp, Artificial Sequence
  Synthetic polynucleotide
atcatctcaccttgcctcctgctccgcagctttaaccgcctgcagggggaaattcccagagggaaattccctcggggaaattcccgacgggaaattcccctagggaaattcccactgggaaattccctgcgggaaattcccgtagggaaattcccggcgcgccatgcttcatcagactct

SEQ ID NO: 10475 - DNA, 180 bp, Artificial Sequence; identical to SEQ ID NO: 10474
  Synthetic polynucleotide

SEQ ID NO: 10476 - DNA, 148 bp, Artificial Sequence
  Synthetic polynucleotide
atcatctcaccttgcctcctgtgcacgacgtgcctagtcctgcaggttgtaatagattgtaattcgttgtaatgacttgtaatctattgtaatactttgtaattgcttgtaatgtattgtaatggcgcgccatgcttcatcagactct

SEQ ID NO: 10477 - DNA, 148 bp, Artificial Sequence; identical to SEQ ID NO: 10476
  Synthetic polynucleotide

SEQ ID NO: 10478 - DNA, 191 bp, Artificial Sequence
  Synthetic polynucleotide
atcatctcaccttgcctcctgtaacacaactcacgtcacctgcaggataattgataccctattagaataattgataccctatttcgataattgataccctattgacataattgataccctattctaataattgataccctattactataattgataccctatttgcggcgcgccatgcttcatcagactct

SEQ ID NO: 10479 - DNA, 191 bp, Artificial Sequence; identical to SEQ ID NO: 10478
  Synthetic polynucleotide

SEQ ID NO: 10480 - DNA, 185 bp, Artificial Sequence
  Synthetic polynucleotide
atcatctcaccttgcctcctggcggccactcctcatttcctgcaggaggctaatccccaacgagaaggctaatccccaacgtcgaggctaatccccaacggacaggctaatccccaacgctaaggctaatccccaacgactaggctaatccccaacgtgcggcgcgccatgcttcatcagactct

SEQ ID NO: 10481 - DNA, 185 bp, Artificial Sequence; identical to SEQ ID NO: 10480
  Synthetic polynucleotide

SEQ ID NO: 10482 - DNA, 196 bp, Artificial Sequence
  Synthetic polynucleotide
atcatctcaccttgcctcctgagtgagataaccggagccctgcagggggaaagggagagagagggaaagggagagtcggggaaagggagaggacgggaaagggagagctagggaaagggagagactgggaaagggagagtgcgggaaagggagaggtagggaaagggagagggcgcgccatgcttcatcagactct

SEQ ID NO: 10483 - DNA, 196 bp, Artificial Sequence; identical to SEQ ID NO: 10482
  Synthetic polynucleotide

SEQ ID NO: 10484 - DNA, 191 bp, Artificial Sequence
  Synthetic polynucleotide
atcatctcaccttgcctcctgaaagaccgcaaccgagtcctgcaggtgctttctaggaattcaagatgctttctaggaattcatcgtgctttctaggaattcagactgctttctaggaattcactatgctttctaggaattcaacttgctttctaggaattcatgcggcgcgccatgcttcatcagactct

SEQ ID NO: 10485 - DNA, 191 bp, Artificial Sequence; identical to SEQ ID NO: 10484
  Synthetic polynucleotide

SEQ ID NO: 10486 - DNA, 156 bp, Artificial Sequence
  Synthetic polynucleotide
atcatctcaccttgcctcctgatagaacgcttcagttgcctgcaggcaacggccagacaacggcctcgcaacggccgaccaacggccctacaacggccactcaacggcctgccaacggccgtacaacggccggcgcgccatgcttcatcagactct

SEQ ID NO: 10487 - DNA, 156 bp, Artificial Sequence; identical to SEQ ID NO: 10486
  Synthetic polynucleotide

SEQ ID NO: 10488 - DNA, 190 bp, Artificial Sequence
  Synthetic polynucleotide
atcatctcaccttgcctcctgaatatcccagctaggcacctgcaggacagataagaatctagaacagataagaatcttcgacagataagaatctgacacagataagaatctctaacagataagaatctactacagataagaatcttgcacagataagaatctgtaggcgcgccatgcttcatcagactct

SEQ ID NO: 10489 - DNA, 190 bp, Artificial Sequence; identical to SEQ ID NO: 10488
  Synthetic polynucleotide

SEQ ID NO: 10490 - DNA, 180 bp, Artificial Sequence
  Synthetic polynucleotide
atcatctcaccttgcctcctgaaggttgcgttaagcgccctgcaggatgactcatccagaatgactcatcctcgatgactcatccgacatgactcatccctaatgactcatccactatgactcatcctgcatgactcatccgtaatgactcatccggcgcgccatgcttcatcagactct

SEQ ID NO: 10491 - DNA, 180 bp, Artificial Sequence; identical to SEQ ID NO: 10490
  Synthetic polynucleotide

SEQ ID NO: 10492 - DNA, 164 bp, Artificial Sequence
  Synthetic polynucleotide
atcatctcaccttgcctcctgcagtactccgaatttaacctgcaggcaccccctgagacaccccctgtcgcaccccctggaccaccccctgctacaccccctgactcaccccctgtgccaccccctggtacaccccctgggcgcgccatgcttcatcagactct

SEQ ID NO: 10493 - DNA, 164 bp, Artificial Sequence; identical to SEQ ID NO: 10492
  Synthetic polynucleotide

SEQ ID NO: 10494 - DNA, 164 bp, Artificial Sequence
  Synthetic polynucleotide
atcatctcaccttgcctcctgtctgagaagcgaatctccctgcaggtcgtaaacaagatcgtaaacatcgtcgtaaacagactcgtaaacactatcgtaaacaacttcgtaaacatgctcgtaaacagtatcgtaaacaggcgcgccatgcttcatcagactct

SEQ ID NO: 10495 - DNA, 164 bp, Artificial Sequence; identical to SEQ ID NO: 10494
  Synthetic polynucleotide

SEQ ID NO: 10496 - DNA, 197 bp, Artificial Sequence
  Synthetic polynucleotide
atcatctcaccttgcctcctgagctcaagtcagcacgtcctgcagggccataccctcctgcagagccataccctcctgctcggccataccctcctgcgacgccataccctcctgcctagccataccctcctgcactgccataccctcctgctgcgccataccctcctgcgtaggcgcgccatgcttcatcagactct

SEQ ID NO: 10497 - DNA, 197 bp, Artificial Sequence; identical to SEQ ID NO: 10496
  Synthetic polynucleotide

SEQ ID NO: 10498 - DNA, 197 bp, Artificial Sequence
  Synthetic polynucleotide
atcatctcaccttgcctcctgatggacaaggagagaaccctgcaggaaggtcatttcaaggtcaagaaaggtcatttcaaggtcatcgaaggtcatttcaaggtcagacaaggtcatttcaaggtcactaaaggtcatttcaaggtcaactaaggtcatttcaaggtcatgcggcgcgccatgcttcatcagactct

SEQ ID NO: 10499 - DNA, 197 bp, Artificial Sequence; identical to SEQ ID NO: 10498
  Synthetic polynucleotide

SEQ ID NO: 10500 - DNA, 197 bp, Artificial Sequence
  Synthetic polynucleotide
atcatctcaccttgcctcctgatccttcaagctggaggcctgcaggtggccaccagggggcagatggccaccagggggctcgtggccaccagggggcgactggccaccagggggcctatggccaccagggggcacttggccaccagggggctgctggccaccagggggcgtaggcgcgccatgcttcatcagactct

SEQ ID NO: 10501 - DNA, 197 bp, Artificial Sequence; identical to SEQ ID NO: 10500
  Synthetic polynucleotide

SEQ ID NO: 10502 - DNA, 179 bp, Artificial Sequence
  Synthetic polynucleotide
atcatctcaccttgcctcctgaatgggatccgtacactcctgcaggggcatatgctgtgatttattttttagaggcatatgctgtgatttatttttttcgggcatatgctgtgatttattttttgacggcatatgctgtgatttattttttctaggcgcgccatgcttcatcagactct

SEQ ID NO: 10503 - DNA, 179 bp, Artificial Sequence; identical to SEQ ID NO: 10502
  Synthetic polynucleotide

SEQ ID NO: 10504 - DNA, 172 bp, Artificial Sequence
  Synthetic polynucleotide
atcatctcaccttgcctcctgtatgctgaaattaagcccctgcaggccacttccggagaccacttccggtcgccacttccgggacccacttccggctaccacttccggactccacttccggtgcccacttccgggtaccacttccggggcgcgccatgcttcatcagactct

SEQ ID NO: 10505 - DNA, 172 bp, Artificial Sequence; identical to SEQ ID NO: 10504
  Synthetic polynucleotide

SEQ ID NO: 10506 - DNA, 172 bp, Artificial Sequence
  Synthetic polynucleotide
atcatctcaccttgcctcctggaacaccctcgggcattcctgcaggattattaataagaattattaatatcgattattaatagacattattaatactaattattaataactattattaatatgcattattaatagtaattattaataggcgcgccatgcttcatcagactct

SEQ ID NO: 10507 - DNA, 172 bp, Artificial Sequence; identical to SEQ ID NO: 10506
  Synthetic polynucleotide

SEQ ID NO: 10508 - DNA, 156 bp, Artificial Sequence
  Synthetic polynucleotide
atcatctcaccttgcctcctgttcctcatccaaagccgcctgcaggcggaaatcagacggaaatctcgcggaaatcgaccggaaatcctacggaaatcactcggaaatctgccggaaatcgtacggaaatcggcgcgccatgcttcatcagactct

SEQ ID NO: 10509 - DNA, 156 bp, Artificial Sequence; identical to SEQ ID NO: 10508
  Synthetic polynucleotide

SEQ ID NO: 10510 - DNA, 188 bp, Artificial Sequence
  Synthetic polynucleotide
atcatctcaccttgcctcctgtgttgaaatatctcaggcctgcaggaaatgacagctcagaaaatgacagctctcgaaatgacagctcgacaaatgacagctcctaaaatgacagctcactaaatgacagctctgcaaatgacagctcgtaaaatgacagctcggcgcgccatgcttcatcagactct

SEQ ID NO: 10511 - DNA, 188 bp, Artificial Sequence; identical to SEQ ID NO: 10510
  Synthetic polynucleotide

SEQ ID NO: 10512 - DNA, 164 bp, Artificial Sequence
  Synthetic polynucleotide
atcatctcaccttgcctcctggttggaccaaaggtcctcctgcaggacaagataaagaacaagataatcgacaagataagacacaagataactaacaagataaactacaagataatgcacaagataagtaacaagataaggcgcgccatgcttcatcagactct

SEQ ID NO: 10513 - DNA, 164 bp, Artificial Sequence; identical to SEQ ID NO: 10512
  Synthetic polynucleotide

SEQ ID NO: 10514 - DNA, 191 bp, Artificial Sequence
  Synthetic polynucleotide
atcatctcaccttgcctcctgatgtgtagatccgaaagcctgcaggttgttgccaggctactaagattgttgccaggctactatcgttgttgccaggctactagacttgttgccaggctactactattgttgccaggctactaactttgttgccaggctactatgcggcgcgccatgcttcatcagactct

SEQ ID NO: 10515 - DNA, 191 bp, Artificial Sequence; identical to SEQ ID NO: 10514
  Synthetic polynucleotide

SEQ ID NO: 10516 - DNA, 191 bp, Artificial Sequence
  Synthetic polynucleotide
atcatctcaccttgcctcctgaagattgcaaatcggtgcctgcaggcccatttcccggaaatcccatagacccatttcccggaaatcccattcgcccatttcccggaaatcccatgaccccatttcccggaaatcccatctacccatttcccggaaatcccatactggcgcgccatgcttcatcagactct

SEQ ID NO: 10517 - DNA, 191 bp, Artificial Sequence; identical to SEQ ID NO: 10516
  Synthetic polynucleotide

SEQ ID NO: 10518 - DNA, 148 bp, Artificial Sequence
  Synthetic polynucleotide
atcatctcaccttgcctcctggcctcccagtacatgagcctgcaggccacgtgagaccacgtgtcgccacgtggacccacgtgctaccacgtgactccacgtgtgcccacgtggtaccacgtgggcgcgccatgcttcatcagactct

SEQ ID NO: 10519 - DNA, 148 bp, Artificial Sequence; identical to SEQ ID NO: 10518
  Synthetic polynucleotide

SEQ ID NO: 10520 - DNA, 156 bp, Artificial Sequence
  Synthetic polynucleotide
atcatctcaccttgcctcctgcttcagtcaggccgaaccctgcaggcggaaatgagacggaaatgtcgcggaaatggaccggaaatgctacggaaatgactcggaaatgtgccggaaatggtacggaaatgggcgcgccatgcttcatcagactct

SEQ ID NO: 10521 - DNA, 156 bp, Artificial Sequence; identical to SEQ ID NO: 10520
  Synthetic polynucleotide

SEQ ID NO: 10522 - DNA, 197 bp, Artificial Sequence
  Synthetic polynucleotide
atcatctcaccttgcctcctgagtgatcccactggaaccctgcaggaacaattgcattgttagaaacaattgcattgtttcgaacaattgcattgttgacaacaattgcattgttctaaacaattgcattgttactaacaattgcattgtttgcaacaattgcattgttgtaggcgcgccatgcttcatcagactct

SEQ ID NO: 10523 - DNA, 197 bp, Artificial Sequence; identical to SEQ ID NO: 10522
  Synthetic polynucleotide

SEQ ID NO: 10524 - DNA, 200 bp, Artificial Sequence
  Synthetic polynucleotide
atcatctcaccttgcctcctgaccactcatacggtaaccctgcagggtgaccttattaaggtcacagagtgaccttattaaggtcactcggtgaccttattaaggtcacgacgtgaccttattaaggtcacctagtgaccttattaaggtcacactgtgaccttattaaggtcacggcgcgccatgcttcatcagactct

SEQ ID NO: 10525 - DNA, 200 bp, Artificial Sequence; identical to SEQ ID NO: 10524
  Synthetic polynucleotide

SEQ ID NO: 10526 - DNA, 172 bp, Artificial Sequence
  Synthetic polynucleotide
atcatctcaccttgcctcctgtgatgtcgtctcttacccctgcaggtttttacgacagatttttacgactcgtttttacgacgactttttacgacctatttttacgacacttttttacgactgctttttacgacgtatttttacgacggcgcgccatgcttcatcagactct

SEQ ID NO: 10527 - DNA, 172 bp, Artificial Sequence; identical to SEQ ID NO: 10526
  Synthetic polynucleotide

SEQ ID NO: 10528 - DNA, 172 bp, Artificial Sequence
  Synthetic polynucleotide
atcatctcaccttgcctcctgcgtcatgggtcagaacacctgcaggttaagtggttagattaagtggtttcgttaagtggttgacttaagtggttctattaagtggttactttaagtggtttgcttaagtggttgtattaagtggttggcgcgccatgcttcatcagactct

SEQ ID NO: 10529 - DNA, 172 bp, Artificial Sequence; identical to SEQ ID NO: 10528
  Synthetic polynucleotide

SEQ ID NO: 10530 - DNA, 180 bp, Artificial Sequence
  Synthetic polynucleotide
atcatctcaccttgcctcctggagtgcatttaagtagtcctgcaggtgtttgcttaaagatgtttgcttaatcgtgtttgcttaagactgtttgcttaactatgtttgcttaaacttgtttgcttaatgctgtttgcttaagtatgtttgcttaaggcgcgccatgcttcatcagactct

SEQ ID NO: 10531 - DNA, 180 bp, Artificial Sequence; identical to SEQ ID NO: 10530
  Synthetic polynucleotide

SEQ ID NO: 10532 - DNA, 180 bp, Artificial Sequence
  Synthetic polynucleotide
atcatctcaccttgcctcctgccgcattgagaaagtaacctgcaggggatatcattcagaggatatcattctcgggatatcattcgacggatatcattcctaggatatcattcactggatatcattctgcggatatcattcgtaggatatcattcggcgcgccatgcttcatcagactct

SEQ ID NO: 10533 - DNA, 180 bp, Artificial Sequence; identical to SEQ ID NO: 10532
  Synthetic polynucleotide

SEQ ID NO: 10534 - DNA, 185 bp, Artificial Sequence
  Synthetic polynucleotide
atcatctcaccttgcctcctgcatccaccggtcctaagcctgcaggcgttaccatggcaacgagacgttaccatggcaacgtcgcgttaccatggcaacggaccgttaccatggcaacgctacgttaccatggcaacgactcgttaccatggcaacgtgcggcgcgccatgcttcatcagactct

SEQ ID NO: 10535 - DNA, 185 bp, Artificial Sequence; identical to SEQ ID NO: 10534
  Synthetic polynucleotide

SEQ ID NO: 10536 - DNA, 197 bp, Artificial Sequence
  Synthetic polynucleotide
atcatctcaccttgcctcctgatcaactccacgaggctcctgcaggggccaccagggggcgagaggccaccagggggcgtcgggccaccagggggcggacggccaccagggggcgctaggccaccagggggcgactggccaccagggggcgtgcggccaccagggggcggtaggcgcgccatgcttcatcagactct

SEQ ID NO: 10537 - DNA, 197 bp, Artificial Sequence; identical to SEQ ID NO: 10536
  Synthetic polynucleotide

SEQ ID NO: 10538 - DNA, 172 bp, Artificial Sequence
  Synthetic polynucleotide
atcatctcaccttgcctcctgatatcacgtatggaccgcctgcaggtacccgcataagatacccgcatatcgtacccgcatagactacccgcatactatacccgcataacttacccgcatatgctacccgcatagtatacccgcataggcgcgccatgcttcatcagactct

SEQ ID NO: 10539 - DNA, 172 bp, Artificial Sequence; identical to SEQ ID NO: 10538
  Synthetic polynucleotide

SEQ ID NO: 10540 - DNA, 185 bp, Artificial Sequence
  Synthetic polynucleotide
atcatctcaccttgcctcctgatgggttgatcgacgcacctgcaggatttacgacaaatagcagaatttacgacaaatagctcgatttacgacaaatagcgacatttacgacaaatagcctaatttacgacaaatagcactatttacgacaaatagctgcggcgcgccatgcttcatcagactct

SEQ ID NO: 10541 - DNA, 185 bp, Artificial Sequence; identical to SEQ ID NO: 10540
  Synthetic polynucleotide

SEQ ID NO: 10542 - DNA, 185 bp, Artificial Sequence
  Synthetic polynucleotide
atcatctcaccttgcctcctgtaggtctcgccgtctaacctgcaggtaagccacttaacattagataagccacttaacatttcgtaagccacttaacattgactaagccacttaacattctataagccacttaacattacttaagccacttaacatttgcggcgcgccatgcttcatcagactct

SEQ ID NO: 10543 - DNA, 185 bp, Artificial Sequence; identical to SEQ ID NO: 10542
  Synthetic polynucleotide

SEQ ID NO: 10544 - DNA, 191 bp, Artificial Sequence
  Synthetic polynucleotide
atcatctcaccttgcctcctggatagagaatccgtatacctgcaggcgaaggctgcggggtcagcacagacgaaggctgcggggtcagcactcgcgaaggctgcggggtcagcacgaccgaaggctgcggggtcagcacctacgaaggctgcggggtcagcacactggcgcgccatgcttcatcagactct

SEQ ID NO: 10545 - DNA, 191 bp, Artificial Sequence; identical to SEQ ID NO: 10544
  Synthetic polynucleotide

SEQ ID NO: 10546 - DNA, 164 bp, Artificial Sequence
  Synthetic polynucleotide
atcatctcaccttgcctcctgacccgtatttacctcttcctgcaggacctgtcatagaacctgtcattcgacctgtcatgacacctgtcatctaacctgtcatactacctgtcattgcacctgtcatgtaacctgtcatggcgcgccatgcttcatcagactct

SEQ ID NO: 10547 - DNA, 164 bp, Artificial Sequence; identical to SEQ ID NO: 10546
  Synthetic polynucleotide

SEQ ID NO: 10548 - DNA, 164 bp, Artificial Sequence
  Synthetic polynucleotide
atcatctcaccttgcctcctgctctacagttgttcatacctgcaggtttcgaacgagatttcgaacgtcgtttcgaacggactttcgaacgctatttcgaacgacttttcgaacgtgctttcgaacggtatttcgaacgggcgcgccatgcttcatcagactct

SEQ ID NO: 10549 - DNA, 164 bp, Artificial Sequence; identical to SEQ ID NO: 10548
  Synthetic polynucleotide

SEQ ID NO: 10550 - DNA, 172 bp, Artificial Sequence
  Synthetic polynucleotide
atcatctcaccttgcctcctgcagcctttcgtgagaggcctgcaggtacccgcatgagatacccgcatgtcgtacccgcatggactacccgcatgctatacccgcatgacttacccgcatgtgctacccgcatggtatacccgcatgggcgcgccatgcttcatcagactct

SEQ ID NO: 10551 - DNA, 172 bp, Artificial Sequence; identical to SEQ ID NO: 10550
  Synthetic polynucleotide

SEQ ID NO: 10552 - DNA, 172 bp, Artificial Sequence
  Synthetic polynucleotide
atcatctcaccttgcctcctgggaagagtttgatgtagcctgcaggtcacgtggttagatcacgtggtttcgtcacgtggttgactcacgtggttctatcacgtggttacttcacgtggtttgctcacgtggttgtatcacgtggttggcgcgccatgcttcatcagactct

SEQ ID NO: 10553 - DNA, 172 bp, Artificial Sequence; identical to SEQ ID NO: 10552
  Synthetic polynucleotide

SEQ ID NO: 10554 - DNA, 172 bp, Artificial Sequence
  Synthetic polynucleotide
atcatctcaccttgcctcctgttcatatgcagtgcgcacctgcaggcctggtgctgagacctggtgctgtcgcctggtgctggaccctggtgctgctacctggtgctgactcctggtgctgtgccctggtgctggtacctggtgctgggcgcgccatgcttcatcagactct

SEQ ID NO: 10555 - DNA, 172 bp, Artificial Sequence; identical to SEQ ID NO: 10554
  Synthetic polynucleotide

SEQ ID NO: 10556 - DNA, 197 bp, Artificial Sequence
  Synthetic polynucleotide
atcatctcaccttgcctcctgatcaaggtagcgtcgcccctgcaggtcatactggagagaaagatcatactggagagaatcgtcatactggagagaagactcatactggagagaactatcatactggagagaaacttcatactggagagaatgctcatactggagagaagtaggcgcgccatgcttcatcagactct

SEQ ID NO: 10557 - DNA, 197 bp, Artificial Sequence; identical to SEQ ID NO: 10556
  Synthetic polynucleotide

SEQ ID NO: 10558 - DNA, 196 bp, Artificial Sequence
  Synthetic polynucleotide
atcatctcaccttgcctcctgcagaccggtgaacgaaccctgcaggtttacccacaatgcattgcgccagatttacccacaatgcattgcgcctcgtttacccacaatgcattgcgccgactttacccacaatgcattgcgccctatttacccacaatgcattgcgccactggcgcgccatgcttcatcagactct

SEQ ID NO: 10559 - DNA, 196 bp, Artificial Sequence; identical to SEQ ID NO: 10558
  Synthetic polynucleotide

SEQ ID NO: 10560 - DNA, 180 bp, Artificial Sequence
  Synthetic polynucleotide
atcatctcaccttgcctcctgcaccggtaagccgaaaccctgcaggtaattagattaagataattagattatcgtaattagattagactaattagattactataattagattaacttaattagattatgctaattagattagtataattagattaggcgcgccatgcttcatcagactct

SEQ ID NO: 10561 - DNA, 180 bp, Artificial Sequence; identical to SEQ ID NO: 10560
  Synthetic polynucleotide

SEQ ID NO: 10562 - DNA, 185 bp, Artificial Sequence
  Synthetic polynucleotide
atcatctcaccttgcctcctgtagttagacgatgtaggcctgcaggcgaattttatggctccagacgaattttatggctcctcgcgaattttatggctccgaccgaattttatggctccctacgaattttatggctccactcgaattttatggctcctgcggcgcgccatgcttcatcagactct

SEQ ID NO: 10563 - DNA, 185 bp, Artificial Sequence; identical to SEQ ID NO: 10562
  Synthetic polynucleotide

SEQ ID NO: 10564 - DNA, 156 bp, Artificial Sequence
  Synthetic polynucleotide
atcatctcaccttgcctcctggaagagaaagcattcctcctgcaggtgatacccagatgataccctcgtgatacccgactgatacccctatgatacccacttgataccctgctgatacccgtatgatacccggcgcgccatgcttcatcagactct

SEQ ID NO: 10565 - DNA, 156 bp, Artificial Sequence; identical to SEQ ID NO: 10564
  Synthetic polynucleotide

SEQ ID NO: 10566 - DNA, 185 bp, Artificial Sequence
  Synthetic polynucleotide
atcatctcaccttgcctcctgctggaggaataatcccacctgcagggcagaaagaagtaacaagagcagaaagaagtaacatcggcagaaagaagtaacagacgcagaaagaagtaacactagcagaaagaagtaacaactgcagaaagaagtaacatgcggcgcgccatgcttcatcagactct

SEQ ID NO: 10567 - DNA, 185 bp, Artificial Sequence; identical to SEQ ID NO: 10566
  Synthetic polynucleotide

SEQ ID NO: 10568 - DNA, 172 bp, Artificial Sequence
  Synthetic polynucleotide
atcatctcaccttgcctcctgtttacatgccacggtagcctgcaggcgcttccggcagacgcttccggctcgcgcttccggcgaccgcttccggcctacgcttccggcactcgcttccggctgccgcttccggcgtacgcttccggcggcgcgccatgcttcatcagactct

SEQ ID NO: 10569 - DNA, 172 bp, Artificial Sequence; identical to SEQ ID NO: 10568
  Synthetic polynucleotide

SEQ ID NO: 10570 - DNA, 156 bp, Artificial Sequence
  Synthetic polynucleotide
atcatctcaccttgcctcctgtgcgtcgcaatgggtaacctgcaggtcccgctcagatcccgctctcgtcccgctcgactcccgctcctatcccgctcacttcccgctctgctcccgctcgtatcccgctcggcgcgccatgcttcatcagactct

SEQ ID NO: 10571 - DNA, 156 bp, Artificial Sequence; identical to SEQ ID NO: 10570
  Synthetic polynucleotide

SEQ ID NO: 10572 - DNA, 180 bp, Artificial Sequence
  Synthetic polynucleotide
atcatctcaccttgcctcctggtgagctgtgtccgagacctgcaggtttttattgctagatttttattgcttcgtttttattgctgactttttattgctctatttttattgctacttttttattgcttgctttttattgctgtatttttattgctggcgcgccatgcttcatcagactct

SEQ ID NO: 10573 - DNA, 180 bp, Artificial Sequence; identical to SEQ ID NO: 10572
  Synthetic polynucleotide

SEQ ID NO: 10574 - DNA, 188 bp, Artificial Sequence
  Synthetic polynucleotide
atcatctcaccttgcctcctgagagaaacggcttaagccctgcaggaatgggcgtggcagaaatgggcgtggctcgaatgggcgtggcgacaatgggcgtggcctaaatgggcgtggcactaatgggcgtggctgcaatgggcgtggcgtaaatgggcgtggcggcgcgccatgcttcatcagactct

SEQ ID NO: 10575 - DNA, 188 bp, Artificial Sequence; identical to SEQ ID NO: 10574
  Synthetic polynucleotide

SEQ ID NO: 10576 - DNA, 164 bp, Artificial Sequence
  Synthetic polynucleotide
atcatctcaccttgcctcctggttcttgtccgtgccttcctgcaggacctgtcaaagaacctgtcaatcgacctgtcaagacacctgtcaactaacctgtcaaactacctgtcaatgcacctgtcaagtaacctgtcaaggcgcgccatgcttcatcagactct

SEQ ID NO: 10577 - DNA, 164 bp, Artificial Sequence; identical to SEQ ID NO: 10576
  Synthetic polynucleotide

SEQ ID NO: 10578 - DNA, 164 bp, Artificial Sequence
  Synthetic polynucleotide
atcatctcaccttgcctcctggttctggcaagcaactgcctgcaggccaggtgcaagaccaggtgcatcgccaggtgcagacccaggtgcactaccaggtgcaactccaggtgcatgcccaggtgcagtaccaggtgcaggcgcgccatgcttcatcagactct

SEQ ID NO: 10579 - DNA, 164 bp, Artificial Sequence; identical to SEQ ID NO: 10578
  Synthetic polynucleotide

SEQ ID NO: 10580 - DNA, 191 bp, Artificial Sequence
  Synthetic polynucleotide
atcatctcaccttgcctcctgctgcaggtcctacacagcctgcaggtaaactaattagctttgagataaactaattagctttgtcgtaaactaattagctttggactaaactaattagctttgctataaactaattagctttgacttaaactaattagctttgtgcggcgcgccatgcttcatcagactct

SEQ ID NO: 10581 - DNA, 191 bp, Artificial Sequence; identical to SEQ ID NO: 10580
  Synthetic polynucleotide

SEQ ID NO: 10582 - DNA, 172 bp, Artificial Sequence
  Synthetic polynucleotide
atcatctcaccttgcctcctgctttacctaaggctctgcctgcaggatatgcaaatagaatatgcaaattcgatatgcaaatgacatatgcaaatctaatatgcaaatactatatgcaaattgcatatgcaaatgtaatatgcaaatggcgcgccatgcttcatcagactct

SEQ ID NO: 10583 - DNA, 172 bp, Artificial Sequence; identical to SEQ ID NO: 10582
  Synthetic polynucleotide

SEQ ID NO: 10584 - DNA, 172 bp, Artificial Sequence
  Synthetic polynucleotide
atcatctcaccttgcctcctgaaccagaagactacacgcctgcaggttatttcctgagattatttcctgtcgttatttcctggacttatttcctgctattatttcctgactttatttcctgtgcttatttcctggtattatttcctgggcgcgccatgcttcatcagactct

SEQ ID NO: 10585 - DNA, 172 bp, Artificial Sequence; identical to SEQ ID NO: 10584
  Synthetic polynucleotide

SEQ ID NO: 10586 - DNA, 164 bp, Artificial Sequence
  Synthetic polynucleotide
atcatctcaccttgcctcctgacctttagctgaagtcgcctgcaggttccccaccagattccccacctcgttccccaccgacttccccaccctattccccaccactttccccacctgcttccccaccgtattccccaccggcgcgccatgcttcatcagactct

SEQ ID NO: 10587 - DNA, 164 bp, Artificial Sequence; identical to SEQ ID NO: 10586
  Synthetic polynucleotide

SEQ ID NO: 10588 - DNA, 172 bp, Artificial Sequence
  Synthetic polynucleotide
atcatctcaccttgcctcctgatgtaggagggatcgatcctgcaggcgcccacgtcagacgcccacgtctcgcgcccacgtcgaccgcccacgtcctacgcccacgtcactcgcccacgtctgccgcccacgtcgtacgcccacgtcggcgcgccatgcttcatcagactct

SEQ ID NO: 10589 - DNA, 172 bp, Artificial Sequence; identical to SEQ ID NO: 10588
  Synthetic polynucleotide

SEQ ID NO: 10590 - DNA, 172 bp, Artificial Sequence
  Synthetic polynucleotide
atcatctcaccttgcctcctgctagtagacgttgtgtgcctgcaggacacttgagtagaacacttgagttcgacacttgagtgacacacttgagtctaacacttgagtactacacttgagttgcacacttgagtgtaacacttgagtggcgcgccatgcttcatcagactct

SEQ ID NO: 10591 - DNA, 172 bp, Artificial Sequence; identical to SEQ ID NO: 10590
  Synthetic polynucleotide

SEQ ID NO: 10592 - DNA, 156 bp, Artificial Sequence
  Synthetic polynucleotide
atcatctcaccttgcctcctggctcttagatcaatcatcctgcaggaaattcctagaaaattccttcgaaattcctgacaaattcctctaaaattcctactaaattccttgcaaattcctgtaaaattcctggcgcgccatgcttcatcagactct

SEQ ID NO: 10593 - DNA, 156 bp, Artificial Sequence; identical to SEQ ID NO: 10592
  Synthetic polynucleotide

SEQ ID NO: 10594 - DNA, 172 bp, Artificial Sequence
  Synthetic polynucleotide
atcatctcaccttgcctcctgaggtcctgtggagtgaccctgcagggcttatctttagagcttatcttttcggcttatctttgacgcttatctttctagcttatctttactgcttatcttttgcgcttatctttgtagcttatctttggcgcgccatgcttcatcagactct

SEQ ID NO: 10595 - DNA, 172 bp, Artificial Sequence; identical to SEQ ID NO: 10594
  Synthetic polynucleotide

SEQ ID NO: 10596 - DNA, 156 bp, Artificial Sequence
  Synthetic polynucleotide
atcatctcaccttgcctcctgaagagggcatagcaacccctgcaggtaataaaaagataataaaatcgtaataaaagactaataaaactataataaaaacttaataaaatgctaataaaagtataataaaaggcgcgccatgcttcatcagactct

SEQ ID NO: 10597 - DNA, 156 bp, Artificial Sequence; identical to SEQ ID NO: 10596
  Synthetic polynucleotide

SEQ ID NO: 10598 - DNA, 191 bp, Artificial Sequence
  Synthetic polynucleotide
atcatctcaccttgcctcctgacggtggctactatttacctgcaggaatggggtatcacttttagaaatggggtatcactttttcgaatggggtatcacttttgacaatggggtatcacttttctaaatggggtatcacttttactaatggggtatcactttttgcggcgcgccatgcttcatcagactct

SEQ ID NO: 10599 - DNA, 191 bp, Artificial Sequence; identical to SEQ ID NO: 10598
  Synthetic polynucleotide

SEQ ID NO: 10600 - DNA, 191 bp, Artificial Sequence
  Synthetic polynucleotide
atcatctcaccttgcctcctgcttgcgatactgctattcctgcaggttggatacttgccaagaagattggatacttgccaagatcgttggatacttgccaagagacttggatacttgccaagactattggatacttgccaagaactttggatacttgccaagatgcggcgcgccatgcttcatcagactct

SEQ ID NO: 10601 - DNA, 191 bp, Artificial Sequence; identical to SEQ ID NO: 10600
  Synthetic polynucleotide

SEQ ID NO: 10602 - DNA, 156 bp, Artificial Sequence
  Synthetic polynucleotide
atcatctcaccttgcctcctgccctatgaagacttccacctgcaggctcaagtgagactcaagtgtcgctcaagtggacctcaagtgctactcaagtgactctcaagtgtgcctcaagtggtactcaagtgggcgcgccatgcttcatcagactct

SEQ ID NO: 10603 - DNA, 156 bp, Artificial Sequence; identical to SEQ ID NO: 10602
  Synthetic polynucleotide

SEQ ID NO: 10604 - DNA, 164 bp, Artificial Sequence
  Synthetic polynucleotide
atcatctcaccttgcctcctgacaaatgtcctcgattacctgcaggtggaaaattagatggaaaatttcgtggaaaattgactggaaaattctatggaaaattacttggaaaatttgctggaaaattgtatggaaaattggcgcgccatgcttcatcagactct

SEQ ID NO: 10605 - DNA, 164 bp, Artificial Sequence; identical to SEQ ID NO: 10604
  Synthetic polynucleotide

SEQ ID NO: 10606 - DNA, 156 bp, Artificial Sequence
  Synthetic polynucleotide
atcatctcaccttgcctcctggatatgtcgaatccgttcctgcaggttcaaaggagattcaaaggtcgttcaaagggacttcaaaggctattcaaaggactttcaaaggtgcttcaaagggtattcaaaggggcgcgccatgcttcatcagactct

SEQ ID NO: 10607 - DNA, 156 bp, Artificial Sequence; identical to SEQ ID NO: 10606
  Synthetic polynucleotide

SEQ ID NO: 10608 - DNA, 197 bp, Artificial Sequence
  Synthetic polynucleotide
atcatctcaccttgcctcctgacgacatacgcaacaatcctgcaggatgatttattactttagaatgatttattacttttcgatgatttattactttgacatgatttattactttctaatgatttattactttactatgatttattacttttgcatgatttattactttgtaggcgcgccatgcttcatcagactct

SEQ ID NO: 10609 - DNA, 197 bp, Artificial Sequence; identical to SEQ ID NO: 10608
  Synthetic polynucleotide

SEQ ID NO: 10610 - DNA, 140 bp, Artificial Sequence
  Synthetic polynucleotide
atcatctcaccttgcctcctgcccttcgtgtgaactgacctgcaggaacaatagaaacaattcgaacaatgacaacaatctaaacaatactaacaattgcaacaatgtaaacaatggcgcgccatgcttcatcagactct

SEQ ID NO: 10611 - DNA, 140 bp, Artificial Sequence; identical to SEQ ID NO: 10610
  Synthetic polynucleotide

SEQ ID NO: 10612 - DNA, 188 bp, Artificial Sequence
  Synthetic polynucleotide
atcatctcaccttgcctcctgtagaaccgactaccacgcctgcaggattgcacaatttagaattgcacaattttcgattgcacaatttgacattgcacaatttctaattgcacaatttactattgcacaattttgcattgcacaatttgtaattgcacaatttggcgcgccatgcttcatcagactct

SEQ ID NO: 10613 - DNA, 188 bp, Artificial Sequence; identical to SEQ ID NO: 10612
  Synthetic polynucleotide

SEQ ID NO: 10614 - DNA, 197 bp, Artificial Sequence
  Synthetic polynucleotide
atcatctcaccttgcctcctgttgggaccaggtacccacctgcaggttctatttttggcatagattctatttttggcattcgttctatttttggcatgacttctatttttggcatctattctatttttggcatactttctatttttggcattgcttctatttttggcatgtaggcgcgccatgcttcatcagactct

SEQ ID NO: 10615 - DNA, 197 bp, Artificial Sequence; identical to SEQ ID NO: 10614
  Synthetic polynucleotide

SEQ ID NO: 10616 - DNA, 180 bp, Artificial Sequence
  Synthetic polynucleotide
atcatctcaccttgcctcctgactcgcttgtatcacttcctgcaggcacagctgcagagacacagctgcagtcgcacagctgcaggaccacagctgcagctacacagctgcagactcacagctgcagtgccacagctgcaggtacacagctgcagggcgcgccatgcttcatcagactct

SEQ ID NO: 10617 - DNA, 180 bp, Artificial Sequence; identical to SEQ ID NO: 10616
  Synthetic polynucleotide

SEQ ID NO: 10618 - DNA, 197 bp, Artificial Sequence
  Synthetic polynucleotide
atcatctcaccttgcctcctgatatcagacaggctgggcctgcaggcatttccgggaaatgagacatttccgggaaatgtcgcatttccgggaaatggaccatttccgggaaatgctacatttccgggaaatgactcatttccgggaaatgtgccatttccgggaaatggtaggcgcgccatgcttcatcagactct

SEQ ID NO: 10619 - DNA, 197 bp, Artificial Sequence; identical to SEQ ID NO: 10618
  Synthetic polynucleotide

SEQ ID NO: 10620 - DNA, 164 bp, Artificial Sequence
  Synthetic polynucleotide
atcatctcaccttgcctcctgacgcaccaattcttagccctgcagggagaacaatagagagaacaattcggagaacaatgacgagaacaatctagagaacaatactgagaacaattgcgagaacaatgtagagaacaatggcgcgccatgcttcatcagactct

SEQ ID NO: 10621 - DNA, 164 bp, Artificial Sequence; identical to SEQ ID NO: 10620
  Synthetic polynucleotide

SEQ ID NO: 10622 - DNA, 180 bp, Artificial Sequence
  Synthetic polynucleotide
atcatctcaccttgcctcctgctaggtgctgggaggtacctgcaggcggcagatggtagacggcagatggttcgcggcagatggtgaccggcagatggtctacggcagatggtactcggcagatggttgccggcagatggtgtacggcagatggtggcgcgccatgcttcatcagactct

SEQ ID NO: 10623 - DNA, 180 bp, Artificial Sequence; identical to SEQ ID NO: 10622
  Synthetic polynucleotide

SEQ ID NO: 10624 - DNA, 197 bp, Artificial Sequence
  Synthetic polynucleotide
atcatctcaccttgcctcctgatagccgtcaagtgtgacctgcagggaggggtgcccgcaggccagagaggggtgcccgcaggcctcggaggggtgcccgcaggccgacgaggggtgcccgcaggccctagaggggtgcccgcaggccactgaggggtgcccgcaggcctgcggcgcgccatgcttcatcagactct

SEQ ID NO: 10625 - DNA, 197 bp, Artificial Sequence; identical to SEQ ID NO: 10624
  Synthetic polynucleotide

SEQ ID NO: 10626 - DNA, 190 bp, Artificial Sequence
  Synthetic polynucleotide
atcatctcaccttgcctcctggtatcagagcgtagacgcctgcaggatttttttggttttagaatttttttggtttttcgatttttttggttttgacatttttttggttttctaatttttttggttttactatttttttggtttttgcatttttttggttttgtaggcgcgccatgcttcatcagactct

SEQ ID NO: 10627 - DNA, 190 bp, Artificial Sequence; identical to SEQ ID NO: 10626
  Synthetic polynucleotide

SEQ ID NO: 10628 - DNA, 191 bp, Artificial Sequence
  Synthetic polynucleotide
atcatctcaccttgcctcctggttgccatgatgaaccacctgcaggagaagaacaaaggactaagaagaagaacaaaggactatcgagaagaacaaaggactagacagaagaacaaaggactactaagaagaacaaaggactaactagaagaacaaaggactatgcggcgcgccatgcttcatcagactct

SEQ ID NO: 10629 - DNA, 191 bp, Artificial Sequence; identical to SEQ ID NO: 10628
  Synthetic polynucleotide

SEQ ID NO: 10630 - DNA, 180 bp, Artificial Sequence
  Synthetic polynucleotide
atcatctcaccttgcctcctgaaacgatcccgcagggtcctgcaggccggggtgctgagaccggggtgctgtcgccggggtgctggacccggggtgctgctaccggggtgctgactccggggtgctgtgcccggggtgctggtaccggggtgctgggcgcgccatgcttcatcagactct

SEQ ID NO: 10631 - DNA, 180 bp, Artificial Sequence; identical to SEQ ID NO: 10630
  Synthetic polynucleotide

SEQ ID NO: 10632 - DNA, 188 bp, Artificial Sequence
  Synthetic polynucleotide
atcatctcaccttgcctcctggatgaagccgctcgattcctgcaggaataaacaaacaagaaataaacaaacatcgaataaacaaacagacaataaacaaacactaaataaacaaacaactaataaacaaacatgcaataaacaaacagtaaataaacaaacaggcgcgccatgcttcatcagactct

SEQ ID NO: 10633 - DNA, 188 bp, Artificial Sequence; identical to SEQ ID NO: 10632
  Synthetic polynucleotide

SEQ ID NO: 10634 - DNA, 197 bp, Artificial Sequence
  Synthetic polynucleotide
atcatctcaccttgcctcctgaaataatcaaagacgggcctgcaggttataaataaacattcaaagattataaataaacattcaatcgttataaataaacattcaagacttataaataaacattcaactattataaataaacattcaaactttataaataaacattcaatgcggcgcgccatgcttcatcagactct

SEQ ID NO: 10635 - DNA, 197 bp, Artificial Sequence; identical to SEQ ID NO: 10634
  Synthetic polynucleotide

SEQ ID NO: 10636 - DNA, 172 bp, Artificial Sequence
  Synthetic polynucleotide
atcatctcaccttgcctcctgagtgcggtgacggtatgcctgcaggatcacatgacagaatcacatgactcgatcacatgacgacatcacatgacctaatcacatgacactatcacatgactgcatcacatgacgtaatcacatgacggcgcgccatgcttcatcagactct

SEQ ID NO: 10637 - DNA, 172 bp, Artificial Sequence; identical to SEQ ID NO: 10636
  Synthetic polynucleotide

SEQ ID NO: 10638 - DNA, 196 bp, Artificial Sequence
  Synthetic polynucleotide
atcatctcaccttgcctcctgcgctcatcggtgttgaccctgcaggccacttccggttcagaccacttccggttctcgccacttccggttcgacccacttccggttcctaccacttccggttcactccacttccggttctgcccacttccggttcgtaccacttccggttcggcgcgccatgcttcatcagactct

SEQ ID NO: 10639 - DNA, 196 bp, Artificial Sequence; identical to SEQ ID NO: 10638
  Synthetic polynucleotide

SEQ ID NO: 10640 - DNA, 172 bp, Artificial Sequence
  Synthetic polynucleotide
atcatctcaccttgcctcctgctgagcaagtacccttgcctgcaggcccaattagcagacccaattagctcgcccaattagcgaccccaattagcctacccaattagcactcccaattagctgccccaattagcgtacccaattagcggcgcgccatgcttcatcagactct

SEQ ID NO: 10641 - DNA, 172 bp, Artificial Sequence; identical to SEQ ID NO: 10640
  Synthetic polynucleotide

SEQ ID NO: 10642 - DNA, 164 bp, Artificial Sequence
  Synthetic polynucleotide
atcatctcaccttgcctcctgggacaaagtcacaattccctgcaggtttatgaccagatttatgacctcgtttatgaccgactttatgaccctatttatgaccacttttatgacctgctttatgaccgtatttatgaccggcgcgccatgcttcatcagactct

SEQ ID NO: 10643 - DNA, 164 bp, Artificial Sequence; identical to SEQ ID NO: 10642
  Synthetic polynucleotide

SEQ ID NO: 10644 - DNA, 196 bp, Artificial Sequence
  Synthetic polynucleotide
atcatctcaccttgcctcctgcccgtcaggtatccatccctgcaggaaattagcataatagaaaattagcataattcgaaattagcataatgacaaattagcataatctaaaattagcataatactaaattagcataattgcaaattagcataatgtaaaattagcataatggcgcgccatgcttcatcagactct

SEQ ID NO: 10645 - DNA, 196 bp, Artificial Sequence; identical to SEQ ID NO: 10644
  Synthetic polynucleotide

SEQ ID NO: 10646 - DNA, 148 bp, Artificial Sequence
  Synthetic polynucleotide
atcatctcaccttgcctcctgcaatctctcatcaaacacctgcagggcatgacagagcatgactcggcatgacgacgcatgacctagcatgacactgcatgactgcgcatgacgtagcatgacggcgcgccatgcttcatcagactct

SEQ ID NO: 10647 - DNA, 148 bp, Artificial Sequence; identical to SEQ ID NO: 10646
  Synthetic polynucleotide

SEQ ID NO: 10648 - DNA, 200 bp, Artificial Sequence
  Synthetic polynucleotide
atcatctcaccttgcctcctgccacttcggctgtgatacctgcagggagggcagtgaagcgtgacagagagggcagtgaagcgtgactcggagggcagtgaagcgtgacgacgagggcagtgaagcgtgacctagagggcagtgaagcgtgacactgagggcagtgaagcgtgacggcgcgccatgcttcatcagactct

SEQ ID NO: 10649 - DNA, 200 bp, Artificial Sequence; identical to SEQ ID NO: 10648
  Synthetic polynucleotide

SEQ ID NO: 10650 - DNA, 185 bp, Artificial Sequence
  Synthetic polynucleotide
atcatctcaccttgcctcctgtcgcgtaaatgaacgcgcctgcaggaggttaattagctgatagaaggttaattagctgattcgaggttaattagctgatgacaggttaattagctgatctaaggttaattagctgatactaggttaattagctgattgcggcgcgccatgcttcatcagactct

SEQ ID NO: 10651 - DNA, 185 bp, Artificial Sequence; identical to SEQ ID NO: 10650
  Synthetic polynucleotide

SEQ ID NO: 10652 - DNA, 172 bp, Artificial Sequence
  Synthetic polynucleotide
atcatctcaccttgcctcctgcctgtatcattgcgaaacctgcaggacaagagggcagaacaagagggctcgacaagagggcgacacaagagggcctaacaagagggcactacaagagggctgcacaagagggcgtaacaagagggcggcgcgccatgcttcatcagactct

SEQ ID NO: 10653 - DNA, 172 bp, Artificial Sequence; identical to SEQ ID NO: 10652
  Synthetic polynucleotide

SEQ ID NO: 10654 - DNA, 196 bp, Artificial Sequence
  Synthetic polynucleotide
atcatctcaccttgcctcctgcgtgattcgtgcgaagccctgcaggactgtgggaaacgagaactgtgggaaacgtcgactgtgggaaacggacactgtgggaaacgctaactgtgggaaacgactactgtgggaaacgtgcactgtgggaaacggtaactgtgggaaacgggcgcgccatgcttcatcagactct

SEQ ID NO: 10655 - DNA, 196 bp, Artificial Sequence; identical to SEQ ID NO: 10654
  Synthetic polynucleotide

SEQ ID NO: 10656 - DNA, 140 bp, Artificial Sequence
  Synthetic polynucleotide
atcatctcaccttgcctcctgttattggcccacaattacctgcaggtgatacagatgatactcgtgatacgactgatacctatgatacacttgatactgctgatacgtatgatacggcgcgccatgcttcatcagactct

SEQ ID NO: 10657 - DNA, 140 bp, Artificial Sequence; identical to SEQ ID NO: 10656
  Synthetic polynucleotide

SEQ ID NO: 10658 - DNA, 197 bp, Artificial Sequence
  Synthetic polynucleotide
atcatctcaccttgcctcctgtgacagcctttcccaatcctgcaggtgggtcattagactcagatgggtcattagactctcgtgggtcattagactcgactgggtcattagactcctatgggtcattagactcacttgggtcattagactctgctgggtcattagactcgtaggcgcgccatgcttcatcagactct

SEQ ID NO: 10659 - DNA, 197 bp, Artificial Sequence; identical to SEQ ID NO: 10658
  Synthetic polynucleotide

SEQ ID NO: 10660 - DNA, 180 bp, Artificial Sequence
  Synthetic polynucleotide
atcatctcaccttgcctcctgtgtaggacaataacatgcctgcaggcttcacacctaagacttcacacctatcgcttcacacctagaccttcacacctactacttcacacctaactcttcacacctatgccttcacacctagtacttcacacctaggcgcgccatgcttcatcagactct

SEQ ID NO: 10661 - DNA, 180 bp, Artificial Sequence; identical to SEQ ID NO: 10660
  Synthetic polynucleotide

SEQ ID NO: 10662 - DNA, 148 bp, Artificial Sequence
  Synthetic polynucleotide
atcatctcaccttgcctcctgggtgagtagccatacaccctgcaggaaggtcaagaaaggtcatcgaaggtcagacaaggtcactaaaggtcaactaaggtcatgcaaggtcagtaaaggtcaggcgcgccatgcttcatcagactct

SEQ ID NO: 10663 - DNA, 148 bp, Artificial Sequence; identical to SEQ ID NO: 10662
  Synthetic polynucleotide

SEQ ID NO: 10664 - DNA, 172 bp, Artificial Sequence
  Synthetic polynucleotide
atcatctcaccttgcctcctgattccggttcaaataaccctgcaggggtcaaaggtagaggtcaaaggttcgggtcaaaggtgacggtcaaaggtctaggtcaaaggtactggtcaaaggttgcggtcaaaggtgtaggtcaaaggtggcgcgccatgcttcatcagactct

SEQ ID NO: 10665 - DNA, 172 bp, Artificial Sequence; identical to SEQ ID NO: 10664
  Synthetic polynucleotide

SEQ ID NO: 10666 - DNA, 172 bp, Artificial Sequence
  Synthetic polynucleotide
atcatctcaccttgcctcctgctgacctcgaagagatacctgcaggggtaataaaaagaggtaataaaatcgggtaataaaagacggtaataaaactaggtaataaaaactggtaataaaatgcggtaataaaagtaggtaataaaaggcgcgccatgcttcatcagactct

SEQ ID NO: 10667 - DNA, 172 bp, Artificial Sequence; identical to SEQ ID NO: 10666
  Synthetic polynucleotide

SEQ ID NO: 10668 - DNA, 188 bp, Artificial Sequence
  Synthetic polynucleotide
atcatctcaccttgcctcctgcgaggcatctccaaccacctgcaggcgccaggtgctgagacgccaggtgctgtcgcgccaggtgctggaccgccaggtgctgctacgccaggtgctgactcgccaggtgctgtgccgccaggtgctggtacgccaggtgctgggcgcgccatgcttcatcagactct

SEQ ID NO: 10669 - DNA, 188 bp, Artificial Sequence; identical to SEQ ID NO: 10668
  Synthetic polynucleotide

SEQ ID NO: 10670 - DNA, 197 bp, Artificial Sequence
  Synthetic polynucleotide
atcatctcaccttgcctcctgatacttggccgtagggccctgcaggggggtttgtggtttgagaggggtttgtggtttgtcgggggtttgtggtttggacggggtttgtggtttgctaggggtttgtggtttgactggggtttgtggtttgtgcggggtttgtggtttggtaggcgcgccatgcttcatcagactct

SEQ ID NO: 10671 - DNA, 197 bp, Artificial Sequence; identical to SEQ ID NO: 10670
  Synthetic polynucleotide

SEQ ID NO: 10672 - DNA, 185 bp, Artificial Sequence
  Synthetic polynucleotide
atcatctcaccttgcctcctgcatagtgcattcgcaatcctgcaggaaaacaggaagtacgtagaaaaacaggaagtacgttcgaaaacaggaagtacgtgacaaaacaggaagtacgtctaaaaacaggaagtacgtactaaaacaggaagtacgttgcggcgcgccatgcttcatcagactct

SEQ ID NO: 10673 - DNA, 185 bp, Artificial Sequence; identical to SEQ ID NO: 10672
  Synthetic polynucleotide

SEQ ID NO: 10674 - DNA, 172 bp, Artificial Sequence
  Synthetic polynucleotide
atcatctcaccttgcctcctgctcagtctaatccggatcctgcaggctgacctttgagactgacctttgtcgctgacctttggacctgacctttgctactgacctttgactctgacctttgtgcctgacctttggtactgacctttgggcgcgccatgcttcatcagactct

SEQ ID NO: 10675 - DNA, 172 bp, Artificial Sequence; identical to SEQ ID NO: 10674
  Synthetic polynucleotide

SEQ ID NO: 10676 - DNA, 191 bp, Artificial Sequence
  Synthetic polynucleotide
atcatctcaccttgcctcctgcgtaagatgacacggcgcctgcaggtgagctaattagttggaagatgagctaattagttggatcgtgagctaattagttggagactgagctaattagttggactatgagctaattagttggaacttgagctaattagttggatgcggcgcgccatgcttcatcagactct

SEQ ID NO: 10677 - DNA, 191 bp, Artificial Sequence; identical to SEQ ID NO: 10676
  Synthetic polynucleotide

SEQ ID NO: 10678 - DNA, 191 bp, Artificial Sequence
  Synthetic polynucleotide
atcatctcaccttgcctcctgttggtgagccatacacacctgcaggtgttttacatgtatattagatgttttacatgtatatttcgtgttttacatgtatattgactgttttacatgtatattctatgttttacatgtatattacttgttttacatgtatatttgcggcgcgccatgcttcatcagactct

SEQ ID NO: 10679 - DNA, 191 bp, Artificial Sequence; identical to SEQ ID NO: 10678
  Synthetic polynucleotide

SEQ ID NO: 10680 - DNA, 172 bp, Artificial Sequence
  Synthetic polynucleotide
atcatctcaccttgcctcctgcgaagcgtgactgcaaccctgcaggtccctattcgagatccctattcgtcgtccctattcggactccctattcgctatccctattcgacttccctattcgtgctccctattcggtatccctattcgggcgcgccatgcttcatcagactct

SEQ ID NO: 10681 - DNA, 172 bp, Artificial Sequence; identical to SEQ ID NO: 10680
  Synthetic polynucleotide

SEQ ID NO: 10682 - DNA, 140 bp, Artificial Sequence
  Synthetic polynucleotide
atcatctcaccttgcctcctggacggtctcagacatagcctgcaggtgacagagatgacagtcgtgacaggactgacagctatgacagacttgacagtgctgacaggtatgacagggcgcgccatgcttcatcagactct

SEQ ID NO: 10683 - DNA, 140 bp, Artificial Sequence; identical to SEQ ID NO: 10682
  Synthetic polynucleotide

SEQ ID NO: 10684 - DNA, 197 bp, Artificial Sequence
  Synthetic polynucleotide
atcatctcaccttgcctcctgcactgtcaagtcacgcgcctgcaggtacgtcagttacgtaagatacgtcagttacgtatcgtacgtcagttacgtagactacgtcagttacgtactatacgtcagttacgtaacttacgtcagttacgtatgctacgtcagttacgtagtaggcgcgccatgcttcatcagactct

SEQ ID NO: 10685 - DNA, 197 bp, Artificial Sequence; identical to SEQ ID NO: 10684
  Synthetic polynucleotide

SEQ ID NO: 10686 - DNA, 172 bp, Artificial Sequence
  Synthetic polynucleotide
atcatctcaccttgcctcctgccattagcagtacacatcctgcaggtttgacagctagatttgacagcttcgtttgacagctgactttgacagctctatttgacagctacttttgacagcttgctttgacagctgtatttgacagctggcgcgccatgcttcatcagactct

SEQ ID NO: 10687 - DNA, 172 bp, Artificial Sequence; identical to SEQ ID NO: 10686
  Synthetic polynucleotide

SEQ ID NO: 10688 - DNA, 190 bp, Artificial Sequence
  Synthetic polynucleotide
atcatctcaccttgcctcctgcaagtgataattacgtgcctgcagggccgggcagcggggagagccgggcagcggggtcggccgggcagcgggggacgccgggcagcggggctagccgggcagcggggactgccgggcagcggggtgcgccgggcagcgggggtaggcgcgccatgcttcatcagactct

SEQ ID NO: 10689 - DNA, 190 bp, Artificial Sequence; identical to SEQ ID NO: 10688
  Synthetic polynucleotide

SEQ ID NO: 10690 - DNA, 188 bp, Artificial Sequence
  Synthetic polynucleotide
atcatctcaccttgcctcctggcacagggatgacaatgcctgcaggcacacccgcattagacacacccgcatttcgcacacccgcattgaccacacccgcattctacacacccgcattactcacacccgcatttgccacacccgcattgtacacacccgcattggcgcgccatgcttcatcagactct

SEQ ID NO: 10691 - DNA, 188 bp, Artificial Sequence; identical to SEQ ID NO: 10690
  Synthetic polynucleotide

SEQ ID NO: 10692 - DNA, 180 bp, Artificial Sequence
  Synthetic polynucleotide
atcatctcaccttgcctcctggggtacagtttgcagaccctgcaggtatcaccccacagatatcaccccactcgtatcaccccacgactatcaccccacctatatcaccccacacttatcaccccactgctatcaccccacgtatatcaccccacggcgcgccatgcttcatcagactct

SEQ ID NO: 10693 - DNA, 180 bp, Artificial Sequence; identical to SEQ ID NO: 10692
  Synthetic polynucleotide

SEQ ID NO: 10694 - DNA, 180 bp, Artificial Sequence
  Synthetic polynucleotide
atcatctcaccttgcctcctgggtctacgaagagacgtcctgcaggaccagatggtcagaaccagatggtctcgaccagatggtcgacaccagatggtcctaaccagatggtcactaccagatggtctgcaccagatggtcgtaaccagatggtcggcgcgccatgcttcatcagactct

SEQ ID NO: 10695 - DNA, 180 bp, Artificial Sequence; identical to SEQ ID NO: 10694
  Synthetic polynucleotide

SEQ ID NO: 10696 - DNA, 185 bp, Artificial Sequence
  Synthetic polynucleotide
atcatctcaccttgcctcctgtccagactagccagacccctgcaggtctcaaaggtcacctgagatctcaaaggtcacctgtcgtctcaaaggtcacctggactctcaaaggtcacctgctatctcaaaggtcacctgacttctcaaaggtcacctgtgcggcgcgccatgcttcatcagactct

SEQ ID NO: 10697 - DNA, 185 bp, Artificial Sequence; identical to SEQ ID NO: 10696
  Synthetic polynucleotide

SEQ ID NO: 10698 - DNA, 172 bp, Artificial Sequence
  Synthetic polynucleotide
atcatctcaccttgcctcctgctaggatcctatgttctcctgcaggccctttgatgagaccctttgatgtcgccctttgatggacccctttgatgctaccctttgatgactccctttgatgtgcccctttgatggtaccctttgatgggcgcgccatgcttcatcagactct

SEQ ID NO: 10699 - DNA, 172 bp, Artificial Sequence; identical to SEQ ID NO: 10698
  Synthetic polynucleotide

SEQ ID NO: 10700 - DNA, 156 bp, Artificial Sequence
  Synthetic polynucleotide
atcatctcaccttgcctcctggcatgcgctagatccaccctgcaggtcataaaaagatcataaaatcgtcataaaagactcataaaactatcataaaaacttcataaaatgctcataaaagtatcataaaaggcgcgccatgcttcatcagactct

SEQ ID NO: 10701 - DNA, 156 bp, Artificial Sequence; identical to SEQ ID NO: 10700
  Synthetic polynucleotide

SEQ ID NO: 10702 - DNA, 156 bp, Artificial Sequence
  Synthetic polynucleotide
atcatctcaccttgcctcctggcacgcgtaaggacttgcctgcaggattacatgagaattacatgtcgattacatggacattacatgctaattacatgactattacatgtgcattacatggtaattacatgggcgcgccatgcttcatcagactct

SEQ ID NO: 10703 - DNA, 156 bp, Artificial Sequence; identical to SEQ ID NO: 10702
  Synthetic polynucleotide

SEQ ID NO: 10704 - DNA, 196 bp, Artificial Sequence
  Synthetic polynucleotide
atcatctcaccttgcctcctggaccataatactctgtacctgcaggcagctccccagggagacagctccccagggtcgcagctccccaggggaccagctccccagggctacagctccccagggactcagctccccagggtgccagctccccaggggtacagctccccagggggcgcgccatgcttcatcagactct

SEQ ID NO: 10705 - DNA, 196 bp, Artificial Sequence; identical to SEQ ID NO: 10704
  Synthetic polynucleotide

SEQ ID NO: 10706 - DNA, 148 bp, Artificial Sequence
  Synthetic polynucleotide
atcatctcaccttgcctcctgacttaatagcgagctcccctgcagggttaatgagagttaatgtcggttaatggacgttaatgctagttaatgactgttaatgtgcgttaatggtagttaatgggcgcgccatgcttcatcagactct

SEQ ID NO: 10707 - DNA, 148 bp, Artificial Sequence; identical to SEQ ID NO: 10706
  Synthetic polynucleotide

SEQ ID NO: 10708 - DNA, 172 bp, Artificial Sequence
  Synthetic polynucleotide
atcatctcaccttgcctcctgttactcctcaccgaaagcctgcaggtcattaattgagatcattaattgtcgtcattaattggactcattaattgctatcattaattgacttcattaattgtgctcattaattggtatcattaattgggcgcgccatgcttcatcagactct

SEQ ID NO: 10709 - DNA, 172 bp, Artificial Sequence; identical to SEQ ID NO: 10708
  Synthetic polynucleotide

SEQ ID NO: 10710 - DNA, 200 bp, Artificial Sequence
  Synthetic polynucleotide
atcatctcaccttgcctcctggcgtacgtcgtcttcgacctgcaggttgtgctgagtcagcatttagattgtgctgagtcagcattttcgttgtgctgagtcagcatttgacttgtgctgagtcagcatttctattgtgctgagtcagcatttactttgtgctgagtcagcatttggcgcgccatgcttcatcagactct

SEQ ID NO: 10711 - DNA, 200 bp, Artificial Sequence; identical to SEQ ID NO: 10710
  Synthetic polynucleotide

SEQ ID NO: 10712 - DNA, 172 bp, Artificial Sequence
  Synthetic polynucleotide
atcatctcaccttgcctcctgcgagacagtggaagtcacctgcagggcacttgagcagagcacttgagctcggcacttgagcgacgcacttgagcctagcacttgagcactgcacttgagctgcgcacttgagcgtagcacttgagcggcgcgccatgcttcatcagactct

SEQ ID NO: 10713 - DNA, 172 bp, Artificial Sequence; identical to SEQ ID NO: 10712
  Synthetic polynucleotide

SEQ ID NO: 10714 - DNA, 156 bp, Artificial Sequence
  Synthetic polynucleotide
atcatctcaccttgcctcctggatgatatgcaacggcgcctgcaggcatttctaagacatttctatcgcatttctagaccatttctactacatttctaactcatttctatgccatttctagtacatttctaggcgcgccatgcttcatcagactct

SEQ ID NO: 10715 - DNA, 156 bp, Artificial Sequence; identical to SEQ ID NO: 10714
  Synthetic polynucleotide

SEQ ID NO: 10716 - DNA, 190 bp, Artificial Sequence
  Synthetic polynucleotide
atcatctcaccttgcctcctgtcaaggctcatcgccaccctgcagggacaggaagtaattagagacaggaagtaatttcggacaggaagtaattgacgacaggaagtaattctagacaggaagtaattactgacaggaagtaatttgcgacaggaagtaattgtaggcgcgccatgcttcatcagactct

SEQ ID NO: 10717 - DNA, 190 bp, Artificial Sequence; identical to SEQ ID NO: 10716
  Synthetic polynucleotide

SEQ ID NO: 10718 - DNA, 164 bp, Artificial Sequence
  Synthetic polynucleotide
atcatctcaccttgcctcctgaggtgagaagaatttctcctgcaggacaggaagtagaacaggaagttcgacaggaagtgacacaggaagtctaacaggaagtactacaggaagttgcacaggaagtgtaacaggaagtggcgcgccatgcttcatcagactct

SEQ ID NO: 10719 - DNA, 164 bp, Artificial Sequence; identical to SEQ ID NO: 10718
  Synthetic polynucleotide

SEQ ID NO: 10720 - DNA, 191 bp, Artificial Sequence
  Synthetic polynucleotide
atcatctcaccttgcctcctgctgcaaacaaacggctacctgcagggcttattaattaactcgagagcttattaattaactcgtcggcttattaattaactcggacgcttattaattaactcgctagcttattaattaactcgactgcttattaattaactcgtgcggcgcgccatgcttcatcagactct

SEQ ID NO: 10721 - DNA, 191 bp, Artificial Sequence; identical to SEQ ID NO: 10720
  Synthetic polynucleotide

SEQ ID NO: 10722 - DNA, 188 bp, Artificial Sequence
  Synthetic polynucleotide
atcatctcaccttgcctcctgcctcggtggccttgtatcctgcaggcaacacctgtccagacaacacctgtcctcgcaacacctgtccgaccaacacctgtccctacaacacctgtccactcaacacctgtcctgccaacacctgtccgtacaacacctgtccggcgcgccatgcttcatcagactct

SEQ ID NO: 10723 - DNA, 188 bp, Artificial Sequence; identical to SEQ ID NO: 10722
  Synthetic polynucleotide

SEQ ID NO: 10724 - DNA, 156 bp, Artificial Sequence
  Synthetic polynucleotide
atcatctcaccttgcctcctgttagtagggacgtcagtcctgcagggggggcggagagggggcggtcggggggcgggacgggggcggctagggggcggactgggggcggtgcgggggcgggtagggggcggggcgcgccatgcttcatcagactct

SEQ ID NO: 10725 - DNA, 156 bp, Artificial Sequence; identical to SEQ ID NO: 10724
  Synthetic polynucleotide

SEQ ID NO: 10726 - DNA, 191 bp, Artificial Sequence
  Synthetic polynucleotide
atcatctcaccttgcctcctgcggagagtagcatgcatcctgcaggcaaggtcgtaaaatcttagacaaggtcgtaaaatctttcgcaaggtcgtaaaatcttgaccaaggtcgtaaaatcttctacaaggtcgtaaaatcttactcaaggtcgtaaaatctttgcggcgcgccatgcttcatcagactct

SEQ ID NO: 10727 - DNA, 191 bp, Artificial Sequence; identical to SEQ ID NO: 10726
  Synthetic polynucleotide

SEQ ID NO: 10728 - DNA, 188 bp, Artificial Sequence
  Synthetic polynucleotide
atcatctcaccttgcctcctgaacgtcaagtgattcgccctgcaggactttcactttcagaactttcactttctcgactttcactttcgacactttcactttcctaactttcactttcactactttcactttctgcactttcactttcgtaactttcactttcggcgcgccatgcttcatcagactct

SEQ ID NO: 10729 - DNA, 188 bp, Artificial Sequence; identical to SEQ ID NO: 10728
  Synthetic polynucleotide

SEQ ID NO: 10730 - DNA, 172 bp, Artificial Sequence
  Synthetic polynucleotide
atcatctcaccttgcctcctgaggtccggtgactacctcctgcaggagccaatgagagaagccaatgagtcgagccaatgaggacagccaatgagctaagccaatgagactagccaatgagtgcagccaatgaggtaagccaatgagggcgcgccatgcttcatcagactct

SEQ ID NO: 10731 - DNA, 172 bp, Artificial Sequence; identical to SEQ ID NO: 10730
  Synthetic polynucleotide

SEQ ID NO: 10732 - DNA, 180 bp, Artificial Sequence
  Synthetic polynucleotide
atcatctcaccttgcctcctgagagaactgtcaccactcctgcaggccccggcctccagaccccggcctcctcgccccggcctccgacccccggcctccctaccccggcctccactccccggcctcctgcccccggcctccgtaccccggcctccggcgcgccatgcttcatcagactct

SEQ ID NO: 10733 - DNA, 180 bp, Artificial Sequence; identical to SEQ ID NO: 10732
  Synthetic polynucleotide

SEQ ID NO: 10734 - DNA, 197 bp, Artificial Sequence
  Synthetic polynucleotide
atcatctcaccttgcctcctgaggttaagtcacctatacctgcaggtagcgccccctggtggccagatagcgccccctggtggcctcgtagcgccccctggtggccgactagcgccccctggtggccctatagcgccccctggtggccacttagcgccccctggtggcctgcggcgcgccatgcttcatcagactct

SEQ ID NO: 10735 - DNA, 197 bp, Artificial Sequence; identical to SEQ ID NO: 10734
  Synthetic polynucleotide

SEQ ID NO: 10736 - DNA, 196 bp, Artificial Sequence
  Synthetic polynucleotide
atcatctcaccttgcctcctggtatggtggacgaaatacctgcaggttgtttattttttagattgtttatttttttcgttgtttattttttgacttgtttattttttctattgtttattttttactttgtttatttttttgcttgtttattttttgtattgtttattttttggcgcgccatgcttcatcagactct

SEQ ID NO: 10737 - DNA, 196 bp, Artificial Sequence; identical to SEQ ID NO: 10736
  Synthetic polynucleotide

SEQ ID NO: 10738 - DNA, 188 bp, Artificial Sequence
  Synthetic polynucleotide
atcatctcaccttgcctcctggttgaccgaaatactcacctgcaggccctttgatcttagaccctttgatctttcgccctttgatcttgacccctttgatcttctaccctttgatcttactccctttgatctttgcccctttgatcttgtaccctttgatcttggcgcgccatgcttcatcagactct

SEQ ID NO: 10739 - DNA, 188 bp, Artificial Sequence; identical to SEQ ID NO: 10738
  Synthetic polynucleotide

SEQ ID NO: 10740 - DNA, 164 bp, Artificial Sequence
  Synthetic polynucleotide
atcatctcaccttgcctcctgctcgtacttcttatgagcctgcaggaagcggaagagaaagcggaagtcgaagcggaaggacaagcggaagctaaagcggaagactaagcggaagtgcaagcggaaggtaaagcggaagggcgcgccatgcttcatcagactct

SEQ ID NO: 10741 - DNA, 164 bp, Artificial Sequence; identical to SEQ ID NO: 10740
  Synthetic polynucleotide

SEQ ID NO: 10742 - DNA, 197 bp, Artificial Sequence
  Synthetic polynucleotide
atcatctcaccttgcctcctgcagggtatcagccacgacctgcaggcatggccccagggcaagacatggccccagggcatcgcatggccccagggcagaccatggccccagggcactacatggccccagggcaactcatggccccagggcatgccatggccccagggcagtaggcgcgccatgcttcatcagactct

SEQ ID NO: 10743 - DNA, 197 bp, Artificial Sequence; identical to SEQ ID NO: 10742
  Synthetic polynucleotide

SEQ ID NO: 10744 - DNA, 185 bp, Artificial Sequence
  Synthetic polynucleotide
atcatctcaccttgcctcctgctgcatatctcccgagtcctgcagggtattgacagctccttagagtattgacagctcctttcggtattgacagctccttgacgtattgacagctccttctagtattgacagctccttactgtattgacagctcctttgcggcgcgccatgcttcatcagactct

SEQ ID NO: 10745 - DNA, 185 bp, Artificial Sequence; identical to SEQ ID NO: 10744
  Synthetic polynucleotide

SEQ ID NO: 10746 - DNA, 164 bp, Artificial Sequence
  Synthetic polynucleotide
atcatctcaccttgcctcctggaaacgaaaggaatgaccctgcaggttccgggaaagattccgggaatcgttccgggaagacttccgggaactattccgggaaactttccgggaatgcttccgggaagtattccgggaaggcgcgccatgcttcatcagactct

SEQ ID NO: 10747 - DNA, 164 bp, Artificial Sequence; identical to SEQ ID NO: 10746
  Synthetic polynucleotide

SEQ ID NO: 10748 - DNA, 197 bp, Artificial Sequence
  Synthetic polynucleotide
atcatctcaccttgcctcctgcgggtaatacagcgtagcctgcaggaacactgaaattgttagaaacactgaaattgtttcgaacactgaaattgttgacaacactgaaattgttctaaacactgaaattgttactaacactgaaattgtttgcaacactgaaattgttgtaggcgcgccatgcttcatcagactct

SEQ ID NO: 10749 - DNA, 197 bp, Artificial Sequence; identical to SEQ ID NO: 10748
  Synthetic polynucleotide

SEQ ID NO: 10750 - DNA, 190 bp, Artificial Sequence
  Synthetic polynucleotide
atcatctcaccttgcctcctgtatgccgctaggaactgcctgcaggggactacagctcccagaggactacagctccctcgggactacagctcccgacggactacagctcccctaggactacagctcccactggactacagctccctgcggactacagctcccgtaggcgcgccatgcttcatcagactct

SEQ ID NO: 10751 - DNA, 190 bp, Artificial Sequence; identical to SEQ ID NO: 10750
  Synthetic polynucleotide

SEQ ID NO: 10752 - DNA, 197 bp, Artificial Sequence
  Synthetic polynucleotide
atcatctcaccttgcctcctggcttcttcttctctacccctgcaggtcagcaccacggacaagatcagcaccacggacatcgtcagcaccacggacagactcagcaccacggacactatcagcaccacggacaacttcagcaccacggacatgctcagcaccacggacagtaggcgcgccatgcttcatcagactct

SEQ ID NO: 10753 - DNA, 197 bp, Artificial Sequence; identical to SEQ ID NO: 10752
  Synthetic polynucleotide

SEQ ID NO: 10754 - DNA, 172 bp, Artificial Sequence
  Synthetic polynucleotide
atcatctcaccttgcctcctgttgcagaaggtgtacttcctgcaggtctaattaacagatctaattaactcgtctaattaacgactctaattaacctatctaattaacacttctaattaactgctctaattaacgtatctaattaacggcgcgccatgcttcatcagactct

SEQ ID NO: 10755 - DNA, 172 bp, Artificial Sequence; identical to SEQ ID NO: 10754
  Synthetic polynucleotide

SEQ ID NO: 10756 - DNA, 172 bp, Artificial Sequence
  Synthetic polynucleotide
atcatctcaccttgcctcctgattatggcatggatatccctgcagggcctcgggcgagagcctcgggcgtcggcctcgggcggacgcctcgggcgctagcctcgggcgactgcctcgggcgtgcgcctcgggcggtagcctcgggcgggcgcgccatgcttcatcagactct

SEQ ID NO: 10757 - DNA, 172 bp, Artificial Sequence; identical to SEQ ID NO: 10756
  Synthetic polynucleotide

SEQ ID NO: 10758 - DNA, 172 bp, Artificial Sequence
  Synthetic polynucleotide
atcatctcaccttgcctcctgctaattcagccagcacccctgcaggcgccatcttgagacgccatcttgtcgcgccatcttggaccgccatcttgctacgccatcttgactcgccatcttgtgccgccatcttggtacgccatcttgggcgcgccatgcttcatcagactct

SEQ ID NO: 10759 - DNA, 172 bp, Artificial Sequence; identical to SEQ ID NO: 10758
  Synthetic polynucleotide

SEQ ID NO: 10760 - DNA, 197 bp, Artificial Sequence
  Synthetic polynucleotide
atcatctcaccttgcctcctgtaccaatgcctactttgcctgcaggatgctatttttagctagaatgctatttttagcttcgatgctatttttagctgacatgctatttttagctctaatgctatttttagctactatgctatttttagcttgcatgctatttttagctgtaggcgcgccatgcttcatcagactct

SEQ ID NO: 10761 - DNA, 197 bp, Artificial Sequence; identical to SEQ ID NO: 10760
  Synthetic polynucleotide

SEQ ID NO: 10762 - DNA, 197 bp, Artificial Sequence
  Synthetic polynucleotide
atcatctcaccttgcctcctgcaagtcagatttgagcccctgcagggctggtttgagctggagagctggtttgagctggtcggctggtttgagctgggacgctggtttgagctggctagctggtttgagctggactgctggtttgagctggtgcgctggtttgagctgggtaggcgcgccatgcttcatcagactct

SEQ ID NO: 10763 - DNA, 197 bp, Artificial Sequence; identical to SEQ ID NO: 10762
  Synthetic polynucleotide

SEQ ID NO: 10764 - DNA, 172 bp, Artificial Sequence
  Synthetic polynucleotide
atcatctcaccttgcctcctgcagcgacgtacccaaagcctgcaggtctaattaaaagatctaattaaatcgtctaattaaagactctaattaaactatctaattaaaacttctaattaaatgctctaattaaagtatctaattaaaggcgcgccatgcttcatcagactct

SEQ ID NO: 10765 - DNA, 172 bp, Artificial Sequence; identical to SEQ ID NO: 10764
  Synthetic polynucleotide

SEQ ID NO: 10766 - DNA, 148 bp, Artificial Sequence
  Synthetic polynucleotide
atcatctcaccttgcctcctgggaagtttagtgacagtcctgcaggaacaatgagaaacaatgtcgaacaatggacaacaatgctaaacaatgactaacaatgtgcaacaatggtaaacaatgggcgcgccatgcttcatcagactct

SEQ ID NO: 10767 - DNA, 148 bp, Artificial Sequence; identical to SEQ ID NO: 10766
  Synthetic polynucleotide

SEQ ID NO: 10768 - DNA, 197 bp, Artificial Sequence
  Synthetic polynucleotide
atcatctcaccttgcctcctgtcgggcaatgtgtacgacctgcaggagttaatcattaactagaagttaatcattaacttcgagttaatcattaactgacagttaatcattaactctaagttaatcattaactactagttaatcattaacttgcagttaatcattaactgtaggcgcgccatgcttcatcagactct

SEQ ID NO: 10769 - DNA, 197 bp, Artificial Sequence; identical to SEQ ID NO: 10768
  Synthetic polynucleotide

SEQ ID NO: 10770 - DNA, 196 bp, Artificial Sequence
  Synthetic polynucleotide
atcatctcaccttgcctcctgctgtgacggtaataatgcctgcaggcagccaatcagagagacagccaatcagagtcgcagccaatcagaggaccagccaatcagagctacagccaatcagagactcagccaatcagagtgccagccaatcagaggtacagccaatcagagggcgcgccatgcttcatcagactct

SEQ ID NO: 10771 - DNA, 196 bp, Artificial Sequence; identical to SEQ ID NO: 10770
  Synthetic polynucleotide

SEQ ID NO: 10772 - DNA, 188 bp, Artificial Sequence
  Synthetic polynucleotide
atcatctcaccttgcctcctgacgcatatctcgccatacctgcaggtgacctttgaccagatgacctttgacctcgtgacctttgaccgactgacctttgaccctatgacctttgaccacttgacctttgacctgctgacctttgaccgtatgacctttgaccggcgcgccatgcttcatcagactct

SEQ ID NO: 10773 - DNA, 188 bp, Artificial Sequence; identical to SEQ ID NO: 10772
  Synthetic polynucleotide

SEQ ID NO: 10774 - DNA, 188 bp, Artificial Sequence
  Synthetic polynucleotide
atcatctcaccttgcctcctgggaatacttccactgggcctgcaggttctgattggtcagattctgattggtctcgttctgattggtcgacttctgattggtcctattctgattggtcactttctgattggtctgcttctgattggtcgtattctgattggtcggcgcgccatgcttcatcagactct

SEQ ID NO: 10775 - DNA, 188 bp, Artificial Sequence; identical to SEQ ID NO: 10774
  Synthetic polynucleotide

SEQ ID NO: 10776 - DNA, 197 bp, Artificial Sequence
  Synthetic polynucleotide
atcatctcaccttgcctcctgaataacctgatgctcgccctgcagggcaggagggtatggcagagcaggagggtatggctcggcaggagggtatggcgacgcaggagggtatggcctagcaggagggtatggcactgcaggagggtatggctgcgcaggagggtatggcgtaggcgcgccatgcttcatcagactct

SEQ ID NO: 10777 - DNA, 197 bp, Artificial Sequence; identical to SEQ ID NO: 10776
  Synthetic polynucleotide

SEQ ID NO: 10778 - DNA, 180 bp, Artificial Sequence
  Synthetic polynucleotide
atcatctcaccttgcctcctgagcattcgacgtggtcgcctgcaggtaattagctaaagataattagctaatcgtaattagctaagactaattagctaactataattagctaaacttaattagctaatgctaattagctaagtataattagctaaggcgcgccatgcttcatcagactct

SEQ ID NO: 10779 - DNA, 180 bp, Artificial Sequence; identical to SEQ ID NO: 10778
  Synthetic polynucleotide

SEQ ID NO: 10780 - DNA, 191 bp, Artificial Sequence
  Synthetic polynucleotide
atcatctcaccttgcctcctgcatacgtgcaaagacgccctgcaggacaagcaattaatgaatagaacaagcaattaatgaattcgacaagcaattaatgaatgacacaagcaattaatgaatctaacaagcaattaatgaatactacaagcaattaatgaattgcggcgcgccatgcttcatcagactct

SEQ ID NO: 10781 - DNA, 191 bp, Artificial Sequence; identical to SEQ ID NO: 10780
  Synthetic polynucleotide

SEQ ID NO: 10782 - DNA, 156 bp, Artificial Sequence
  Synthetic polynucleotide
atcatctcaccttgcctcctgatccacccaacacaaggcctgcaggctgaccccagactgacccctcgctgaccccgacctgaccccctactgaccccactctgacccctgcctgaccccgtactgaccccggcgcgccatgcttcatcagactct

SEQ ID NO: 10783 - DNA, 156 bp, Artificial Sequence; identical to SEQ ID NO: 10782
  Synthetic polynucleotide

SEQ ID NO: 10784 - DNA, 197 bp, Artificial Sequence
  Synthetic polynucleotide
atcatctcaccttgcctcctgcgtcgtagttagttagtcctgcaggcggcggcggcgcctgagacggcggcggcgcctgtcgcggcggcggcgcctggaccggcggcggcgcctgctacggcggcggcgcctgactcggcggcggcgcctgtgccggcggcggcgcctggtaggcgcgccatgcttcatcagactct

SEQ ID NO: 10785 - DNA, 197 bp, Artificial Sequence; identical to SEQ ID NO: 10784
  Synthetic polynucleotide

SEQ ID NO: 10786 - DNA, 198 bp, Artificial Sequence
  Synthetic polynucleotide
atcatctcaccttgcctcctggatgaatatctcgtgaccctgcaggcccggagggcttcctggaggaggagacccggagggcttcctggaggaggtcgcccggagggcttcctggaggagggaccccggagggcttcctggaggaggctacccggagggcttcctggaggaggggcgcgccatgcttcatcagactct

SEQ ID NO: 10787 - DNA, 198 bp, Artificial Sequence; identical to SEQ ID NO: 10786
  Synthetic polynucleotide

SEQ ID NO: 10788 - DNA, 196 bp, Artificial Sequence
  Synthetic polynucleotide
atcatctcaccttgcctcctgctagtcttattgttcggcctgcaggaccccaaaccacccccccccccagaaccccaaaccaccccccccccctcgaccccaaaccacccccccccccgacaccccaaaccacccccccccccctaaccccaaaccacccccccccccactggcgcgccatgcttcatcagactct

SEQ ID NO: 10789 - DNA, 196 bp, Artificial Sequence; identical to SEQ ID NO: 10788
  Synthetic polynucleotide

SEQ ID NO: 10790 - DNA, 191 bp, Artificial Sequence
  Synthetic polynucleotide
atcatctcaccttgcctcctggtggaaacgtgcgccttcctgcaggtgcactaattagtggaaagatgcactaattagtggaatcgtgcactaattagtggaagactgcactaattagtggaactatgcactaattagtggaaacttgcactaattagtggaatgcggcgcgccatgcttcatcagactct

SEQ ID NO: 10791 - DNA, 191 bp, Artificial Sequence; identical to SEQ ID NO: 10790
  Synthetic polynucleotide

SEQ ID NO: 10792 - DNA, 156 bp, Artificial Sequence
  Synthetic polynucleotide
atcatctcaccttgcctcctgggcactgactcttagctcctgcaggattacaagagaattacaagtcgattacaaggacattacaagctaattacaagactattacaagtgcattacaaggtaattacaagggcgcgccatgcttcatcagactct

SEQ ID NO: 10793 - DNA, 156 bp, Artificial Sequence; identical to SEQ ID NO: 10792
  Synthetic polynucleotide

SEQ ID NO: 10794 - DNA, 164 bp, Artificial Sequence
  Synthetic polynucleotide
atcatctcaccttgcctcctgaggcctgttcagcatgacctgcagggtcgtaaaaagagtcgtaaaatcggtcgtaaaagacgtcgtaaaactagtcgtaaaaactgtcgtaaaatgcgtcgtaaaagtagtcgtaaaaggcgcgccatgcttcatcagactct

SEQ ID NO: 10795 - DNA, 164 bp, Artificial Sequence; identical to SEQ ID NO: 10794
  Synthetic polynucleotide

SEQ ID NO: 10796 - DNA, 190 bp, Artificial Sequence
  Synthetic polynucleotide
atcatctcaccttgcctcctgttgtacaaatgcctcatcctgcagggatgacgtggcattagagatgacgtggcatttcggatgacgtggcattgacgatgacgtggcattctagatgacgtggcattactgatgacgtggcatttgcgatgacgtggcattgtaggcgcgccatgcttcatcagactct

SEQ ID NO: 10797 - DNA, 190 bp, Artificial Sequence; identical to SEQ ID NO: 10796
  Synthetic polynucleotide

SEQ ID NO: 10798 - DNA, 188 bp, Artificial Sequence
  Synthetic polynucleotide
atcatctcaccttgcctcctgtggcctgggaatacgagcctgcaggaaaatgctgactagaaaaatgctgacttcgaaaatgctgactgacaaaatgctgactctaaaaatgctgactactaaaatgctgacttgcaaaatgctgactgtaaaaatgctgactggcgcgccatgcttcatcagactct

SEQ ID NO: 10799 - DNA, 188 bp, Artificial Sequence; identical to SEQ ID NO: 10798
  Synthetic polynucleotide

SEQ ID NO: 10800 - DNA, 156 bp, Artificial Sequence
  Synthetic polynucleotide
atcatctcaccttgcctcctggtattccgcaactgccgcctgcaggcagctggcagacagctggctcgcagctggcgaccagctggcctacagctggcactcagctggctgccagctggcgtacagctggcggcgcgccatgcttcatcagactct

SEQ ID NO: 10801 - DNA, 156 bp, Artificial Sequence; identical to SEQ ID NO: 10800
  Synthetic polynucleotide

SEQ ID NO: 10802 - DNA, 191 bp, Artificial Sequence
  Synthetic polynucleotide
atcatctcaccttgcctcctgtctcatgcgcttcggaccctgcagggccaccctctggtggccagagccaccctctggtggcctcggccaccctctggtggccgacgccaccctctggtggccctagccaccctctggtggccactgccaccctctggtggcctgcggcgcgccatgcttcatcagactct

SEQ ID NO: 10803 - DNA, 191 bp, Artificial Sequence; identical to SEQ ID NO: 10802
  Synthetic polynucleotide

SEQ ID NO: 10804 - DNA, 156 bp, Artificial Sequence
  Synthetic polynucleotide
atcatctcaccttgcctcctgcatcagtcttcaattagcctgcaggagaggtcaagaagaggtcatcgagaggtcagacagaggtcactaagaggtcaactagaggtcatgcagaggtcagtaagaggtcaggcgcgccatgcttcatcagactct

SEQ ID NO: 10805 - DNA, 156 bp, Artificial Sequence; identical to SEQ ID NO: 10804
  Synthetic polynucleotide

SEQ ID NO: 10806 - DNA, 164 bp, Artificial Sequence
  Synthetic polynucleotide
atcatctcaccttgcctcctgtcagtgtgtagtgacagcctgcaggcaactgccaagacaactgccatcgcaactgccagaccaactgccactacaactgccaactcaactgccatgccaactgccagtacaactgccaggcgcgccatgcttcatcagactct

SEQ ID NO: 10807 - DNA, 164 bp, Artificial Sequence; identical to SEQ ID NO: 10806
  Synthetic polynucleotide

SEQ ID NO: 10808 - DNA, 191 bp, Artificial Sequence
  Synthetic polynucleotide
atcatctcaccttgcctcctgtcagctataccgagtcacctgcaggaggacgctgtaaagggaagaaggacgctgtaaagggatcgaggacgctgtaaagggagacaggacgctgtaaagggactaaggacgctgtaaagggaactaggacgctgtaaagggatgcggcgcgccatgcttcatcagactct

SEQ ID NO: 10809 - DNA, 191 bp, Artificial Sequence; identical to SEQ ID NO: 10808
  Synthetic polynucleotide

SEQ ID NO: 10810 - DNA, 164 bp, Artificial Sequence
  Synthetic polynucleotide
atcatctcaccttgcctcctgtttatcaatctttcccgcctgcagggaaaaaatcagagaaaaaatctcggaaaaaatcgacgaaaaaatcctagaaaaaatcactgaaaaaatctgcgaaaaaatcgtagaaaaaatcggcgcgccatgcttcatcagactct

SEQ ID NO: 10811 - DNA, 164 bp, Artificial Sequence; identical to SEQ ID NO: 10810
  Synthetic polynucleotide

SEQ ID NO: 10812 - DNA, 197 bp, Artificial Sequence
  Synthetic polynucleotide
atcatctcaccttgcctcctgcacgagtcggtagtatccctgcagggggagggggcggggcagagggagggggcggggctcggggagggggcggggcgacgggagggggcggggcctagggagggggcggggcactgggagggggcggggctgcgggagggggcggggcgtaggcgcgccatgcttcatcagactct

SEQ ID NO: 10813 - DNA, 197 bp, Artificial Sequence; identical to SEQ ID NO: 10812
  Synthetic polynucleotide

SEQ ID NO: 10814 - DNA, 164 bp, Artificial Sequence
  Synthetic polynucleotide
atcatctcaccttgcctcctgttaccggcgatagtgctcctgcaggagtccatctagaagtccatcttcgagtccatctgacagtccatctctaagtccatctactagtccatcttgcagtccatctgtaagtccatctggcgcgccatgcttcatcagactct

SEQ ID NO: 10815 - DNA, 164 bp, Artificial Sequence; identical to SEQ ID NO: 10814
  Synthetic polynucleotide

SEQ ID NO: 10816 - DNA, 200 bp, Artificial Sequence
  Synthetic polynucleotide
atcatctcaccttgcctcctgaggttcgttatggcgggcctgcaggtgaccttgaaatgaccttgagatgaccttgaaatgaccttgtcgtgaccttgaaatgaccttggactgaccttgaaatgaccttgctatgaccttgaaatgaccttgacttgaccttgaaatgaccttgggcgcgccatgcttcatcagactct

SEQ ID NO: 10817 - DNA, 200 bp, Artificial Sequence; identical to SEQ ID NO: 10816
  Synthetic polynucleotide

SEQ ID NO: 10818 - DNA, 132 bp, Artificial Sequence
  Synthetic polynucleotide
atcatctcaccttgcctcctgactactgtagtggccaccctgcaggttggtagattggttcgttggtgacttggtctattggtactttggttgcttggtgtattggtggcgcgccatgcttcatcagactct

SEQ ID NO: 10819 - DNA, 132 bp, Artificial Sequence; identical to SEQ ID NO: 10818
  Synthetic polynucleotide

SEQ ID NO: 10820 - DNA, 196 bp, Artificial Sequence
  Synthetic polynucleotide
atcatctcaccttgcctcctgaggatgcgaagtatttacctgcaggcacttccggttccagacacttccggttcctcgcacttccggttccgaccacttccggttccctacacttccggttccactcacttccggttcctgccacttccggttccgtacacttccggttccggcgcgccatgcttcatcagactct

SEQ ID NO: 10821 - DNA, 196 bp, Artificial Sequence; identical to SEQ ID NO: 10820
  Synthetic polynucleotide

SEQ ID NO: 10822 - DNA, 191 bp, Artificial Sequence
  Synthetic polynucleotide
atcatctcaccttgcctcctgtataacggtccatacgtcctgcaggtaatcggtatttaattgagataatcggtatttaattgtcgtaatcggtatttaattggactaatcggtatttaattgctataatcggtatttaattgacttaatcggtatttaattgtgcggcgcgccatgcttcatcagactct

SEQ ID NO: 10823 - DNA, 191 bp, Artificial Sequence; identical to SEQ ID NO: 10822
  Synthetic polynucleotide

SEQ ID NO: 10824 - DNA, 164 bp, Artificial Sequence
  Synthetic polynucleotide
atcatctcaccttgcctcctgtcgacattcgaaacggacctgcagggggggcgggagagggggcgggtcggggggcggggacgggggcgggctagggggcgggactgggggcgggtgcgggggcggggtagggggcgggggcgcgccatgcttcatcagactct

SEQ ID NO: 10825 - DNA, 164 bp, Artificial Sequence; identical to SEQ ID NO: 10824
  Synthetic polynucleotide

SEQ ID NO: 10826 - DNA, 190 bp, Artificial Sequence
  Synthetic polynucleotide
atcatctcaccttgcctcctgattaagtcgcgaattggcctgcaggttatgtactaataaagattatgtactaataatcgttatgtactaataagacttatgtactaataactattatgtactaataaactttatgtactaataatgcttatgtactaataagtaggcgcgccatgcttcatcagactct

SEQ ID NO: 10827 - DNA, 190 bp, Artificial Sequence; identical to SEQ ID NO: 10826
  Synthetic polynucleotide

SEQ ID NO: 10828 - DNA, 188 bp, Artificial Sequence
  Synthetic polynucleotide
atcatctcaccttgcctcctggttacgaataagccgaccctgcaggggaccacccaggagaggaccacccaggtcgggaccacccagggacggaccacccaggctaggaccacccaggactggaccacccaggtgcggaccacccagggtaggaccacccaggggcgcgccatgcttcatcagactct

SEQ ID NO: 10829 - DNA, 188 bp, Artificial Sequence; identical to SEQ ID NO: 10828
  Synthetic polynucleotide

SEQ ID NO: 10830 - DNA, 185 bp, Artificial Sequence
  Synthetic polynucleotide
atcatctcaccttgcctcctgtaatgccgccttacacccctgcaggactatgaatgaatgatagaactatgaatgaatgattcgactatgaatgaatgatgacactatgaatgaatgatctaactatgaatgaatgatactactatgaatgaatgattgcggcgcgccatgcttcatcagactct

SEQ ID NO: 10831 - DNA, 185 bp, Artificial Sequence; identical to SEQ ID NO: 10830
  Synthetic polynucleotide

SEQ ID NO: 10832 - DNA, 197 bp, Artificial Sequence
  Synthetic polynucleotide
atcatctcaccttgcctcctgttacgcatagtattgagcctgcaggaatgcaattttttgaagaaatgcaattttttgatcgaatgcaattttttgagacaatgcaattttttgactaaatgcaattttttgaactaatgcaattttttgatgcaatgcaattttttgagtaggcgcgccatgcttcatcagactct

SEQ ID NO: 10833 - DNA, 197 bp, Artificial Sequence; identical to SEQ ID NO: 10832
  Synthetic polynucleotide

SEQ ID NO: 10834 - DNA, 164 bp, Artificial Sequence
  Synthetic polynucleotide
atcatctcaccttgcctcctgggagtgaagtatgctcacctgcagggggggcggaagagggggcggatcggggggcggagacgggggcggactagggggcggaactgggggcggatgcgggggcggagtagggggcggaggcgcgccatgcttcatcagactct

SEQ ID NO: 10835 - DNA, 164 bp, Artificial Sequence; identical to SEQ ID NO: 10834
  Synthetic polynucleotide

SEQ ID NO: 10836 - DNA, 156 bp, Artificial Sequence
  Synthetic polynucleotide
atcatctcaccttgcctcctgcaattccggttccgcaacctgcaggtcattagcagatcattagctcgtcattagcgactcattagcctatcattagcacttcattagctgctcattagcgtatcattagcggcgcgccatgcttcatcagactct

SEQ ID NO: 10837 - DNA, 156 bp, Artificial Sequence; identical to SEQ ID NO: 10836
  Synthetic polynucleotide

SEQ ID NO: 10838 - DNA, 185 bp, Artificial Sequence
  Synthetic polynucleotide
atcatctcaccttgcctcctgttgagtgctgcgtgaggcctgcaggacgttttacgactttaagaacgttttacgactttatcgacgttttacgactttagacacgttttacgactttactaacgttttacgactttaactacgttttacgactttatgcggcgcgccatgcttcatcagactct

SEQ ID NO: 10839 - DNA, 185 bp, Artificial Sequence; identical to SEQ ID NO: 10838
  Synthetic polynucleotide

SEQ ID NO: 10840 - DNA, 172 bp, Artificial Sequence
  Synthetic polynucleotide
atcatctcaccttgcctcctgggattctccatttatcccctgcaggccctatcacgagaccctatcacgtcgccctatcacggacccctatcacgctaccctatcacgactccctatcacgtgcccctatcacggtaccctatcacgggcgcgccatgcttcatcagactct

SEQ ID NO: 10841 - DNA, 172 bp, Artificial Sequence; identical to SEQ ID NO: 10840
  Synthetic polynucleotide

SEQ ID NO: 10842 - DNA, 172 bp, Artificial Sequence
  Synthetic polynucleotide
atcatctcaccttgcctcctgggatcataggaacagagcctgcaggtgggattaaaagatgggattaaatcgtgggattaaagactgggattaaactatgggattaaaacttgggattaaatgctgggattaaagtatgggattaaaggcgcgccatgcttcatcagactct

SEQ ID NO: 10843 - DNA, 172 bp, Artificial Sequence; identical to SEQ ID NO: 10842
  Synthetic polynucleotide

SEQ ID NO: 10844 - DNA, 196 bp, Artificial Sequence
  Synthetic polynucleotide
atcatctcaccttgcctcctgtaaatgccttcgttcgacctgcaggtttttagagataagaaataaagagatttttagagataagaaataaagtcgtttttagagataagaaataaaggactttttagagataagaaataaagctatttttagagataagaaataaagactggcgcgccatgcttcatcagactct

SEQ ID NO: 10845 - DNA, 196 bp, Artificial Sequence; identical to SEQ ID NO: 10844
  Synthetic polynucleotide

SEQ ID NO: 10846 - DNA, 180 bp, Artificial Sequence
  Synthetic polynucleotide
atcatctcaccttgcctcctgagtatgtcgtgtttggacctgcaggataaggaaaaaagaataaggaaaaatcgataaggaaaaagacataaggaaaaactaataaggaaaaaactataaggaaaaatgcataaggaaaaagtaataaggaaaaaggcgcgccatgcttcatcagactct

SEQ ID NO: 10847 - DNA, 180 bp, Artificial Sequence; identical to SEQ ID NO: 10846
  Synthetic polynucleotide

SEQ ID NO: 10848 - DNA, 188 bp, Artificial Sequence
  Synthetic polynucleotide
atcatctcaccttgcctcctgctttctacgttggctaccctgcagggtcagcaattttagagtcagcaatttttcggtcagcaattttgacgtcagcaattttctagtcagcaattttactgtcagcaatttttgcgtcagcaattttgtagtcagcaattttggcgcgccatgcttcatcagactct

SEQ ID NO: 10849 - DNA, 188 bp, Artificial Sequence; identical to SEQ ID NO: 10848
  Synthetic polynucleotide

SEQ ID NO: 10850 - DNA, 185 bp, Artificial Sequence
  Synthetic polynucleotide
atcatctcaccttgcctcctgtacacacttgtcccgatcctgcaggatcttgtttatgtataagaatcttgtttatgtatatcgatcttgtttatgtatagacatcttgtttatgtatactaatcttgtttatgtataactatcttgtttatgtatatgcggcgcgccatgcttcatcagactct

SEQ ID NO: 10851 - DNA, 185 bp, Artificial Sequence; identical to SEQ ID NO: 10850
  Synthetic polynucleotide

SEQ ID NO: 10852 - DNA, 196 bp, Artificial Sequence
  Synthetic polynucleotide
atcatctcaccttgcctcctggtatcagcaatgttcggcctgcaggctcatttgcatatagactcatttgcatattcgctcatttgcatatgacctcatttgcatatctactcatttgcatatactctcatttgcatattgcctcatttgcatatgtactcatttgcatatggcgcgccatgcttcatcagactct

SEQ ID NO: 10853 - DNA, 196 bp, Artificial Sequence; identical to SEQ ID NO: 10852
  Synthetic polynucleotide

SEQ ID NO: 10854 - DNA, 180 bp, Artificial Sequence
  Synthetic polynucleotide
atcatctcaccttgcctcctgggtaactatcaggtaggcctgcaggtaatttaattaagataatttaattatcgtaatttaattagactaatttaattactataatttaattaacttaatttaattatgctaatttaattagtataatttaattaggcgcgccatgcttcatcagactct

SEQ ID NO: 10855 - DNA, 180 bp, Artificial Sequence; identical to SEQ ID NO: 10854
  Synthetic polynucleotide

SEQ ID NO: 10856 - DNA, 190 bp, Artificial Sequence
  Synthetic polynucleotide
atcatctcaccttgcctcctgtatcaccacagtagggacctgcaggttgaggtaattagtagattgaggtaattagttcgttgaggtaattagtgacttgaggtaattagtctattgaggtaattagtactttgaggtaattagttgcttgaggtaattagtgtaggcgcgccatgcttcatcagactct

SEQ ID NO: 10857 - DNA, 190 bp, Artificial Sequence; identical to SEQ ID NO: 10856
  Synthetic polynucleotide

SEQ ID NO: 10858 - DNA, 164 bp, Artificial Sequence
  Synthetic polynucleotide
atcatctcaccttgcctcctgcgtattccaggtttatccctgcaggaattcaaatagaaattcaaattcgaattcaaatgacaattcaaatctaaattcaaatactaattcaaattgcaattcaaatgtaaattcaaatggcgcgccatgcttcatcagactct

SEQ ID NO: 10859 - DNA, 164 bp, Artificial Sequence; identical to SEQ ID NO: 10858
  Synthetic polynucleotide

SEQ ID NO: 10860 - DNA, 185 bp, Artificial Sequence
  Synthetic polynucleotide
atcatctcaccttgcctcctggggcatctgagacaccacctgcagggacctcattaataactagagacctcattaataacttcggacctcattaataactgacgacctcattaataactctagacctcattaataactactgacctcattaataacttgcggcgcgccatgcttcatcagactct

SEQ ID NO: 10861 - DNA, 185 bp, Artificial Sequence; identical to SEQ ID NO: 10860
  Synthetic polynucleotide

SEQ ID NO: 10862 - DNA, 156 bp, Artificial Sequence
  Synthetic polynucleotide
atcatctcaccttgcctcctgctagttatcccagatagcctgcaggtgacccctagatgaccccttcgtgacccctgactgacccctctatgacccctacttgaccccttgctgacccctgtatgacccctggcgcgccatgcttcatcagactct

SEQ ID NO: 10863 - DNA, 156 bp, Artificial Sequence; identical to SEQ ID NO: 10862
  Synthetic polynucleotide

SEQ ID NO: 10864 - DNA, 164 bp, Artificial Sequence
  Synthetic polynucleotide
atcatctcaccttgcctcctgccatcgaacaaagatggcctgcaggatgcccaccagaatgcccacctcgatgcccaccgacatgcccaccctaatgcccaccactatgcccacctgcatgcccaccgtaatgcccaccggcgcgccatgcttcatcagactct

SEQ ID NO: 10865 - DNA, 164 bp, Artificial Sequence; identical to SEQ ID NO: 10864
  Synthetic polynucleotide

SEQ ID NO: 10866 - DNA, 156 bp, Artificial Sequence
  Synthetic polynucleotide
atcatctcaccttgcctcctgtgtcaccaacgataggccctgcaggcacgcggtagacacgcggttcgcacgcggtgaccacgcggtctacacgcggtactcacgcggttgccacgcggtgtacacgcggtggcgcgccatgcttcatcagactct

SEQ ID NO: 10867 - DNA, 156 bp, Artificial Sequence; identical to SEQ ID NO: 10866
  Synthetic polynucleotide

SEQ ID NO: 10868 - DNA, 185 bp, Artificial Sequence
  Synthetic polynucleotide
atcatctcaccttgcctcctggagctgtttgataggagcctgcaggtaattttattaccttaagataattttattaccttatcgtaattttattaccttagactaattttattaccttactataattttattaccttaacttaattttattaccttatgcggcgcgccatgcttcatcagactct

SEQ ID NO: 10869 - DNA, 185 bp, Artificial Sequence; identical to SEQ ID NO: 10868
  Synthetic polynucleotide

SEQ ID NO: 10870 - DNA, 172 bp, Artificial Sequence
  Synthetic polynucleotide
atcatctcaccttgcctcctggaatcatcgcctaggaacctgcaggttcaaggccaagattcaaggccatcgttcaaggccagacttcaaggccactattcaaggccaactttcaaggccatgcttcaaggccagtattcaaggccaggcgcgccatgcttcatcagactct

SEQ ID NO: 10871 - DNA, 172 bp, Artificial Sequence; identical to SEQ ID NO: 10870
  Synthetic polynucleotide

SEQ ID NO: 10872 - DNA, 180 bp, Artificial Sequence
  Synthetic polynucleotide
atcatctcaccttgcctcctgtctgtcacctgcgagcacctgcagggacagctgcagagagacagctgcagtcggacagctgcaggacgacagctgcagctagacagctgcagactgacagctgcagtgcgacagctgcaggtagacagctgcagggcgcgccatgcttcatcagactct

SEQ ID NO: 10873 - DNA, 180 bp, Artificial Sequence; identical to SEQ ID NO: 10872
  Synthetic polynucleotide

SEQ ID NO: 10874 - DNA, 148 bp, Artificial Sequence
  Synthetic polynucleotide
atcatctcaccttgcctcctgtggtctaagatgcctagcctgcaggtattaatagatattaattcgtattaatgactattaatctatattaatacttattaattgctattaatgtatattaatggcgcgccatgcttcatcagactct

SEQ ID NO: 10875 - DNA, 148 bp, Artificial Sequence; identical to SEQ ID NO: 10874
  Synthetic polynucleotide

SEQ ID NO: 10876 - DNA, 156 bp, Artificial Sequence
  Synthetic polynucleotide
atcatctcaccttgcctcctgcggtggtggacttaaatcctgcaggttttgattagattttgatttcgttttgattgacttttgattctattttgattactttttgatttgcttttgattgtattttgattggcgcgccatgcttcatcagactct

SEQ ID NO: 10877 - DNA, 156 bp, Artificial Sequence; identical to SEQ ID NO: 10876
  Synthetic polynucleotide

SEQ ID NO: 10878 - DNA, 190 bp, Artificial Sequence
  Synthetic polynucleotide
atcatctcaccttgcctcctgccttcacggtgacgctacctgcagggaggggacagggagagagaggggacagggagtcggaggggacagggaggacgaggggacagggagctagaggggacagggagactgaggggacagggagtgcgaggggacagggaggtaggcgcgccatgcttcatcagactct

SEQ ID NO: 10879 - DNA, 190 bp, Artificial Sequence; identical to SEQ ID NO: 10878
  Synthetic polynucleotide

SEQ ID NO: 10880 - DNA, 185 bp, Artificial Sequence
  Synthetic polynucleotide
atcatctcaccttgcctcctgccgtgagtgaggtgtaccctgcaggcgaattttattgggttagacgaattttattgggtttcgcgaattttattgggttgaccgaattttattgggttctacgaattttattgggttactcgaattttattgggtttgcggcgcgccatgcttcatcagactct

SEQ ID NO: 10881 - DNA, 185 bp, Artificial Sequence; identical to SEQ ID NO: 10880
  Synthetic polynucleotide

SEQ ID NO: 10882 - DNA, 180 bp, Artificial Sequence
  Synthetic polynucleotide
atcatctcaccttgcctcctgctaaccgcatagactatcctgcagggtggtcacggtagagtggtcacggttcggtggtcacggtgacgtggtcacggtctagtggtcacggtactgtggtcacggttgcgtggtcacggtgtagtggtcacggtggcgcgccatgcttcatcagactct

SEQ ID NO: 10883 - DNA, 180 bp, Artificial Sequence; identical to SEQ ID NO: 10882
  Synthetic polynucleotide

SEQ ID NO: 10884 - DNA, 164 bp, Artificial Sequence
  Synthetic polynucleotide
atcatctcaccttgcctcctgacgcagggcataccttccctgcaggaatcgataaagaaatcgataatcgaatcgataagacaatcgataactaaatcgataaactaatcgataatgcaatcgataagtaaatcgataaggcgcgccatgcttcatcagactct

SEQ ID NO: 10885 - DNA, 164 bp, Artificial Sequence; identical to SEQ ID NO: 10884
  Synthetic polynucleotide

SEQ ID NO: 10886 - DNA, 156 bp, Artificial Sequence
  Synthetic polynucleotide
atcatctcaccttgcctcctgagattgcagtcatgcgtcctgcaggacaactccagaacaactcctcgacaactccgacacaactccctaacaactccactacaactcctgcacaactccgtaacaactccggcgcgccatgcttcatcagactct

SEQ ID NO: 10887 - DNA, 156 bp, Artificial Sequence; identical to SEQ ID NO: 10886
  Synthetic polynucleotide

SEQ ID NO: 10888 - DNA, 190 bp, Artificial Sequence
  Synthetic polynucleotide
atcatctcaccttgcctcctgacgcggtgttgagataacctgcaggatgccctagggcaaagaatgccctagggcaatcgatgccctagggcaagacatgccctagggcaactaatgccctagggcaaactatgccctagggcaatgcatgccctagggcaagtaggcgcgccatgcttcatcagactct

SEQ ID NO: 10889 - DNA, 190 bp, Artificial Sequence; identical to SEQ ID NO: 10888
  Synthetic polynucleotide

SEQ ID NO: 10890 - DNA, 185 bp, Artificial Sequence
  Synthetic polynucleotide
atcatctcaccttgcctcctgtggccgttatgtacgcgcctgcaggcgttgccatggtaacgagacgttgccatggtaacgtcgcgttgccatggtaacggaccgttgccatggtaacgctacgttgccatggtaacgactcgttgccatggtaacgtgcggcgcgccatgcttcatcagactct

SEQ ID NO: 10891 - DNA, 185 bp, Artificial Sequence; identical to SEQ ID NO: 10890
  Synthetic polynucleotide

SEQ ID NO: 10892 - DNA, 172 bp, Artificial Sequence
  Synthetic polynucleotide
atcatctcaccttgcctcctgtatcggtatctggacctcctgcaggccacctgggtagaccacctgggttcgccacctgggtgacccacctgggtctaccacctgggtactccacctgggttgcccacctgggtgtaccacctgggtggcgcgccatgcttcatcagactct

SEQ ID NO: 10893 - DNA, 172 bp, Artificial Sequence; identical to SEQ ID NO: 10892
  Synthetic polynucleotide

SEQ ID NO: 10894 - DNA, 197 bp, Artificial Sequence
  Synthetic polynucleotide
atcatctcaccttgcctcctggtgcaatagatcatacccctgcaggagaacaccctgtaccagaagaacaccctgtacctcgagaacaccctgtaccgacagaacaccctgtaccctaagaacaccctgtaccactagaacaccctgtacctgcagaacaccctgtaccgtaggcgcgccatgcttcatcagactct

SEQ ID NO: 10895 - DNA, 197 bp, Artificial Sequence; identical to SEQ ID NO: 10894
  Synthetic polynucleotide

SEQ ID NO: 10896 - DNA, 172 bp, Artificial Sequence
  Synthetic polynucleotide
atcatctcaccttgcctcctgaatcgactctgtcgacgcctgcaggttgattaatgagattgattaatgtcgttgattaatggacttgattaatgctattgattaatgactttgattaatgtgcttgattaatggtattgattaatgggcgcgccatgcttcatcagactct

SEQ ID NO: 10897 - DNA, 172 bp, Artificial Sequence; identical to SEQ ID NO: 10896
  Synthetic polynucleotide

SEQ ID NO: 10898 - DNA, 188 bp, Artificial Sequence
  Synthetic polynucleotide
atcatctcaccttgcctcctgatgtaaagagtgtcgctcctgcaggcaaaatggcggcagacaaaatggcggctcgcaaaatggcggcgaccaaaatggcggcctacaaaatggcggcactcaaaatggcggctgccaaaatggcggcgtacaaaatggcggcggcgcgccatgcttcatcagactct

SEQ ID NO: 10899 - DNA, 188 bp, Artificial Sequence; identical to SEQ ID NO: 10898
  Synthetic polynucleotide

SEQ ID NO: 10900 - DNA, 180 bp, Artificial Sequence
  Synthetic polynucleotide
atcatctcaccttgcctcctgtctgtgctaaacacttacctgcaggccttcccgcccagaccttcccgccctcgccttcccgcccgacccttcccgcccctaccttcccgcccactccttcccgccctgcccttcccgcccgtaccttcccgcccggcgcgccatgcttcatcagactct

SEQ ID NO: 10901 - DNA, 180 bp, Artificial Sequence; identical to SEQ ID NO: 10900
  Synthetic polynucleotide

SEQ ID NO: 10902 - DNA, 197 bp, Artificial Sequence
  Synthetic polynucleotide
atcatctcaccttgcctcctgtgccaacgtacggatgtcctgcaggctttaatcccttaacagactttaatcccttaactcgctttaatcccttaacgacctttaatcccttaacctactttaatcccttaacactctttaatcccttaactgcctttaatcccttaacgtaggcgcgccatgcttcatcagactct

SEQ ID NO: 10903 - DNA, 197 bp, Artificial Sequence; identical to SEQ ID NO: 10902
  Synthetic polynucleotide

SEQ ID NO: 10904 - DNA, 190 bp, Artificial Sequence
  Synthetic polynucleotide
atcatctcaccttgcctcctggccttacgactaatgtccctgcaggtttgattgatgcccagatttgattgatgccctcgtttgattgatgcccgactttgattgatgcccctatttgattgatgcccacttttgattgatgccctgctttgattgatgcccgtaggcgcgccatgcttcatcagactct

SEQ ID NO: 10905 - DNA, 190 bp, Artificial Sequence; identical to SEQ ID NO: 10904
  Synthetic polynucleotide

SEQ ID NO: 10906 - DNA, 196 bp, Artificial Sequence
  Synthetic polynucleotide
atcatctcaccttgcctcctgtctggcccggtatctagcctgcaggctcatttgcatacagactcatttgcatactcgctcatttgcatacgacctcatttgcatacctactcatttgcatacactctcatttgcatactgcctcatttgcatacgtactcatttgcatacggcgcgccatgcttcatcagactct

SEQ ID NO: 10907 - DNA, 196 bp, Artificial Sequence; identical to SEQ ID NO: 10906
  Synthetic polynucleotide

SEQ ID NO: 10908 - DNA, 188 bp, Artificial Sequence
  Synthetic polynucleotide
atcatctcaccttgcctcctggtcaccgtcacatataacctgcaggccgctcagccgcagaccgctcagccgctcgccgctcagccgcgacccgctcagccgcctaccgctcagccgcactccgctcagccgctgcccgctcagccgcgtaccgctcagccgcggcgcgccatgcttcatcagactct

SEQ ID NO: 10909 - DNA, 188 bp, Artificial Sequence; identical to SEQ ID NO: 10908
  Synthetic polynucleotide

SEQ ID NO: 10910 - DNA, 197 bp, Artificial Sequence
  Synthetic polynucleotide
atcatctcaccttgcctcctgcgcttagatagcaaggacctgcagggtgactgttactataagagtgactgttactatatcggtgactgttactatagacgtgactgttactatactagtgactgttactataactgtgactgttactatatgcgtgactgttactatagtaggcgcgccatgcttcatcagactct

SEQ ID NO: 10911 - DNA, 197 bp, Artificial Sequence; identical to SEQ ID NO: 10910
  Synthetic polynucleotide

SEQ ID NO: 10912 - DNA, 197 bp, Artificial Sequence
  Synthetic polynucleotide
atcatctcaccttgcctcctgcgacgacgatcgggaatcctgcaggtgaactcgttgacccagatgaactcgttgaccctcgtgaactcgttgacccgactgaactcgttgacccctatgaactcgttgacccacttgaactcgttgaccctgctgaactcgttgacccgtaggcgcgccatgcttcatcagactct

SEQ ID NO: 10913 - DNA, 197 bp, Artificial Sequence; identical to SEQ ID NO: 10912
  Synthetic polynucleotide

SEQ ID NO: 10914 - DNA, 180 bp, Artificial Sequence
  Synthetic polynucleotide
atcatctcaccttgcctcctggtagacattcggagttccctgcagggtacccgcatgagagtacccgcatgtcggtacccgcatggacgtacccgcatgctagtacccgcatgactgtacccgcatgtgcgtacccgcatggtagtacccgcatgggcgcgccatgcttcatcagactct

SEQ ID NO: 10915 - DNA, 180 bp, Artificial Sequence; identical to SEQ ID NO: 10914
  Synthetic polynucleotide

SEQ ID NO: 10916 - DNA, 156 bp, Artificial Sequence
  Synthetic polynucleotide
atcatctcaccttgcctcctgttccttccgatttgattcctgcaggtttatggcagatttatggctcgtttatggcgactttatggcctatttatggcacttttatggctgctttatggcgtatttatggcggcgcgccatgcttcatcagactct

SEQ ID NO: 10917 - DNA, 156 bp, Artificial Sequence; identical to SEQ ID NO: 10916
  Synthetic polynucleotide

SEQ ID NO: 10918 - DNA, 156 bp, Artificial Sequence
  Synthetic polynucleotide
atcatctcaccttgcctcctgtgatcaccctgcgttcgcctgcaggacattccaagaacattccatcgacattccagacacattccactaacattccaactacattccatgcacattccagtaacattccaggcgcgccatgcttcatcagactct

SEQ ID NO: 10919 - DNA, 156 bp, Artificial Sequence; identical to SEQ ID NO: 10918
  Synthetic polynucleotide

SEQ ID NO: 10920 - DNA, 190 bp, Artificial Sequence
  Synthetic polynucleotide
atcatctcaccttgcctcctggcttgggcagaattcatcctgcaggcacagcggggggtcagacacagcggggggtctcgcacagcggggggtcgaccacagcggggggtcctacacagcggggggtcactcacagcggggggtctgccacagcggggggtcgtaggcgcgccatgcttcatcagactct

SEQ ID NO: 10921 - DNA, 190 bp, Artificial Sequence; identical to SEQ ID NO: 10920
  Synthetic polynucleotide

SEQ ID NO: 10922 - DNA, 179 bp, Artificial Sequence
  Synthetic polynucleotide
atcatctcaccttgcctcctgagagggagtatttactacctgcaggctagtcacacctaggtgtgaaattagactagtcacacctaggtgtgaaatttcgctagtcacacctaggtgtgaaattgacctagtcacacctaggtgtgaaattctaggcgcgccatgcttcatcagactct

SEQ ID NO: 10923 - DNA, 179 bp, Artificial Sequence; identical to SEQ ID NO: 10922
  Synthetic polynucleotide

SEQ ID NO: 10924 - DNA, 156 bp, Artificial Sequence
  Synthetic polynucleotide
atcatctcaccttgcctcctgtttgtgttggtctctgccctgcaggggacgtgcagaggacgtgctcgggacgtgcgacggacgtgcctaggacgtgcactggacgtgctgcggacgtgcgtaggacgtgcggcgcgccatgcttcatcagactct

SEQ ID NO: 10925 - DNA, 156 bp, Artificial Sequence; identical to SEQ ID NO: 10924
  Synthetic polynucleotide

SEQ ID NO: 10926 - DNA, 180 bp, Artificial Sequence
  Synthetic polynucleotide
atcatctcaccttgcctcctgtctgggtttctgacatccctgcaggtacttccggtgagatacttccggtgtcgtacttccggtggactacttccggtgctatacttccggtgacttacttccggtgtgctacttccggtggtatacttccggtgggcgcgccatgcttcatcagactct

SEQ ID NO: 10927 - DNA, 180 bp, Artificial Sequence; identical to SEQ ID NO: 10926
  Synthetic polynucleotide

SEQ ID NO: 10928 - DNA, 180 bp, Artificial Sequence
  Synthetic polynucleotide
atcatctcaccttgcctcctgaaccagccatcagtaatcctgcaggctgccccctggagactgccccctggtcgctgccccctgggacctgccccctggctactgccccctggactctgccccctggtgcctgccccctgggtactgccccctggggcgcgccatgcttcatcagactct

SEQ ID NO: 10929 - DNA, 180 bp, Artificial Sequence; identical to SEQ ID NO: 10928
  Synthetic polynucleotide

SEQ ID NO: 10930 - DNA, 156 bp, Artificial Sequence
  Synthetic polynucleotide
atcatctcaccttgcctcctgctataagcacagtatggcctgcaggtatgtataagatatgtatatcgtatgtatagactatgtatactatatgtataacttatgtatatgctatgtatagtatatgtataggcgcgccatgcttcatcagactct

SEQ ID NO: 10931 - DNA, 156 bp, Artificial Sequence; identical to SEQ ID NO: 10930
  Synthetic polynucleotide

SEQ ID NO: 10932 - DNA, 172 bp, Artificial Sequence
  Synthetic polynucleotide
atcatctcaccttgcctcctgctacaaccaatgcgagccctgcaggcgaatattctagacgaatattcttcgcgaatattctgaccgaatattctctacgaatattctactcgaatattcttgccgaatattctgtacgaatattctggcgcgccatgcttcatcagactct

SEQ ID NO: 10933 - DNA, 172 bp, Artificial Sequence; identical to SEQ ID NO: 10932
  Synthetic polynucleotide

SEQ ID NO: 10934 - DNA, 190 bp, Artificial Sequence
  Synthetic polynucleotide
atcatctcaccttgcctcctgtacacctctaagcgaaacctgcaggccagccaatcagagagaccagccaatcagagtcgccagccaatcagaggacccagccaatcagagctaccagccaatcagagactccagccaatcagagtgcccagccaatcagaggtaggcgcgccatgcttcatcagactct

SEQ ID NO: 10935 - DNA, 190 bp, Artificial Sequence; identical to SEQ ID NO: 10934
  Synthetic polynucleotide

SEQ ID NO: 10936 - DNA, 191 bp, Artificial Sequence
  Synthetic polynucleotide
atcatctcaccttgcctcctgccagtgtttgttattgacctgcaggttcattaatccggttcaagattcattaatccggttcatcgttcattaatccggttcagacttcattaatccggttcactattcattaatccggttcaactttcattaatccggttcatgcggcgcgccatgcttcatcagactct

SEQ ID NO: 10937 - DNA, 191 bp, Artificial Sequence; identical to SEQ ID NO: 10936
  Synthetic polynucleotide

SEQ ID NO: 10938 - DNA, 196 bp, Artificial Sequence
  Synthetic polynucleotide
atcatctcaccttgcctcctgtgtttcctcaactcgtgcctgcagggccccccccctccccctctccgagagccccccccctccccctctccgtcggccccccccctccccctctccggacgccccccccctccccctctccgctagccccccccctccccctctccgactggcgcgccatgcttcatcagactct

SEQ ID NO: 10939 - DNA, 196 bp, Artificial Sequence; identical to SEQ ID NO: 10938
  Synthetic polynucleotide

SEQ ID NO: 10940 - DNA, 197 bp, Artificial Sequence
  Synthetic polynucleotide
atcatctcaccttgcctcctgaacttgctgcagacaaccctgcaggtatttcctggaattcagatatttcctggaattctcgtatttcctggaattcgactatttcctggaattcctatatttcctggaattcacttatttcctggaattctgctatttcctggaattcgtaggcgcgccatgcttcatcagactct

SEQ ID NO: 10941 - DNA, 197 bp, Artificial Sequence; identical to SEQ ID NO: 10940
  Synthetic polynucleotide

SEQ ID NO: 10942 - DNA, 180 bp, Artificial Sequence
  Synthetic polynucleotide
atcatctcaccttgcctcctggtcctaatgggacatgacctgcaggatgagtcatccagaatgagtcatcctcgatgagtcatccgacatgagtcatccctaatgagtcatccactatgagtcatcctgcatgagtcatccgtaatgagtcatccggcgcgccatgcttcatcagactct

SEQ ID NO: 10943 - DNA, 180 bp, Artificial Sequence; identical to SEQ ID NO: 10942
  Synthetic polynucleotide

SEQ ID NO: 10944 - DNA, 190 bp, Artificial Sequence
  Synthetic polynucleotide
atcatctcaccttgcctcctgctacgagctttggcgtccctgcaggtgtgaccttgggccagatgtgaccttgggcctcgtgtgaccttgggccgactgtgaccttgggccctatgtgaccttgggccacttgtgaccttgggcctgctgtgaccttgggccgtaggcgcgccatgcttcatcagactct

SEQ ID NO: 10945 - DNA, 190 bp, Artificial Sequence; identical to SEQ ID NO: 10944
  Synthetic polynucleotide

SEQ ID NO: 10946 - DNA, 200 bp, Artificial Sequence
  Synthetic polynucleotide
atcatctcaccttgcctcctgcacgacgcgaaagcttgcctgcaggtcacaccttaaaggtgtgaagatcacaccttaaaggtgtgatcgtcacaccttaaaggtgtgagactcacaccttaaaggtgtgactatcacaccttaaaggtgtgaacttcacaccttaaaggtgtgaggcgcgccatgcttcatcagactct

SEQ ID NO: 10947 - DNA, 200 bp, Artificial Sequence; identical to SEQ ID NO: 10946
  Synthetic polynucleotide

SEQ ID NO: 10948 - DNA, 164 bp, Artificial Sequence
  Synthetic polynucleotide
atcatctcaccttgcctcctgctcctaacagtcctcaccctgcaggcccatcaaaagacccatcaaatcgcccatcaaagaccccatcaaactacccatcaaaactcccatcaaatgccccatcaaagtacccatcaaaggcgcgccatgcttcatcagactct

SEQ ID NO: 10949 - DNA, 164 bp, Artificial Sequence; identical to SEQ ID NO: 10948
  Synthetic polynucleotide

SEQ ID NO: 10950 - DNA, 172 bp, Artificial Sequence
  Synthetic polynucleotide
atcatctcaccttgcctcctgacgtgggtagcataaatcctgcagggctgtgatttagagctgtgattttcggctgtgatttgacgctgtgatttctagctgtgatttactgctgtgattttgcgctgtgatttgtagctgtgatttggcgcgccatgcttcatcagactct

SEQ ID NO: 10951 - DNA, 172 bp, Artificial Sequence; identical to SEQ ID NO: 10950
  Synthetic polynucleotide

SEQ ID NO: 10952 - DNA, 180 bp, Artificial Sequence
  Synthetic polynucleotide
atcatctcaccttgcctcctgaggcgagcacagactctcctgcagggtaccatatggagagtaccatatggtcggtaccatatgggacgtaccatatggctagtaccatatggactgtaccatatggtgcgtaccatatgggtagtaccatatggggcgcgccatgcttcatcagactct

SEQ ID NO: 10953 - DNA, 180 bp, Artificial Sequence; identical to SEQ ID NO: 10952
  Synthetic polynucleotide

SEQ ID NO: 10954 - DNA, 200 bp, Artificial Sequence
  Synthetic polynucleotide
atcatctcaccttgcctcctgcacgaagctatgcattccctgcaggggcatgcctgggcatgtccagaggcatgcctgggcatgtcctcgggcatgcctgggcatgtccgacggcatgcctgggcatgtccctaggcatgcctgggcatgtccactggcatgcctgggcatgtccggcgcgccatgcttcatcagactct

SEQ ID NO: 10955 - DNA, 200 bp, Artificial Sequence; identical to SEQ ID NO: 10954
  Synthetic polynucleotide

SEQ ID NO: 10956 - DNA, 180 bp, Artificial Sequence
  Synthetic polynucleotide
atcatctcaccttgcctcctggcaaatttcccttcgtgcctgcaggaattaattagtagaaattaattagttcgaattaattagtgacaattaattagtctaaattaattagtactaattaattagttgcaattaattagtgtaaattaattagtggcgcgccatgcttcatcagactct

SEQ ID NO: 10957 - DNA, 180 bp, Artificial Sequence; identical to SEQ ID NO: 10956
  Synthetic polynucleotide

SEQ ID NO: 10958 - DNA, 148 bp, Artificial Sequence
  Synthetic polynucleotide
atcatctcaccttgcctcctgcgtgataccgtcaccgacctgcaggaggtcacagaaggtcactcgaggtcacgacaggtcacctaaggtcacactaggtcactgcaggtcacgtaaggtcacggcgcgccatgcttcatcagactct

SEQ ID NO: 10959 - DNA, 148 bp, Artificial Sequence; identical to SEQ ID NO: 10958
  Synthetic polynucleotide

SEQ ID NO: 10960 - DNA, 191 bp, Artificial Sequence
  Synthetic polynucleotide
atcatctcaccttgcctcctgctcgccgcatcataaagcctgcaggattcattaattgcttgtagaattcattaattgcttgttcgattcattaattgcttgtgacattcattaattgcttgtctaattcattaattgcttgtactattcattaattgcttgttgcggcgcgccatgcttcatcagactct

SEQ ID NO: 10961 - DNA, 191 bp, Artificial Sequence; identical to SEQ ID NO: 10960
  Synthetic polynucleotide

SEQ ID NO: 10962 - DNA, 190 bp, Artificial Sequence
  Synthetic polynucleotide
atcatctcaccttgcctcctgttagaatccgagggcgacctgcaggcccccgcccccgccagacccccgcccccgcctcgcccccgcccccgccgaccccccgcccccgccctacccccgcccccgccactcccccgcccccgcctgccccccgcccccgccgtaggcgcgccatgcttcatcagactct

SEQ ID NO: 10963 - DNA, 190 bp, Artificial Sequence; identical to SEQ ID NO: 10962
  Synthetic polynucleotide

SEQ ID NO: 10964 - DNA, 140 bp, Artificial Sequence
  Synthetic polynucleotide
atcatctcaccttgcctcctgccggccctaggatttcacctgcaggatccacagaatccactcgatccacgacatccacctaatccacactatccactgcatccacgtaatccacggcgcgccatgcttcatcagactct

SEQ ID NO: 10965 - DNA, 140 bp, Artificial Sequence; identical to SEQ ID NO: 10964
  Synthetic polynucleotide

SEQ ID NO: 10966 - DNA, 164 bp, Artificial Sequence
  Synthetic polynucleotide
atcatctcaccttgcctcctgacgagtaaacacgattacctgcaggacaaagggcagaacaaagggctcgacaaagggcgacacaaagggcctaacaaagggcactacaaagggctgcacaaagggcgtaacaaagggcggcgcgccatgcttcatcagactct

SEQ ID NO: 10967 - DNA, 164 bp, Artificial Sequence; identical to SEQ ID NO: 10966
  Synthetic polynucleotide

SEQ ID NO: 10968 - DNA, 172 bp, Artificial Sequence
  Synthetic polynucleotide
atcatctcaccttgcctcctgcttaggcaggacggtatcctgcaggtaacggtcaaagataacggtcaatcgtaacggtcaagactaacggtcaactataacggtcaaacttaacggtcaatgctaacggtcaagtataacggtcaaggcgcgccatgcttcatcagactct

SEQ ID NO: 10969 - DNA, 172 bp, Artificial Sequence; identical to SEQ ID NO: 10968
  Synthetic polynucleotide

SEQ ID NO: 10970 - DNA, 180 bp, Artificial Sequence
  Synthetic polynucleotide
atcatctcaccttgcctcctgggcggatgactctgatacctgcaggaccacctgttgagaaccacctgttgtcgaccacctgttggacaccacctgttgctaaccacctgttgactaccacctgttgtgcaccacctgttggtaaccacctgttgggcgcgccatgcttcatcagactct

SEQ ID NO: 10971 - DNA, 180 bp, Artificial Sequence; identical to SEQ ID NO: 10970
  Synthetic polynucleotide

SEQ ID NO: 10972 - DNA, 197 bp, Artificial Sequence
  Synthetic polynucleotide
atcatctcaccttgcctcctgtctaaggtgctagtcatcctgcaggaaagatgatgcaataagaaaagatgatgcaatatcgaaagatgatgcaatagacaaagatgatgcaatactaaaagatgatgcaataactaaagatgatgcaatatgcaaagatgatgcaatagtaggcgcgccatgcttcatcagactct

SEQ ID NO: 10973 - DNA, 197 bp, Artificial Sequence; identical to SEQ ID NO: 10972
  Synthetic polynucleotide

SEQ ID NO: 10974 - DNA, 188 bp, Artificial Sequence
  Synthetic polynucleotide
atcatctcaccttgcctcctgtcgaagaggctcagcagcctgcaggtttggcgccaatagatttggcgccaattcgtttggcgccaatgactttggcgccaatctatttggcgccaatacttttggcgccaattgctttggcgccaatgtatttggcgccaatggcgcgccatgcttcatcagactct

SEQ ID NO: 10975 - DNA, 188 bp, Artificial Sequence; identical to SEQ ID NO: 10974
  Synthetic polynucleotide

SEQ ID NO: 10976 - DNA, 172 bp, Artificial Sequence
  Synthetic polynucleotide
atcatctcaccttgcctcctgtgatggaatctttagcacctgcagggcggacgttaagagcggacgttatcggcggacgttagacgcggacgttactagcggacgttaactgcggacgttatgcgcggacgttagtagcggacgttaggcgcgccatgcttcatcagactct

SEQ ID NO: 10977 - DNA, 172 bp, Artificial Sequence; identical to SEQ ID NO: 10976
  Synthetic polynucleotide

SEQ ID NO: 10978 - DNA, 156 bp, Artificial Sequence
  Synthetic polynucleotide
atcatctcaccttgcctcctgtgccatgatcgtgttgccctgcaggccatatgtagaccatatgttcgccatatgtgacccatatgtctaccatatgtactccatatgttgcccatatgtgtaccatatgtggcgcgccatgcttcatcagactct

SEQ ID NO: 10979 - DNA, 156 bp, Artificial Sequence; identical to SEQ ID NO: 10978
  Synthetic polynucleotide

SEQ ID NO: 10980 - DNA, 197 bp, Artificial Sequence
  Synthetic polynucleotide
atcatctcaccttgcctcctgtaaatgcgtccttcgtacctgcaggaacaataacattgttagaaacaataacattgtttcgaacaataacattgttgacaacaataacattgttctaaacaataacattgttactaacaataacattgtttgcaacaataacattgttgtaggcgcgccatgcttcatcagactct

SEQ ID NO: 10981 - DNA, 197 bp, Artificial Sequence; identical to SEQ ID NO: 10980
  Synthetic polynucleotide

SEQ ID NO: 10982 - DNA, 197 bp, Artificial Sequence
  Synthetic polynucleotide
atcatctcaccttgcctcctggagagttccttgtaggacctgcaggacccccttatcagactatagaacccccttatcagactattcgacccccttatcagactatgacacccccttatcagactatctaacccccttatcagactatactacccccttatcagactattgcggcgcgccatgcttcatcagactct

SEQ ID NO: 10983 - DNA, 197 bp, Artificial Sequence; identical to SEQ ID NO: 10982
  Synthetic polynucleotide

SEQ ID NO: 10984 - DNA, 196 bp, Artificial Sequence
  Synthetic polynucleotide
atcatctcaccttgcctcctgttcttgggtatctcgggcctgcaggtgcccccggggcaagatgcccccggggcatcgtgcccccggggcagactgcccccggggcactatgcccccggggcaacttgcccccggggcatgctgcccccggggcagtatgcccccggggcaggcgcgccatgcttcatcagactct

SEQ ID NO: 10985 - DNA, 196 bp, Artificial Sequence; identical to SEQ ID NO: 10984
  Synthetic polynucleotide

SEQ ID NO: 10986 - DNA, 185 bp, Artificial Sequence
  Synthetic polynucleotide
atcatctcaccttgcctcctggtcttgcatgcattgatcctgcagggaagaacaggtgtccgagagaagaacaggtgtccgtcggaagaacaggtgtccggacgaagaacaggtgtccgctagaagaacaggtgtccgactgaagaacaggtgtccgtgcggcgcgccatgcttcatcagactct

SEQ ID NO: 10987 - DNA, 185 bp, Artificial Sequence; identical to SEQ ID NO: 10986
  Synthetic polynucleotide

SEQ ID NO: 10988 - DNA, 185 bp, Artificial Sequence
  Synthetic polynucleotide
atcatctcaccttgcctcctgcgcaggaaagtctagagcctgcaggtaagggttgcgtgcccagataagggttgcgtgccctcgtaagggttgcgtgcccgactaagggttgcgtgcccctataagggttgcgtgcccacttaagggttgcgtgccctgcggcgcgccatgcttcatcagactct

SEQ ID NO: 10989 - DNA, 185 bp, Artificial Sequence; identical to SEQ ID NO: 10988
  Synthetic polynucleotide

SEQ ID NO: 10990 - DNA, 196 bp, Artificial Sequence
  Synthetic polynucleotide
atcatctcaccttgcctcctgagcccgctattaagattcctgcaggcttccaaaatgacagacttccaaaatgactcgcttccaaaatgacgaccttccaaaatgacctacttccaaaatgacactcttccaaaatgactgccttccaaaatgacgtacttccaaaatgacggcgcgccatgcttcatcagactct

SEQ ID NO: 10991 - DNA, 196 bp, Artificial Sequence; identical to SEQ ID NO: 10990
  Synthetic polynucleotide

SEQ ID NO: 10992 - DNA, 185 bp, Artificial Sequence
  Synthetic polynucleotide
atcatctcaccttgcctcctgcggcgaaaggttatatacctgcagggtgcactaattaagacagagtgcactaattaagactcggtgcactaattaagacgacgtgcactaattaagacctagtgcactaattaagacactgtgcactaattaagactgcggcgcgccatgcttcatcagactct

SEQ ID NO: 10993 - DNA, 185 bp, Artificial Sequence; identical to SEQ ID NO: 10992
  Synthetic polynucleotide

SEQ ID NO: 10994 - DNA, 172 bp, Artificial Sequence
  Synthetic polynucleotide
atcatctcaccttgcctcctgagactcgtaagatctttcctgcaggaggtgtgaaaagaaggtgtgaaatcgaggtgtgaaagacaggtgtgaaactaaggtgtgaaaactaggtgtgaaatgcaggtgtgaaagtaaggtgtgaaaggcgcgccatgcttcatcagactct

SEQ ID NO: 10995 - DNA, 172 bp, Artificial Sequence; identical to SEQ ID NO: 10994
  Synthetic polynucleotide

SEQ ID NO: 10996 - DNA, 156 bp, Artificial Sequence
  Synthetic polynucleotide
atcatctcaccttgcctcctgaatagccagcgtcgatccctgcaggatttttctagaatttttcttcgatttttctgacatttttctctaatttttctactatttttcttgcatttttctgtaatttttctggcgcgccatgcttcatcagactct

SEQ ID NO: 10997 - DNA, 156 bp, Artificial Sequence; identical to SEQ ID NO: 10996
  Synthetic polynucleotide

SEQ ID NO: 10998 - DNA, 196 bp, Artificial Sequence
  Synthetic polynucleotide
atcatctcaccttgcctcctgttccggagacggtttgccctgcagggaacgttctagaaagagaacgttctagaatcggaacgttctagaagacgaacgttctagaactagaacgttctagaaactgaacgttctagaatgcgaacgttctagaagtagaacgttctagaaggcgcgccatgcttcatcagactct

SEQ ID NO: 10999 - DNA, 196 bp, Artificial Sequence; identical to SEQ ID NO: 10998
  Synthetic polynucleotide

SEQ ID NO: 11000 - DNA, 186 bp, Artificial Sequence
  Synthetic polynucleotide
atcatctcaccttgcctcctggattgtgtttgactttccctgcaggagggaaaataattttccattagaagggaaaataattttccatttcgagggaaaataattttccattgacagggaaaataattttccattctaagggaaaataattttccattactggcgcgccatgcttcatcagactct

SEQ ID NO: 11001 - DNA, 186 bp, Artificial Sequence; identical to SEQ ID NO: 11000
  Synthetic polynucleotide

SEQ ID NO: 11002 - DNA, 196 bp, Artificial Sequence
  Synthetic polynucleotide
atcatctcaccttgcctcctggcagcgtaggacgttctcctgcaggggtcaaaggtcacagaggtcaaaggtcactcgggtcaaaggtcacgacggtcaaaggtcacctaggtcaaaggtcacactggtcaaaggtcactgcggtcaaaggtcacgtaggtcaaaggtcacggcgcgccatgcttcatcagactct

SEQ ID NO: 11003 - DNA, 196 bp, Artificial Sequence; identical to SEQ ID NO: 11002
  Synthetic polynucleotide

SEQ ID NO: 11004 - DNA, 188 bp, Artificial Sequence
  Synthetic polynucleotide
atcatctcaccttgcctcctgcagtgatctcacgaaatcctgcaggtttggcgccaaaagatttggcgccaaatcgtttggcgccaaagactttggcgccaaactatttggcgccaaaacttttggcgccaaatgctttggcgccaaagtatttggcgccaaaggcgcgccatgcttcatcagactct

SEQ ID NO: 11005 - DNA, 188 bp, Artificial Sequence; identical to SEQ ID NO: 11004
  Synthetic polynucleotide

SEQ ID NO: 11006 - DNA, 197 bp, Artificial Sequence
  Synthetic polynucleotide
atcatctcaccttgcctcctggagtaccttcagcacgacctgcaggtgaccttttgaccttagatgaccttttgacctttcgtgaccttttgaccttgactgaccttttgaccttctatgaccttttgaccttacttgaccttttgacctttgctgaccttttgaccttgtaggcgcgccatgcttcatcagactct

SEQ ID NO: 11007 - DNA, 197 bp, Artificial Sequence; identical to SEQ ID NO: 11006
  Synthetic polynucleotide

SEQ ID NO: 11008 - DNA, 180 bp, Artificial Sequence
  Synthetic polynucleotide
atcatctcaccttgcctcctgaatatgcctatagcccgcctgcaggatgactcacccagaatgactcaccctcgatgactcacccgacatgactcacccctaatgactcacccactatgactcaccctgcatgactcacccgtaatgactcacccggcgcgccatgcttcatcagactct

SEQ ID NO: 11009 - DNA, 180 bp, Artificial Sequence; identical to SEQ ID NO: 11008
  Synthetic polynucleotide

SEQ ID NO: 11010 - DNA, 191 bp, Artificial Sequence
  Synthetic polynucleotide
atcatctcaccttgcctcctgcaagactagagtcactccctgcaggaaattaacggttttcaaagaaaattaacggttttcaatcgaaattaacggttttcaagacaaattaacggttttcaactaaaattaacggttttcaaactaaattaacggttttcaatgcggcgcgccatgcttcatcagactct

SEQ ID NO: 11011 - DNA, 191 bp, Artificial Sequence; identical to SEQ ID NO: 11010
  Synthetic polynucleotide

SEQ ID NO: 11012 - DNA, 172 bp, Artificial Sequence
  Synthetic polynucleotide
atcatctcaccttgcctcctgtatggtctgggtaatcccctgcagggtacctacctagagtacctaccttcggtacctacctgacgtacctacctctagtacctacctactgtacctaccttgcgtacctacctgtagtacctacctggcgcgccatgcttcatcagactct

SEQ ID NO: 11013 - DNA, 172 bp, Artificial Sequence; identical to SEQ ID NO: 11012
  Synthetic polynucleotide

SEQ ID NO: 11014 - DNA, 197 bp, Artificial Sequence
  Synthetic polynucleotide
atcatctcaccttgcctcctgtcgattaaatctacggccctgcaggtgaccttttgacctcagatgaccttttgacctctcgtgaccttttgacctcgactgaccttttgacctcctatgaccttttgacctcacttgaccttttgacctctgctgaccttttgacctcgtaggcgcgccatgcttcatcagactct

SEQ ID NO: 11015 - DNA, 197 bp, Artificial Sequence; identical to SEQ ID NO: 11014
  Synthetic polynucleotide

SEQ ID NO: 11016 - DNA, 197 bp, Artificial Sequence
  Synthetic polynucleotide
atcatctcaccttgcctcctgtcctttgcccacccgatcctgcaggcagaccccccacagaagacagaccccccacagatcgcagaccccccacagagaccagaccccccacagactacagaccccccacagaactcagaccccccacagatgccagaccccccacagagtaggcgcgccatgcttcatcagactct

SEQ ID NO: 11017 - DNA, 197 bp, Artificial Sequence; identical to SEQ ID NO: 11016
  Synthetic polynucleotide

SEQ ID NO: 11018 - DNA, 156 bp, Artificial Sequence
  Synthetic polynucleotide
atcatctcaccttgcctcctgtgccagagagcctccttcctgcaggtttatgacagatttatgactcgtttatgacgactttatgacctatttatgacacttttatgactgctttatgacgtatttatgacggcgcgccatgcttcatcagactct

SEQ ID NO: 11019 - DNA, 156 bp, Artificial Sequence; identical to SEQ ID NO: 11018
  Synthetic polynucleotide

SEQ ID NO: 11020 - DNA, 148 bp, Artificial Sequence
  Synthetic polynucleotide
atcatctcaccttgcctcctgaactgggtgtttagtaacctgcaggtcattagagatcattagtcgtcattaggactcattagctatcattagacttcattagtgctcattaggtatcattagggcgcgccatgcttcatcagactct

SEQ ID NO: 11021 - DNA, 148 bp, Artificial Sequence; identical to SEQ ID NO: 11020
  Synthetic polynucleotide

SEQ ID NO: 11022 - DNA, 197 bp, Artificial Sequence
  Synthetic polynucleotide
atcatctcaccttgcctcctgatagcttcacatgccgtcctgcagggtataaaaggcggggagagtataaaaggcggggtcggtataaaaggcgggggacgtataaaaggcggggctagtataaaaggcggggactgtataaaaggcggggtgcgtataaaaggcgggggtaggcgcgccatgcttcatcagactct

SEQ ID NO: 11023 - DNA, 197 bp, Artificial Sequence; identical to SEQ ID NO: 11022
  Synthetic polynucleotide

SEQ ID NO: 11024 - DNA, 188 bp, Artificial Sequence
  Synthetic polynucleotide
atcatctcaccttgcctcctgataacttgagcagtggccctgcaggggccatctgccgagaggccatctgccgtcgggccatctgccggacggccatctgccgctaggccatctgccgactggccatctgccgtgcggccatctgccggtaggccatctgccgggcgcgccatgcttcatcagactct

SEQ ID NO: 11025 - DNA, 188 bp, Artificial Sequence; identical to SEQ ID NO: 11024
  Synthetic polynucleotide

SEQ ID NO: 11026 - DNA, 164 bp, Artificial Sequence
  Synthetic polynucleotide
atcatctcaccttgcctcctgagttagtggctgggagccctgcagggccccaggcagagccccaggctcggccccaggcgacgccccaggcctagccccaggcactgccccaggctgcgccccaggcgtagccccaggcggcgcgccatgcttcatcagactct

SEQ ID NO: 11027 - DNA, 164 bp, Artificial Sequence; identical to SEQ ID NO: 11026
  Synthetic polynucleotide

SEQ ID NO: 11028 - DNA, 197 bp, Artificial Sequence
  Synthetic polynucleotide
atcatctcaccttgcctcctgttacattcgctcagacgcctgcaggctaattagcgctaattaaagactaattagcgctaattaatcgctaattagcgctaattaagacctaattagcgctaattaactactaattagcgctaattaaactctaattagcgctaattaatgcggcgcgccatgcttcatcagactct

SEQ ID NO: 11029 - DNA, 197 bp, Artificial Sequence; identical to SEQ ID NO: 11028
  Synthetic polynucleotide

SEQ ID NO: 11030 - DNA, 186 bp, Artificial Sequence
  Synthetic polynucleotide
atcatctcaccttgcctcctgtgagtaatgctgttggacctgcaggtgtttcccaattcggaaatgagatgtttcccaattcggaaatgtcgtgtttcccaattcggaaatggactgtttcccaattcggaaatgctatgtttcccaattcggaaatgactggcgcgccatgcttcatcagactct

SEQ ID NO: 11031 - DNA, 186 bp, Artificial Sequence; identical to SEQ ID NO: 11030
  Synthetic polynucleotide

SEQ ID NO: 11032 - DNA, 148 bp, Artificial Sequence
  Synthetic polynucleotide
atcatctcaccttgcctcctggataaactctcgcaacccctgcaggtcattaaagatcattaatcgtcattaagactcattaactatcattaaacttcattaatgctcattaagtatcattaaggcgcgccatgcttcatcagactct

SEQ ID NO: 11033 - DNA, 148 bp, Artificial Sequence; identical to SEQ ID NO: 11032
  Synthetic polynucleotide

SEQ ID NO: 11034 - DNA, 190 bp, Artificial Sequence
  Synthetic polynucleotide
atcatctcaccttgcctcctgttcagggcaattccgcacctgcaggtgacttttgactttagatgacttttgacttttcgtgacttttgactttgactgacttttgactttctatgacttttgactttacttgacttttgacttttgctgacttttgactttgtaggcgcgccatgcttcatcagactct

SEQ ID NO: 11035 - DNA, 190 bp, Artificial Sequence; identical to SEQ ID NO: 11034
  Synthetic polynucleotide

SEQ ID NO: 11036 - DNA, 196 bp, Artificial Sequence
  Synthetic polynucleotide
atcatctcaccttgcctcctggtggtggcgaagttgagcctgcaggtacagactgttctagatacagactgttcttcgtacagactgttctgactacagactgttctctatacagactgttctacttacagactgttcttgctacagactgttctgtatacagactgttctggcgcgccatgcttcatcagactct

SEQ ID NO: 11037 - DNA, 196 bp, Artificial Sequence; identical to SEQ ID NO: 11036
  Synthetic polynucleotide

SEQ ID NO: 11038 - DNA, 172 bp, Artificial Sequence
  Synthetic polynucleotide
atcatctcaccttgcctcctgggattgaccctcgctgtcctgcaggataattcataagaataattcatatcgataattcatagacataattcatactaataattcataactataattcatatgcataattcatagtaataattcataggcgcgccatgcttcatcagactct

SEQ ID NO: 11039 - DNA, 172 bp, Artificial Sequence; identical to SEQ ID NO: 11038
  Synthetic polynucleotide

SEQ ID NO: 11040 - DNA, 164 bp, Artificial Sequence
  Synthetic polynucleotide
atcatctcaccttgcctcctgacgctctaacgccacaacctgcaggaataaactcagaaataaactctcgaataaactcgacaataaactcctaaataaactcactaataaactctgcaataaactcgtaaataaactcggcgcgccatgcttcatcagactct

SEQ ID NO: 11041 - DNA, 164 bp, Artificial Sequence; identical to SEQ ID NO: 11040
  Synthetic polynucleotide

SEQ ID NO: 11042 - DNA, 172 bp, Artificial Sequence
  Synthetic polynucleotide
atcatctcaccttgcctcctgggaatcttgactcctaacctgcaggtctaattagcagatctaattagctcgtctaattagcgactctaattagcctatctaattagcacttctaattagctgctctaattagcgtatctaattagcggcgcgccatgcttcatcagactct

SEQ ID NO: 11043 - DNA, 172 bp, Artificial Sequence; identical to SEQ ID NO: 11042
  Synthetic polynucleotide

SEQ ID NO: 11044 - DNA, 180 bp, Artificial Sequence
  Synthetic polynucleotide
atcatctcaccttgcctcctgacgggtttagagacctacctgcagggatgactcatcagagatgactcatctcggatgactcatcgacgatgactcatcctagatgactcatcactgatgactcatctgcgatgactcatcgtagatgactcatcggcgcgccatgcttcatcagactct

SEQ ID NO: 11045 - DNA, 180 bp, Artificial Sequence; identical to SEQ ID NO: 11044
  Synthetic polynucleotide

SEQ ID NO: 11046 - DNA, 198 bp, Artificial Sequence
  Synthetic polynucleotide
atcatctcaccttgcctcctggctgctgcatctcacgtcctgcagggccgccatcttgggtgcgggcaaagagccgccatcttgggtgcgggcaatcggccgccatcttgggtgcgggcaagacgccgccatcttgggtgcgggcaactagccgccatcttgggtgcgggcaaggcgcgccatgcttcatcagactct

SEQ ID NO: 11047 - DNA, 198 bp, Artificial Sequence; identical to SEQ ID NO: 11046
  Synthetic polynucleotide

SEQ ID NO: 11048 - DNA, 172 bp, Artificial Sequence
  Synthetic polynucleotide
atcatctcaccttgcctcctgctcatgttcctaccttacctgcaggaaccacgtgaagaaaccacgtgatcgaaccacgtgagacaaccacgtgactaaaccacgtgaactaaccacgtgatgcaaccacgtgagtaaaccacgtgaggcgcgccatgcttcatcagactct

SEQ ID NO: 11049 - DNA, 172 bp, Artificial Sequence; identical to SEQ ID NO: 11048
  Synthetic polynucleotide

SEQ ID NO: 11050 - DNA, 172 bp, Artificial Sequence
  Synthetic polynucleotide
atcatctcaccttgcctcctggtgtaagcactttgaggcctgcaggagccacttaaagaagccacttaatcgagccacttaagacagccacttaactaagccacttaaactagccacttaatgcagccacttaagtaagccacttaaggcgcgccatgcttcatcagactct

SEQ ID NO: 11051 - DNA, 172 bp, Artificial Sequence; identical to SEQ ID NO: 11050
  Synthetic polynucleotide

SEQ ID NO: 11052 - DNA, 197 bp, Artificial Sequence
  Synthetic polynucleotide
atcatctcaccttgcctcctgcgcgtcctgatcttgatcctgcaggacccaagatggcggcagaacccaagatggcggctcgacccaagatggcggcgacacccaagatggcggcctaacccaagatggcggcactacccaagatggcggctgcacccaagatggcggcgtaggcgcgccatgcttcatcagactct

SEQ ID NO: 11053 - DNA, 197 bp, Artificial Sequence; identical to SEQ ID NO: 11052
  Synthetic polynucleotide

SEQ ID NO: 11054 - DNA, 172 bp, Artificial Sequence
  Synthetic polynucleotide
atcatctcaccttgcctcctgcgatgataacggagtctcctgcaggaaccacgtggagaaaccacgtggtcgaaccacgtgggacaaccacgtggctaaaccacgtggactaaccacgtggtgcaaccacgtgggtaaaccacgtggggcgcgccatgcttcatcagactct

SEQ ID NO: 11055 - DNA, 172 bp, Artificial Sequence; identical to SEQ ID NO: 11054
  Synthetic polynucleotide

SEQ ID NO: 11056 - DNA, 191 bp, Artificial Sequence
  Synthetic polynucleotide
atcatctcaccttgcctcctgcccggtaaacagttaggcctgcagggcaacctcattatgtttagagcaacctcattatgttttcggcaacctcattatgtttgacgcaacctcattatgtttctagcaacctcattatgtttactgcaacctcattatgttttgcggcgcgccatgcttcatcagactct

SEQ ID NO: 11057 - DNA, 191 bp, Artificial Sequence; identical to SEQ ID NO: 11056
  Synthetic polynucleotide

SEQ ID NO: 11058 - DNA, 185 bp, Artificial Sequence
  Synthetic polynucleotide
atcatctcaccttgcctcctgggatggtcgtgtatcgccctgcagggaattaattaattaaaagagaattaattaattaaatcggaattaattaattaaagacgaattaattaattaaactagaattaattaattaaaactgaattaattaattaaatgcggcgcgccatgcttcatcagactct

SEQ ID NO: 11059 - DNA, 185 bp, Artificial Sequence; identical to SEQ ID NO: 11058
  Synthetic polynucleotide

SEQ ID NO: 11060 - DNA, 197 bp, Artificial Sequence
  Synthetic polynucleotide
atcatctcaccttgcctcctgtttgtctcacccgagctcctgcaggatgctgagtcagcgaagaatgctgagtcagcgatcgatgctgagtcagcgagacatgctgagtcagcgactaatgctgagtcagcgaactatgctgagtcagcgatgcatgctgagtcagcgagtaggcgcgccatgcttcatcagactct

SEQ ID NO: 11061 - DNA, 197 bp, Artificial Sequence; identical to SEQ ID NO: 11060
  Synthetic polynucleotide

SEQ ID NO: 11062 - DNA, 172 bp, Artificial Sequence
  Synthetic polynucleotide
atcatctcaccttgcctcctgcgtcaacgcgtgtacgacctgcaggacgcgccaaaagaacgcgccaaatcgacgcgccaaagacacgcgccaaactaacgcgccaaaactacgcgccaaatgcacgcgccaaagtaacgcgccaaaggcgcgccatgcttcatcagactct

SEQ ID NO: 11063 - DNA, 172 bp, Artificial Sequence; identical to SEQ ID NO: 11062
  Synthetic polynucleotide

SEQ ID NO: 11064 - DNA, 197 bp, Artificial Sequence
  Synthetic polynucleotide
atcatctcaccttgcctcctgatctgggatcgttatcgcctgcagggcaacaatgtatcaaagagcaacaatgtatcaatcggcaacaatgtatcaagacgcaacaatgtatcaactagcaacaatgtatcaaactgcaacaatgtatcaatgcgcaacaatgtatcaagtaggcgcgccatgcttcatcagactct

SEQ ID NO: 11065 - DNA, 197 bp, Artificial Sequence; identical to SEQ ID NO: 11064
  Synthetic polynucleotide

SEQ ID NO: 11066 - DNA, 156 bp, Artificial Sequence
  Synthetic polynucleotide
atcatctcaccttgcctcctgtattacgtctccgacgccctgcaggtcattaagagatcattaagtcgtcattaaggactcattaagctatcattaagacttcattaagtgctcattaaggtatcattaagggcgcgccatgcttcatcagactct

SEQ ID NO: 11067 - DNA, 156 bp, Artificial Sequence; identical to SEQ ID NO: 11066
  Synthetic polynucleotide

SEQ ID NO: 11068 - DNA, 188 bp, Artificial Sequence
  Synthetic polynucleotide
atcatctcaccttgcctcctgttaaccttcgaatacagcctgcaggcgtacgtgcggcagacgtacgtgcggctcgcgtacgtgcggcgaccgtacgtgcggcctacgtacgtgcggcactcgtacgtgcggctgccgtacgtgcggcgtacgtacgtgcggcggcgcgccatgcttcatcagactct

SEQ ID NO: 11069 - DNA, 188 bp, Artificial Sequence; identical to SEQ ID NO: 11068
  Synthetic polynucleotide

SEQ ID NO: 11070 - DNA, 156 bp, Artificial Sequence
  Synthetic polynucleotide
atcatctcaccttgcctcctgactagagttcactgagccctgcaggtcattaacagatcattaactcgtcattaacgactcattaacctatcattaacacttcattaactgctcattaacgtatcattaacggcgcgccatgcttcatcagactct

SEQ ID NO: 11071 - DNA, 156 bp, Artificial Sequence; identical to SEQ ID NO: 11070
  Synthetic polynucleotide

SEQ ID NO: 11072 - DNA, 197 bp, Artificial Sequence
  Synthetic polynucleotide
atcatctcaccttgcctcctgacggtgtactctcagcccctgcaggttgacctttggacccagattgacctttggaccctcgttgacctttggacccgacttgacctttggacccctattgacctttggacccactttgacctttggaccctgcttgacctttggacccgtaggcgcgccatgcttcatcagactct

SEQ ID NO: 11073 - DNA, 197 bp, Artificial Sequence; identical to SEQ ID NO: 11072
  Synthetic polynucleotide

SEQ ID NO: 11074 - DNA, 164 bp, Artificial Sequence
  Synthetic polynucleotide
atcatctcaccttgcctcctggagagggatagctgcaccctgcaggttttattgcagattttattgctcgttttattgcgacttttattgcctattttattgcactttttattgctgcttttattgcgtattttattgcggcgcgccatgcttcatcagactct

SEQ ID NO: 11075 - DNA, 164 bp, Artificial Sequence; identical to SEQ ID NO: 11074
  Synthetic polynucleotide

SEQ ID NO: 11076 - DNA, 188 bp, Artificial Sequence
  Synthetic polynucleotide
atcatctcaccttgcctcctgttcatgtccgctgtactcctgcaggggtaattatttcagaggtaattatttctcgggtaattatttcgacggtaattatttcctaggtaattatttcactggtaattatttctgcggtaattatttcgtaggtaattatttcggcgcgccatgcttcatcagactct

SEQ ID NO: 11077 - DNA, 188 bp, Artificial Sequence; identical to SEQ ID NO: 11076
  Synthetic polynucleotide

SEQ ID NO: 11078 - DNA, 197 bp, Artificial Sequence
  Synthetic polynucleotide
atcatctcaccttgcctcctgactcttgcacacatcaccctgcaggtggggtcactggcggtcaagatggggtcactggcggtcatcgtggggtcactggcggtcagactggggtcactggcggtcactatggggtcactggcggtcaacttggggtcactggcggtcatgcggcgcgccatgcttcatcagactct

SEQ ID NO: 11079 - DNA, 197 bp, Artificial Sequence; identical to SEQ ID NO: 11078
  Synthetic polynucleotide

SEQ ID NO: 11080 - DNA, 148 bp, Artificial Sequence
  Synthetic polynucleotide
atcatctcaccttgcctcctgccagtctgcagcactttcctgcaggttatcttagattatctttcgttatcttgacttatcttctattatcttactttatctttgcttatcttgtattatcttggcgcgccatgcttcatcagactct

SEQ ID NO: 11081 - DNA, 148 bp, Artificial Sequence; identical to SEQ ID NO: 11080
  Synthetic polynucleotide

SEQ ID NO: 11082 - DNA, 188 bp, Artificial Sequence
  Synthetic polynucleotide
atcatctcaccttgcctcctggttggacctactggtttcctgcaggattcacctgtacagaattcacctgtactcgattcacctgtacgacattcacctgtacctaattcacctgtacactattcacctgtactgcattcacctgtacgtaattcacctgtacggcgcgccatgcttcatcagactct

SEQ ID NO: 11083 - DNA, 188 bp, Artificial Sequence; identical to SEQ ID NO: 11082
  Synthetic polynucleotide

SEQ ID NO: 11084 - DNA, 197 bp, Artificial Sequence
  Synthetic polynucleotide
atcatctcaccttgcctcctgactgcaaaccctctttccctgcagggttggcataggctggcacagagttggcataggctggcactcggttggcataggctggcacgacgttggcataggctggcacctagttggcataggctggcacactgttggcataggctggcactgcggcgcgccatgcttcatcagactct

SEQ ID NO: 11085 - DNA, 197 bp, Artificial Sequence; identical to SEQ ID NO: 11084
  Synthetic polynucleotide

SEQ ID NO: 11086 - DNA, 188 bp, Artificial Sequence
  Synthetic polynucleotide
atcatctcaccttgcctcctgggctggatgtggtcgaacctgcaggtaaattatgcatagataaattatgcattcgtaaattatgcatgactaaattatgcatctataaattatgcatacttaaattatgcattgctaaattatgcatgtataaattatgcatggcgcgccatgcttcatcagactct

SEQ ID NO: 11087 - DNA, 188 bp, Artificial Sequence; identical to SEQ ID NO: 11086
  Synthetic polynucleotide

SEQ ID NO: 11088 - DNA, 191 bp, Artificial Sequence
  Synthetic polynucleotide
atcatctcaccttgcctcctgtataccaggcctatttccctgcagggtctgaaacaacatttcagagtctgaaacaacatttctcggtctgaaacaacatttcgacgtctgaaacaacatttcctagtctgaaacaacatttcactgtctgaaacaacatttctgcggcgcgccatgcttcatcagactct

SEQ ID NO: 11089 - DNA, 191 bp, Artificial Sequence; identical to SEQ ID NO: 11088
  Synthetic polynucleotide

SEQ ID NO: 11090 - DNA, 180 bp, Artificial Sequence
  Synthetic polynucleotide
atcatctcaccttgcctcctgagaagcatggatacgtccctgcagggcgggaagtggagagcgggaagtggtcggcgggaagtgggacgcgggaagtggctagcgggaagtggactgcgggaagtggtgcgcgggaagtgggtagcgggaagtggggcgcgccatgcttcatcagactct

SEQ ID NO: 11091 - DNA, 180 bp, Artificial Sequence; identical to SEQ ID NO: 11090
  Synthetic polynucleotide

SEQ ID NO: 11092 - DNA, 197 bp, Artificial Sequence
  Synthetic polynucleotide
atcatctcaccttgcctcctgtcccttgtgacatgatgcctgcaggaagaacagaatgttcagaaagaacagaatgttctcgaagaacagaatgttcgacaagaacagaatgttcctaaagaacagaatgttcactaagaacagaatgttctgcaagaacagaatgttcgtaggcgcgccatgcttcatcagactct

SEQ ID NO: 11093 - DNA, 197 bp, Artificial Sequence; identical to SEQ ID NO: 11092
  Synthetic polynucleotide

SEQ ID NO: 11094 - DNA, 156 bp, Artificial Sequence
  Synthetic polynucleotide
atcatctcaccttgcctcctgttaagcagaagatctgccctgcaggtcattaaaagatcattaaatcgtcattaaagactcattaaactatcattaaaacttcattaaatgctcattaaagtatcattaaaggcgcgccatgcttcatcagactct

SEQ ID NO: 11095 - DNA, 156 bp, Artificial Sequence; identical to SEQ ID NO: 11094
  Synthetic polynucleotide

SEQ ID NO: 11096 - DNA, 180 bp, Artificial Sequence
  Synthetic polynucleotide
atcatctcaccttgcctcctgtattccaattgtctgcccctgcaggactgagtcaccagaactgagtcacctcgactgagtcaccgacactgagtcaccctaactgagtcaccactactgagtcacctgcactgagtcaccgtaactgagtcaccggcgcgccatgcttcatcagactct

SEQ ID NO: 11097 - DNA, 180 bp, Artificial Sequence; identical to SEQ ID NO: 11096
  Synthetic polynucleotide

SEQ ID NO: 11098 - DNA, 200 bp, Artificial Sequence
  Synthetic polynucleotide
atcatctcaccttgcctcctgtgcaggtcgacgtgttacctgcagggcatgtgacaccgccgtggagagcatgtgacaccgccgtggtcggcatgtgacaccgccgtgggacgcatgtgacaccgccgtggctagcatgtgacaccgccgtggactgcatgtgacaccgccgtggggcgcgccatgcttcatcagactct

SEQ ID NO: 11099 - DNA, 200 bp, Artificial Sequence; identical to SEQ ID NO: 11098
  Synthetic polynucleotide

SEQ ID NO: 11100 - DNA, 148 bp, Artificial Sequence
  Synthetic polynucleotide
atcatctcaccttgcctcctgcttgaagtcacccggaacctgcaggctttgtcagactttgtctcgctttgtcgacctttgtcctactttgtcactctttgtctgcctttgtcgtactttgtcggcgcgccatgcttcatcagactct

SEQ ID NO: 11101 - DNA, 148 bp, Artificial Sequence; identical to SEQ ID NO: 11100
  Synthetic polynucleotide

SEQ ID NO: 11102 - DNA, 180 bp, Artificial Sequence
  Synthetic polynucleotide
atcatctcaccttgcctcctgtgagacgaggcaactcacctgcagggtcgcccccacagagtcgcccccactcggtcgcccccacgacgtcgcccccacctagtcgcccccacactgtcgcccccactgcgtcgcccccacgtagtcgcccccacggcgcgccatgcttcatcagactct

SEQ ID NO: 11103 - DNA, 180 bp, Artificial Sequence; identical to SEQ ID NO: 11102
  Synthetic polynucleotide

SEQ ID NO: 11104 - DNA, 148 bp, Artificial Sequence
  Synthetic polynucleotide
atcatctcaccttgcctcctgatttacgaggcagttcccctgcaggttatctgagattatctgtcgttatctggacttatctgctattatctgactttatctgtgcttatctggtattatctgggcgcgccatgcttcatcagactct

SEQ ID NO: 11105 - DNA, 148 bp, Artificial Sequence; identical to SEQ ID NO: 11104
  Synthetic polynucleotide

SEQ ID NO: 11106 - DNA, 197 bp, Artificial Sequence
  Synthetic polynucleotide
atcatctcaccttgcctcctgacggttgtgtctcctcgcctgcagggagaattcatactggagagagaattcatactggtcggagaattcatactgggacgagaattcatactggctagagaattcatactggactgagaattcatactggtgcgagaattcatactgggtaggcgcgccatgcttcatcagactct

SEQ ID NO: 11107 - DNA, 197 bp, Artificial Sequence; identical to SEQ ID NO: 11106
  Synthetic polynucleotide

SEQ ID NO: 11108 - DNA, 156 bp, Artificial Sequence
  Synthetic polynucleotide
atcatctcaccttgcctcctgagctgtaccagactcgccctgcaggattaattaagaattaattatcgattaattagacattaattactaattaattaactattaattatgcattaattagtaattaattaggcgcgccatgcttcatcagactct

SEQ ID NO: 11109 - DNA, 156 bp, Artificial Sequence; identical to SEQ ID NO: 11108
  Synthetic polynucleotide

SEQ ID NO: 11110 - DNA, 191 bp, Artificial Sequence
  Synthetic polynucleotide
atcatctcaccttgcctcctgataaggctggcggtcgtcctgcaggtccatcccataatactcagatccatcccataatactctcgtccatcccataatactcgactccatcccataatactcctatccatcccataatactcacttccatcccataatactctgcggcgcgccatgcttcatcagactct

SEQ ID NO: 11111 - DNA, 191 bp, Artificial Sequence; identical to SEQ ID NO: 11110
  Synthetic polynucleotide

SEQ ID NO: 11112 - DNA, 156 bp, Artificial Sequence
  Synthetic polynucleotide
atcatctcaccttgcctcctggtagatcgagctttggccctgcaggtggtaccaagatggtaccatcgtggtaccagactggtaccactatggtaccaacttggtaccatgctggtaccagtatggtaccaggcgcgccatgcttcatcagactct

SEQ ID NO: 11113 - DNA, 156 bp, Artificial Sequence; identical to SEQ ID NO: 11112
  Synthetic polynucleotide

SEQ ID NO: 11114 - DNA, 197 bp, Artificial Sequence
  Synthetic polynucleotide
atcatctcaccttgcctcctgtgcgtcagtaacggtatcctgcaggttgccttatatgggcatgagattgccttatatgggcatgtcgttgccttatatgggcatggacttgccttatatgggcatgctattgccttatatgggcatgactttgccttatatgggcatgtgcggcgcgccatgcttcatcagactct

SEQ ID NO: 11115 - DNA, 197 bp, Artificial Sequence; identical to SEQ ID NO: 11114
  Synthetic polynucleotide

SEQ ID NO: 11116 - DNA, 197 bp, Artificial Sequence
  Synthetic polynucleotide
atcatctcaccttgcctcctgcccacgagtcgatctgtcctgcaggtatagtaacagtcacagatatagtaacagtcactcgtatagtaacagtcacgactatagtaacagtcacctatatagtaacagtcacacttatagtaacagtcactgctatagtaacagtcacgtaggcgcgccatgcttcatcagactct

SEQ ID NO: 11117 - DNA, 197 bp, Artificial Sequence; identical to SEQ ID NO: 11116
  Synthetic polynucleotide

SEQ ID NO: 11118 - DNA, 172 bp, Artificial Sequence
  Synthetic polynucleotide
atcatctcaccttgcctcctggcgaatatggcccatgccctgcaggacgcgtgacgagaacgcgtgacgtcgacgcgtgacggacacgcgtgacgctaacgcgtgacgactacgcgtgacgtgcacgcgtgacggtaacgcgtgacgggcgcgccatgcttcatcagactct

SEQ ID NO: 11119 - DNA, 172 bp, Artificial Sequence; identical to SEQ ID NO: 11118
  Synthetic polynucleotide

SEQ ID NO: 11120 - DNA, 172 bp, Artificial Sequence
  Synthetic polynucleotide
atcatctcaccttgcctcctgatcgtgaagcaaggtaacctgcaggaacatatggcagaaacatatggctcgaacatatggcgacaacatatggcctaaacatatggcactaacatatggctgcaacatatggcgtaaacatatggcggcgcgccatgcttcatcagactct

SEQ ID NO: 11121 - DNA, 172 bp, Artificial Sequence; identical to SEQ ID NO: 11120
  Synthetic polynucleotide

SEQ ID NO: 11122 - DNA, 190 bp, Artificial Sequence
  Synthetic polynucleotide
atcatctcaccttgcctcctgccttgaccgtcgttagccctgcaggtgaatgtgcagtcaagatgaatgtgcagtcatcgtgaatgtgcagtcagactgaatgtgcagtcactatgaatgtgcagtcaacttgaatgtgcagtcatgctgaatgtgcagtcagtaggcgcgccatgcttcatcagactct

SEQ ID NO: 11123 - DNA, 190 bp, Artificial Sequence; identical to SEQ ID NO: 11122
  Synthetic polynucleotide

SEQ ID NO: 11124 - DNA, 172 bp, Artificial Sequence
  Synthetic polynucleotide
atcatctcaccttgcctcctggtgatattcgtgcatgacctgcagggaattgtagtagagaattgtagttcggaattgtagtgacgaattgtagtctagaattgtagtactgaattgtagttgcgaattgtagtgtagaattgtagtggcgcgccatgcttcatcagactct

SEQ ID NO: 11125 - DNA, 172 bp, Artificial Sequence; identical to SEQ ID NO: 11124
  Synthetic polynucleotide

SEQ ID NO: 11126 - DNA, 172 bp, Artificial Sequence
  Synthetic polynucleotide
atcatctcaccttgcctcctggaattcggagaaggtttcctgcaggctcattggctagactcattggcttcgctcattggctgacctcattggctctactcattggctactctcattggcttgcctcattggctgtactcattggctggcgcgccatgcttcatcagactct

SEQ ID NO: 11127 - DNA, 172 bp, Artificial Sequence; identical to SEQ ID NO: 11126
  Synthetic polynucleotide

SEQ ID NO: 11128 - DNA, 191 bp, Artificial Sequence
  Synthetic polynucleotide
atcatctcaccttgcctcctgaccaagcgctcattgcccctgcaggcacgtgctaaccacgtgagacacgtgctaaccacgtgtcgcacgtgctaaccacgtggaccacgtgctaaccacgtgctacacgtgctaaccacgtgactcacgtgctaaccacgtgtgcggcgcgccatgcttcatcagactct

SEQ ID NO: 11129 - DNA, 191 bp, Artificial Sequence; identical to SEQ ID NO: 11128
  Synthetic polynucleotide

SEQ ID NO: 11130 - DNA, 172 bp, Artificial Sequence
  Synthetic polynucleotide
atcatctcaccttgcctcctgaggaagcacatcacacacctgcaggggggatttccagaggggatttcctcgggggatttccgacggggatttccctaggggatttccactggggatttcctgcggggatttccgtaggggatttccggcgcgccatgcttcatcagactct

SEQ ID NO: 11131 - DNA, 172 bp, Artificial Sequence; identical to SEQ ID NO: 11130
  Synthetic polynucleotide

SEQ ID NO: 11132 - DNA, 172 bp, Artificial Sequence
  Synthetic polynucleotide
atcatctcaccttgcctcctgaatgcttctggttggtccctgcaggggtgagtcatagaggtgagtcattcgggtgagtcatgacggtgagtcatctaggtgagtcatactggtgagtcattgcggtgagtcatgtaggtgagtcatggcgcgccatgcttcatcagactct

SEQ ID NO: 11133 - DNA, 172 bp, Artificial Sequence; identical to SEQ ID NO: 11132
  Synthetic polynucleotide

SEQ ID NO: 11134 - DNA, 196 bp, Artificial Sequence
  Synthetic polynucleotide
atcatctcaccttgcctcctgagaggagaccaccactccctgcaggatcagataaggggagaatcagataaggggtcgatcagataagggggacatcagataaggggctaatcagataaggggactatcagataaggggtgcatcagataagggggtaatcagataaggggggcgcgccatgcttcatcagactct

SEQ ID NO: 11135 - DNA, 196 bp, Artificial Sequence; identical to SEQ ID NO: 11134
  Synthetic polynucleotide

SEQ ID NO: 11136 - DNA, 185 bp, Artificial Sequence
  Synthetic polynucleotide
atcatctcaccttgcctcctgaagtgccagactcacaacctgcaggcaagtgggggggggggagacaagtgggggggggggtcgcaagtggggggggggggaccaagtgggggggggggctacaagtgggggggggggactcaagtgggggggggggtgcggcgcgccatgcttcatcagactct

SEQ ID NO: 11137 - DNA, 185 bp, Artificial Sequence; identical to SEQ ID NO: 11136
  Synthetic polynucleotide

SEQ ID NO: 11138 - DNA, 191 bp, Artificial Sequence
  Synthetic polynucleotide
atcatctcaccttgcctcctgatagacgaatggccagccctgcaggtgataggtgtcatttatagatgataggtgtcatttattcgtgataggtgtcatttatgactgataggtgtcatttatctatgataggtgtcatttatacttgataggtgtcatttattgcggcgcgccatgcttcatcagactct

SEQ ID NO: 11139 - DNA, 191 bp, Artificial Sequence; identical to SEQ ID NO: 11138
  Synthetic polynucleotide

SEQ ID NO: 11140 - DNA, 148 bp, Artificial Sequence
  Synthetic polynucleotide
atcatctcaccttgcctcctggttattaaaccgtggttcctgcaggcccggagagacccggagtcgcccggaggaccccggagctacccggagactcccggagtgccccggaggtacccggagggcgcgccatgcttcatcagactct

SEQ ID NO: 11141 - DNA, 148 bp, Artificial Sequence; identical to SEQ ID NO: 11140
  Synthetic polynucleotide

SEQ ID NO: 11142 - DNA, 180 bp, Artificial Sequence
  Synthetic polynucleotide
atcatctcaccttgcctcctgggatgaatcagcggatccctgcaggtacttccgggtagatacttccgggttcgtacttccgggtgactacttccgggtctatacttccgggtacttacttccgggttgctacttccgggtgtatacttccgggtggcgcgccatgcttcatcagactct

SEQ ID NO: 11143 - DNA, 180 bp, Artificial Sequence; identical to SEQ ID NO: 11142
  Synthetic polynucleotide

SEQ ID NO: 11144 - DNA, 185 bp, Artificial Sequence
  Synthetic polynucleotide
atcatctcaccttgcctcctgagaagtggaacgaatcccctgcaggctattttacgactttaagactattttacgactttatcgctattttacgactttagacctattttacgactttactactattttacgactttaactctattttacgactttatgcggcgcgccatgcttcatcagactct

SEQ ID NO: 11145 - DNA, 185 bp, Artificial Sequence; identical to SEQ ID NO: 11144
  Synthetic polynucleotide

SEQ ID NO: 11146 - DNA, 180 bp, Artificial Sequence
  Synthetic polynucleotide
atcatctcaccttgcctcctgtgccgtttcacgtatcccctgcaggagtaccgttatagaagtaccgttattcgagtaccgttatgacagtaccgttatctaagtaccgttatactagtaccgttattgcagtaccgttatgtaagtaccgttatggcgcgccatgcttcatcagactct

SEQ ID NO: 11147 - DNA, 180 bp, Artificial Sequence; identical to SEQ ID NO: 11146
  Synthetic polynucleotide

SEQ ID NO: 11148 - DNA, 196 bp, Artificial Sequence
  Synthetic polynucleotide
atcatctcaccttgcctcctgcatgggagttaaagggccctgcaggaggggacgcagctgcgccccctagaaggggacgcagctgcgcccccttcgaggggacgcagctgcgccccctgacaggggacgcagctgcgccccctctaaggggacgcagctgcgccccctactggcgcgccatgcttcatcagactct

SEQ ID NO: 11149 - DNA, 196 bp, Artificial Sequence; identical to SEQ ID NO: 11148
  Synthetic polynucleotide

SEQ ID NO: 11150 - DNA, 148 bp, Artificial Sequence
  Synthetic polynucleotide
atcatctcaccttgcctcctgggtcaagtacgcctcttcctgcagggcgggggagagcgggggtcggcggggggacgcgggggctagcgggggactgcgggggtgcgcggggggtagcgggggggcgcgccatgcttcatcagactct

SEQ ID NO: 11151 - DNA, 148 bp, Artificial Sequence; identical to SEQ ID NO: 11150
  Synthetic polynucleotide

SEQ ID NO: 11152 - DNA, 185 bp, Artificial Sequence
  Synthetic polynucleotide
atcatctcaccttgcctcctgggcgggacagttctgaacctgcaggttggcgcgaaacgggcagattggcgcgaaacgggctcgttggcgcgaaacgggcgacttggcgcgaaacgggcctattggcgcgaaacgggcactttggcgcgaaacgggctgcggcgcgccatgcttcatcagactct

SEQ ID NO: 11153 - DNA, 185 bp, Artificial Sequence; identical to SEQ ID NO: 11152
  Synthetic polynucleotide

SEQ ID NO: 11154 - DNA, 197 bp, Artificial Sequence
  Synthetic polynucleotide
atcatctcaccttgcctcctgaagaacaacaattggtccctgcaggaaactacatttcccaagaaaactacatttcccatcgaaactacatttcccagacaaactacatttcccactaaaactacatttcccaactaaactacatttcccatgcaaactacatttcccagtaggcgcgccatgcttcatcagactct

SEQ ID NO: 11155 - DNA, 197 bp, Artificial Sequence; identical to SEQ ID NO: 11154
  Synthetic polynucleotide

SEQ ID NO: 11156 - DNA, 188 bp, Artificial Sequence
  Synthetic polynucleotide
atcatctcaccttgcctcctggcgtgatggcatgtgcacctgcaggccttacgtcaccagaccttacgtcacctcgccttacgtcaccgacccttacgtcaccctaccttacgtcaccactccttacgtcacctgcccttacgtcaccgtaccttacgtcaccggcgcgccatgcttcatcagactct

SEQ ID NO: 11157 - DNA, 188 bp, Artificial Sequence; identical to SEQ ID NO: 11156
  Synthetic polynucleotide

SEQ ID NO: 11158 - DNA, 196 bp, Artificial Sequence
  Synthetic polynucleotide
atcatctcaccttgcctcctgatcttcccagccgtgaccctgcaggtgcatcaatcattagatgcatcaatcatttcgtgcatcaatcattgactgcatcaatcattctatgcatcaatcattacttgcatcaatcatttgctgcatcaatcattgtatgcatcaatcattggcgcgccatgcttcatcagactct

SEQ ID NO: 11159 - DNA, 196 bp, Artificial Sequence; identical to SEQ ID NO: 11158
  Synthetic polynucleotide

SEQ ID NO: 11160 - DNA, 191 bp, Artificial Sequence
  Synthetic polynucleotide
atcatctcaccttgcctcctgtgtaaagcgtaacaatccctgcaggaatcgctaattagcgctagaaatcgctaattagcgcttcgaatcgctaattagcgctgacaatcgctaattagcgctctaaatcgctaattagcgctactaatcgctaattagcgcttgcggcgcgccatgcttcatcagactct

SEQ ID NO: 11161 - DNA, 191 bp, Artificial Sequence; identical to SEQ ID NO: 11160
  Synthetic polynucleotide

SEQ ID NO: 11162 - DNA, 191 bp, Artificial Sequence
  Synthetic polynucleotide
atcatctcaccttgcctcctggagggtgaacaactatacctgcaggccggttcaaaccggttctggcagaccggttcaaaccggttctggctcgccggttcaaaccggttctggcgacccggttcaaaccggttctggcctaccggttcaaaccggttctggcactggcgcgccatgcttcatcagactct

SEQ ID NO: 11163 - DNA, 191 bp, Artificial Sequence; identical to SEQ ID NO: 11162
  Synthetic polynucleotide

SEQ ID NO: 11164 - DNA, 188 bp, Artificial Sequence
  Synthetic polynucleotide
atcatctcaccttgcctcctgattgcatacatccgcaccctgcaggctcccctgccgcagactcccctgccgctcgctcccctgccgcgacctcccctgccgcctactcccctgccgcactctcccctgccgctgcctcccctgccgcgtactcccctgccgcggcgcgccatgcttcatcagactct

SEQ ID NO: 11165 - DNA, 188 bp, Artificial Sequence; identical to SEQ ID NO: 11164
  Synthetic polynucleotide

SEQ ID NO: 11166 - DNA, 172 bp, Artificial Sequence
  Synthetic polynucleotide
atcatctcaccttgcctcctgacctgggctcactctaccctgcaggggtgagtcacagaggtgagtcactcgggtgagtcacgacggtgagtcacctaggtgagtcacactggtgagtcactgcggtgagtcacgtaggtgagtcacggcgcgccatgcttcatcagactct

SEQ ID NO: 11167 - DNA, 172 bp, Artificial Sequence; identical to SEQ ID NO: 11166
  Synthetic polynucleotide

SEQ ID NO: 11168 - DNA, 191 bp, Artificial Sequence
  Synthetic polynucleotide
atcatctcaccttgcctcctgatccggccgagctatgacctgcaggtgcagtcatgcgtgacgagatgcagtcatgcgtgacgtcgtgcagtcatgcgtgacggactgcagtcatgcgtgacgctatgcagtcatgcgtgacgacttgcagtcatgcgtgacgtgcggcgcgccatgcttcatcagactct

SEQ ID NO: 11169 - DNA, 191 bp, Artificial Sequence; identical to SEQ ID NO: 11168
  Synthetic polynucleotide

SEQ ID NO: 11170 - DNA, 185 bp, Artificial Sequence
  Synthetic polynucleotide
atcatctcaccttgcctcctgagcctcggttggtgatacctgcagggggtcaacgagttcacagagggtcaacgagttcactcggggtcaacgagttcacgacgggtcaacgagttcacctagggtcaacgagttcacactgggtcaacgagttcactgcggcgcgccatgcttcatcagactct

SEQ ID NO: 11171 - DNA, 185 bp, Artificial Sequence; identical to SEQ ID NO: 11170
  Synthetic polynucleotide

SEQ ID NO: 11172 - DNA, 185 bp, Artificial Sequence
  Synthetic polynucleotide
atcatctcaccttgcctcctgcgacaactagcatcaagcctgcaggcaaattgatacattgtagacaaattgatacattgttcgcaaattgatacattgtgaccaaattgatacattgtctacaaattgatacattgtactcaaattgatacattgttgcggcgcgccatgcttcatcagactct

SEQ ID NO: 11173 - DNA, 185 bp, Artificial Sequence; identical to SEQ ID NO: 11172
  Synthetic polynucleotide

SEQ ID NO: 11174 - DNA, 197 bp, Artificial Sequence
  Synthetic polynucleotide
atcatctcaccttgcctcctgcgcctatattcctgaatcctgcaggaccgttgctatggtaagaaccgttgctatggtatcgaccgttgctatggtagacaccgttgctatggtactaaccgttgctatggtaactaccgttgctatggtatgcaccgttgctatggtagtaggcgcgccatgcttcatcagactct

SEQ ID NO: 11175 - DNA, 197 bp, Artificial Sequence; identical to SEQ ID NO: 11174
  Synthetic polynucleotide

SEQ ID NO: 11176 - DNA, 196 bp, Artificial Sequence
  Synthetic polynucleotide
atcatctcaccttgcctcctgggcagccattcctagttcctgcagggtgcaacaggtggagagtgcaacaggtggtcggtgcaacaggtgggacgtgcaacaggtggctagtgcaacaggtggactgtgcaacaggtggtgcgtgcaacaggtgggtagtgcaacaggtggggcgcgccatgcttcatcagactct

SEQ ID NO: 11177 - DNA, 196 bp, Artificial Sequence; identical to SEQ ID NO: 11176
  Synthetic polynucleotide

SEQ ID NO: 11178 - DNA, 172 bp, Artificial Sequence
  Synthetic polynucleotide
atcatctcaccttgcctcctgatactccagatacgccacctgcagggatcacgtggagagatcacgtggtcggatcacgtgggacgatcacgtggctagatcacgtggactgatcacgtggtgcgatcacgtgggtagatcacgtggggcgcgccatgcttcatcagactct

SEQ ID NO: 11179 - DNA, 172 bp, Artificial Sequence; identical to SEQ ID NO: 11178
  Synthetic polynucleotide

SEQ ID NO: 11180 - DNA, 172 bp, Artificial Sequence
  Synthetic polynucleotide
atcatctcaccttgcctcctgtgcatggtcatggacaccctgcaggagatcaaaggagaagatcaaaggtcgagatcaaagggacagatcaaaggctaagatcaaaggactagatcaaaggtgcagatcaaagggtaagatcaaaggggcgcgccatgcttcatcagactct

SEQ ID NO: 11181 - DNA, 172 bp, Artificial Sequence; identical to SEQ ID NO: 11180
  Synthetic polynucleotide

SEQ ID NO: 11182 - DNA, 164 bp, Artificial Sequence
  Synthetic polynucleotide
atcatctcaccttgcctcctgtcatcaaaccgtgttgtcctgcaggtcttaattaagatcttaattatcgtcttaattagactcttaattactatcttaattaacttcttaattatgctcttaattagtatcttaattaggcgcgccatgcttcatcagactct

SEQ ID NO: 11183 - DNA, 164 bp, Artificial Sequence; identical to SEQ ID NO: 11182
  Synthetic polynucleotide

SEQ ID NO: 11184 - DNA, 190 bp, Artificial Sequence
  Synthetic polynucleotide
atcatctcaccttgcctcctgtctcgaggacagacccacctgcaggtcgaggctagaccaagatcgaggctagaccatcgtcgaggctagaccagactcgaggctagaccactatcgaggctagaccaacttcgaggctagaccatgctcgaggctagaccagtaggcgcgccatgcttcatcagactct

SEQ ID NO: 11185 - DNA, 190 bp, Artificial Sequence; identical to SEQ ID NO: 11184
  Synthetic polynucleotide

SEQ ID NO: 11186 - DNA, 188 bp, Artificial Sequence
  Synthetic polynucleotide
atcatctcaccttgcctcctggtatgctaacgcgacaccctgcaggcttaattgctttagacttaattgcttttcgcttaattgctttgaccttaattgctttctacttaattgctttactcttaattgcttttgccttaattgctttgtacttaattgctttggcgcgccatgcttcatcagactct

SEQ ID NO: 11187 - DNA, 188 bp, Artificial Sequence; identical to SEQ ID NO: 11186
  Synthetic polynucleotide

SEQ ID NO: 11188 - DNA, 172 bp, Artificial Sequence
  Synthetic polynucleotide
atcatctcaccttgcctcctggtacgtggaacagagcacctgcaggattccagacaagaattccagacatcgattccagacagacattccagacactaattccagacaactattccagacatgcattccagacagtaattccagacaggcgcgccatgcttcatcagactct

SEQ ID NO: 11189 - DNA, 172 bp, Artificial Sequence; identical to SEQ ID NO: 11188
  Synthetic polynucleotide

SEQ ID NO: 11190 - DNA, 180 bp, Artificial Sequence
  Synthetic polynucleotide
atcatctcaccttgcctcctgtgtcagttgaagcggatcctgcaggggatcacgtggagaggatcacgtggtcgggatcacgtgggacggatcacgtggctaggatcacgtggactggatcacgtggtgcggatcacgtgggtaggatcacgtggggcgcgccatgcttcatcagactct

SEQ ID NO: 11191 - DNA, 180 bp, Artificial Sequence; identical to SEQ ID NO: 11190
  Synthetic polynucleotide

SEQ ID NO: 11192 - DNA, 191 bp, Artificial Sequence
  Synthetic polynucleotide
atcatctcaccttgcctcctgagtaagcttgactccatcctgcaggcaagttaattaataatcagacaagttaattaataatctcgcaagttaattaataatcgaccaagttaattaataatcctacaagttaattaataatcactcaagttaattaataatctgcggcgcgccatgcttcatcagactct

SEQ ID NO: 11193 - DNA, 191 bp, Artificial Sequence; identical to SEQ ID NO: 11192
  Synthetic polynucleotide

SEQ ID NO: 11194 - DNA, 172 bp, Artificial Sequence
  Synthetic polynucleotide
atcatctcaccttgcctcctgccatgcattcgcgttctcctgcaggggggggcgggagaggggggcgggtcgggggggcggggacggggggcgggctaggggggcgggactggggggcgggtgcggggggcggggtaggggggcgggggcgcgccatgcttcatcagactct

SEQ ID NO: 11195 - DNA, 172 bp, Artificial Sequence; identical to SEQ ID NO: 11194
  Synthetic polynucleotide

SEQ ID NO: 11196 - DNA, 180 bp, Artificial Sequence
  Synthetic polynucleotide
atcatctcaccttgcctcctgggaactgtgacccttcccctgcaggtgtgactcattagatgtgactcatttcgtgtgactcattgactgtgactcattctatgtgactcattacttgtgactcatttgctgtgactcattgtatgtgactcattggcgcgccatgcttcatcagactct

SEQ ID NO: 11197 - DNA, 180 bp, Artificial Sequence; identical to SEQ ID NO: 11196
  Synthetic polynucleotide

SEQ ID NO: 11198 - DNA, 156 bp, Artificial Sequence
  Synthetic polynucleotide
atcatctcaccttgcctcctgattccaacactcgctttcctgcaggctacgtttagactacgttttcgctacgtttgacctacgtttctactacgtttactctacgttttgcctacgtttgtactacgtttggcgcgccatgcttcatcagactct

SEQ ID NO: 11199 - DNA, 156 bp, Artificial Sequence; identical to SEQ ID NO: 11198
  Synthetic polynucleotide

SEQ ID NO: 11200 - DNA, 172 bp, Artificial Sequence
  Synthetic polynucleotide
atcatctcaccttgcctcctgacagcatccgatgcttgcctgcaggtcaagtgggaagatcaagtgggatcgtcaagtgggagactcaagtgggactatcaagtgggaacttcaagtgggatgctcaagtgggagtatcaagtgggaggcgcgccatgcttcatcagactct

SEQ ID NO: 11201 - DNA, 172 bp, Artificial Sequence; identical to SEQ ID NO: 11200
  Synthetic polynucleotide

SEQ ID NO: 11202 - DNA, 197 bp, Artificial Sequence
  Synthetic polynucleotide
atcatctcaccttgcctcctggcgacttactccacgttcctgcagggaaagtgaaactgaaagagaaagtgaaactgaatcggaaagtgaaactgaagacgaaagtgaaactgaactagaaagtgaaactgaaactgaaagtgaaactgaatgcgaaagtgaaactgaagtaggcgcgccatgcttcatcagactct

SEQ ID NO: 11203 - DNA, 197 bp, Artificial Sequence; identical to SEQ ID NO: 11202
  Synthetic polynucleotide

SEQ ID NO: 11204 - DNA, 148 bp, Artificial Sequence
  Synthetic polynucleotide
atcatctcaccttgcctcctgggtccacatcttgcgatcctgcaggtggggtgagatggggtgtcgtggggtggactggggtgctatggggtgacttggggtgtgctggggtggtatggggtgggcgcgccatgcttcatcagactct

SEQ ID NO: 11205 - DNA, 148 bp, Artificial Sequence; identical to SEQ ID NO: 11204
  Synthetic polynucleotide

SEQ ID NO: 11206 - DNA, 164 bp, Artificial Sequence
  Synthetic polynucleotide
atcatctcaccttgcctcctgcaggaatactcaggctgcctgcaggaggatgaatagaaggatgaattcgaggatgaatgacaggatgaatctaaggatgaatactaggatgaattgcaggatgaatgtaaggatgaatggcgcgccatgcttcatcagactct

SEQ ID NO: 11207 - DNA, 164 bp, Artificial Sequence; identical to SEQ ID NO: 11206
  Synthetic polynucleotide

SEQ ID NO: 11208 - DNA, 197 bp, Artificial Sequence
  Synthetic polynucleotide
atcatctcaccttgcctcctgcgtaaggcacaaattaccctgcaggcaagatggcggccccagacaagatggcggcccctcgcaagatggcggccccgaccaagatggcggccccctacaagatggcggccccactcaagatggcggcccctgccaagatggcggccccgtaggcgcgccatgcttcatcagactct

SEQ ID NO: 11209 - DNA, 197 bp, Artificial Sequence; identical to SEQ ID NO: 11208
  Synthetic polynucleotide

SEQ ID NO: 11210 - DNA, 140 bp, Artificial Sequence
  Synthetic polynucleotide
atcatctcaccttgcctcctgaatctggatcagtacaacctgcaggcatgacagacatgactcgcatgacgaccatgacctacatgacactcatgactgccatgacgtacatgacggcgcgccatgcttcatcagactct

SEQ ID NO: 11211 - DNA, 140 bp, Artificial Sequence; identical to SEQ ID NO: 11210
  Synthetic polynucleotide

SEQ ID NO: 11212 - DNA, 191 bp, Artificial Sequence
  Synthetic polynucleotide
atcatctcaccttgcctcctgcggatgtaaactcaacacctgcagggatgaatggtattcatgagagatgaatggtattcatgtcggatgaatggtattcatggacgatgaatggtattcatgctagatgaatggtattcatgactgatgaatggtattcatgtgcggcgcgccatgcttcatcagactct

SEQ ID NO: 11213 - DNA, 191 bp, Artificial Sequence; identical to SEQ ID NO: 11212
  Synthetic polynucleotide

SEQ ID NO: 11214 - DNA, 200 bp, Artificial Sequence
  Synthetic polynucleotide
atcatctcaccttgcctcctggcctatgacactgaggtcctgcaggactacaactcccagcaggcagaactacaactcccagcaggctcgactacaactcccagcaggcgacactacaactcccagcaggcctaactacaactcccagcaggcactactacaactcccagcaggcggcgcgccatgcttcatcagactct

SEQ ID NO: 11215 - DNA, 200 bp, Artificial Sequence; identical to SEQ ID NO: 11214
  Synthetic polynucleotide

SEQ ID NO: 11216 - DNA, 164 bp, Artificial Sequence
  Synthetic polynucleotide
atcatctcaccttgcctcctgttcataccagacaattgcctgcaggactcattgaagaactcattgatcgactcattgagacactcattgactaactcattgaactactcattgatgcactcattgagtaactcattgaggcgcgccatgcttcatcagactct

SEQ ID NO: 11217 - DNA, 164 bp, Artificial Sequence; identical to SEQ ID NO: 11216
  Synthetic polynucleotide

SEQ ID NO: 11218 - DNA, 172 bp, Artificial Sequence
  Synthetic polynucleotide
atcatctcaccttgcctcctgctctccatcaaactagacctgcagggtcacgcttgagagtcacgcttgtcggtcacgcttggacgtcacgcttgctagtcacgcttgactgtcacgcttgtgcgtcacgcttggtagtcacgcttgggcgcgccatgcttcatcagactct

SEQ ID NO: 11219 - DNA, 172 bp, Artificial Sequence; identical to SEQ ID NO: 11218
  Synthetic polynucleotide

SEQ ID NO: 11220 - DNA, 156 bp, Artificial Sequence
  Synthetic polynucleotide
atcatctcaccttgcctcctggcactgtgaatgcattgcctgcaggtatcaattagatatcaatttcgtatcaattgactatcaattctatatcaattacttatcaatttgctatcaattgtatatcaattggcgcgccatgcttcatcagactct

SEQ ID NO: 11221 - DNA, 156 bp, Artificial Sequence; identical to SEQ ID NO: 11220
  Synthetic polynucleotide

SEQ ID NO: 11222 - DNA, 191 bp, Artificial Sequence
  Synthetic polynucleotide
atcatctcaccttgcctcctgcaagccgggttgatgtccctgcaggtaaactaattagtgaacagataaactaattagtgaactcgtaaactaattagtgaacgactaaactaattagtgaacctataaactaattagtgaacacttaaactaattagtgaactgcggcgcgccatgcttcatcagactct

SEQ ID NO: 11223 - DNA, 191 bp, Artificial Sequence; identical to SEQ ID NO: 11222
  Synthetic polynucleotide

SEQ ID NO: 11224 - DNA, 180 bp, Artificial Sequence
  Synthetic polynucleotide
atcatctcaccttgcctcctgatgtttcattcgcatggcctgcaggcgggcgggaggagacgggcgggaggtcgcgggcgggagggaccgggcgggaggctacgggcgggaggactcgggcgggaggtgccgggcgggagggtacgggcgggaggggcgcgccatgcttcatcagactct

SEQ ID NO: 11225 - DNA, 180 bp, Artificial Sequence; identical to SEQ ID NO: 11224
  Synthetic polynucleotide

SEQ ID NO: 11226 - DNA, 190 bp, Artificial Sequence
  Synthetic polynucleotide
atcatctcaccttgcctcctggtttaataacgaggctacctgcaggagtaaatattaactagaagtaaatattaacttcgagtaaatattaactgacagtaaatattaactctaagtaaatattaactactagtaaatattaacttgcagtaaatattaactgtaggcgcgccatgcttcatcagactct

SEQ ID NO: 11227 - DNA, 190 bp, Artificial Sequence; identical to SEQ ID NO: 11226
  Synthetic polynucleotide

SEQ ID NO: 11228 - DNA, 185 bp, Artificial Sequence
  Synthetic polynucleotide
atcatctcaccttgcctcctggcttcttaagtgcatttcctgcaggaatgccagacgccattagaaatgccagacgccatttcgaatgccagacgccattgacaatgccagacgccattctaaatgccagacgccattactaatgccagacgccatttgcggcgcgccatgcttcatcagactct

SEQ ID NO: 11229 - DNA, 185 bp, Artificial Sequence; identical to SEQ ID NO: 11228
  Synthetic polynucleotide

SEQ ID NO: 11230 - DNA, 172 bp, Artificial Sequence
  Synthetic polynucleotide
atcatctcaccttgcctcctgtatcatgctaccctagccctgcaggttttatgagcagattttatgagctcgttttatgagcgacttttatgagcctattttatgagcactttttatgagctgcttttatgagcgtattttatgagcggcgcgccatgcttcatcagactct

SEQ ID NO: 11231 - DNA, 172 bp, Artificial Sequence; identical to SEQ ID NO: 11230
  Synthetic polynucleotide

SEQ ID NO: 11232 - DNA, 191 bp, Artificial Sequence
  Synthetic polynucleotide
atcatctcaccttgcctcctgtgggaatacgtggaatacctgcagggaaatgttgtttcagacagagaaatgttgtttcagactcggaaatgttgtttcagacgacgaaatgttgtttcagacctagaaatgttgtttcagacactgaaatgttgtttcagactgcggcgcgccatgcttcatcagactct

SEQ ID NO: 11233 - DNA, 191 bp, Artificial Sequence; identical to SEQ ID NO: 11232
  Synthetic polynucleotide

SEQ ID NO: 11234 - DNA, 164 bp, Artificial Sequence
  Synthetic polynucleotide
atcatctcaccttgcctcctgatgcacttacgaatcgccctgcaggattccaggcagaattccaggctcgattccaggcgacattccaggcctaattccaggcactattccaggctgcattccaggcgtaattccaggcggcgcgccatgcttcatcagactct

SEQ ID NO: 11235 - DNA, 164 bp, Artificial Sequence; identical to SEQ ID NO: 11234
  Synthetic polynucleotide

SEQ ID NO: 11236 - DNA, 188 bp, Artificial Sequence
  Synthetic polynucleotide
atcatctcaccttgcctcctgacaagacgtacttcgagcctgcaggcagcagctgctgagacagcagctgctgtcgcagcagctgctggaccagcagctgctgctacagcagctgctgactcagcagctgctgtgccagcagctgctggtacagcagctgctgggcgcgccatgcttcatcagactct

SEQ ID NO: 11237 - DNA, 188 bp, Artificial Sequence; identical to SEQ ID NO: 11236
  Synthetic polynucleotide

SEQ ID NO: 11238 - DNA, 180 bp, Artificial Sequence
  Synthetic polynucleotide
atcatctcaccttgcctcctgaggattagatttgtacgcctgcaggcagccaatgagagacagccaatgagtcgcagccaatgaggaccagccaatgagctacagccaatgagactcagccaatgagtgccagccaatgaggtacagccaatgagggcgcgccatgcttcatcagactct

SEQ ID NO: 11239 - DNA, 180 bp, Artificial Sequence; identical to SEQ ID NO: 11238
  Synthetic polynucleotide

SEQ ID NO: 11240 - DNA, 190 bp, Artificial Sequence
  Synthetic polynucleotide
atcatctcaccttgcctcctgactgcaccattgttctacctgcaggagaaagttctagaaagaagaaagttctagaatcgagaaagttctagaagacagaaagttctagaactaagaaagttctagaaactagaaagttctagaatgcagaaagttctagaagtaggcgcgccatgcttcatcagactct

SEQ ID NO: 11241 - DNA, 190 bp, Artificial Sequence; identical to SEQ ID NO: 11240
  Synthetic polynucleotide

SEQ ID NO: 11242 - DNA, 196 bp, Artificial Sequence
  Synthetic polynucleotide
atcatctcaccttgcctcctgtggcatattgggagatgcctgcaggtatgcataaattaagatatgcataaattatcgtatgcataaattagactatgcataaattactatatgcataaattaacttatgcataaattatgctatgcataaattagtatatgcataaattaggcgcgccatgcttcatcagactct

SEQ ID NO: 11243 - DNA, 196 bp, Artificial Sequence; identical to SEQ ID NO: 11242
  Synthetic polynucleotide

SEQ ID NO: 11244 - DNA, 197 bp, Artificial Sequence
  Synthetic polynucleotide
atcatctcaccttgcctcctgcggagtatcagaggattcctgcaggcgaacccggaagtggagacgaacccggaagtggtcgcgaacccggaagtgggaccgaacccggaagtggctacgaacccggaagtggactcgaacccggaagtggtgccgaacccggaagtgggtaggcgcgccatgcttcatcagactct

SEQ ID NO: 11245 - DNA, 197 bp, Artificial Sequence; identical to SEQ ID NO: 11244
  Synthetic polynucleotide

SEQ ID NO: 11246 - DNA, 180 bp, Artificial Sequence
  Synthetic polynucleotide
atcatctcaccttgcctcctggcattaaatcgagtgggcctgcaggatgagtcacccagaatgagtcaccctcgatgagtcacccgacatgagtcacccctaatgagtcacccactatgagtcaccctgcatgagtcacccgtaatgagtcacccggcgcgccatgcttcatcagactct

SEQ ID NO: 11247 - DNA, 180 bp, Artificial Sequence; identical to SEQ ID NO: 11246
  Synthetic polynucleotide

SEQ ID NO: 11248 - DNA, 164 bp, Artificial Sequence
  Synthetic polynucleotide
atcatctcaccttgcctcctgtaggcaatgcagtcggtcctgcaggcttggcacgagacttggcacgtcgcttggcacggaccttggcacgctacttggcacgactcttggcacgtgccttggcacggtacttggcacgggcgcgccatgcttcatcagactct

SEQ ID NO: 11249 - DNA, 164 bp, Artificial Sequence; identical to SEQ ID NO: 11248
  Synthetic polynucleotide

SEQ ID NO: 11250 - DNA, 188 bp, Artificial Sequence
  Synthetic polynucleotide
atcatctcaccttgcctcctggcctccaattgttgcatcctgcaggataagaggaaatagaataagaggaaattcgataagaggaaatgacataagaggaaatctaataagaggaaatactataagaggaaattgcataagaggaaatgtaataagaggaaatggcgcgccatgcttcatcagactct

SEQ ID NO: 11251 - DNA, 188 bp, Artificial Sequence; identical to SEQ ID NO: 11250
  Synthetic polynucleotide

SEQ ID NO: 11252 - DNA, 185 bp, Artificial Sequence
  Synthetic polynucleotide
atcatctcaccttgcctcctgccagtttgtataactcacctgcagggtcaccatctgttcgaagagtcaccatctgttcgatcggtcaccatctgttcgagacgtcaccatctgttcgactagtcaccatctgttcgaactgtcaccatctgttcgatgcggcgcgccatgcttcatcagactct

SEQ ID NO: 11253 - DNA, 185 bp, Artificial Sequence; identical to SEQ ID NO: 11252
  Synthetic polynucleotide

SEQ ID NO: 11254 - DNA, 172 bp, Artificial Sequence
  Synthetic polynucleotide
atcatctcaccttgcctcctggccgacacatttcctaccctgcagggttgcgggacagagttgcgggactcggttgcgggacgacgttgcgggacctagttgcgggacactgttgcgggactgcgttgcgggacgtagttgcgggacggcgcgccatgcttcatcagactct

SEQ ID NO: 11255 - DNA, 172 bp, Artificial Sequence; identical to SEQ ID NO: 11254
  Synthetic polynucleotide

SEQ ID NO: 11256 - DNA, 180 bp, Artificial Sequence
  Synthetic polynucleotide
atcatctcaccttgcctcctgaactgtaactgcgatggcctgcaggtttccaggaaaagatttccaggaaatcgtttccaggaaagactttccaggaaactatttccaggaaaacttttccaggaaatgctttccaggaaagtatttccaggaaaggcgcgccatgcttcatcagactct

SEQ ID NO: 11257 - DNA, 180 bp, Artificial Sequence; identical to SEQ ID NO: 11256
  Synthetic polynucleotide

SEQ ID NO: 11258 - DNA, 172 bp, Artificial Sequence
  Synthetic polynucleotide
atcatctcaccttgcctcctgatctctagctccgtggccctgcagggccgccgcggagagccgccgcggtcggccgccgcgggacgccgccgcggctagccgccgcggactgccgccgcggtgcgccgccgcgggtagccgccgcggggcgcgccatgcttcatcagactct

SEQ ID NO: 11259 - DNA, 172 bp, Artificial Sequence; identical to SEQ ID NO: 11258
  Synthetic polynucleotide

SEQ ID NO: 11260 - DNA, 191 bp, Artificial Sequence
  Synthetic polynucleotide
atcatctcaccttgcctcctgttctcgtgattagcggccctgcaggatttgcataacaaaggaagaatttgcataacaaaggatcgatttgcataacaaaggagacatttgcataacaaaggactaatttgcataacaaaggaactatttgcataacaaaggatgcggcgcgccatgcttcatcagactct

SEQ ID NO: 11261 - DNA, 191 bp, Artificial Sequence; identical to SEQ ID NO: 11260
  Synthetic polynucleotide

SEQ ID NO: 11262 - DNA, 180 bp, Artificial Sequence
  Synthetic polynucleotide
atcatctcaccttgcctcctgataatggcctagcgtgacctgcaggctcctcgccccagactcctcgcccctcgctcctcgccccgacctcctcgccccctactcctcgccccactctcctcgcccctgcctcctcgccccgtactcctcgccccggcgcgccatgcttcatcagactct

SEQ ID NO: 11263 - DNA, 180 bp, Artificial Sequence; identical to SEQ ID NO: 11262
  Synthetic polynucleotide

SEQ ID NO: 11264 - DNA, 164 bp, Artificial Sequence
  Synthetic polynucleotide
atcatctcaccttgcctcctgtcccgttcaaacccggacctgcaggtatatatatagatatatatattcgtatatatatgactatatatatctatatatatatacttatatatattgctatatatatgtatatatatatggcgcgccatgcttcatcagactct

SEQ ID NO: 11265 - DNA, 164 bp, Artificial Sequence; identical to SEQ ID NO: 11264
  Synthetic polynucleotide

SEQ ID NO: 11266 - DNA, 190 bp, Artificial Sequence
  Synthetic polynucleotide
atcatctcaccttgcctcctgtcggcttctttcgggctcctgcaggcccacagcctcgtcagacccacagcctcgtctcgcccacagcctcgtcgaccccacagcctcgtcctacccacagcctcgtcactcccacagcctcgtctgccccacagcctcgtcgtaggcgcgccatgcttcatcagactct

SEQ ID NO: 11267 - DNA, 190 bp, Artificial Sequence; identical to SEQ ID NO: 11266
  Synthetic polynucleotide

SEQ ID NO: 11268 - DNA, 190 bp, Artificial Sequence
  Synthetic polynucleotide
atcatctcaccttgcctcctgcatctcacttgctgcaccctgcaggggaaagtgaaagcaagaggaaagtgaaagcatcgggaaagtgaaagcagacggaaagtgaaagcactaggaaagtgaaagcaactggaaagtgaaagcatgcggaaagtgaaagcagtaggcgcgccatgcttcatcagactct

SEQ ID NO: 11269 - DNA, 190 bp, Artificial Sequence; identical to SEQ ID NO: 11268
  Synthetic polynucleotide

SEQ ID NO: 11270 - DNA, 197 bp, Artificial Sequence
  Synthetic polynucleotide
atcatctcaccttgcctcctgtacaagccgaccctatgcctgcaggcaggtcaccgtgaccttgagacaggtcaccgtgaccttgtcgcaggtcaccgtgaccttggaccaggtcaccgtgaccttgctacaggtcaccgtgaccttgactcaggtcaccgtgaccttgtgcggcgcgccatgcttcatcagactct

SEQ ID NO: 11271 - DNA, 197 bp, Artificial Sequence; identical to SEQ ID NO: 11270
  Synthetic polynucleotide

SEQ ID NO: 11272 - DNA, 156 bp, Artificial Sequence
  Synthetic polynucleotide
atcatctcaccttgcctcctgcctcaggatctatgtagcctgcaggagctgactagaagctgacttcgagctgactgacagctgactctaagctgactactagctgacttgcagctgactgtaagctgactggcgcgccatgcttcatcagactct

SEQ ID NO: 11273 - DNA, 156 bp, Artificial Sequence; identical to SEQ ID NO: 11272
  Synthetic polynucleotide

SEQ ID NO: 11274 - DNA, 148 bp, Artificial Sequence
  Synthetic polynucleotide
atcatctcaccttgcctcctgaggagaccttctagcctcctgcaggtaagtatagataagtattcgtaagtatgactaagtatctataagtatacttaagtattgctaagtatgtataagtatggcgcgccatgcttcatcagactct

SEQ ID NO: 11275 - DNA, 148 bp, Artificial Sequence; identical to SEQ ID NO: 11274
  Synthetic polynucleotide

SEQ ID NO: 11276 - DNA, 156 bp, Artificial Sequence
  Synthetic polynucleotide
atcatctcaccttgcctcctgacttactagcataacgccctgcaggtgaccttgagatgaccttgtcgtgaccttggactgaccttgctatgaccttgacttgaccttgtgctgaccttggtatgaccttgggcgcgccatgcttcatcagactct

SEQ ID NO: 11277 - DNA, 156 bp, Artificial Sequence; identical to SEQ ID NO: 11276
  Synthetic polynucleotide

SEQ ID NO: 11278 - DNA, 164 bp, Artificial Sequence
  Synthetic polynucleotide
atcatctcaccttgcctcctgtccaggtcaacccaacccctgcagggttaattagagagttaattagtcggttaattaggacgttaattagctagttaattagactgttaattagtgcgttaattaggtagttaattagggcgcgccatgcttcatcagactct

SEQ ID NO: 11279 - DNA, 164 bp, Artificial Sequence; identical to SEQ ID NO: 11278
  Synthetic polynucleotide

SEQ ID NO: 11280 - DNA, 197 bp, Artificial Sequence
  Synthetic polynucleotide
atcatctcaccttgcctcctggacatgatcggttggcgcctgcaggaccgcaccatctgtcagaaccgcaccatctgtctcgaccgcaccatctgtcgacaccgcaccatctgtcctaaccgcaccatctgtcactaccgcaccatctgtctgcaccgcaccatctgtcgtaggcgcgccatgcttcatcagactct

SEQ ID NO: 11281 - DNA, 197 bp, Artificial Sequence; identical to SEQ ID NO: 11280
  Synthetic polynucleotide

SEQ ID NO: 11282 - DNA, 188 bp, Artificial Sequence
  Synthetic polynucleotide
atcatctcaccttgcctcctgacctttccctggtattacctgcaggatgcgtgggcggagaatgcgtgggcggtcgatgcgtgggcgggacatgcgtgggcggctaatgcgtgggcggactatgcgtgggcggtgcatgcgtgggcgggtaatgcgtgggcggggcgcgccatgcttcatcagactct

SEQ ID NO: 11283 - DNA, 188 bp, Artificial Sequence; identical to SEQ ID NO: 11282
  Synthetic polynucleotide

SEQ ID NO: 11284 - DNA, 196 bp, Artificial Sequence
  Synthetic polynucleotide
atcatctcaccttgcctcctgaggcttgctacggtggacctgcagggccttaccaaataagagccttaccaaatatcggccttaccaaatagacgccttaccaaatactagccttaccaaataactgccttaccaaatatgcgccttaccaaatagtagccttaccaaataggcgcgccatgcttcatcagactct

SEQ ID NO: 11285 - DNA, 196 bp, Artificial Sequence; identical to SEQ ID NO: 11284
  Synthetic polynucleotide

SEQ ID NO: 11286 - DNA, 197 bp, Artificial Sequence
  Synthetic polynucleotide
atcatctcaccttgcctcctgtctcacagggcatcagccctgcagggggcaaaggtcagggagagggcaaaggtcagggtcggggcaaaggtcaggggacgggcaaaggtcagggctagggcaaaggtcagggactgggcaaaggtcagggtgcgggcaaaggtcaggggtaggcgcgccatgcttcatcagactct

SEQ ID NO: 11287 - DNA, 197 bp, Artificial Sequence; identical to SEQ ID NO: 11286
  Synthetic polynucleotide

SEQ ID NO: 11288 - DNA, 172 bp, Artificial Sequence
  Synthetic polynucleotide
atcatctcaccttgcctcctgagctatcgcgtggcactcctgcaggagaggtcagtagaagaggtcagttcgagaggtcagtgacagaggtcagtctaagaggtcagtactagaggtcagttgcagaggtcagtgtaagaggtcagtggcgcgccatgcttcatcagactct

SEQ ID NO: 11289 - DNA, 172 bp, Artificial Sequence; identical to SEQ ID NO: 11288
  Synthetic polynucleotide

SEQ ID NO: 11290 - DNA, 180 bp, Artificial Sequence
  Synthetic polynucleotide
atcatctcaccttgcctcctgattgtgatttcagggtgcctgcaggccacttcctgtagaccacttcctgttcgccacttcctgtgacccacttcctgtctaccacttcctgtactccacttcctgttgcccacttcctgtgtaccacttcctgtggcgcgccatgcttcatcagactct

SEQ ID NO: 11291 - DNA, 180 bp, Artificial Sequence; identical to SEQ ID NO: 11290
  Synthetic polynucleotide

SEQ ID NO: 11292 - DNA, 186 bp, Artificial Sequence
  Synthetic polynucleotide
atcatctcaccttgcctcctgatgacagttgcaagaggcctgcaggaggtcagggtgacctgggccagaaggtcagggtgacctgggcctcgaggtcagggtgacctgggccgacaggtcagggtgacctgggccctaaggtcagggtgacctgggccactggcgcgccatgcttcatcagactct

SEQ ID NO: 11293 - DNA, 186 bp, Artificial Sequence; identical to SEQ ID NO: 11292
  Synthetic polynucleotide

SEQ ID NO: 11294 - DNA, 148 bp, Artificial Sequence
  Synthetic polynucleotide
atcatctcaccttgcctcctgcataagagagctggttgcctgcaggcagataaagacagataatcgcagataagaccagataactacagataaactcagataatgccagataagtacagataaggcgcgccatgcttcatcagactct

SEQ ID NO: 11295 - DNA, 148 bp, Artificial Sequence; identical to SEQ ID NO: 11294
  Synthetic polynucleotide

SEQ ID NO: 11296 - DNA, 197 bp, Artificial Sequence
  Synthetic polynucleotide
atcatctcaccttgcctcctgagtgtcgtgacgatcaccctgcagggttctcgcgagatttagagttctcgcgagattttcggttctcgcgagatttgacgttctcgcgagatttctagttctcgcgagatttactgttctcgcgagattttgcgttctcgcgagatttgtaggcgcgccatgcttcatcagactct

SEQ ID NO: 11297 - DNA, 197 bp, Artificial Sequence; identical to SEQ ID NO: 11296
  Synthetic polynucleotide

SEQ ID NO: 11298 - DNA, 186 bp, Artificial Sequence
  Synthetic polynucleotide
atcatctcaccttgcctcctggaatgttcctcccggtacctgcagggtaggtcacggtgacctactagagtaggtcacggtgacctacttcggtaggtcacggtgacctactgacgtaggtcacggtgacctactctagtaggtcacggtgacctactactggcgcgccatgcttcatcagactct

SEQ ID NO: 11299 - DNA, 186 bp, Artificial Sequence; identical to SEQ ID NO: 11298
  Synthetic polynucleotide

SEQ ID NO: 11300 - DNA, 179 bp, Artificial Sequence
  Synthetic polynucleotide
atcatctcaccttgcctcctgatacgatcacgtaccggcctgcaggttcccagaattgcgtttcctagagagattcccagaattgcgtttcctagagtcgttcccagaattgcgtttcctagaggacttcccagaattgcgtttcctagagctaggcgcgccatgcttcatcagactct

SEQ ID NO: 11301 - DNA, 179 bp, Artificial Sequence; identical to SEQ ID NO: 11300
  Synthetic polynucleotide

SEQ ID NO: 11302 - DNA, 186 bp, Artificial Sequence
  Synthetic polynucleotide
atcatctcaccttgcctcctgtgttcacagtgtaagttcctgcaggttcacacctagaggtgtgaaagattcacacctagaggtgtgaatcgttcacacctagaggtgtgaagacttcacacctagaggtgtgaactattcacacctagaggtgtgaaactggcgcgccatgcttcatcagactct

SEQ ID NO: 11303 - DNA, 186 bp, Artificial Sequence; identical to SEQ ID NO: 11302
  Synthetic polynucleotide

SEQ ID NO: 11304 - DNA, 156 bp, Artificial Sequence
  Synthetic polynucleotide
atcatctcaccttgcctcctgttgtacatctacgtgtccctgcaggatttattgagaatttattgtcgatttattggacatttattgctaatttattgactatttattgtgcatttattggtaatttattgggcgcgccatgcttcatcagactct

SEQ ID NO: 11305 - DNA, 156 bp, Artificial Sequence; identical to SEQ ID NO: 11304
  Synthetic polynucleotide

SEQ ID NO: 11306 - DNA, 197 bp, Artificial Sequence
  Synthetic polynucleotide
atcatctcaccttgcctcctggacctatatacgctaaacctgcaggaaaggtcatttgaggtcaagaaaaggtcatttgaggtcatcgaaaggtcatttgaggtcagacaaaggtcatttgaggtcactaaaaggtcatttgaggtcaactaaaggtcatttgaggtcatgcggcgcgccatgcttcatcagactct

SEQ ID NO: 11307 - DNA, 197 bp, Artificial Sequence; identical to SEQ ID NO: 11306
  Synthetic polynucleotide

SEQ ID NO: 11308 - DNA, 148 bp, Artificial Sequence
  Synthetic polynucleotide
atcatctcaccttgcctcctgcctgaagtttctcgcgccctgcagggtaaacaagagtaaacatcggtaaacagacgtaaacactagtaaacaactgtaaacatgcgtaaacagtagtaaacaggcgcgccatgcttcatcagactct

SEQ ID NO: 11309 - DNA, 148 bp, Artificial Sequence; identical to SEQ ID NO: 11308
  Synthetic polynucleotide

SEQ ID NO: 11310 - DNA, 140 bp, Artificial Sequence
  Synthetic polynucleotide
atcatctcaccttgcctcctgctcccataaggttcttccctgcaggggcgcgagaggcgcgtcgggcgcggacggcgcgctaggcgcgactggcgcgtgcggcgcggtaggcgcgggcgcgccatgcttcatcagactct

SEQ ID NO: 11311 - DNA, 140 bp, Artificial Sequence; identical to SEQ ID NO: 11310
  Synthetic polynucleotide

SEQ ID NO: 11312 - DNA, 191 bp, Artificial Sequence
  Synthetic polynucleotide
atcatctcaccttgcctcctggtttgcaggtttgccgccctgcaggtcgctttacagcgtcttagatcgctttacagcgtctttcgtcgctttacagcgtcttgactcgctttacagcgtcttctatcgctttacagcgtcttacttcgctttacagcgtctttgcggcgcgccatgcttcatcagactct

SEQ ID NO: 11313 - DNA, 191 bp, Artificial Sequence; identical to SEQ ID NO: 11312
  Synthetic polynucleotide

SEQ ID NO: 11314 - DNA, 191 bp, Artificial Sequence
  Synthetic polynucleotide
atcatctcaccttgcctcctgaacacttggctgagattcctgcaggaatcaattgcagtgattagaaatcaattgcagtgatttcgaatcaattgcagtgattgacaatcaattgcagtgattctaaatcaattgcagtgattactaatcaattgcagtgatttgcggcgcgccatgcttcatcagactct

SEQ ID NO: 11315 - DNA, 191 bp, Artificial Sequence; identical to SEQ ID NO: 11314
  Synthetic polynucleotide

SEQ ID NO: 11316 - DNA, 188 bp, Artificial Sequence
  Synthetic polynucleotide
atcatctcaccttgcctcctgttagtccgtatctgggccctgcaggttcgcgccaaacagattcgcgccaaactcgttcgcgccaaacgacttcgcgccaaacctattcgcgccaaacactttcgcgccaaactgcttcgcgccaaacgtattcgcgccaaacggcgcgccatgcttcatcagactct

SEQ ID NO: 11317 - DNA, 188 bp, Artificial Sequence; identical to SEQ ID NO: 11316
  Synthetic polynucleotide

SEQ ID NO: 11318 - DNA, 191 bp, Artificial Sequence
  Synthetic polynucleotide
atcatctcaccttgcctcctgaagatccaagaagcggacctgcaggaatatgctgactcagcaatttagaaatatgctgactcagcaattttcgaatatgctgactcagcaatttgacaatatgctgactcagcaatttctaaatatgctgactcagcaatttactggcgcgccatgcttcatcagactct

SEQ ID NO: 11319 - DNA, 191 bp, Artificial Sequence; identical to SEQ ID NO: 11318
  Synthetic polynucleotide

SEQ ID NO: 11320 - DNA, 197 bp, Artificial Sequence
  Synthetic polynucleotide
atcatctcaccttgcctcctgaagaaactcagcgtgtacctgcagggggtgaccttgacctagagggtgaccttgaccttcggggtgaccttgacctgacgggtgaccttgacctctagggtgaccttgacctactgggtgaccttgaccttgcgggtgaccttgacctgtaggcgcgccatgcttcatcagactct

SEQ ID NO: 11321 - DNA, 197 bp, Artificial Sequence; identical to SEQ ID NO: 11320
  Synthetic polynucleotide

SEQ ID NO: 11322 - DNA, 188 bp, Artificial Sequence
  Synthetic polynucleotide
atcatctcaccttgcctcctggtttcccgtgaaggtcgcctgcaggccatcaatcaaaagaccatcaatcaaatcgccatcaatcaaagacccatcaatcaaactaccatcaatcaaaactccatcaatcaaatgcccatcaatcaaagtaccatcaatcaaaggcgcgccatgcttcatcagactct

SEQ ID NO: 11323 - DNA, 188 bp, Artificial Sequence; identical to SEQ ID NO: 11322
  Synthetic polynucleotide

SEQ ID NO: 11324 - DNA, 164 bp, Artificial Sequence
  Synthetic polynucleotide
atcatctcaccttgcctcctgtcacgatagttgagtagcctgcaggccaggtgtgagaccaggtgtgtcgccaggtgtggacccaggtgtgctaccaggtgtgactccaggtgtgtgcccaggtgtggtaccaggtgtgggcgcgccatgcttcatcagactct

SEQ ID NO: 11325 - DNA, 164 bp, Artificial Sequence; identical to SEQ ID NO: 11324
  Synthetic polynucleotide

SEQ ID NO: 11326 - DNA, 172 bp, Artificial Sequence
  Synthetic polynucleotide
atcatctcaccttgcctcctgatggaccgtcattaacacctgcaggagggggcgctagaagggggcgcttcgagggggcgctgacagggggcgctctaagggggcgctactagggggcgcttgcagggggcgctgtaagggggcgctggcgcgccatgcttcatcagactct

SEQ ID NO: 11327 - DNA, 172 bp, Artificial Sequence; identical to SEQ ID NO: 11326
  Synthetic polynucleotide

SEQ ID NO: 11328 - DNA, 180 bp, Artificial Sequence
  Synthetic polynucleotide
atcatctcaccttgcctcctggattcttatccaatcagcctgcaggtggcacgtgccagatggcacgtgcctcgtggcacgtgccgactggcacgtgccctatggcacgtgccacttggcacgtgcctgctggcacgtgccgtatggcacgtgccggcgcgccatgcttcatcagactct

SEQ ID NO: 11329 - DNA, 180 bp, Artificial Sequence; identical to SEQ ID NO: 11328
  Synthetic polynucleotide

SEQ ID NO: 11330 - DNA, 180 bp, Artificial Sequence
  Synthetic polynucleotide
atcatctcaccttgcctcctgtgtgccgttatcctcaccctgcagggagcacgtggcagagagcacgtggctcggagcacgtggcgacgagcacgtggcctagagcacgtggcactgagcacgtggctgcgagcacgtggcgtagagcacgtggcggcgcgccatgcttcatcagactct

SEQ ID NO: 11331 - DNA, 180 bp, Artificial Sequence; identical to SEQ ID NO: 11330
  Synthetic polynucleotide

SEQ ID NO: 11332 - DNA, 180 bp, Artificial Sequence
  Synthetic polynucleotide
atcatctcaccttgcctcctgacctgcaagacagagcgcctgcaggccacttcccgcagaccacttcccgctcgccacttcccgcgacccacttcccgcctaccacttcccgcactccacttcccgctgcccacttcccgcgtaccacttcccgcggcgcgccatgcttcatcagactct

SEQ ID NO: 11333 - DNA, 180 bp, Artificial Sequence; identical to SEQ ID NO: 11332
  Synthetic polynucleotide

SEQ ID NO: 11334 - DNA, 190 bp, Artificial Sequence
  Synthetic polynucleotide
atcatctcaccttgcctcctggaatgtcatccaggcggcctgcagggacgaggctgtgggagagacgaggctgtgggtcggacgaggctgtggggacgacgaggctgtgggctagacgaggctgtgggactgacgaggctgtgggtgcgacgaggctgtggggtaggcgcgccatgcttcatcagactct

SEQ ID NO: 11335 - DNA, 190 bp, Artificial Sequence; identical to SEQ ID NO: 11334
  Synthetic polynucleotide

SEQ ID NO: 11336 - DNA, 191 bp, Artificial Sequence
  Synthetic polynucleotide
atcatctcaccttgcctcctgtgggcgatctgcgtaaacctgcaggtagccattaattaattaagatagccattaattaattatcgtagccattaattaattagactagccattaattaattactatagccattaattaattaacttagccattaattaattatgcggcgcgccatgcttcatcagactct

SEQ ID NO: 11337 - DNA, 191 bp, Artificial Sequence; identical to SEQ ID NO: 11336
  Synthetic polynucleotide

SEQ ID NO: 11338 - DNA, 156 bp, Artificial Sequence
  Synthetic polynucleotide
atcatctcaccttgcctcctgcagttacaacgacacgccctgcaggcagctgccagacagctgcctcgcagctgccgaccagctgccctacagctgccactcagctgcctgccagctgccgtacagctgccggcgcgccatgcttcatcagactct

SEQ ID NO: 11339 - DNA, 156 bp, Artificial Sequence; identical to SEQ ID NO: 11338
  Synthetic polynucleotide

SEQ ID NO: 11340 - DNA, 172 bp, Artificial Sequence
  Synthetic polynucleotide
atcatctcaccttgcctcctggtgcatctggaaccctgcctgcaggcacgcacttgagacacgcacttgtcgcacgcacttggaccacgcacttgctacacgcacttgactcacgcacttgtgccacgcacttggtacacgcacttgggcgcgccatgcttcatcagactct

SEQ ID NO: 11341 - DNA, 172 bp, Artificial Sequence; identical to SEQ ID NO: 11340
  Synthetic polynucleotide

SEQ ID NO: 11342 - DNA, 188 bp, Artificial Sequence
  Synthetic polynucleotide
atcatctcaccttgcctcctgatcttcagggtagtttccctgcagggaccaatcagaaagagaccaatcagaatcggaccaatcagaagacgaccaatcagaactagaccaatcagaaactgaccaatcagaatgcgaccaatcagaagtagaccaatcagaaggcgcgccatgcttcatcagactct

SEQ ID NO: 11343 - DNA, 188 bp, Artificial Sequence; identical to SEQ ID NO: 11342
  Synthetic polynucleotide

SEQ ID NO: 11344 - DNA, 164 bp, Artificial Sequence
  Synthetic polynucleotide
atcatctcaccttgcctcctggcattcggtctagccgacctgcaggccaggtgttagaccaggtgtttcgccaggtgttgacccaggtgttctaccaggtgttactccaggtgtttgcccaggtgttgtaccaggtgttggcgcgccatgcttcatcagactct

SEQ ID NO: 11345 - DNA, 164 bp, Artificial Sequence; identical to SEQ ID NO: 11344
  Synthetic polynucleotide

SEQ ID NO: 11346 - DNA, 185 bp, Artificial Sequence
  Synthetic polynucleotide
atcatctcaccttgcctcctggagtgtggcatttattacctgcaggtatcgaccccccacagagatatcgaccccccacagtcgtatcgaccccccacaggactatcgaccccccacagctatatcgaccccccacagacttatcgaccccccacagtgcggcgcgccatgcttcatcagactct

SEQ ID NO: 11347 - DNA, 185 bp, Artificial Sequence; identical to SEQ ID NO: 11346
  Synthetic polynucleotide

SEQ ID NO: 11348 - DNA, 190 bp, Artificial Sequence
  Synthetic polynucleotide
atcatctcaccttgcctcctgctgaggcaatgaccacccctgcaggaaaaagcggaagtaagaaaaaagcggaagtatcgaaaaagcggaagtagacaaaaagcggaagtactaaaaaagcggaagtaactaaaaagcggaagtatgcaaaaagcggaagtagtaggcgcgccatgcttcatcagactct

SEQ ID NO: 11349 - DNA, 190 bp, Artificial Sequence; identical to SEQ ID NO: 11348
  Synthetic polynucleotide

SEQ ID NO: 11350 - DNA, 180 bp, Artificial Sequence
  Synthetic polynucleotide
atcatctcaccttgcctcctgtatgcacgtctcggagacctgcaggtttccccacacagatttccccacactcgtttccccacacgactttccccacacctatttccccacacacttttccccacactgctttccccacacgtatttccccacacggcgcgccatgcttcatcagactct

SEQ ID NO: 11351 - DNA, 180 bp, Artificial Sequence; identical to SEQ ID NO: 11350
  Synthetic polynucleotide

SEQ ID NO: 11352 - DNA, 191 bp, Artificial Sequence
  Synthetic polynucleotide
atcatctcaccttgcctcctgatcagggttacgtaatgcctgcaggggtgattaattaattcgagaggtgattaattaattcgtcgggtgattaattaattcggacggtgattaattaattcgctaggtgattaattaattcgactggtgattaattaattcgtgcggcgcgccatgcttcatcagactct

SEQ ID NO: 11353 - DNA, 191 bp, Artificial Sequence; identical to SEQ ID NO: 11352
  Synthetic polynucleotide

SEQ ID NO: 11354 - DNA, 188 bp, Artificial Sequence
  Synthetic polynucleotide
atcatctcaccttgcctcctgttgcacggcatgaaagccctgcaggcgttgacgtcacagacgttgacgtcactcgcgttgacgtcacgaccgttgacgtcacctacgttgacgtcacactcgttgacgtcactgccgttgacgtcacgtacgttgacgtcacggcgcgccatgcttcatcagactct

SEQ ID NO: 11355 - DNA, 188 bp, Artificial Sequence; identical to SEQ ID NO: 11354
  Synthetic polynucleotide

SEQ ID NO: 11356 - DNA, 190 bp, Artificial Sequence
  Synthetic polynucleotide
atcatctcaccttgcctcctgcgggtaaatggcaagttcctgcagggggccgtgtgcagaagagggccgtgtgcagatcggggccgtgtgcagagacgggccgtgtgcagactagggccgtgtgcagaactgggccgtgtgcagatgcgggccgtgtgcagagtaggcgcgccatgcttcatcagactct

SEQ ID NO: 11357 - DNA, 190 bp, Artificial Sequence; identical to SEQ ID NO: 11356
  Synthetic polynucleotide

SEQ ID NO: 11358 - DNA, 197 bp, Artificial Sequence
  Synthetic polynucleotide
atcatctcaccttgcctcctgactcctcagtatcgacgcctgcaggcaagatggcggccgcagacaagatggcggccgctcgcaagatggcggccgcgaccaagatggcggccgcctacaagatggcggccgcactcaagatggcggccgctgccaagatggcggccgcgtaggcgcgccatgcttcatcagactct

SEQ ID NO: 11359 - DNA, 197 bp, Artificial Sequence; identical to SEQ ID NO: 11358
  Synthetic polynucleotide

SEQ ID NO: 11360 - DNA, 188 bp, Artificial Sequence
  Synthetic polynucleotide
atcatctcaccttgcctcctgcagattactcggcttggcctgcaggatgcgtgggcgtagaatgcgtgggcgttcgatgcgtgggcgtgacatgcgtgggcgtctaatgcgtgggcgtactatgcgtgggcgttgcatgcgtgggcgtgtaatgcgtgggcgtggcgcgccatgcttcatcagactct

SEQ ID NO: 11361 - DNA, 188 bp, Artificial Sequence; identical to SEQ ID NO: 11360
  Synthetic polynucleotide

SEQ ID NO: 11362 - DNA, 156 bp, Artificial Sequence
  Synthetic polynucleotide
atcatctcaccttgcctcctggtgaaggtagctaaacacctgcaggtcatgtgaagatcatgtgatcgtcatgtgagactcatgtgactatcatgtgaacttcatgtgatgctcatgtgagtatcatgtgaggcgcgccatgcttcatcagactct

SEQ ID NO: 11363 - DNA, 156 bp, Artificial Sequence; identical to SEQ ID NO: 11362
  Synthetic polynucleotide

SEQ ID NO: 11364 - DNA, 180 bp, Artificial Sequence
  Synthetic polynucleotide
atcatctcaccttgcctcctgtgatggaggctgaatggcctgcaggtgtggattggaagatgtggattggatcgtgtggattggagactgtggattggactatgtggattggaacttgtggattggatgctgtggattggagtatgtggattggaggcgcgccatgcttcatcagactct

SEQ ID NO: 11365 - DNA, 180 bp, Artificial Sequence; identical to SEQ ID NO: 11364
  Synthetic polynucleotide

SEQ ID NO: 11366 - DNA, 196 bp, Artificial Sequence
  Synthetic polynucleotide
atcatctcaccttgcctcctgtttcggagggtgtctaacctgcagggggtcacgtgaccagagggtcacgtgacctcggggtcacgtgaccgacgggtcacgtgaccctagggtcacgtgaccactgggtcacgtgacctgcgggtcacgtgaccgtagggtcacgtgaccggcgcgccatgcttcatcagactct

SEQ ID NO: 11367 - DNA, 196 bp, Artificial Sequence; identical to SEQ ID NO: 11366
  Synthetic polynucleotide

SEQ ID NO: 11368 - DNA, 180 bp, Artificial Sequence
  Synthetic polynucleotide
atcatctcaccttgcctcctgattatgccttatacgcacctgcaggtctgacctttgagatctgacctttgtcgtctgacctttggactctgacctttgctatctgacctttgacttctgacctttgtgctctgacctttggtatctgacctttgggcgcgccatgcttcatcagactct

SEQ ID NO: 11369 - DNA, 180 bp, Artificial Sequence; identical to SEQ ID NO: 11368
  Synthetic polynucleotide

SEQ ID NO: 11370 - DNA, 197 bp, Artificial Sequence
  Synthetic polynucleotide
atcatctcaccttgcctcctgggtcaaactgggcactacctgcagggtggaaaactccatgagagtggaaaactccatgtcggtggaaaactccatggacgtggaaaactccatgctagtggaaaactccatgactgtggaaaactccatgtgcgtggaaaactccatggtaggcgcgccatgcttcatcagactct

SEQ ID NO: 11371 - DNA, 197 bp, Artificial Sequence; identical to SEQ ID NO: 11370
  Synthetic polynucleotide

SEQ ID NO: 11372 - DNA, 180 bp, Artificial Sequence
  Synthetic polynucleotide
atcatctcaccttgcctcctgccgacgccaagatcctacctgcagggtccccagggaagagtccccagggatcggtccccagggagacgtccccagggactagtccccagggaactgtccccagggatgcgtccccagggagtagtccccagggaggcgcgccatgcttcatcagactct

SEQ ID NO: 11373 - DNA, 180 bp, Artificial Sequence; identical to SEQ ID NO: 11372
  Synthetic polynucleotide

SEQ ID NO: 11374 - DNA, 172 bp, Artificial Sequence
  Synthetic polynucleotide
atcatctcaccttgcctcctgtgcggatatccaggactcctgcaggtaaacaaagaagataaacaaagatcgtaaacaaagagactaaacaaagactataaacaaagaacttaaacaaagatgctaaacaaagagtataaacaaagaggcgcgccatgcttcatcagactct

SEQ ID NO: 11375 - DNA, 172 bp, Artificial Sequence; identical to SEQ ID NO: 11374
  Synthetic polynucleotide

SEQ ID NO: 11376 - DNA, 172 bp, Artificial Sequence
  Synthetic polynucleotide
atcatctcaccttgcctcctgatttccttgctatctctcctgcagggatgacgtaaagagatgacgtaatcggatgacgtaagacgatgacgtaactagatgacgtaaactgatgacgtaatgcgatgacgtaagtagatgacgtaaggcgcgccatgcttcatcagactct

SEQ ID NO: 11377 - DNA, 172 bp, Artificial Sequence; identical to SEQ ID NO: 11376
  Synthetic polynucleotide

SEQ ID NO: 11378 - DNA, 164 bp, Artificial Sequence
  Synthetic polynucleotide
atcatctcaccttgcctcctggacctgtgcctaggaaccctgcaggaggagctgtagaaggagctgttcgaggagctgtgacaggagctgtctaaggagctgtactaggagctgttgcaggagctgtgtaaggagctgtggcgcgccatgcttcatcagactct

SEQ ID NO: 11379 - DNA, 164 bp, Artificial Sequence; identical to SEQ ID NO: 11378
  Synthetic polynucleotide

SEQ ID NO: 11380 - DNA, 180 bp, Artificial Sequence
  Synthetic polynucleotide
atcatctcaccttgcctcctgtcgcaacaattggacgacctgcagggctgttaccctagagctgttacccttcggctgttaccctgacgctgttaccctctagctgttaccctactgctgttacccttgcgctgttaccctgtagctgttaccctggcgcgccatgcttcatcagactct

SEQ ID NO: 11381 - DNA, 180 bp, Artificial Sequence; identical to SEQ ID NO: 11380
  Synthetic polynucleotide

SEQ ID NO: 11382 - DNA, 172 bp, Artificial Sequence
  Synthetic polynucleotide
atcatctcaccttgcctcctggacaggcttcggattcgcctgcaggttttatgaccagattttatgacctcgttttatgaccgacttttatgaccctattttatgaccactttttatgacctgcttttatgaccgtattttatgaccggcgcgccatgcttcatcagactct

SEQ ID NO: 11383 - DNA, 172 bp, Artificial Sequence; identical to SEQ ID NO: 11382
  Synthetic polynucleotide

SEQ ID NO: 11384 - DNA, 132 bp, Artificial Sequence
  Synthetic polynucleotide
atcatctcaccttgcctcctgttacactcgtagtcacccctgcaggtgacaagatgacatcgtgacagactgacactatgacaacttgacatgctgacagtatgacaggcgcgccatgcttcatcagactct

SEQ ID NO: 11385 - DNA, 132 bp, Artificial Sequence; identical to SEQ ID NO: 11384
  Synthetic polynucleotide

SEQ ID NO: 11386 - DNA, 140 bp, Artificial Sequence
  Synthetic polynucleotide
atcatctcaccttgcctcctgtcttcccgggtcaatagcctgcaggacaaagagaacaaagtcgacaaaggacacaaagctaacaaagactacaaagtgcacaaaggtaacaaagggcgcgccatgcttcatcagactct

SEQ ID NO: 11387 - DNA, 140 bp, Artificial Sequence; identical to SEQ ID NO: 11386
  Synthetic polynucleotide

SEQ ID NO: 11388 - DNA, 196 bp, Artificial Sequence
  Synthetic polynucleotide
atcatctcaccttgcctcctgccgatgactgaagaatgcctgcaggtatttacgtaacaagatatttacgtaacatcgtatttacgtaacagactatttacgtaacactatatttacgtaacaacttatttacgtaacatgctatttacgtaacagtatatttacgtaacaggcgcgccatgcttcatcagactct

SEQ ID NO: 11389 - DNA, 196 bp, Artificial Sequence; identical to SEQ ID NO: 11388
  Synthetic polynucleotide

SEQ ID NO: 11390 - DNA, 172 bp, Artificial Sequence
  Synthetic polynucleotide
atcatctcaccttgcctcctgcgatctcagcacactagcctgcaggctcaactggcagactcaactggctcgctcaactggcgacctcaactggcctactcaactggcactctcaactggctgcctcaactggcgtactcaactggcggcgcgccatgcttcatcagactct

SEQ ID NO: 11391 - DNA, 172 bp, Artificial Sequence; identical to SEQ ID NO: 11390
  Synthetic polynucleotide

SEQ ID NO: 11392 - DNA, 164 bp, Artificial Sequence
  Synthetic polynucleotide
atcatctcaccttgcctcctgttatccttggtactccccctgcaggcgtgggaaaagacgtgggaaatcgcgtgggaaagaccgtgggaaactacgtgggaaaactcgtgggaaatgccgtgggaaagtacgtgggaaaggcgcgccatgcttcatcagactct

SEQ ID NO: 11393 - DNA, 164 bp, Artificial Sequence; identical to SEQ ID NO: 11392
  Synthetic polynucleotide

SEQ ID NO: 11394 - DNA, 180 bp, Artificial Sequence
  Synthetic polynucleotide
atcatctcaccttgcctcctgcattgcaggaggtgttccctgcagggtcacgcaatgagagtcacgcaatgtcggtcacgcaatggacgtcacgcaatgctagtcacgcaatgactgtcacgcaatgtgcgtcacgcaatggtagtcacgcaatgggcgcgccatgcttcatcagactct

SEQ ID NO: 11395 - DNA, 180 bp, Artificial Sequence; identical to SEQ ID NO: 11394
  Synthetic polynucleotide

SEQ ID NO: 11396 - DNA, 185 bp, Artificial Sequence
  Synthetic polynucleotide
atcatctcaccttgcctcctgataatcatcgctgctatcctgcaggattggactttggacccagaattggactttggaccctcgattggactttggacccgacattggactttggacccctaattggactttggacccactattggactttggaccctgcggcgcgccatgcttcatcagactct

SEQ ID NO: 11397 - DNA, 185 bp, Artificial Sequence; identical to SEQ ID NO: 11396
  Synthetic polynucleotide

SEQ ID NO: 11398 - DNA, 172 bp, Artificial Sequence
  Synthetic polynucleotide
atcatctcaccttgcctcctggggatggtgccctaactcctgcaggggggattcccagaggggattccctcgggggattcccgacggggattcccctaggggattcccactggggattccctgcggggattcccgtaggggattcccggcgcgccatgcttcatcagactct

SEQ ID NO: 11399 - DNA, 172 bp, Artificial Sequence; identical to SEQ ID NO: 11398
  Synthetic polynucleotide

SEQ ID NO: 11400 - DNA, 156 bp, Artificial Sequence
  Synthetic polynucleotide
atcatctcaccttgcctcctgatgtggaggtcttcgtgcctgcagggcgcgcggagagcgcgcggtcggcgcgcgggacgcgcgcggctagcgcgcggactgcgcgcggtgcgcgcgcgggtagcgcgcggggcgcgccatgcttcatcagactct

SEQ ID NO: 11401 - DNA, 156 bp, Artificial Sequence; identical to SEQ ID NO: 11400
  Synthetic polynucleotide

SEQ ID NO: 11402 - DNA, 200 bp, Artificial Sequence
  Synthetic polynucleotide
atcatctcaccttgcctcctgctctcagaatgtatatgcctgcaggtgacctactaacctagttaagatgacctactaacctagttatcgtgacctactaacctagttagactgacctactaacctagttactatgacctactaacctagttaacttgacctactaacctagttaggcgcgccatgcttcatcagactct

SEQ ID NO: 11403 - DNA, 200 bp, Artificial Sequence; identical to SEQ ID NO: 11402
  Synthetic polynucleotide

SEQ ID NO: 11404 - DNA, 172 bp, Artificial Sequence
  Synthetic polynucleotide
atcatctcaccttgcctcctggaatgctttagggaggtcctgcaggcctttgatgtagacctttgatgttcgcctttgatgtgaccctttgatgtctacctttgatgtactcctttgatgttgccctttgatgtgtacctttgatgtggcgcgccatgcttcatcagactct

SEQ ID NO: 11405 - DNA, 172 bp, Artificial Sequence; identical to SEQ ID NO: 11404
  Synthetic polynucleotide

SEQ ID NO: 11406 - DNA, 156 bp, Artificial Sequence
  Synthetic polynucleotide
atcatctcaccttgcctcctgggctacatatgtcgaaccctgcaggaattgataagaaattgatatcgaattgatagacaattgatactaaattgataactaattgatatgcaattgatagtaaattgataggcgcgccatgcttcatcagactct

SEQ ID NO: 11407 - DNA, 156 bp, Artificial Sequence; identical to SEQ ID NO: 11406
  Synthetic polynucleotide

SEQ ID NO: 11408 - DNA, 188 bp, Artificial Sequence
  Synthetic polynucleotide
atcatctcaccttgcctcctgcatccagcgaagagacacctgcaggcaacatatgcgaagacaacatatgcgatcgcaacatatgcgagaccaacatatgcgactacaacatatgcgaactcaacatatgcgatgccaacatatgcgagtacaacatatgcgaggcgcgccatgcttcatcagactct

SEQ ID NO: 11409 - DNA, 188 bp, Artificial Sequence; identical to SEQ ID NO: 11408
  Synthetic polynucleotide

SEQ ID NO: 11410 - DNA, 185 bp, Artificial Sequence
  Synthetic polynucleotide
atcatctcaccttgcctcctgtataagtagtgtatccgcctgcaggtgaccgccagtaacccagatgaccgccagtaaccctcgtgaccgccagtaacccgactgaccgccagtaacccctatgaccgccagtaacccacttgaccgccagtaaccctgcggcgcgccatgcttcatcagactct

SEQ ID NO: 11411 - DNA, 185 bp, Artificial Sequence; identical to SEQ ID NO: 11410
  Synthetic polynucleotide

SEQ ID NO: 11412 - DNA, 190 bp, Artificial Sequence
  Synthetic polynucleotide
atcatctcaccttgcctcctgaaattagatgactgacccctgcaggggggcccaagggggagaggggcccaagggggtcgggggcccaaggggggacggggcccaagggggctaggggcccaagggggactggggcccaagggggtgcggggcccaaggggggtaggcgcgccatgcttcatcagactct

SEQ ID NO: 11413 - DNA, 190 bp, Artificial Sequence; identical to SEQ ID NO: 11412
  Synthetic polynucleotide

SEQ ID NO: 11414 - DNA, 172 bp, Artificial Sequence
  Synthetic polynucleotide
atcatctcaccttgcctcctgtccttgtacagagacgtcctgcaggtgtttactcaagatgtttactcatcgtgtttactcagactgtttactcactatgtttactcaacttgtttactcatgctgtttactcagtatgtttactcaggcgcgccatgcttcatcagactct

SEQ ID NO: 11415 - DNA, 172 bp, Artificial Sequence; identical to SEQ ID NO: 11414
  Synthetic polynucleotide

SEQ ID NO: 11416 - DNA, 156 bp, Artificial Sequence
  Synthetic polynucleotide
atcatctcaccttgcctcctgctccgggttctcaatagcctgcaggcttcctctagacttcctcttcgcttcctctgaccttcctctctacttcctctactcttcctcttgccttcctctgtacttcctctggcgcgccatgcttcatcagactct

SEQ ID NO: 11417 - DNA, 156 bp, Artificial Sequence; identical to SEQ ID NO: 11416
  Synthetic polynucleotide

SEQ ID NO: 11418 - DNA, 190 bp, Artificial Sequence
  Synthetic polynucleotide
atcatctcaccttgcctcctggcaaataggcgagtggtcctgcaggttttcccgccaattagattttcccgccaatttcgttttcccgccaattgacttttcccgccaattctattttcccgccaattactttttcccgccaatttgcttttcccgccaattgtaggcgcgccatgcttcatcagactct

SEQ ID NO: 11419 - DNA, 190 bp, Artificial Sequence; identical to SEQ ID NO: 11418
  Synthetic polynucleotide

SEQ ID NO: 11420 - DNA, 172 bp, Artificial Sequence
  Synthetic polynucleotide
atcatctcaccttgcctcctgatacaattgattgagcccctgcaggccaaatttggagaccaaatttggtcgccaaatttgggacccaaatttggctaccaaatttggactccaaatttggtgcccaaatttgggtaccaaatttggggcgcgccatgcttcatcagactct

SEQ ID NO: 11421 - DNA, 172 bp, Artificial Sequence; identical to SEQ ID NO: 11420
  Synthetic polynucleotide

SEQ ID NO: 11422 - DNA, 164 bp, Artificial Sequence
  Synthetic polynucleotide
atcatctcaccttgcctcctgggagagcgagccgatatcctgcaggccctctagtagaccctctagttcgccctctagtgacccctctagtctaccctctagtactccctctagttgcccctctagtgtaccctctagtggcgcgccatgcttcatcagactct

SEQ ID NO: 11423 - DNA, 164 bp, Artificial Sequence; identical to SEQ ID NO: 11422
  Synthetic polynucleotide

SEQ ID NO: 11424 - DNA, 191 bp, Artificial Sequence
  Synthetic polynucleotide
atcatctcaccttgcctcctggtcggcactcaaatcaacctgcaggttggccggcgggcctgtcactagattggccggcgggcctgtcacttcgttggccggcgggcctgtcactgacttggccggcgggcctgtcactctattggccggcgggcctgtcactactggcgcgccatgcttcatcagactct

SEQ ID NO: 11425 - DNA, 191 bp, Artificial Sequence; identical to SEQ ID NO: 11424
  Synthetic polynucleotide

SEQ ID NO: 11426 - DNA, 191 bp, Artificial Sequence
  Synthetic polynucleotide
atcatctcaccttgcctcctgccctgtaaagaggaatacctgcagggggggggggacatggtgttcttgggggagagggggggggacatggtgttcttgggggtcggggggggggacatggtgttcttggggggacgggggggggacatggtgttcttgggggctaggcgcgccatgcttcatcagactct

SEQ ID NO: 11427 - DNA, 191 bp, Artificial Sequence; identical to SEQ ID NO: 11426
  Synthetic polynucleotide

SEQ ID NO: 11428 - DNA, 196 bp, Artificial Sequence
  Synthetic polynucleotide
atcatctcaccttgcctcctgcacatcctgttcaagcacctgcaggagatgatagagccagaagatgatagagcctcgagatgatagagccgacagatgatagagccctaagatgatagagccactagatgatagagcctgcagatgatagagccgtaagatgatagagccggcgcgccatgcttcatcagactct

SEQ ID NO: 11429 - DNA, 196 bp, Artificial Sequence; identical to SEQ ID NO: 11428
  Synthetic polynucleotide

SEQ ID NO: 11430 - DNA, 172 bp, Artificial Sequence
  Synthetic polynucleotide
atcatctcaccttgcctcctgatgcggtactggcctgacctgcaggaacatatggtagaaacatatggttcgaacatatggtgacaacatatggtctaaacatatggtactaacatatggttgcaacatatggtgtaaacatatggtggcgcgccatgcttcatcagactct

SEQ ID NO: 11431 - DNA, 172 bp, Artificial Sequence; identical to SEQ ID NO: 11430
  Synthetic polynucleotide

SEQ ID NO: 11432 - DNA, 197 bp, Artificial Sequence
  Synthetic polynucleotide
atcatctcaccttgcctcctggtcgaactaatattcaccctgcaggaggtgagtgacagctagaaggtgagtgacagcttcgaggtgagtgacagctgacaggtgagtgacagctctaaggtgagtgacagctactaggtgagtgacagcttgcaggtgagtgacagctgtaggcgcgccatgcttcatcagactct

SEQ ID NO: 11433 - DNA, 197 bp, Artificial Sequence; identical to SEQ ID NO: 11432
  Synthetic polynucleotide

SEQ ID NO: 11434 - DNA, 197 bp, Artificial Sequence
  Synthetic polynucleotide
atcatctcaccttgcctcctgagcatttctgaatgacccctgcaggaacatgttgggacatgtcagaaacatgttgggacatgtctcgaacatgttgggacatgtcgacaacatgttgggacatgtcctaaacatgttgggacatgtcactaacatgttgggacatgtctgcggcgcgccatgcttcatcagactct

SEQ ID NO: 11435 - DNA, 197 bp, Artificial Sequence; identical to SEQ ID NO: 11434
  Synthetic polynucleotide

SEQ ID NO: 11436 - DNA, 164 bp, Artificial Sequence
  Synthetic polynucleotide
atcatctcaccttgcctcctgaatacccaacgctattacctgcaggggggtcacgagaggggtcacgtcgggggtcacggacggggtcacgctaggggtcacgactggggtcacgtgcggggtcacggtaggggtcacgggcgcgccatgcttcatcagactct

SEQ ID NO: 11437 - DNA, 164 bp, Artificial Sequence; identical to SEQ ID NO: 11436
  Synthetic polynucleotide

SEQ ID NO: 11438 - DNA, 197 bp, Artificial Sequence
  Synthetic polynucleotide
atcatctcaccttgcctcctgcacagcgacagcatcttcctgcaggttcgaacgtttcgaaagattcgaacgtttcgaatcgttcgaacgtttcgaagacttcgaacgtttcgaactattcgaacgtttcgaaactttcgaacgtttcgaatgcttcgaacgtttcgaagtaggcgcgccatgcttcatcagactct

SEQ ID NO: 11439 - DNA, 197 bp, Artificial Sequence; identical to SEQ ID NO: 11438
  Synthetic polynucleotide

SEQ ID NO: 11440 - DNA, 148 bp, Artificial Sequence
  Synthetic polynucleotide
atcatctcaccttgcctcctggcagattattcatacgtcctgcaggcccccgcagacccccgctcgcccccgcgaccccccgcctacccccgcactcccccgctgccccccgcgtacccccgcggcgcgccatgcttcatcagactct

SEQ ID NO: 11441 - DNA, 148 bp, Artificial Sequence; identical to SEQ ID NO: 11440
  Synthetic polynucleotide

SEQ ID NO: 11442 - DNA, 190 bp, Artificial Sequence
  Synthetic polynucleotide
atcatctcaccttgcctcctggccgaagagctggatagcctgcagggaatgacacagcgaagagaatgacacagcgatcggaatgacacagcgagacgaatgacacagcgactagaatgacacagcgaactgaatgacacagcgatgcgaatgacacagcgagtaggcgcgccatgcttcatcagactct

SEQ ID NO: 11443 - DNA, 190 bp, Artificial Sequence; identical to SEQ ID NO: 11442
  Synthetic polynucleotide

SEQ ID NO: 11444 - DNA, 164 bp, Artificial Sequence
  Synthetic polynucleotide
atcatctcaccttgcctcctgaacaatttcgacttccacctgcaggttaatccccagattaatcccctcgttaatccccgacttaatccccctattaatccccactttaatcccctgcttaatccccgtattaatccccggcgcgccatgcttcatcagactct

SEQ ID NO: 11445 - DNA, 164 bp, Artificial Sequence; identical to SEQ ID NO: 11444
  Synthetic polynucleotide

SEQ ID NO: 11446 - DNA, 188 bp, Artificial Sequence
  Synthetic polynucleotide
atcatctcaccttgcctcctgcagggttagggcgaatgcctgcagggtccccagggacagagtccccagggactcggtccccagggacgacgtccccagggacctagtccccagggacactgtccccagggactgcgtccccagggacgtagtccccagggacggcgcgccatgcttcatcagactct

SEQ ID NO: 11447 - DNA, 188 bp, Artificial Sequence; identical to SEQ ID NO: 11446
  Synthetic polynucleotide

SEQ ID NO: 11448 - DNA, 180 bp, Artificial Sequence
  Synthetic polynucleotide
atcatctcaccttgcctcctgagcacttgccagttcatcctgcaggttgtttacattagattgtttacatttcgttgtttacattgacttgtttacattctattgtttacattactttgtttacatttgcttgtttacattgtattgtttacattggcgcgccatgcttcatcagactct

SEQ ID NO: 11449 - DNA, 180 bp, Artificial Sequence; identical to SEQ ID NO: 11448
  Synthetic polynucleotide

SEQ ID NO: 11450 - DNA, 180 bp, Artificial Sequence
  Synthetic polynucleotide
atcatctcaccttgcctcctgttcccgctccagtcacacctgcagggtcacgtgggcagagtcacgtgggctcggtcacgtgggcgacgtcacgtgggcctagtcacgtgggcactgtcacgtgggctgcgtcacgtgggcgtagtcacgtgggcggcgcgccatgcttcatcagactct

SEQ ID NO: 11451 - DNA, 180 bp, Artificial Sequence; identical to SEQ ID NO: 11450
  Synthetic polynucleotide

SEQ ID NO: 11452 - DNA, 156 bp, Artificial Sequence
  Synthetic polynucleotide
atcatctcaccttgcctcctgtactggccagccatgatcctgcaggatatgataagaatatgatatcgatatgatagacatatgatactaatatgataactatatgatatgcatatgatagtaatatgataggcgcgccatgcttcatcagactct

SEQ ID NO: 11453 - DNA, 156 bp, Artificial Sequence; identical to SEQ ID NO: 11452
  Synthetic polynucleotide

SEQ ID NO: 11454 - DNA, 191 bp, Artificial Sequence
  Synthetic polynucleotide
atcatctcaccttgcctcctgcatcactaatgcaatagcctgcaggaaaaagtaaacaaagacagaaaaaagtaaacaaagactcgaaaaagtaaacaaagacgacaaaaagtaaacaaagacctaaaaaagtaaacaaagacactaaaaagtaaacaaagactgcggcgcgccatgcttcatcagactct

SEQ ID NO: 11455 - DNA, 191 bp, Artificial Sequence; identical to SEQ ID NO: 11454
  Synthetic polynucleotide

SEQ ID NO: 11456 - DNA, 172 bp, Artificial Sequence
  Synthetic polynucleotide
atcatctcaccttgcctcctgaatggtgtacgtcgttacctgcaggcggacacaatagacggacacaattcgcggacacaatgaccggacacaatctacggacacaatactcggacacaattgccggacacaatgtacggacacaatggcgcgccatgcttcatcagactct

SEQ ID NO: 11457 - DNA, 172 bp, Artificial Sequence; identical to SEQ ID NO: 11456
  Synthetic polynucleotide

SEQ ID NO: 11458 - DNA, 197 bp, Artificial Sequence
  Synthetic polynucleotide
atcatctcaccttgcctcctgcccaagtattgaccggtcctgcaggagaaccagctgcggtcagagaagaaccagctgcggtcagtcgagaaccagctgcggtcaggacagaaccagctgcggtcagctaagaaccagctgcggtcagactagaaccagctgcggtcagtgcggcgcgccatgcttcatcagactct

SEQ ID NO: 11459 - DNA, 197 bp, Artificial Sequence; identical to SEQ ID NO: 11458
  Synthetic polynucleotide

SEQ ID NO: 11460 - DNA, 180 bp, Artificial Sequence
  Synthetic polynucleotide
atcatctcaccttgcctcctgcgacgaaatgcctcaaacctgcaggagggccagttgagaagggccagttgtcgagggccagttggacagggccagttgctaagggccagttgactagggccagttgtgcagggccagttggtaagggccagttgggcgcgccatgcttcatcagactct

SEQ ID NO: 11461 - DNA, 180 bp, Artificial Sequence; identical to SEQ ID NO: 11460
  Synthetic polynucleotide

SEQ ID NO: 11462 - DNA, 190 bp, Artificial Sequence
  Synthetic polynucleotide
atcatctcaccttgcctcctggaatccctggaatagtgcctgcaggccctccccaaggctagaccctccccaaggcttcgccctccccaaggctgacccctccccaaggctctaccctccccaaggctactccctccccaaggcttgcccctccccaaggctgtaggcgcgccatgcttcatcagactct

SEQ ID NO: 11463 - DNA, 190 bp, Artificial Sequence; identical to SEQ ID NO: 11462
  Synthetic polynucleotide

SEQ ID NO: 11464 - DNA, 172 bp, Artificial Sequence
  Synthetic polynucleotide
atcatctcaccttgcctcctgaacggaaacgatgccatcctgcaggccccgcccccagaccccgccccctcgccccgcccccgacccccgcccccctaccccgcccccactccccgccccctgcccccgcccccgtaccccgcccccggcgcgccatgcttcatcagactct

SEQ ID NO: 11465 - DNA, 172 bp, Artificial Sequence; identical to SEQ ID NO: 11464
  Synthetic polynucleotide

SEQ ID NO: 11466 - DNA, 148 bp, Artificial Sequence
  Synthetic polynucleotide
atcatctcaccttgcctcctgaactcagggtagatcctcctgcaggtctttgtagatctttgttcgtctttgtgactctttgtctatctttgtacttctttgttgctctttgtgtatctttgtggcgcgccatgcttcatcagactct

SEQ ID NO: 11467 - DNA, 148 bp, Artificial Sequence; identical to SEQ ID NO: 11466
  Synthetic polynucleotide

SEQ ID NO: 11468 - DNA, 164 bp, Artificial Sequence
  Synthetic polynucleotide
atcatctcaccttgcctcctgcatctgtaagaaagcggcctgcaggagggcccccagaagggccccctcgagggcccccgacagggcccccctaagggcccccactagggccccctgcagggcccccgtaagggcccccggcgcgccatgcttcatcagactct

SEQ ID NO: 11469 - DNA, 164 bp, Artificial Sequence; identical to SEQ ID NO: 11468
  Synthetic polynucleotide

SEQ ID NO: 11470 - DNA, 197 bp, Artificial Sequence
  Synthetic polynucleotide
atcatctcaccttgcctcctgtcgtttcagttctattgcctgcaggctggactttggactcagactggactttggactctcgctggactttggactcgacctggactttggactcctactggactttggactcactctggactttggactctgcctggactttggactcgtaggcgcgccatgcttcatcagactct

SEQ ID NO: 11471 - DNA, 197 bp, Artificial Sequence; identical to SEQ ID NO: 11470
  Synthetic polynucleotide

SEQ ID NO: 11472 - DNA, 197 bp, Artificial Sequence
  Synthetic polynucleotide
atcatctcaccttgcctcctgatagcgccaactgcaatcctgcaggcccatataaggagatggcagacccatataaggagatggctcgcccatataaggagatggcgaccccatataaggagatggcctacccatataaggagatggcactcccatataaggagatggctgcggcgcgccatgcttcatcagactct

SEQ ID NO: 11473 - DNA, 197 bp, Artificial Sequence; identical to SEQ ID NO: 11472
  Synthetic polynucleotide

SEQ ID NO: 11474 - DNA, 172 bp, Artificial Sequence
  Synthetic polynucleotide
atcatctcaccttgcctcctggcatggacatattcccacctgcaggtcttatctatagatcttatctattcgtcttatctatgactcttatctatctatcttatctatacttcttatctattgctcttatctatgtatcttatctatggcgcgccatgcttcatcagactct

SEQ ID NO: 11475 - DNA, 172 bp, Artificial Sequence; identical to SEQ ID NO: 11474
  Synthetic polynucleotide

SEQ ID NO: 11476 - DNA, 185 bp, Artificial Sequence
  Synthetic polynucleotide
atcatctcaccttgcctcctgtccagcccgagtttacgcctgcaggtttattaattgccggtagatttattaattgccggttcgtttattaattgccggtgactttattaattgccggtctatttattaattgccggtacttttattaattgccggttgcggcgcgccatgcttcatcagactct

SEQ ID NO: 11477 - DNA, 185 bp, Artificial Sequence; identical to SEQ ID NO: 11476
  Synthetic polynucleotide

SEQ ID NO: 11478 - DNA, 191 bp, Artificial Sequence
  Synthetic polynucleotide
atcatctcaccttgcctcctgtactgcgcaagatgtctcctgcaggcaggtcaccgtgaccttagacaggtcaccgtgacctttcgcaggtcaccgtgaccttgaccaggtcaccgtgaccttctacaggtcaccgtgaccttactcaggtcaccgtgacctttgcggcgcgccatgcttcatcagactct

SEQ ID NO: 11479 - DNA, 191 bp, Artificial Sequence; identical to SEQ ID NO: 11478
  Synthetic polynucleotide

SEQ ID NO: 11480 - DNA, 164 bp, Artificial Sequence
  Synthetic polynucleotide
atcatctcaccttgcctcctgtgttggttgtcaggcgacctgcaggttggactttagattggacttttcgttggactttgacttggactttctattggactttactttggacttttgcttggactttgtattggactttggcgcgccatgcttcatcagactct

SEQ ID NO: 11481 - DNA, 164 bp, Artificial Sequence; identical to SEQ ID NO: 11480
  Synthetic polynucleotide

SEQ ID NO: 11482 - DNA, 197 bp, Artificial Sequence
  Synthetic polynucleotide
atcatctcaccttgcctcctggtcaccattaatctcgccctgcagggcgccccctggtggcagagcgccccctggtggctcggcgccccctggtggcgacgcgccccctggtggcctagcgccccctggtggcactgcgccccctggtggctgcgcgccccctggtggcgtaggcgcgccatgcttcatcagactct

SEQ ID NO: 11483 - DNA, 197 bp, Artificial Sequence; identical to SEQ ID NO: 11482
  Synthetic polynucleotide

SEQ ID NO: 11484 - DNA, 191 bp, Artificial Sequence
  Synthetic polynucleotide
atcatctcaccttgcctcctgtacagtaacgaaggtctcctgcaggtcaggtgatcaaccggtagatcaggtgatcaaccggttcgtcaggtgatcaaccggtgactcaggtgatcaaccggtctatcaggtgatcaaccggtacttcaggtgatcaaccggttgcggcgcgccatgcttcatcagactct

SEQ ID NO: 11485 - DNA, 191 bp, Artificial Sequence; identical to SEQ ID NO: 11484
  Synthetic polynucleotide

SEQ ID NO: 11486 - DNA, 190 bp, Artificial Sequence
  Synthetic polynucleotide
atcatctcaccttgcctcctggcgattgtagacctgcgcctgcaggccgctctgaccctgagaccgctctgaccctgtcgccgctctgaccctggacccgctctgaccctgctaccgctctgaccctgactccgctctgaccctgtgcccgctctgaccctggtaggcgcgccatgcttcatcagactct

SEQ ID NO: 11487 - DNA, 190 bp, Artificial Sequence; identical to SEQ ID NO: 11486
  Synthetic polynucleotide

SEQ ID NO: 11488 - DNA, 188 bp, Artificial Sequence
  Synthetic polynucleotide
atcatctcaccttgcctcctggccgtacacctctagagcctgcaggcgccaggtgcagagacgccaggtgcagtcgcgccaggtgcaggaccgccaggtgcagctacgccaggtgcagactcgccaggtgcagtgccgccaggtgcaggtacgccaggtgcagggcgcgccatgcttcatcagactct

SEQ ID NO: 11489 - DNA, 188 bp, Artificial Sequence; identical to SEQ ID NO: 11488
  Synthetic polynucleotide

SEQ ID NO: 11490 - DNA, 172 bp, Artificial Sequence
  Synthetic polynucleotide
atcatctcaccttgcctcctgctggtgggcagatcgaacctgcaggttccgggtcaagattccgggtcatcgttccgggtcagacttccgggtcactattccgggtcaactttccgggtcatgcttccgggtcagtattccgggtcaggcgcgccatgcttcatcagactct

SEQ ID NO: 11491 - DNA, 172 bp, Artificial Sequence; identical to SEQ ID NO: 11490
  Synthetic polynucleotide

SEQ ID NO: 11492 - DNA, 156 bp, Artificial Sequence
  Synthetic polynucleotide
atcatctcaccttgcctcctgtacccaatagtcgagaacctgcagggtcattaaagagtcattaatcggtcattaagacgtcattaactagtcattaaactgtcattaatgcgtcattaagtagtcattaaggcgcgccatgcttcatcagactct

SEQ ID NO: 11493 - DNA, 156 bp, Artificial Sequence; identical to SEQ ID NO: 11492
  Synthetic polynucleotide

SEQ ID NO: 11494 - DNA, 148 bp, Artificial Sequence
  Synthetic polynucleotide
atcatctcaccttgcctcctgaaacgaagagcgtatctcctgcaggccgctaaagaccgctaatcgccgctaagacccgctaactaccgctaaactccgctaatgcccgctaagtaccgctaaggcgcgccatgcttcatcagactct

SEQ ID NO: 11495 - DNA, 148 bp, Artificial Sequence; identical to SEQ ID NO: 11494
  Synthetic polynucleotide

SEQ ID NO: 11496 - DNA, 180 bp, Artificial Sequence
  Synthetic polynucleotide
atcatctcaccttgcctcctgacgtcatagtaacttcacctgcagggtcccttgggaagagtcccttgggatcggtcccttgggagacgtcccttgggactagtcccttgggaactgtcccttgggatgcgtcccttgggagtagtcccttgggaggcgcgccatgcttcatcagactct

SEQ ID NO: 11497 - DNA, 180 bp, Artificial Sequence; identical to SEQ ID NO: 11496
  Synthetic polynucleotide

SEQ ID NO: 11498 - DNA, 197 bp, Artificial Sequence
  Synthetic polynucleotide
atcatctcaccttgcctcctggttgcctcattgacgtccctgcaggtaattcaatgaagtgagataattcaatgaagtgtcgtaattcaatgaagtggactaattcaatgaagtgctataattcaatgaagtgacttaattcaatgaagtgtgctaattcaatgaagtggtaggcgcgccatgcttcatcagactct

SEQ ID NO: 11499 - DNA, 197 bp, Artificial Sequence; identical to SEQ ID NO: 11498
  Synthetic polynucleotide

SEQ ID NO: 11500 - DNA, 172 bp, Artificial Sequence
  Synthetic polynucleotide
atcatctcaccttgcctcctgcaatgctttccgagatccctgcaggatgactcagcagaatgactcagctcgatgactcagcgacatgactcagcctaatgactcagcactatgactcagctgcatgactcagcgtaatgactcagcggcgcgccatgcttcatcagactct

SEQ ID NO: 11501 - DNA, 172 bp, Artificial Sequence; identical to SEQ ID NO: 11500
  Synthetic polynucleotide

SEQ ID NO: 11502 - DNA, 197 bp, Artificial Sequence
  Synthetic polynucleotide
atcatctcaccttgcctcctgcactagaacgagttatgcctgcaggaagtctgtggttagcagaaagtctgtggttagctcgaagtctgtggttagcgacaagtctgtggttagcctaaagtctgtggttagcactaagtctgtggttagctgcaagtctgtggttagcgtaggcgcgccatgcttcatcagactct

SEQ ID NO: 11503 - DNA, 197 bp, Artificial Sequence; identical to SEQ ID NO: 11502
  Synthetic polynucleotide

SEQ ID NO: 11504 - DNA, 188 bp, Artificial Sequence
  Synthetic polynucleotide
atcatctcaccttgcctcctggagagactagctagcagcctgcaggcagaggaaaaatagacagaggaaaaattcgcagaggaaaaatgaccagaggaaaaatctacagaggaaaaatactcagaggaaaaattgccagaggaaaaatgtacagaggaaaaatggcgcgccatgcttcatcagactct

SEQ ID NO: 11505 - DNA, 188 bp, Artificial Sequence; identical to SEQ ID NO: 11504
  Synthetic polynucleotide

SEQ ID NO: 11506 - DNA, 197 bp, Artificial Sequence
  Synthetic polynucleotide
atcatctcaccttgcctcctgcaacgtgccgtcattcacctgcaggggacaatgaagattgttgagaggacaatgaagattgttgtcgggacaatgaagattgttggacggacaatgaagattgttgctaggacaatgaagattgttgactggacaatgaagattgttgtgcggcgcgccatgcttcatcagactct

SEQ ID NO: 11507 - DNA, 197 bp, Artificial Sequence; identical to SEQ ID NO: 11506
  Synthetic polynucleotide

SEQ ID NO: 11508 - DNA, 191 bp, Artificial Sequence
  Synthetic polynucleotide
atcatctcaccttgcctcctgcggacgtttctaatggccctgcaggtgcactaattagcgcacagatgcactaattagcgcactcgtgcactaattagcgcacgactgcactaattagcgcacctatgcactaattagcgcacacttgcactaattagcgcactgcggcgcgccatgcttcatcagactct

SEQ ID NO: 11509 - DNA, 191 bp, Artificial Sequence; identical to SEQ ID NO: 11508
  Synthetic polynucleotide

SEQ ID NO: 11510 - DNA, 172 bp, Artificial Sequence
  Synthetic polynucleotide
atcatctcaccttgcctcctgtagggtagaaggtgcgtcctgcaggccatggcaacagaccatggcaactcgccatggcaacgacccatggcaacctaccatggcaacactccatggcaactgcccatggcaacgtaccatggcaacggcgcgccatgcttcatcagactct

SEQ ID NO: 11511 - DNA, 172 bp, Artificial Sequence; identical to SEQ ID NO: 11510
  Synthetic polynucleotide

SEQ ID NO: 11512 - DNA, 180 bp, Artificial Sequence
  Synthetic polynucleotide
atcatctcaccttgcctcctgaacgttgtatgtagggtcctgcaggtaatttaatcaagataatttaatcatcgtaatttaatcagactaatttaatcactataatttaatcaacttaatttaatcatgctaatttaatcagtataatttaatcaggcgcgccatgcttcatcagactct

SEQ ID NO: 11513 - DNA, 180 bp, Artificial Sequence; identical to SEQ ID NO: 11512
  Synthetic polynucleotide

SEQ ID NO: 11514 - DNA, 172 bp, Artificial Sequence
  Synthetic polynucleotide
atcatctcaccttgcctcctggcgatgcattcagtgaccctgcagggttaactagtagagttaactagttcggttaactagtgacgttaactagtctagttaactagtactgttaactagttgcgttaactagtgtagttaactagtggcgcgccatgcttcatcagactct

SEQ ID NO: 11515 - DNA, 172 bp, Artificial Sequence; identical to SEQ ID NO: 11514
  Synthetic polynucleotide

SEQ ID NO: 11516 - DNA, 191 bp, Artificial Sequence
  Synthetic polynucleotide
atcatctcaccttgcctcctgaaataccttacgggtgtcctgcaggcgcattaattaattaccagacgcattaattaattacctcgcgcattaattaattaccgaccgcattaattaattaccctacgcattaattaattaccactcgcattaattaattacctgcggcgcgccatgcttcatcagactct

SEQ ID NO: 11517 - DNA, 191 bp, Artificial Sequence; identical to SEQ ID NO: 11516
  Synthetic polynucleotide

SEQ ID NO: 11518 - DNA, 190 bp, Artificial Sequence
  Synthetic polynucleotide
atcatctcaccttgcctcctgattcaagggcatggactcctgcagggaaccggaagtggcagagaaccggaagtggctcggaaccggaagtggcgacgaaccggaagtggcctagaaccggaagtggcactgaaccggaagtggctgcgaaccggaagtggcgtaggcgcgccatgcttcatcagactct

SEQ ID NO: 11519 - DNA, 190 bp, Artificial Sequence; identical to SEQ ID NO: 11518
  Synthetic polynucleotide

SEQ ID NO: 11520 - DNA, 190 bp, Artificial Sequence
  Synthetic polynucleotide
atcatctcaccttgcctcctgagattggagatgacacgcctgcaggtttgaatattcataagatttgaatattcatatcgtttgaatattcatagactttgaatattcatactatttgaatattcataacttttgaatattcatatgctttgaatattcatagtaggcgcgccatgcttcatcagactct

SEQ ID NO: 11521 - DNA, 190 bp, Artificial Sequence; identical to SEQ ID NO: 11520
  Synthetic polynucleotide

SEQ ID NO: 11522 - DNA, 196 bp, Artificial Sequence
  Synthetic polynucleotide
atcatctcaccttgcctcctgtggccaattcagtaactcctgcaggctcatttcaaaaaagactcatttcaaaaatcgctcatttcaaaaagacctcatttcaaaaactactcatttcaaaaaactctcatttcaaaaatgcctcatttcaaaaagtactcatttcaaaaaggcgcgccatgcttcatcagactct

SEQ ID NO: 11523 - DNA, 196 bp, Artificial Sequence; identical to SEQ ID NO: 11522
  Synthetic polynucleotide

SEQ ID NO: 11524 - DNA, 191 bp, Artificial Sequence
  Synthetic polynucleotide
atcatctcaccttgcctcctgaagccctgttgctatgccctgcaggacatgtcatagacatgtagaacatgtcatagacatgttcgacatgtcatagacatgtgacacatgtcatagacatgtctaacatgtcatagacatgtactacatgtcatagacatgttgcggcgcgccatgcttcatcagactct

SEQ ID NO: 11525 - DNA, 191 bp, Artificial Sequence; identical to SEQ ID NO: 11524
  Synthetic polynucleotide

SEQ ID NO: 11526 - DNA, 180 bp, Artificial Sequence
  Synthetic polynucleotide
atcatctcaccttgcctcctgttggtctgggcattgttcctgcaggtcccaagggacagatcccaagggactcgtcccaagggacgactcccaagggacctatcccaagggacacttcccaagggactgctcccaagggacgtatcccaagggacggcgcgccatgcttcatcagactct

SEQ ID NO: 11527 - DNA, 180 bp, Artificial Sequence; identical to SEQ ID NO: 11526
  Synthetic polynucleotide

SEQ ID NO: 11528 - DNA, 197 bp, Artificial Sequence
  Synthetic polynucleotide
atcatctcaccttgcctcctgcccgttcttcaaatcctcctgcaggaaaacccggagcggaagaaaaacccggagcggatcgaaaacccggagcggagacaaaacccggagcggactaaaaacccggagcggaactaaaacccggagcggatgcaaaacccggagcggagtaggcgcgccatgcttcatcagactct

SEQ ID NO: 11529 - DNA, 197 bp, Artificial Sequence; identical to SEQ ID NO: 11528
  Synthetic polynucleotide

SEQ ID NO: 11530 - DNA, 172 bp, Artificial Sequence
  Synthetic polynucleotide
atcatctcaccttgcctcctgttagaagatttcgcggtcctgcaggcacagctggtagacacagctggttcgcacagctggtgaccacagctggtctacacagctggtactcacagctggttgccacagctggtgtacacagctggtggcgcgccatgcttcatcagactct

SEQ ID NO: 11531 - DNA, 172 bp, Artificial Sequence; identical to SEQ ID NO: 11530
  Synthetic polynucleotide

SEQ ID NO: 11532 - DNA, 185 bp, Artificial Sequence
  Synthetic polynucleotide
atcatctcaccttgcctcctggtcgcaaattggctgtgcctgcagggggcacgcaacccttaagagggcacgcaacccttatcggggcacgcaacccttagacgggcacgcaacccttactagggcacgcaacccttaactgggcacgcaacccttatgcggcgcgccatgcttcatcagactct

SEQ ID NO: 11533 - DNA, 185 bp, Artificial Sequence; identical to SEQ ID NO: 11532
  Synthetic polynucleotide

SEQ ID NO: 11534 - DNA, 172 bp, Artificial Sequence
  Synthetic polynucleotide
atcatctcaccttgcctcctgcggtatgttcggattgccctgcagggcggatagcgagagcggatagcgtcggcggatagcggacgcggatagcgctagcggatagcgactgcggatagcgtgcgcggatagcggtagcggatagcgggcgcgccatgcttcatcagactct

SEQ ID NO: 11535 - DNA, 172 bp, Artificial Sequence; identical to SEQ ID NO: 11534
  Synthetic polynucleotide

SEQ ID NO: 11536 - DNA, 164 bp, Artificial Sequence
  Synthetic polynucleotide
atcatctcaccttgcctcctgaggtgtttctacatacacctgcagggcctcaggcagagcctcaggctcggcctcaggcgacgcctcaggcctagcctcaggcactgcctcaggctgcgcctcaggcgtagcctcaggcggcgcgccatgcttcatcagactct

SEQ ID NO: 11537 - DNA, 164 bp, Artificial Sequence; identical to SEQ ID NO: 11536
  Synthetic polynucleotide

SEQ ID NO: 11538 - DNA, 196 bp, Artificial Sequence
  Synthetic polynucleotide
atcatctcaccttgcctcctggccggtacgaaatacggcctgcaggcgaaatcacggccagacgaaatcacggcctcgcgaaatcacggccgaccgaaatcacggccctacgaaatcacggccactcgaaatcacggcctgccgaaatcacggccgtacgaaatcacggccggcgcgccatgcttcatcagactct

SEQ ID NO: 11539 - DNA, 196 bp, Artificial Sequence; identical to SEQ ID NO: 11538
  Synthetic polynucleotide

SEQ ID NO: 11540 - DNA, 172 bp, Artificial Sequence
  Synthetic polynucleotide
atcatctcaccttgcctcctgacaccgcgtttagtgggcctgcaggaaaactacaaagaaaaactacaatcgaaaactacaagacaaaactacaactaaaaactacaaactaaaactacaatgcaaaactacaagtaaaaactacaaggcgcgccatgcttcatcagactct

SEQ ID NO: 11541 - DNA, 172 bp, Artificial Sequence; identical to SEQ ID NO: 11540
  Synthetic polynucleotide

SEQ ID NO: 11542 - DNA, 191 bp, Artificial Sequence
  Synthetic polynucleotide
atcatctcaccttgcctcctgggaagaacgtaagggtacctgcagggttcactaattagtttaagagttcactaattagtttatcggttcactaattagtttagacgttcactaattagtttactagttcactaattagtttaactgttcactaattagtttatgcggcgcgccatgcttcatcagactct

SEQ ID NO: 11543 - DNA, 191 bp, Artificial Sequence; identical to SEQ ID NO: 11542
  Synthetic polynucleotide

SEQ ID NO: 11544 - DNA, 180 bp, Artificial Sequence
  Synthetic polynucleotide
atcatctcaccttgcctcctgcaacatttcgcgcaagtcctgcagggcgccccctggagagcgccccctggtcggcgccccctgggacgcgccccctggctagcgccccctggactgcgccccctggtgcgcgccccctgggtagcgccccctggggcgcgccatgcttcatcagactct

SEQ ID NO: 11545 - DNA, 180 bp, Artificial Sequence; identical to SEQ ID NO: 11544
  Synthetic polynucleotide

SEQ ID NO: 11546 - DNA, 185 bp, Artificial Sequence
  Synthetic polynucleotide
atcatctcaccttgcctcctgaagacatgcggctgcgacctgcaggcaccagggggcgccagagacaccagggggcgccagtcgcaccagggggcgccaggaccaccagggggcgccagctacaccagggggcgccagactcaccagggggcgccagtgcggcgcgccatgcttcatcagactct

SEQ ID NO: 11547 - DNA, 185 bp, Artificial Sequence; identical to SEQ ID NO: 11546
  Synthetic polynucleotide

SEQ ID NO: 11548 - DNA, 180 bp, Artificial Sequence
  Synthetic polynucleotide
atcatctcaccttgcctcctggtgccctgagagacatacctgcaggctgggtggtccagactgggtggtcctcgctgggtggtccgacctgggtggtccctactgggtggtccactctgggtggtcctgcctgggtggtccgtactgggtggtccggcgcgccatgcttcatcagactct

SEQ ID NO: 11549 - DNA, 180 bp, Artificial Sequence; identical to SEQ ID NO: 11548
  Synthetic polynucleotide

SEQ ID NO: 11550 - DNA, 164 bp, Artificial Sequence
  Synthetic polynucleotide
atcatctcaccttgcctcctgttacgaggctgacctaacctgcaggttttaattgagattttaattgtcgttttaattggacttttaattgctattttaattgactttttaattgtgcttttaattggtattttaattgggcgcgccatgcttcatcagactct

SEQ ID NO: 11551 - DNA, 164 bp, Artificial Sequence; identical to SEQ ID NO: 11550
  Synthetic polynucleotide

SEQ ID NO: 11552 - DNA, 164 bp, Artificial Sequence
  Synthetic polynucleotide
atcatctcaccttgcctcctggcttaatcagtgttggacctgcaggttttaattaagattttaattatcgttttaattagacttttaattactattttaattaactttttaattatgcttttaattagtattttaattaggcgcgccatgcttcatcagactct

SEQ ID NO: 11553 - DNA, 164 bp, Artificial Sequence; identical to SEQ ID NO: 11552
  Synthetic polynucleotide

SEQ ID NO: 11554 - DNA, 172 bp, Artificial Sequence
  Synthetic polynucleotide
atcatctcaccttgcctcctgcgtaatccagcataaatcctgcaggatcaccccacagaatcaccccactcgatcaccccacgacatcaccccacctaatcaccccacactatcaccccactgcatcaccccacgtaatcaccccacggcgcgccatgcttcatcagactct

SEQ ID NO: 11555 - DNA, 172 bp, Artificial Sequence; identical to SEQ ID NO: 11554
  Synthetic polynucleotide

SEQ ID NO: 11556 - DNA, 191 bp, Artificial Sequence
  Synthetic polynucleotide
atcatctcaccttgcctcctgagcaggaccattggtttcctgcagggaaaattaattacttcgagagaaaattaattacttcgtcggaaaattaattacttcggacgaaaattaattacttcgctagaaaattaattacttcgactgaaaattaattacttcgtgcggcgcgccatgcttcatcagactct

SEQ ID NO: 11557 - DNA, 191 bp, Artificial Sequence; identical to SEQ ID NO: 11556
  Synthetic polynucleotide

SEQ ID NO: 11558 - DNA, 172 bp, Artificial Sequence
  Synthetic polynucleotide
atcatctcaccttgcctcctggggtcctactttctgatcctgcagggcgcgccaatagagcgcgccaattcggcgcgccaatgacgcgcgccaatctagcgcgccaatactgcgcgccaattgcgcgcgccaatgtagcgcgccaatggcgcgccatgcttcatcagactct

SEQ ID NO: 11559 - DNA, 172 bp, Artificial Sequence; identical to SEQ ID NO: 11558
  Synthetic polynucleotide

SEQ ID NO: 11560 - DNA, 196 bp, Artificial Sequence
  Synthetic polynucleotide
atcatctcaccttgcctcctgattagccagtgaaatggcctgcaggaccactagatggcactattgcaagaaccactagatggcactattgcatcgaccactagatggcactattgcagacaccactagatggcactattgcactaaccactagatggcactattgcaactggcgcgccatgcttcatcagactct

SEQ ID NO: 11561 - DNA, 196 bp, Artificial Sequence; identical to SEQ ID NO: 11560
  Synthetic polynucleotide

SEQ ID NO: 11562 - DNA, 191 bp, Artificial Sequence
  Synthetic polynucleotide
atcatctcaccttgcctcctgaatgaacgaggacaacacctgcaggtacactaattagtggcaagatacactaattagtggcatcgtacactaattagtggcagactacactaattagtggcactatacactaattagtggcaacttacactaattagtggcatgcggcgcgccatgcttcatcagactct

SEQ ID NO: 11563 - DNA, 191 bp, Artificial Sequence; identical to SEQ ID NO: 11562
  Synthetic polynucleotide

SEQ ID NO: 11564 - DNA, 197 bp, Artificial Sequence
  Synthetic polynucleotide
atcatctcaccttgcctcctgacgttagtgtcctgtatcctgcagggactacaattcccagagagactacaattcccagtcggactacaattcccaggacgactacaattcccagctagactacaattcccagactgactacaattcccagtgcgactacaattcccaggtaggcgcgccatgcttcatcagactct

SEQ ID NO: 11565 - DNA, 197 bp, Artificial Sequence; identical to SEQ ID NO: 11564
  Synthetic polynucleotide

SEQ ID NO: 11566 - DNA, 172 bp, Artificial Sequence
  Synthetic polynucleotide
atcatctcaccttgcctcctgctggtggttattaatcgcctgcaggagcacgtgacagaagcacgtgactcgagcacgtgacgacagcacgtgacctaagcacgtgacactagcacgtgactgcagcacgtgacgtaagcacgtgacggcgcgccatgcttcatcagactct

SEQ ID NO: 11567 - DNA, 172 bp, Artificial Sequence; identical to SEQ ID NO: 11566
  Synthetic polynucleotide

SEQ ID NO: 11568 - DNA, 156 bp, Artificial Sequence
  Synthetic polynucleotide
atcatctcaccttgcctcctgcgtcagggtctcgctatcctgcaggccctccccagaccctcccctcgccctccccgacccctccccctaccctccccactccctcccctgcccctccccgtaccctccccggcgcgccatgcttcatcagactct

SEQ ID NO: 11569 - DNA, 156 bp, Artificial Sequence; identical to SEQ ID NO: 11568
  Synthetic polynucleotide

SEQ ID NO: 11570 - DNA, 164 bp, Artificial Sequence
  Synthetic polynucleotide
atcatctcaccttgcctcctgttacccgcccaatgtatcctgcaggatttaattaagaatttaattatcgatttaattagacatttaattactaatttaattaactatttaattatgcatttaattagtaatttaattaggcgcgccatgcttcatcagactct

SEQ ID NO: 11571 - DNA, 164 bp, Artificial Sequence; identical to SEQ ID NO: 11570
  Synthetic polynucleotide

SEQ ID NO: 11572 - DNA, 188 bp, Artificial Sequence
  Synthetic polynucleotide
atcatctcaccttgcctcctgtgctcaaactcctcagacctgcaggtttcccgccaaaagatttcccgccaaatcgtttcccgccaaagactttcccgccaaactatttcccgccaaaacttttcccgccaaatgctttcccgccaaagtatttcccgccaaaggcgcgccatgcttcatcagactct

SEQ ID NO: 11573 - DNA, 188 bp, Artificial Sequence; identical to SEQ ID NO: 11572
  Synthetic polynucleotide

SEQ ID NO: 11574 - DNA, 185 bp, Artificial Sequence
  Synthetic polynucleotide
atcatctcaccttgcctcctgttaatcccggcgatggacctgcaggcagcattaattagtagagacagcattaattagtagtcgcagcattaattagtaggaccagcattaattagtagctacagcattaattagtagactcagcattaattagtagtgcggcgcgccatgcttcatcagactct

SEQ ID NO: 11575 - DNA, 185 bp, Artificial Sequence; identical to SEQ ID NO: 11574
  Synthetic polynucleotide

SEQ ID NO: 11576 - DNA, 180 bp, Artificial Sequence
  Synthetic polynucleotide
atcatctcaccttgcctcctgggcccgaagtaaaccctcctgcaggaaccacttaagagaaaccacttaagtcgaaccacttaaggacaaccacttaagctaaaccacttaagactaaccacttaagtgcaaccacttaaggtaaaccacttaagggcgcgccatgcttcatcagactct

SEQ ID NO: 11577 - DNA, 180 bp, Artificial Sequence; identical to SEQ ID NO: 11576
  Synthetic polynucleotide

SEQ ID NO: 11578 - DNA, 185 bp, Artificial Sequence
  Synthetic polynucleotide
atcatctcaccttgcctcctgtgtatcaaccgctagaccctgcaggctgtggggggtcgataagactgtggggggtcgatatcgctgtggggggtcgatagacctgtggggggtcgatactactgtggggggtcgataactctgtggggggtcgatatgcggcgcgccatgcttcatcagactct

SEQ ID NO: 11579 - DNA, 185 bp, Artificial Sequence; identical to SEQ ID NO: 11578
  Synthetic polynucleotide

SEQ ID NO: 11580 - DNA, 172 bp, Artificial Sequence
  Synthetic polynucleotide
atcatctcaccttgcctcctgtgtgtccacgggtgtaacctgcaggacccggaaatagaacccggaaattcgacccggaaatgacacccggaaatctaacccggaaatactacccggaaattgcacccggaaatgtaacccggaaatggcgcgccatgcttcatcagactct

SEQ ID NO: 11581 - DNA, 172 bp, Artificial Sequence; identical to SEQ ID NO: 11580
  Synthetic polynucleotide

SEQ ID NO: 11582 - DNA, 191 bp, Artificial Sequence
  Synthetic polynucleotide
atcatctcaccttgcctcctggaagaggatacagtaaacctgcaggctgatcgaaaccaaagtagactgatcgaaaccaaagttcgctgatcgaaaccaaagtgacctgatcgaaaccaaagtctactgatcgaaaccaaagtactctgatcgaaaccaaagttgcggcgcgccatgcttcatcagactct

SEQ ID NO: 11583 - DNA, 191 bp, Artificial Sequence; identical to SEQ ID NO: 11582
  Synthetic polynucleotide

SEQ ID NO: 11584 - DNA, 140 bp, Artificial Sequence
  Synthetic polynucleotide
atcatctcaccttgcctcctgcactagtagtcactcgacctgcaggggaatgagaggaatgtcgggaatggacggaatgctaggaatgactggaatgtgcggaatggtaggaatgggcgcgccatgcttcatcagactct

SEQ ID NO: 11585 - DNA, 140 bp, Artificial Sequence; identical to SEQ ID NO: 11584
  Synthetic polynucleotide

SEQ ID NO: 11586 - DNA, 197 bp, Artificial Sequence
  Synthetic polynucleotide
atcatctcaccttgcctcctgcctgaactcttgaacatcctgcaggcatgtcgggacatgcagacatgtcgggacatgctcgcatgtcgggacatgcgaccatgtcgggacatgcctacatgtcgggacatgcactcatgtcgggacatgctgccatgtcgggacatgcgtaggcgcgccatgcttcatcagactct

SEQ ID NO: 11587 - DNA, 197 bp, Artificial Sequence; identical to SEQ ID NO: 11586
  Synthetic polynucleotide

SEQ ID NO: 11588 - DNA, 197 bp, Artificial Sequence
  Synthetic polynucleotide
atcatctcaccttgcctcctgcaagtttaacgacgtaccctgcaggtgctaaaaatagcaaagatgctaaaaatagcaatcgtgctaaaaatagcaagactgctaaaaatagcaactatgctaaaaatagcaaacttgctaaaaatagcaatgctgctaaaaatagcaagtaggcgcgccatgcttcatcagactct

SEQ ID NO: 11589 - DNA, 197 bp, Artificial Sequence; identical to SEQ ID NO: 11588
  Synthetic polynucleotide

SEQ ID NO: 11590 - DNA, 172 bp, Artificial Sequence
  Synthetic polynucleotide
atcatctcaccttgcctcctgaagaccatctatacggccctgcagggttaatccgcagagttaatccgctcggttaatccgcgacgttaatccgcctagttaatccgcactgttaatccgctgcgttaatccgcgtagttaatccgcggcgcgccatgcttcatcagactct

SEQ ID NO: 11591 - DNA, 172 bp, Artificial Sequence; identical to SEQ ID NO: 11590
  Synthetic polynucleotide

SEQ ID NO: 11592 - DNA, 172 bp, Artificial Sequence
  Synthetic polynucleotide
atcatctcaccttgcctcctgggactcacctttatacgcctgcaggtcttatctctagatcttatctcttcgtcttatctctgactcttatctctctatcttatctctacttcttatctcttgctcttatctctgtatcttatctctggcgcgccatgcttcatcagactct

SEQ ID NO: 11593 - DNA, 172 bp, Artificial Sequence; identical to SEQ ID NO: 11592
  Synthetic polynucleotide

SEQ ID NO: 11594 - DNA, 188 bp, Artificial Sequence
  Synthetic polynucleotide
atcatctcaccttgcctcctgggtcccaggagagcttacctgcaggttgtgtttttttagattgtgttttttttcgttgtgtttttttgacttgtgtttttttctattgtgtttttttactttgtgttttttttgcttgtgtttttttgtattgtgtttttttggcgcgccatgcttcatcagactct

SEQ ID NO: 11595 - DNA, 188 bp, Artificial Sequence; identical to SEQ ID NO: 11594
  Synthetic polynucleotide

SEQ ID NO: 11596 - DNA, 197 bp, Artificial Sequence
  Synthetic polynucleotide
atcatctcaccttgcctcctgttacatgagatgaagctcctgcaggggaaggaaggaaggaaggagaggaaggaaggaaggaaggtcgggaaggaaggaaggaagggacggaaggaaggaaggaaggctaggaaggaaggaaggaaggactggaaggaaggaaggaaggtgcggcgcgccatgcttcatcagactct

SEQ ID NO: 11597 - DNA, 197 bp, Artificial Sequence; identical to SEQ ID NO: 11596
  Synthetic polynucleotide

SEQ ID NO: 11598 - DNA, 196 bp, Artificial Sequence
  Synthetic polynucleotide
atcatctcaccttgcctcctgggtcatcccaattgttacctgcaggtgctgagtcagcaagatgctgagtcagcatcgtgctgagtcagcagactgctgagtcagcactatgctgagtcagcaacttgctgagtcagcatgctgctgagtcagcagtatgctgagtcagcaggcgcgccatgcttcatcagactct

SEQ ID NO: 11599 - DNA, 196 bp, Artificial Sequence; identical to SEQ ID NO: 11598
  Synthetic polynucleotide

SEQ ID NO: 11600 - DNA, 164 bp, Artificial Sequence
  Synthetic polynucleotide
atcatctcaccttgcctcctgttatgaggcctgctgtgcctgcaggtatcactttagatatcacttttcgtatcactttgactatcactttctatatcactttacttatcacttttgctatcactttgtatatcactttggcgcgccatgcttcatcagactct

SEQ ID NO: 11601 - DNA, 164 bp, Artificial Sequence; identical to SEQ ID NO: 11600
  Synthetic polynucleotide

SEQ ID NO: 11602 - DNA, 185 bp, Artificial Sequence
  Synthetic polynucleotide
atcatctcaccttgcctcctgaacacaatcacacgccgcctgcagggtatacttcttactgcagagtatacttcttactgctcggtatacttcttactgcgacgtatacttcttactgcctagtatacttcttactgcactgtatacttcttactgctgcggcgcgccatgcttcatcagactct

SEQ ID NO: 11603 - DNA, 185 bp, Artificial Sequence; identical to SEQ ID NO: 11602
  Synthetic polynucleotide

SEQ ID NO: 11604 - DNA, 156 bp, Artificial Sequence
  Synthetic polynucleotide
atcatctcaccttgcctcctggccctatcttgtctattcctgcaggaaaggcgcagaaaaggcgctcgaaaggcgcgacaaaggcgcctaaaaggcgcactaaaggcgctgcaaaggcgcgtaaaaggcgcggcgcgccatgcttcatcagactct

SEQ ID NO: 11605 - DNA, 156 bp, Artificial Sequence; identical to SEQ ID NO: 11604
  Synthetic polynucleotide

SEQ ID NO: 11606 - DNA, 156 bp, Artificial Sequence
  Synthetic polynucleotide
atcatctcaccttgcctcctgcctacgcgaggtgtagacctgcaggggctgaggagaggctgaggtcgggctgagggacggctgaggctaggctgaggactggctgaggtgcggctgagggtaggctgaggggcgcgccatgcttcatcagactct

SEQ ID NO: 11607 - DNA, 156 bp, Artificial Sequence; identical to SEQ ID NO: 11606
  Synthetic polynucleotide

SEQ ID NO: 11608 - DNA, 172 bp, Artificial Sequence
  Synthetic polynucleotide
atcatctcaccttgcctcctgatgctcaggaatgactgcctgcaggtgatgactcaagatgatgactcatcgtgatgactcagactgatgactcactatgatgactcaacttgatgactcatgctgatgactcagtatgatgactcaggcgcgccatgcttcatcagactct

SEQ ID NO: 11609 - DNA, 172 bp, Artificial Sequence; identical to SEQ ID NO: 11608
  Synthetic polynucleotide

SEQ ID NO: 11610 - DNA, 164 bp, Artificial Sequence
  Synthetic polynucleotide
atcatctcaccttgcctcctgtcgcggatttatgtcaccctgcagggcacgtgtcagagcacgtgtctcggcacgtgtcgacgcacgtgtcctagcacgtgtcactgcacgtgtctgcgcacgtgtcgtagcacgtgtcggcgcgccatgcttcatcagactct

SEQ ID NO: 11611 - DNA, 164 bp, Artificial Sequence; identical to SEQ ID NO: 11610
  Synthetic polynucleotide

SEQ ID NO: 11612 - DNA, 140 bp, Artificial Sequence
  Synthetic polynucleotide
atcatctcaccttgcctcctgagattggcgatcgacggcctgcagggtggatagagtggattcggtggatgacgtggatctagtggatactgtggattgcgtggatgtagtggatggcgcgccatgcttcatcagactct

SEQ ID NO: 11613 - DNA, 140 bp, Artificial Sequence; identical to SEQ ID NO: 11612
  Synthetic polynucleotide

SEQ ID NO: 11614 - DNA, 172 bp, Artificial Sequence
  Synthetic polynucleotide
atcatctcaccttgcctcctgtaagggcatcggtgttacctgcaggcgtcacgcgtagacgtcacgcgttcgcgtcacgcgtgaccgtcacgcgtctacgtcacgcgtactcgtcacgcgttgccgtcacgcgtgtacgtcacgcgtggcgcgccatgcttcatcagactct

SEQ ID NO: 11615 - DNA, 172 bp, Artificial Sequence; identical to SEQ ID NO: 11614
  Synthetic polynucleotide

SEQ ID NO: 11616 - DNA, 164 bp, Artificial Sequence
  Synthetic polynucleotide
atcatctcaccttgcctcctggtttccgtgacaagagccctgcaggcgcgccaaaagacgcgccaaatcgcgcgccaaagaccgcgccaaactacgcgccaaaactcgcgccaaatgccgcgccaaagtacgcgccaaaggcgcgccatgcttcatcagactct

SEQ ID NO: 11617 - DNA, 164 bp, Artificial Sequence; identical to SEQ ID NO: 11616
  Synthetic polynucleotide

SEQ ID NO: 11618 - DNA, 172 bp, Artificial Sequence
  Synthetic polynucleotide
atcatctcaccttgcctcctgaccgaaatctcaaggaacctgcaggaatattgacaagaaatattgacatcgaatattgacagacaatattgacactaaatattgacaactaatattgacatgcaatattgacagtaaatattgacaggcgcgccatgcttcatcagactct

SEQ ID NO: 11619 - DNA, 172 bp, Artificial Sequence; identical to SEQ ID NO: 11618
  Synthetic polynucleotide

SEQ ID NO: 11620 - DNA, 197 bp, Artificial Sequence
  Synthetic polynucleotide
atcatctcaccttgcctcctgcgacccacgaactaacacctgcaggctgaccgcagctggttctagactgaccgcagctggttcttcgctgaccgcagctggttctgacctgaccgcagctggttctctactgaccgcagctggttctactctgaccgcagctggttcttgcggcgcgccatgcttcatcagactct

SEQ ID NO: 11621 - DNA, 197 bp, Artificial Sequence; identical to SEQ ID NO: 11620
  Synthetic polynucleotide

SEQ ID NO: 11622 - DNA, 197 bp, Artificial Sequence
  Synthetic polynucleotide
atcatctcaccttgcctcctggtgatataagcgtgcgacctgcaggtgctgactcagcaaaagatgctgactcagcaaatcgtgctgactcagcaaagactgctgactcagcaaactatgctgactcagcaaaacttgctgactcagcaaatgctgctgactcagcaaagtaggcgcgccatgcttcatcagactct

SEQ ID NO: 11623 - DNA, 197 bp, Artificial Sequence; identical to SEQ ID NO: 11622
  Synthetic polynucleotide

SEQ ID NO: 11624 - DNA, 180 bp, Artificial Sequence
  Synthetic polynucleotide
atcatctcaccttgcctcctgttgggacctaactagggcctgcaggatgaccttgaaagaatgaccttgaatcgatgaccttgaagacatgaccttgaactaatgaccttgaaactatgaccttgaatgcatgaccttgaagtaatgaccttgaaggcgcgccatgcttcatcagactct

SEQ ID NO: 11625 - DNA, 180 bp, Artificial Sequence; identical to SEQ ID NO: 11624
  Synthetic polynucleotide

SEQ ID NO: 11626 - DNA, 172 bp, Artificial Sequence
  Synthetic polynucleotide
atcatctcaccttgcctcctggcatacgtcccgtaatacctgcaggttatgttaatagattatgttaattcgttatgttaatgacttatgttaatctattatgttaatactttatgttaattgcttatgttaatgtattatgttaatggcgcgccatgcttcatcagactct

SEQ ID NO: 11627 - DNA, 172 bp, Artificial Sequence; identical to SEQ ID NO: 11626
  Synthetic polynucleotide

SEQ ID NO: 11628 - DNA, 196 bp, Artificial Sequence
  Synthetic polynucleotide
atcatctcaccttgcctcctgagtctttcacgagcgaccctgcaggaaccaattaaaaaagaaaccaattaaaaatcgaaccaattaaaaagacaaccaattaaaaactaaaccaattaaaaaactaaccaattaaaaatgcaaccaattaaaaagtaaaccaattaaaaaggcgcgccatgcttcatcagactct

SEQ ID NO: 11629 - DNA, 196 bp, Artificial Sequence; identical to SEQ ID NO: 11628
  Synthetic polynucleotide

SEQ ID NO: 11630 - DNA, 180 bp, Artificial Sequence
  Synthetic polynucleotide
atcatctcaccttgcctcctgtcctgcatatcataaaccctgcagggatcaccccacagagatcaccccactcggatcaccccacgacgatcaccccacctagatcaccccacactgatcaccccactgcgatcaccccacgtagatcaccccacggcgcgccatgcttcatcagactct

SEQ ID NO: 11631 - DNA, 180 bp, Artificial Sequence; identical to SEQ ID NO: 11630
  Synthetic polynucleotide

SEQ ID NO: 11632 - DNA, 180 bp, Artificial Sequence
  Synthetic polynucleotide
atcatctcaccttgcctcctgccacgcatcaggagagacctgcaggcggcacctgccagacggcacctgcctcgcggcacctgccgaccggcacctgccctacggcacctgccactcggcacctgcctgccggcacctgccgtacggcacctgccggcgcgccatgcttcatcagactct

SEQ ID NO: 11633 - DNA, 180 bp, Artificial Sequence; identical to SEQ ID NO: 11632
  Synthetic polynucleotide

SEQ ID NO: 11634 - DNA, 180 bp, Artificial Sequence
  Synthetic polynucleotide
atcatctcaccttgcctcctgagggcttgagcgctaatcctgcaggctgggtggtctagactgggtggtcttcgctgggtggtctgacctgggtggtctctactgggtggtctactctgggtggtcttgcctgggtggtctgtactgggtggtctggcgcgccatgcttcatcagactct

SEQ ID NO: 11635 - DNA, 180 bp, Artificial Sequence; identical to SEQ ID NO: 11634
  Synthetic polynucleotide

SEQ ID NO: 11636 - DNA, 172 bp, Artificial Sequence
  Synthetic polynucleotide
atcatctcaccttgcctcctgtgaaatggttgggtggacctgcaggtgccccccttagatgcccccctttcgtgccccccttgactgccccccttctatgccccccttacttgcccccctttgctgccccccttgtatgccccccttggcgcgccatgcttcatcagactct

SEQ ID NO: 11637 - DNA, 172 bp, Artificial Sequence; identical to SEQ ID NO: 11636
  Synthetic polynucleotide

SEQ ID NO: 11638 - DNA, 180 bp, Artificial Sequence
  Synthetic polynucleotide
atcatctcaccttgcctcctgagaacctgagtttccgccctgcaggccatatggtacagaccatatggtactcgccatatggtacgacccatatggtacctaccatatggtacactccatatggtactgcccatatggtacgtaccatatggtacggcgcgccatgcttcatcagactct

SEQ ID NO: 11639 - DNA, 180 bp, Artificial Sequence; identical to SEQ ID NO: 11638
  Synthetic polynucleotide

SEQ ID NO: 11640 - DNA, 156 bp, Artificial Sequence
  Synthetic polynucleotide
atcatctcaccttgcctcctgaccctaactccttgtatcctgcaggtgacctttagatgaccttttcgtgacctttgactgacctttctatgacctttacttgaccttttgctgacctttgtatgacctttggcgcgccatgcttcatcagactct

SEQ ID NO: 11641 - DNA, 156 bp, Artificial Sequence; identical to SEQ ID NO: 11640
  Synthetic polynucleotide

SEQ ID NO: 11642 - DNA, 172 bp, Artificial Sequence
  Synthetic polynucleotide
atcatctcaccttgcctcctgcccacactcccttagtacctgcaggtacaattcccagatacaattccctcgtacaattcccgactacaattcccctatacaattcccacttacaattccctgctacaattcccgtatacaattcccggcgcgccatgcttcatcagactct

SEQ ID NO: 11643 - DNA, 172 bp, Artificial Sequence; identical to SEQ ID NO: 11642
  Synthetic polynucleotide

SEQ ID NO: 11644 - DNA, 172 bp, Artificial Sequence
  Synthetic polynucleotide
atcatctcaccttgcctcctggcttgagggacactcaacctgcaggttaattaattagattaattaatttcgttaattaattgacttaattaattctattaattaattactttaattaatttgcttaattaattgtattaattaattggcgcgccatgcttcatcagactct

SEQ ID NO: 11645 - DNA, 172 bp, Artificial Sequence; identical to SEQ ID NO: 11644
  Synthetic polynucleotide

SEQ ID NO: 11646 - DNA, 188 bp, Artificial Sequence
  Synthetic polynucleotide
atcatctcaccttgcctcctggtctatccagccgacgtcctgcaggtttaagtggtttagatttaagtggttttcgtttaagtggtttgactttaagtggtttctatttaagtggtttacttttaagtggttttgctttaagtggtttgtatttaagtggtttggcgcgccatgcttcatcagactct

SEQ ID NO: 11647 - DNA, 188 bp, Artificial Sequence; identical to SEQ ID NO: 11646
  Synthetic polynucleotide

SEQ ID NO: 11648 - DNA, 191 bp, Artificial Sequence
  Synthetic polynucleotide
atcatctcaccttgcctcctgcagggtcaccgaatttgcctgcaggctcctcccctccctcctccccagactcctcccctccctcctcccctcgctcctcccctccctcctccccgacctcctcccctccctcctccccctactcctcccctccctcctccccactggcgcgccatgcttcatcagactct

SEQ ID NO: 11649 - DNA, 191 bp, Artificial Sequence; identical to SEQ ID NO: 11648
  Synthetic polynucleotide

SEQ ID NO: 11650 - DNA, 190 bp, Artificial Sequence
  Synthetic polynucleotide
atcatctcaccttgcctcctgttcctggtgaaccaactcctgcaggtgattttgcaatatagatgattttgcaatattcgtgattttgcaatatgactgattttgcaatatctatgattttgcaatatacttgattttgcaatattgctgattttgcaatatgtaggcgcgccatgcttcatcagactct

SEQ ID NO: 11651 - DNA, 190 bp, Artificial Sequence; identical to SEQ ID NO: 11650
  Synthetic polynucleotide

SEQ ID NO: 11652 - DNA, 179 bp, Artificial Sequence
  Synthetic polynucleotide
atcatctcaccttgcctcctgctacatctagatgcgcgcctgcaggacggggcgcagggatttgttgcccagaacggggcgcagggatttgttgccctcgacggggcgcagggatttgttgcccgacacggggcgcagggatttgttgcccctaggcgcgccatgcttcatcagactct

SEQ ID NO: 11653 - DNA, 179 bp, Artificial Sequence; identical to SEQ ID NO: 11652
  Synthetic polynucleotide

SEQ ID NO: 11654 - DNA, 197 bp, Artificial Sequence
  Synthetic polynucleotide
atcatctcaccttgcctcctgctcgcttaaggcgcgatcctgcaggttgacctttgacctcagattgacctttgacctctcgttgacctttgacctcgacttgacctttgacctcctattgacctttgacctcactttgacctttgacctctgcttgacctttgacctcgtaggcgcgccatgcttcatcagactct

SEQ ID NO: 11655 - DNA, 197 bp, Artificial Sequence; identical to SEQ ID NO: 11654
  Synthetic polynucleotide

SEQ ID NO: 11656 - DNA, 164 bp, Artificial Sequence
  Synthetic polynucleotide
atcatctcaccttgcctcctgtcgctgagatactgcctcctgcaggttaatggccagattaatggcctcgttaatggccgacttaatggccctattaatggccactttaatggcctgcttaatggccgtattaatggccggcgcgccatgcttcatcagactct

SEQ ID NO: 11657 - DNA, 164 bp, Artificial Sequence; identical to SEQ ID NO: 11656
  Synthetic polynucleotide

SEQ ID NO: 11658 - DNA, 190 bp, Artificial Sequence
  Synthetic polynucleotide
atcatctcaccttgcctcctgaagcattctcatgcgtgcctgcaggtgatgacgtggcatagatgatgacgtggcattcgtgatgacgtggcatgactgatgacgtggcatctatgatgacgtggcatacttgatgacgtggcattgctgatgacgtggcatgtaggcgcgccatgcttcatcagactct

SEQ ID NO: 11659 - DNA, 190 bp, Artificial Sequence; identical to SEQ ID NO: 11658
  Synthetic polynucleotide

SEQ ID NO: 11660 - DNA, 164 bp, Artificial Sequence
  Synthetic polynucleotide
atcatctcaccttgcctcctgcaggagtgtagcgtcctcctgcagggttgtttacagagttgtttactcggttgtttacgacgttgtttacctagttgtttacactgttgtttactgcgttgtttacgtagttgtttacggcgcgccatgcttcatcagactct

SEQ ID NO: 11661 - DNA, 164 bp, Artificial Sequence; identical to SEQ ID NO: 11660
  Synthetic polynucleotide

SEQ ID NO: 11662 - DNA, 156 bp, Artificial Sequence
  Synthetic polynucleotide
atcatctcaccttgcctcctgtaacgtggacagcaatccctgcaggcaattagcagacaattagctcgcaattagcgaccaattagcctacaattagcactcaattagctgccaattagcgtacaattagcggcgcgccatgcttcatcagactct

SEQ ID NO: 11663 - DNA, 156 bp, Artificial Sequence; identical to SEQ ID NO: 11662
  Synthetic polynucleotide

SEQ ID NO: 11664 - DNA, 180 bp, Artificial Sequence
  Synthetic polynucleotide
atcatctcaccttgcctcctgatcgttaggtcggagaccctgcaggcaactggccctagacaactggcccttcgcaactggccctgaccaactggccctctacaactggccctactcaactggcccttgccaactggccctgtacaactggccctggcgcgccatgcttcatcagactct

SEQ ID NO: 11665 - DNA, 180 bp, Artificial Sequence; identical to SEQ ID NO: 11664
  Synthetic polynucleotide

SEQ ID NO: 11666 - DNA, 190 bp, Artificial Sequence
  Synthetic polynucleotide
atcatctcaccttgcctcctgaggagaccaagttacgacctgcaggtattgcacaatcctagatattgcacaatccttcgtattgcacaatcctgactattgcacaatcctctatattgcacaatcctacttattgcacaatccttgctattgcacaatcctgtaggcgcgccatgcttcatcagactct

SEQ ID NO: 11667 - DNA, 190 bp, Artificial Sequence; identical to SEQ ID NO: 11666
  Synthetic polynucleotide

SEQ ID NO: 11668 - DNA, 172 bp, Artificial Sequence
  Synthetic polynucleotide
atcatctcaccttgcctcctgtacgcaatgacatacgacctgcaggccccgcccgcagaccccgcccgctcgccccgcccgcgacccccgcccgcctaccccgcccgcactccccgcccgctgcccccgcccgcgtaccccgcccgcggcgcgccatgcttcatcagactct

SEQ ID NO: 11669 - DNA, 172 bp, Artificial Sequence; identical to SEQ ID NO: 11668
  Synthetic polynucleotide

SEQ ID NO: 11670 - DNA, 190 bp, Artificial Sequence
  Synthetic polynucleotide
atcatctcaccttgcctcctgcacacctctaaagagagcctgcaggggctaattagcgaaagaggctaattagcgaatcgggctaattagcgaagacggctaattagcgaactaggctaattagcgaaactggctaattagcgaatgcggctaattagcgaagtaggcgcgccatgcttcatcagactct

SEQ ID NO: 11671 - DNA, 190 bp, Artificial Sequence; identical to SEQ ID NO: 11670
  Synthetic polynucleotide

SEQ ID NO: 11672 - DNA, 148 bp, Artificial Sequence
  Synthetic polynucleotide
atcatctcaccttgcctcctgtacaaagccttaccctccctgcaggataaacaagaataaacatcgataaacagacataaacactaataaacaactataaacatgcataaacagtaataaacaggcgcgccatgcttcatcagactct

SEQ ID NO: 11673 - DNA, 148 bp, Artificial Sequence; identical to SEQ ID NO: 11672
  Synthetic polynucleotide

SEQ ID NO: 11674 - DNA, 172 bp, Artificial Sequence
  Synthetic polynucleotide
atcatctcaccttgcctcctgtaatatccggttcctctcctgcaggtggttgctacagatggttgctactcgtggttgctacgactggttgctacctatggttgctacacttggttgctactgctggttgctacgtatggttgctacggcgcgccatgcttcatcagactct

SEQ ID NO: 11675 - DNA, 172 bp, Artificial Sequence; identical to SEQ ID NO: 11674
  Synthetic polynucleotide

SEQ ID NO: 11676 - DNA, 172 bp, Artificial Sequence
  Synthetic polynucleotide
atcatctcaccttgcctcctgattaaggatcagcatgacctgcaggccccgcggccagaccccgcggcctcgccccgcggccgacccccgcggccctaccccgcggccactccccgcggcctgcccccgcggccgtaccccgcggccggcgcgccatgcttcatcagactct

SEQ ID NO: 11677 - DNA, 172 bp, Artificial Sequence; identical to SEQ ID NO: 11676
  Synthetic polynucleotide

SEQ ID NO: 11678 - DNA, 197 bp, Artificial Sequence
  Synthetic polynucleotide
atcatctcaccttgcctcctgaccgtcacgtagataaacctgcaggagtacatgatgttctagaagtacatgatgttcttcgagtacatgatgttctgacagtacatgatgttctctaagtacatgatgttctactagtacatgatgttcttgcagtacatgatgttctgtaggcgcgccatgcttcatcagactct

SEQ ID NO: 11679 - DNA, 197 bp, Artificial Sequence; identical to SEQ ID NO: 11678
  Synthetic polynucleotide

SEQ ID NO: 11680 - DNA, 148 bp, Artificial Sequence
  Synthetic polynucleotide
atcatctcaccttgcctcctgtcaccctatggcgttcgcctgcaggtgacgtaagatgacgtatcgtgacgtagactgacgtactatgacgtaacttgacgtatgctgacgtagtatgacgtaggcgcgccatgcttcatcagactct

SEQ ID NO: 11681 - DNA, 148 bp, Artificial Sequence; identical to SEQ ID NO: 11680
  Synthetic polynucleotide

SEQ ID NO: 11682 - DNA, 172 bp, Artificial Sequence
  Synthetic polynucleotide
atcatctcaccttgcctcctgagtaaccctgattgaaacctgcaggcacttcctctagacacttcctcttcgcacttcctctgaccacttcctctctacacttcctctactcacttcctcttgccacttcctctgtacacttcctctggcgcgccatgcttcatcagactct

SEQ ID NO: 11683 - DNA, 172 bp, Artificial Sequence; identical to SEQ ID NO: 11682
  Synthetic polynucleotide

SEQ ID NO: 11684 - DNA, 197 bp, Artificial Sequence
  Synthetic polynucleotide
atcatctcaccttgcctcctgcgaatcgcagagtttcccctgcaggtcttccgcttccttcagatcttccgcttccttctcgtcttccgcttccttcgactcttccgcttccttcctatcttccgcttccttcacttcttccgcttccttctgctcttccgcttccttcgtaggcgcgccatgcttcatcagactct

SEQ ID NO: 11685 - DNA, 197 bp, Artificial Sequence; identical to SEQ ID NO: 11684
  Synthetic polynucleotide

SEQ ID NO: 11686 - DNA, 191 bp, Artificial Sequence
  Synthetic polynucleotide
atcatctcaccttgcctcctggctgtctatagttcttccctgcaggggccaccagagggtggcagaggccaccagagggtggctcgggccaccagagggtggcgacggccaccagagggtggcctaggccaccagagggtggcactggccaccagagggtggctgcggcgcgccatgcttcatcagactct

SEQ ID NO: 11687 - DNA, 191 bp, Artificial Sequence; identical to SEQ ID NO: 11686
  Synthetic polynucleotide

SEQ ID NO: 11688 - DNA, 197 bp, Artificial Sequence
  Synthetic polynucleotide
atcatctcaccttgcctcctgatgccatgggattacagcctgcaggttgacctttgaccttagattgacctttgacctttcgttgacctttgaccttgacttgacctttgaccttctattgacctttgaccttactttgacctttgacctttgcttgacctttgaccttgtaggcgcgccatgcttcatcagactct

SEQ ID NO: 11689 - DNA, 197 bp, Artificial Sequence; identical to SEQ ID NO: 11688
  Synthetic polynucleotide

SEQ ID NO: 11690 - DNA, 197 bp, Artificial Sequence
  Synthetic polynucleotide
atcatctcaccttgcctcctggacgcgtacgctatggtcctgcaggtttgctgagtcagcaagatttgctgagtcagcatcgtttgctgagtcagcagactttgctgagtcagcactatttgctgagtcagcaacttttgctgagtcagcatgctttgctgagtcagcagtaggcgcgccatgcttcatcagactct

SEQ ID NO: 11691 - DNA, 197 bp, Artificial Sequence; identical to SEQ ID NO: 11690
  Synthetic polynucleotide

SEQ ID NO: 11692 - DNA, 164 bp, Artificial Sequence
  Synthetic polynucleotide
atcatctcaccttgcctcctgtataatcgaggaagggacctgcaggggcaattatagaggcaattattcgggcaattatgacggcaattatctaggcaattatactggcaattattgcggcaattatgtaggcaattatggcgcgccatgcttcatcagactct

SEQ ID NO: 11693 - DNA, 164 bp, Artificial Sequence; identical to SEQ ID NO: 11692
  Synthetic polynucleotide

SEQ ID NO: 11694 - DNA, 164 bp, Artificial Sequence
  Synthetic polynucleotide
atcatctcaccttgcctcctgagcaccgcgatcattgacctgcaggaataaacaaagaaataaacaatcgaataaacaagacaataaacaactaaataaacaaactaataaacaatgcaataaacaagtaaataaacaaggcgcgccatgcttcatcagactct

SEQ ID NO: 11695 - DNA, 164 bp, Artificial Sequence; identical to SEQ ID NO: 11694
  Synthetic polynucleotide

SEQ ID NO: 11696 - DNA, 156 bp, Artificial Sequence
  Synthetic polynucleotide
atcatctcaccttgcctcctgttggtgcatcgcggcatcctgcaggtaattaaaagataattaaatcgtaattaaagactaattaaactataattaaaacttaattaaatgctaattaaagtataattaaaggcgcgccatgcttcatcagactct

SEQ ID NO: 11697 - DNA, 156 bp, Artificial Sequence; identical to SEQ ID NO: 11696
  Synthetic polynucleotide

SEQ ID NO: 11698 - DNA, 191 bp, Artificial Sequence
  Synthetic polynucleotide
atcatctcaccttgcctcctgatgccaacacgcacggacctgcaggagaactaattagtggacagaagaactaattagtggactcgagaactaattagtggacgacagaactaattagtggacctaagaactaattagtggacactagaactaattagtggactgcggcgcgccatgcttcatcagactct

SEQ ID NO: 11699 - DNA, 191 bp, Artificial Sequence; identical to SEQ ID NO: 11698
  Synthetic polynucleotide

SEQ ID NO: 11700 - DNA, 197 bp, Artificial Sequence
  Synthetic polynucleotide
atcatctcaccttgcctcctggactcacaacagctaaacctgcaggccgggacagtctgttctcagaccgggacagtctgttctctcgccgggacagtctgttctcgacccgggacagtctgttctcctaccgggacagtctgttctcactccgggacagtctgttctctgcggcgcgccatgcttcatcagactct

SEQ ID NO: 11701 - DNA, 197 bp, Artificial Sequence; identical to SEQ ID NO: 11700
  Synthetic polynucleotide

SEQ ID NO: 11702 - DNA, 164 bp, Artificial Sequence
  Synthetic polynucleotide
atcatctcaccttgcctcctgcagaccgaccttgggttcctgcaggagtaacagtagaagtaacagttcgagtaacagtgacagtaacagtctaagtaacagtactagtaacagttgcagtaacagtgtaagtaacagtggcgcgccatgcttcatcagactct

SEQ ID NO: 11703 - DNA, 164 bp, Artificial Sequence; identical to SEQ ID NO: 11702
  Synthetic polynucleotide

SEQ ID NO: 11704 - DNA, 185 bp, Artificial Sequence
  Synthetic polynucleotide
atcatctcaccttgcctcctgctaaacagttcatacctcctgcagggtcttaattagtgcacagagtcttaattagtgcactcggtcttaattagtgcacgacgtcttaattagtgcacctagtcttaattagtgcacactgtcttaattagtgcactgcggcgcgccatgcttcatcagactct

SEQ ID NO: 11705 - DNA, 185 bp, Artificial Sequence; identical to SEQ ID NO: 11704
  Synthetic polynucleotide

SEQ ID NO: 11706 - DNA, 164 bp, Artificial Sequence
  Synthetic polynucleotide
atcatctcaccttgcctcctgccgatattagactgtcacctgcagggctaattagagagctaattagtcggctaattaggacgctaattagctagctaattagactgctaattagtgcgctaattaggtagctaattagggcgcgccatgcttcatcagactct

SEQ ID NO: 11707 - DNA, 164 bp, Artificial Sequence; identical to SEQ ID NO: 11706
  Synthetic polynucleotide

SEQ ID NO: 11708 - DNA, 164 bp, Artificial Sequence
  Synthetic polynucleotide
atcatctcaccttgcctcctgaacttcaccaatgcgagcctgcaggtcgtgctcaagatcgtgctcatcgtcgtgctcagactcgtgctcactatcgtgctcaacttcgtgctcatgctcgtgctcagtatcgtgctcaggcgcgccatgcttcatcagactct

SEQ ID NO: 11709 - DNA, 164 bp, Artificial Sequence; identical to SEQ ID NO: 11708
  Synthetic polynucleotide

SEQ ID NO: 11710 - DNA, 156 bp, Artificial Sequence
  Synthetic polynucleotide
atcatctcaccttgcctcctgagctcgggtgtgtaacacctgcaggtaattaacagataattaactcgtaattaacgactaattaacctataattaacacttaattaactgctaattaacgtataattaacggcgcgccatgcttcatcagactct

SEQ ID NO: 11711 - DNA, 156 bp, Artificial Sequence; identical to SEQ ID NO: 11710
  Synthetic polynucleotide

SEQ ID NO: 11712 - DNA, 156 bp, Artificial Sequence
  Synthetic polynucleotide
atcatctcaccttgcctcctggtcggcgatatccgatacctgcagggattgatgagagattgatgtcggattgatggacgattgatgctagattgatgactgattgatgtgcgattgatggtagattgatgggcgcgccatgcttcatcagactct

SEQ ID NO: 11713 - DNA, 156 bp, Artificial Sequence; identical to SEQ ID NO: 11712
  Synthetic polynucleotide

SEQ ID NO: 11714 - DNA, 197 bp, Artificial Sequence
  Synthetic polynucleotide
atcatctcaccttgcctcctgctgacagactttacccgcctgcaggcctttgttatgcaaaagacctttgttatgcaaatcgcctttgttatgcaaagaccctttgttatgcaaactacctttgttatgcaaaactcctttgttatgcaaatgccctttgttatgcaaagtaggcgcgccatgcttcatcagactct

SEQ ID NO: 11715 - DNA, 197 bp, Artificial Sequence; identical to SEQ ID NO: 11714
  Synthetic polynucleotide

SEQ ID NO: 11716 - DNA, 190 bp, Artificial Sequence
  Synthetic polynucleotide
atcatctcaccttgcctcctgttgaacggctcaagtagcctgcaggaagataagataacaagaaagataagataacatcgaagataagataacagacaagataagataacactaaagataagataacaactaagataagataacatgcaagataagataacagtaggcgcgccatgcttcatcagactct

SEQ ID NO: 11717 - DNA, 190 bp, Artificial Sequence; identical to SEQ ID NO: 11716
  Synthetic polynucleotide

SEQ ID NO: 11718 - DNA, 179 bp, Artificial Sequence
  Synthetic polynucleotide
atcatctcaccttgcctcctgtacctaggtaaccagtacctgcaggggccttttgttgtcaatcaaaacaagaggccttttgttgtcaatcaaaacatcgggccttttgttgtcaatcaaaacagacggccttttgttgtcaatcaaaacactaggcgcgccatgcttcatcagactct

SEQ ID NO: 11719 - DNA, 179 bp, Artificial Sequence; identical to SEQ ID NO: 11718
  Synthetic polynucleotide

SEQ ID NO: 11720 - DNA, 180 bp, Artificial Sequence
  Synthetic polynucleotide
atcatctcaccttgcctcctgtgcagtgattaagtttccctgcaggatgactcactcagaatgactcactctcgatgactcactcgacatgactcactcctaatgactcactcactatgactcactctgcatgactcactcgtaatgactcactcggcgcgccatgcttcatcagactct

SEQ ID NO: 11721 - DNA, 180 bp, Artificial Sequence; identical to SEQ ID NO: 11720
  Synthetic polynucleotide

SEQ ID NO: 11722 - DNA, 196 bp, Artificial Sequence
  Synthetic polynucleotide
atcatctcaccttgcctcctgcatcttgcgattgaaagcctgcaggttttcgcgcctttagattttcgcgccttttcgttttcgcgcctttgacttttcgcgcctttctattttcgcgcctttactttttcgcgccttttgcttttcgcgcctttgtattttcgcgcctttggcgcgccatgcttcatcagactct

SEQ ID NO: 11723 - DNA, 196 bp, Artificial Sequence; identical to SEQ ID NO: 11722
  Synthetic polynucleotide

SEQ ID NO: 11724 - DNA, 188 bp, Artificial Sequence
  Synthetic polynucleotide
atcatctcaccttgcctcctgctcgcctccaatggaaccctgcaggtcccacgtgtcaagatcccacgtgtcatcgtcccacgtgtcagactcccacgtgtcactatcccacgtgtcaacttcccacgtgtcatgctcccacgtgtcagtatcccacgtgtcaggcgcgccatgcttcatcagactct

SEQ ID NO: 11725 - DNA, 188 bp, Artificial Sequence; identical to SEQ ID NO: 11724
  Synthetic polynucleotide

SEQ ID NO: 11726 - DNA, 164 bp, Artificial Sequence
  Synthetic polynucleotide
atcatctcaccttgcctcctgtgtcgctaacttgaacacctgcaggggcaattaaagaggcaattaatcgggcaattaagacggcaattaactaggcaattaaactggcaattaatgcggcaattaagtaggcaattaaggcgcgccatgcttcatcagactct

SEQ ID NO: 11727 - DNA, 164 bp, Artificial Sequence; identical to SEQ ID NO: 11726
  Synthetic polynucleotide

SEQ ID NO: 11728 - DNA, 172 bp, Artificial Sequence
  Synthetic polynucleotide
atcatctcaccttgcctcctgaccgaaactacgccactcctgcaggcggcgcccgcagacggcgcccgctcgcggcgcccgcgaccggcgcccgcctacggcgcccgcactcggcgcccgctgccggcgcccgcgtacggcgcccgcggcgcgccatgcttcatcagactct

SEQ ID NO: 11729 - DNA, 172 bp, Artificial Sequence; identical to SEQ ID NO: 11728
  Synthetic polynucleotide

SEQ ID NO: 11730 - DNA, 172 bp, Artificial Sequence
  Synthetic polynucleotide
atcatctcaccttgcctcctgacgaaagtgtccgaccccctgcaggtcgcctgaggagatcgcctgaggtcgtcgcctgagggactcgcctgaggctatcgcctgaggacttcgcctgaggtgctcgcctgagggtatcgcctgaggggcgcgccatgcttcatcagactct

SEQ ID NO: 11731 - DNA, 172 bp, Artificial Sequence; identical to SEQ ID NO: 11730
  Synthetic polynucleotide

SEQ ID NO: 11732 - DNA, 156 bp, Artificial Sequence
  Synthetic polynucleotide
atcatctcaccttgcctcctggctcccttctaccaggtcctgcaggtaattaagagataattaagtcgtaattaaggactaattaagctataattaagacttaattaagtgctaattaaggtataattaagggcgcgccatgcttcatcagactct

SEQ ID NO: 11733 - DNA, 156 bp, Artificial Sequence; identical to SEQ ID NO: 11732
  Synthetic polynucleotide

SEQ ID NO: 11734 - DNA, 172 bp, Artificial Sequence
  Synthetic polynucleotide
atcatctcaccttgcctcctgacaagaatgttaagcagcctgcaggtgacctacttagatgacctactttcgtgacctacttgactgacctacttctatgacctacttacttgacctactttgctgacctacttgtatgacctacttggcgcgccatgcttcatcagactct

SEQ ID NO: 11735 - DNA, 172 bp, Artificial Sequence; identical to SEQ ID NO: 11734
  Synthetic polynucleotide

SEQ ID NO: 11736 - DNA, 172 bp, Artificial Sequence
  Synthetic polynucleotide
atcatctcaccttgcctcctgcaacatatttgtatcggcctgcaggaaagatgaatagaaaagatgaattcgaaagatgaatgacaaagatgaatctaaaagatgaatactaaagatgaattgcaaagatgaatgtaaaagatgaatggcgcgccatgcttcatcagactct

SEQ ID NO: 11737 - DNA, 172 bp, Artificial Sequence; identical to SEQ ID NO: 11736
  Synthetic polynucleotide

SEQ ID NO: 11738 - DNA, 190 bp, Artificial Sequence
  Synthetic polynucleotide
atcatctcaccttgcctcctgcatgtatatacccggtccctgcaggtgatgacgtggcacagatgatgacgtggcactcgtgatgacgtggcacgactgatgacgtggcacctatgatgacgtggcacacttgatgacgtggcactgctgatgacgtggcacgtaggcgcgccatgcttcatcagactct

SEQ ID NO: 11739 - DNA, 190 bp, Artificial Sequence; identical to SEQ ID NO: 11738
  Synthetic polynucleotide

SEQ ID NO: 11740 - DNA, 188 bp, Artificial Sequence
  Synthetic polynucleotide
atcatctcaccttgcctcctgggcgaatccatgtggtccctgcaggggtcgtaaaaatagaggtcgtaaaaattcgggtcgtaaaaatgacggtcgtaaaaatctaggtcgtaaaaatactggtcgtaaaaattgcggtcgtaaaaatgtaggtcgtaaaaatggcgcgccatgcttcatcagactct

SEQ ID NO: 11741 - DNA, 188 bp, Artificial Sequence; identical to SEQ ID NO: 11740
  Synthetic polynucleotide

SEQ ID NO: 11742 - DNA, 197 bp, Artificial Sequence
  Synthetic polynucleotide
atcatctcaccttgcctcctgtccatgattaagtcatgcctgcagggctgagtcagcaatttttagagctgagtcagcaattttttcggctgagtcagcaatttttgacgctgagtcagcaatttttctagctgagtcagcaatttttactgctgagtcagcaattttttgcggcgcgccatgcttcatcagactct

SEQ ID NO: 11743 - DNA, 197 bp, Artificial Sequence; identical to SEQ ID NO: 11742
  Synthetic polynucleotide

SEQ ID NO: 11744 - DNA, 172 bp, Artificial Sequence
  Synthetic polynucleotide
atcatctcaccttgcctcctgtaaccactttcgcctatcctgcaggagaggtcaatagaagaggtcaattcgagaggtcaatgacagaggtcaatctaagaggtcaatactagaggtcaattgcagaggtcaatgtaagaggtcaatggcgcgccatgcttcatcagactct

SEQ ID NO: 11745 - DNA, 172 bp, Artificial Sequence; identical to SEQ ID NO: 11744
  Synthetic polynucleotide

SEQ ID NO: 11746 - DNA, 156 bp, Artificial Sequence
  Synthetic polynucleotide
atcatctcaccttgcctcctgccaacagtagtactcgacctgcaggaaaggtcaagaaaaggtcatcgaaaggtcagacaaaggtcactaaaaggtcaactaaaggtcatgcaaaggtcagtaaaaggtcaggcgcgccatgcttcatcagactct

SEQ ID NO: 11747 - DNA, 156 bp, Artificial Sequence; identical to SEQ ID NO: 11746
  Synthetic polynucleotide

SEQ ID NO: 11748 - DNA, 197 bp, Artificial Sequence
  Synthetic polynucleotide
atcatctcaccttgcctcctgcctcacccgatggattccctgcaggtattgcatcatctttagatattgcatcatcttttcgtattgcatcatctttgactattgcatcatctttctatattgcatcatctttacttattgcatcatcttttgctattgcatcatctttgtaggcgcgccatgcttcatcagactct

SEQ ID NO: 11749 - DNA, 197 bp, Artificial Sequence; identical to SEQ ID NO: 11748
  Synthetic polynucleotide

SEQ ID NO: 11750 - DNA, 172 bp, Artificial Sequence
  Synthetic polynucleotide
atcatctcaccttgcctcctgatccctgagacattcttcctgcagggcttccggttagagcttccggtttcggcttccggttgacgcttccggttctagcttccggttactgcttccggtttgcgcttccggttgtagcttccggttggcgcgccatgcttcatcagactct

SEQ ID NO: 11751 - DNA, 172 bp, Artificial Sequence; identical to SEQ ID NO: 11750
  Synthetic polynucleotide

SEQ ID NO: 11752 - DNA, 197 bp, Artificial Sequence
  Synthetic polynucleotide
atcatctcaccttgcctcctggcattctctagtagaaacctgcaggatcaattgcagtgatagaatcaattgcagtgattcgatcaattgcagtgatgacatcaattgcagtgatctaatcaattgcagtgatactatcaattgcagtgattgcatcaattgcagtgatgtaggcgcgccatgcttcatcagactct

SEQ ID NO: 11753 - DNA, 197 bp, Artificial Sequence; identical to SEQ ID NO: 11752
  Synthetic polynucleotide

SEQ ID NO: 11754 - DNA, 156 bp, Artificial Sequence
  Synthetic polynucleotide
atcatctcaccttgcctcctgccgttgtcattaagaaccctgcaggtaattaatagataattaattcgtaattaatgactaattaatctataattaatacttaattaattgctaattaatgtataattaatggcgcgccatgcttcatcagactct

SEQ ID NO: 11755 - DNA, 156 bp, Artificial Sequence; identical to SEQ ID NO: 11754
  Synthetic polynucleotide

SEQ ID NO: 11756 - DNA, 190 bp, Artificial Sequence
  Synthetic polynucleotide
atcatctcaccttgcctcctgcacgactcgtgaaagcgcctgcaggtggcaccatgccaaagatggcaccatgccaatcgtggcaccatgccaagactggcaccatgccaactatggcaccatgccaaacttggcaccatgccaatgctggcaccatgccaagtaggcgcgccatgcttcatcagactct

SEQ ID NO: 11757 - DNA, 190 bp, Artificial Sequence; identical to SEQ ID NO: 11756
  Synthetic polynucleotide

SEQ ID NO: 11758 - DNA, 190 bp, Artificial Sequence
  Synthetic polynucleotide
atcatctcaccttgcctcctgatgcgaaacggatgcttcctgcaggaccggaaatccggtagaaccggaaatccggttcgaccggaaatccggtgacaccggaaatccggtctaaccggaaatccggtactaccggaaatccggttgcaccggaaatccggtgtaggcgcgccatgcttcatcagactct

SEQ ID NO: 11759 - DNA, 190 bp, Artificial Sequence; identical to SEQ ID NO: 11758
  Synthetic polynucleotide

SEQ ID NO: 11760 - DNA, 197 bp, Artificial Sequence
  Synthetic polynucleotide
atcatctcaccttgcctcctgatggctcagtgttaggtcctgcaggtgaccttttgaccctagatgaccttttgacccttcgtgaccttttgaccctgactgaccttttgaccctctatgaccttttgaccctacttgaccttttgacccttgctgaccttttgaccctgtaggcgcgccatgcttcatcagactct

SEQ ID NO: 11761 - DNA, 197 bp, Artificial Sequence; identical to SEQ ID NO: 11760
  Synthetic polynucleotide

SEQ ID NO: 11762 - DNA, 197 bp, Artificial Sequence
  Synthetic polynucleotide
atcatctcaccttgcctcctgctgagcccttaggcctacctgcaggaaggtcatctaaaggtcaagaaaggtcatctaaaggtcatcgaaggtcatctaaaggtcagacaaggtcatctaaaggtcactaaaggtcatctaaaggtcaactaaggtcatctaaaggtcatgcggcgcgccatgcttcatcagactct

SEQ ID NO: 11763 - DNA, 197 bp, Artificial Sequence; identical to SEQ ID NO: 11762
  Synthetic polynucleotide

SEQ ID NO: 11764 - DNA, 185 bp, Artificial Sequence
  Synthetic polynucleotide
atcatctcaccttgcctcctggtagtttgctcaggtaacctgcaggatcactgcacattgatagaatcactgcacattgattcgatcactgcacattgatgacatcactgcacattgatctaatcactgcacattgatactatcactgcacattgattgcggcgcgccatgcttcatcagactct

SEQ ID NO: 11765 - DNA, 185 bp, Artificial Sequence; identical to SEQ ID NO: 11764
  Synthetic polynucleotide

SEQ ID NO: 11766 - DNA, 172 bp, Artificial Sequence
  Synthetic polynucleotide
atcatctcaccttgcctcctgaggaacggatatccacacctgcaggcacagctgcgagacacagctgcgtcgcacagctgcggaccacagctgcgctacacagctgcgactcacagctgcgtgccacagctgcggtacacagctgcgggcgcgccatgcttcatcagactct

SEQ ID NO: 11767 - DNA, 172 bp, Artificial Sequence; identical to SEQ ID NO: 11766
  Synthetic polynucleotide

SEQ ID NO: 11768 - DNA, 185 bp, Artificial Sequence
  Synthetic polynucleotide
atcatctcaccttgcctcctgctccagccgttgaagtacctgcaggaatttttgtttactttagaaatttttgtttacttttcgaatttttgtttactttgacaatttttgtttactttctaaatttttgtttactttactaatttttgtttacttttgcggcgcgccatgcttcatcagactct

SEQ ID NO: 11769 - DNA, 185 bp, Artificial Sequence; identical to SEQ ID NO: 11768
  Synthetic polynucleotide

SEQ ID NO: 11770 - DNA, 156 bp, Artificial Sequence
  Synthetic polynucleotide
atcatctcaccttgcctcctggggatatgttaagaactcctgcaggcatcaatcagacatcaatctcgcatcaatcgaccatcaatcctacatcaatcactcatcaatctgccatcaatcgtacatcaatcggcgcgccatgcttcatcagactct

SEQ ID NO: 11771 - DNA, 156 bp, Artificial Sequence; identical to SEQ ID NO: 11770
  Synthetic polynucleotide

SEQ ID NO: 11772 - DNA, 172 bp, Artificial Sequence
  Synthetic polynucleotide
atcatctcaccttgcctcctgaagtggcagactttattcctgcaggggcacgtgacagaggcacgtgactcgggcacgtgacgacggcacgtgacctaggcacgtgacactggcacgtgactgcggcacgtgacgtaggcacgtgacggcgcgccatgcttcatcagactct

SEQ ID NO: 11773 - DNA, 172 bp, Artificial Sequence; identical to SEQ ID NO: 11772
  Synthetic polynucleotide

SEQ ID NO: 11774 - DNA, 185 bp, Artificial Sequence
  Synthetic polynucleotide
atcatctcaccttgcctcctgattacgagagtcaagggcctgcaggaccggtttaaaccggtagaaccggtttaaaccggttcgaccggtttaaaccggtgacaccggtttaaaccggtctaaccggtttaaaccggtactaccggtttaaaccggttgcggcgcgccatgcttcatcagactct

SEQ ID NO: 11775 - DNA, 185 bp, Artificial Sequence; identical to SEQ ID NO: 11774
  Synthetic polynucleotide

SEQ ID NO: 11776 - DNA, 191 bp, Artificial Sequence
  Synthetic polynucleotide
atcatctcaccttgcctcctgaagccactcatgacactcctgcaggaacgctaattagcggtgagaaacgctaattagcggtgtcgaacgctaattagcggtggacaacgctaattagcggtgctaaacgctaattagcggtgactaacgctaattagcggtgtgcggcgcgccatgcttcatcagactct

SEQ ID NO: 11777 - DNA, 191 bp, Artificial Sequence; identical to SEQ ID NO: 11776
  Synthetic polynucleotide

SEQ ID NO: 11778 - DNA, 197 bp, Artificial Sequence
  Synthetic polynucleotide
atcatctcaccttgcctcctgcacggtgattcaataagcctgcagggagaacagactgtcccggagagagaacagactgtcccggtcggagaacagactgtcccgggacgagaacagactgtcccggctagagaacagactgtcccggactgagaacagactgtcccggtgcggcgcgccatgcttcatcagactct

SEQ ID NO: 11779 - DNA, 197 bp, Artificial Sequence; identical to SEQ ID NO: 11778
  Synthetic polynucleotide

SEQ ID NO: 11780 - DNA, 164 bp, Artificial Sequence
  Synthetic polynucleotide
atcatctcaccttgcctcctgcgaacttcctccacctgcctgcagggacgtcacgagagacgtcacgtcggacgtcacggacgacgtcacgctagacgtcacgactgacgtcacgtgcgacgtcacggtagacgtcacgggcgcgccatgcttcatcagactct

SEQ ID NO: 11781 - DNA, 164 bp, Artificial Sequence; identical to SEQ ID NO: 11780
  Synthetic polynucleotide

SEQ ID NO: 11782 - DNA, 188 bp, Artificial Sequence
  Synthetic polynucleotide
atcatctcaccttgcctcctgccaatatatcatcagcacctgcaggtaaggcgtcttgagataaggcgtcttgtcgtaaggcgtcttggactaaggcgtcttgctataaggcgtcttgacttaaggcgtcttgtgctaaggcgtcttggtataaggcgtcttgggcgcgccatgcttcatcagactct

SEQ ID NO: 11783 - DNA, 188 bp, Artificial Sequence; identical to SEQ ID NO: 11782
  Synthetic polynucleotide

SEQ ID NO: 11784 - DNA, 197 bp, Artificial Sequence
  Synthetic polynucleotide
atcatctcaccttgcctcctgatgagattaccctttcgcctgcagggcctagagcggccccagagcctagagcggcccctcggcctagagcggccccgacgcctagagcggccccctagcctagagcggccccactgcctagagcggcccctgcgcctagagcggccccgtaggcgcgccatgcttcatcagactct

SEQ ID NO: 11785 - DNA, 197 bp, Artificial Sequence; identical to SEQ ID NO: 11784
  Synthetic polynucleotide

SEQ ID NO: 11786 - DNA, 172 bp, Artificial Sequence
  Synthetic polynucleotide
atcatctcaccttgcctcctggattccctcatgaggctcctgcaggtcttatctgtagatcttatctgttcgtcttatctgtgactcttatctgtctatcttatctgtacttcttatctgttgctcttatctgtgtatcttatctgtggcgcgccatgcttcatcagactct

SEQ ID NO: 11787 - DNA, 172 bp, Artificial Sequence; identical to SEQ ID NO: 11786
  Synthetic polynucleotide

SEQ ID NO: 11788 - DNA, 156 bp, Artificial Sequence
  Synthetic polynucleotide
atcatctcaccttgcctcctgacgccaaagccggaatgcctgcaggcaacagaaagacaacagaatcgcaacagaagaccaacagaactacaacagaaactcaacagaatgccaacagaagtacaacagaaggcgcgccatgcttcatcagactct

SEQ ID NO: 11789 - DNA, 156 bp, Artificial Sequence; identical to SEQ ID NO: 11788
  Synthetic polynucleotide

SEQ ID NO: 11790 - DNA, 172 bp, Artificial Sequence
  Synthetic polynucleotide
atcatctcaccttgcctcctggtccaggtattccgtcccctgcagggcaataaaaaagagcaataaaaatcggcaataaaaagacgcaataaaaactagcaataaaaaactgcaataaaaatgcgcaataaaaagtagcaataaaaaggcgcgccatgcttcatcagactct

SEQ ID NO: 11791 - DNA, 172 bp, Artificial Sequence; identical to SEQ ID NO: 11790
  Synthetic polynucleotide

SEQ ID NO: 11792 - DNA, 172 bp, Artificial Sequence
  Synthetic polynucleotide
atcatctcaccttgcctcctgttaccctactagcctagcctgcaggtaaataaacaagataaataaacatcgtaaataaacagactaaataaacactataaataaacaacttaaataaacatgctaaataaacagtataaataaacaggcgcgccatgcttcatcagactct

SEQ ID NO: 11793 - DNA, 172 bp, Artificial Sequence; identical to SEQ ID NO: 11792
  Synthetic polynucleotide

SEQ ID NO: 11794 - DNA, 196 bp, Artificial Sequence
  Synthetic polynucleotide
atcatctcaccttgcctcctgttaacgtactcaaggtgcctgcaggatgcaacaggtggagaatgcaacaggtggtcgatgcaacaggtgggacatgcaacaggtggctaatgcaacaggtggactatgcaacaggtggtgcatgcaacaggtgggtaatgcaacaggtggggcgcgccatgcttcatcagactct

SEQ ID NO: 11795 - DNA, 196 bp, Artificial Sequence; identical to SEQ ID NO: 11794
  Synthetic polynucleotide

SEQ ID NO: 11796 - DNA, 186 bp, Artificial Sequence
  Synthetic polynucleotide
atcatctcaccttgcctcctgccgatcgagcagccttacctgcaggtgggggggggtggtttggggagatgggggggggtggtttggggtcgtgggggggggtggtttgggggactgggggggggtggtttggggctatgggggggggtggtttggggactggcgcgccatgcttcatcagactct

SEQ ID NO: 11797 - DNA, 186 bp, Artificial Sequence; identical to SEQ ID NO: 11796
  Synthetic polynucleotide

SEQ ID NO: 11798 - DNA, 191 bp, Artificial Sequence
  Synthetic polynucleotide
atcatctcaccttgcctcctgtccggctaacaagtgatcctgcaggcgcgccggcggctgctgagacgcgccggcggctgctgtcgcgcgccggcggctgctggaccgcgccggcggctgctgctacgcgccggcggctgctgactcgcgccggcggctgctgtgcggcgcgccatgcttcatcagactct

SEQ ID NO: 11799 - DNA, 191 bp, Artificial Sequence; identical to SEQ ID NO: 11798
  Synthetic polynucleotide

SEQ ID NO: 11800 - DNA, 188 bp, Artificial Sequence
  Synthetic polynucleotide
atcatctcaccttgcctcctgtacctacgattactacgcctgcaggccatgccgccatagaccatgccgccattcgccatgccgccatgacccatgccgccatctaccatgccgccatactccatgccgccattgcccatgccgccatgtaccatgccgccatggcgcgccatgcttcatcagactct

SEQ ID NO: 11801 - DNA, 188 bp, Artificial Sequence; identical to SEQ ID NO: 11800
  Synthetic polynucleotide

SEQ ID NO: 11802 - DNA, 185 bp, Artificial Sequence
  Synthetic polynucleotide
atcatctcaccttgcctcctgaactttattggacgcttcctgcaggaggttaattggttaaaagaaggttaattggttaaatcgaggttaattggttaaagacaggttaattggttaaactaaggttaattggttaaaactaggttaattggttaaatgcggcgcgccatgcttcatcagactct

SEQ ID NO: 11803 - DNA, 185 bp, Artificial Sequence; identical to SEQ ID NO: 11802
  Synthetic polynucleotide

SEQ ID NO: 11804 - DNA, 172 bp, Artificial Sequence
  Synthetic polynucleotide
atcatctcaccttgcctcctgatctattcgtgcattaccctgcagggttttattggagagttttattggtcggttttattgggacgttttattggctagttttattggactgttttattggtgcgttttattgggtagttttattggggcgcgccatgcttcatcagactct

SEQ ID NO: 11805 - DNA, 172 bp, Artificial Sequence; identical to SEQ ID NO: 11804
  Synthetic polynucleotide

SEQ ID NO: 11806 - DNA, 188 bp, Artificial Sequence
  Synthetic polynucleotide
atcatctcaccttgcctcctgcttgacacatgggtcgccctgcaggggtcaaaggtcaagaggtcaaaggtcatcgggtcaaaggtcagacggtcaaaggtcactaggtcaaaggtcaactggtcaaaggtcatgcggtcaaaggtcagtaggtcaaaggtcaggcgcgccatgcttcatcagactct

SEQ ID NO: 11807 - DNA, 188 bp, Artificial Sequence; identical to SEQ ID NO: 11806
  Synthetic polynucleotide

SEQ ID NO: 11808 - DNA, 140 bp, Artificial Sequence
  Synthetic polynucleotide
atcatctcaccttgcctcctgcaacgatcccaacgtagcctgcaggtatgcaagatatgcatcgtatgcagactatgcactatatgcaacttatgcatgctatgcagtatatgcaggcgcgccatgcttcatcagactct

SEQ ID NO: 11809 - DNA, 140 bp, Artificial Sequence; identical to SEQ ID NO: 11808
  Synthetic polynucleotide

SEQ ID NO: 11810 - DNA, 172 bp, Artificial Sequence
  Synthetic polynucleotide
atcatctcaccttgcctcctgcaaagcctcatcaggttcctgcaggacttccgggtagaacttccgggttcgacttccgggtgacacttccgggtctaacttccgggtactacttccgggttgcacttccgggtgtaacttccgggtggcgcgccatgcttcatcagactct

SEQ ID NO: 11811 - DNA, 172 bp, Artificial Sequence; identical to SEQ ID NO: 11810
  Synthetic polynucleotide

SEQ ID NO: 11812 - DNA, 164 bp, Artificial Sequence
  Synthetic polynucleotide
atcatctcaccttgcctcctgatgtacaattctccacccctgcaggcctggttaaagacctggttaatcgcctggttaagaccctggttaactacctggttaaactcctggttaatgccctggttaagtacctggttaaggcgcgccatgcttcatcagactct

SEQ ID NO: 11813 - DNA, 164 bp, Artificial Sequence; identical to SEQ ID NO: 11812
  Synthetic polynucleotide

SEQ ID NO: 11814 - DNA, 164 bp, Artificial Sequence
  Synthetic polynucleotide
atcatctcaccttgcctcctggaccaagtcgttaatcgcctgcaggagatggactagaagatggacttcgagatggactgacagatggactctaagatggactactagatggacttgcagatggactgtaagatggactggcgcgccatgcttcatcagactct

SEQ ID NO: 11815 - DNA, 164 bp, Artificial Sequence; identical to SEQ ID NO: 11814
  Synthetic polynucleotide

SEQ ID NO: 11816 - DNA, 156 bp, Artificial Sequence
  Synthetic polynucleotide
atcatctcaccttgcctcctgggaaatatgacagctcacctgcagggttaattaagagttaattatcggttaattagacgttaattactagttaattaactgttaattatgcgttaattagtagttaattaggcgcgccatgcttcatcagactct

SEQ ID NO: 11817 - DNA, 156 bp, Artificial Sequence; identical to SEQ ID NO: 11816
  Synthetic polynucleotide

SEQ ID NO: 11818 - DNA, 172 bp, Artificial Sequence
  Synthetic polynucleotide
atcatctcaccttgcctcctgtgtattcggtgacgtaccctgcagggaggtgtgaaagagaggtgtgaatcggaggtgtgaagacgaggtgtgaactagaggtgtgaaactgaggtgtgaatgcgaggtgtgaagtagaggtgtgaaggcgcgccatgcttcatcagactct

SEQ ID NO: 11819 - DNA, 172 bp, Artificial Sequence; identical to SEQ ID NO: 11818
  Synthetic polynucleotide

SEQ ID NO: 11820 - DNA, 164 bp, Artificial Sequence
  Synthetic polynucleotide
atcatctcaccttgcctcctgtactcacatagggtcgacctgcaggttaatccctagattaatcccttcgttaatccctgacttaatccctctattaatccctactttaatcccttgcttaatccctgtattaatccctggcgcgccatgcttcatcagactct

SEQ ID NO: 11821 - DNA, 164 bp, Artificial Sequence; identical to SEQ ID NO: 11820
  Synthetic polynucleotide

SEQ ID NO: 11822 - DNA, 197 bp, Artificial Sequence
  Synthetic polynucleotide
atcatctcaccttgcctcctgtgtgcctgatgactaggcctgcaggcacttccgggaaatgagacacttccgggaaatgtcgcacttccgggaaatggaccacttccgggaaatgctacacttccgggaaatgactcacttccgggaaatgtgccacttccgggaaatggtaggcgcgccatgcttcatcagactct

SEQ ID NO: 11823 - DNA, 197 bp, Artificial Sequence; identical to SEQ ID NO: 11822
  Synthetic polynucleotide

SEQ ID NO: 11824 - DNA, 197 bp, Artificial Sequence
  Synthetic polynucleotide
atcatctcaccttgcctcctgggacgagcggatacactcctgcaggcgataatggtaattagttagacgataatggtaattagtttcgcgataatggtaattagttgaccgataatggtaattagttctacgataatggtaattagttactcgataatggtaattagtttgcggcgcgccatgcttcatcagactct

SEQ ID NO: 11825 - DNA, 197 bp, Artificial Sequence; identical to SEQ ID NO: 11824
  Synthetic polynucleotide

SEQ ID NO: 11826 - DNA, 190 bp, Artificial Sequence
  Synthetic polynucleotide
atcatctcaccttgcctcctgacgaagaactgaaaccgcctgcaggagtaccgttatttgagaagtaccgttatttgtcgagtaccgttatttggacagtaccgttatttgctaagtaccgttatttgactagtaccgttatttgtgcagtaccgttatttggtaggcgcgccatgcttcatcagactct

SEQ ID NO: 11827 - DNA, 190 bp, Artificial Sequence; identical to SEQ ID NO: 11826
  Synthetic polynucleotide

SEQ ID NO: 11828 - DNA, 172 bp, Artificial Sequence
  Synthetic polynucleotide
atcatctcaccttgcctcctgaagccgaagtctcgagtcctgcaggagaggtcacgagaagaggtcacgtcgagaggtcacggacagaggtcacgctaagaggtcacgactagaggtcacgtgcagaggtcacggtaagaggtcacgggcgcgccatgcttcatcagactct

SEQ ID NO: 11829 - DNA, 172 bp, Artificial Sequence; identical to SEQ ID NO: 11828
  Synthetic polynucleotide

SEQ ID NO: 11830 - DNA, 172 bp, Artificial Sequence
  Synthetic polynucleotide
atcatctcaccttgcctcctgatggtgcatgcgtcgtacctgcaggagaggtcaccagaagaggtcacctcgagaggtcaccgacagaggtcaccctaagaggtcaccactagaggtcacctgcagaggtcaccgtaagaggtcaccggcgcgccatgcttcatcagactct

SEQ ID NO: 11831 - DNA, 172 bp, Artificial Sequence; identical to SEQ ID NO: 11830
  Synthetic polynucleotide

SEQ ID NO: 11832 - DNA, 156 bp, Artificial Sequence
  Synthetic polynucleotide
atcatctcaccttgcctcctgtagattccgtcgcgagtcctgcaggacagcgtcagaacagcgtctcgacagcgtcgacacagcgtcctaacagcgtcactacagcgtctgcacagcgtcgtaacagcgtcggcgcgccatgcttcatcagactct

SEQ ID NO: 11833 - DNA, 156 bp, Artificial Sequence; identical to SEQ ID NO: 11832
  Synthetic polynucleotide

SEQ ID NO: 11834 - DNA, 156 bp, Artificial Sequence
  Synthetic polynucleotide
atcatctcaccttgcctcctggtccgatagcatcacctcctgcaggttaactagagattaactagtcgttaactaggacttaactagctattaactagactttaactagtgcttaactaggtattaactagggcgcgccatgcttcatcagactct

SEQ ID NO: 11835 - DNA, 156 bp, Artificial Sequence; identical to SEQ ID NO: 11834
  Synthetic polynucleotide

SEQ ID NO: 11836 - DNA, 180 bp, Artificial Sequence
  Synthetic polynucleotide
atcatctcaccttgcctcctgctccctgtgcttaaccgcctgcaggggtaattattcagaggtaattattctcgggtaattattcgacggtaattattcctaggtaattattcactggtaattattctgcggtaattattcgtaggtaattattcggcgcgccatgcttcatcagactct

SEQ ID NO: 11837 - DNA, 180 bp, Artificial Sequence; identical to SEQ ID NO: 11836
  Synthetic polynucleotide

SEQ ID NO: 11838 - DNA, 172 bp, Artificial Sequence
  Synthetic polynucleotide
atcatctcaccttgcctcctgtatgggcctccagggttcctgcaggcgcacgggctagacgcacgggcttcgcgcacgggctgaccgcacgggctctacgcacgggctactcgcacgggcttgccgcacgggctgtacgcacgggctggcgcgccatgcttcatcagactct

SEQ ID NO: 11839 - DNA, 172 bp, Artificial Sequence; identical to SEQ ID NO: 11838
  Synthetic polynucleotide

SEQ ID NO: 11840 - DNA, 197 bp, Artificial Sequence
  Synthetic polynucleotide
atcatctcaccttgcctcctgctacccttcgacatatccctgcaggcacttcattgaattaagacacttcattgaattatcgcacttcattgaattagaccacttcattgaattactacacttcattgaattaactcacttcattgaattatgccacttcattgaattagtaggcgcgccatgcttcatcagactct

SEQ ID NO: 11841 - DNA, 197 bp, Artificial Sequence; identical to SEQ ID NO: 11840
  Synthetic polynucleotide

SEQ ID NO: 11842 - DNA, 172 bp, Artificial Sequence
  Synthetic polynucleotide
atcatctcaccttgcctcctgatcgaggatcagactctcctgcagggcgtcggccgagagcgtcggccgtcggcgtcggccggacgcgtcggccgctagcgtcggccgactgcgtcggccgtgcgcgtcggccggtagcgtcggccgggcgcgccatgcttcatcagactct

SEQ ID NO: 11843 - DNA, 172 bp, Artificial Sequence; identical to SEQ ID NO: 11842
  Synthetic polynucleotide

SEQ ID NO: 11844 - DNA, 191 bp, Artificial Sequence
  Synthetic polynucleotide
atcatctcaccttgcctcctgttggcacgtcgagtgaacctgcagggctaagtcagcaaatttagagctaagtcagcaaattttcggctaagtcagcaaatttgacgctaagtcagcaaatttctagctaagtcagcaaatttactgctaagtcagcaaattttgcggcgcgccatgcttcatcagactct

SEQ ID NO: 11845 - DNA, 191 bp, Artificial Sequence; identical to SEQ ID NO: 11844
  Synthetic polynucleotide

SEQ ID NO: 11846 - DNA, 156 bp, Artificial Sequence
  Synthetic polynucleotide
atcatctcaccttgcctcctggcgttctgctaattcctcctgcaggatttatggagaatttatggtcgatttatgggacatttatggctaatttatggactatttatggtgcatttatgggtaatttatggggcgcgccatgcttcatcagactct

SEQ ID NO: 11847 - DNA, 156 bp, Artificial Sequence; identical to SEQ ID NO: 11846
  Synthetic polynucleotide

SEQ ID NO: 11848 - DNA, 191 bp, Artificial Sequence
  Synthetic polynucleotide
atcatctcaccttgcctcctggtaatggtaaccgctcacctgcaggtttcgctaattagctttagatttcgctaattagcttttcgtttcgctaattagctttgactttcgctaattagctttctatttcgctaattagctttacttttcgctaattagcttttgcggcgcgccatgcttcatcagactct

SEQ ID NO: 11849 - DNA, 191 bp, Artificial Sequence; identical to SEQ ID NO: 11848
  Synthetic polynucleotide

SEQ ID NO: 11850 - DNA, 156 bp, Artificial Sequence
  Synthetic polynucleotide
atcatctcaccttgcctcctgcagctccctgcgatgatcctgcaggcaggtgagagacaggtgagtcgcaggtgaggaccaggtgagctacaggtgagactcaggtgagtgccaggtgaggtacaggtgagggcgcgccatgcttcatcagactct

SEQ ID NO: 11851 - DNA, 156 bp, Artificial Sequence; identical to SEQ ID NO: 11850
  Synthetic polynucleotide

SEQ ID NO: 11852 - DNA, 198 bp, Artificial Sequence
  Synthetic polynucleotide
atcatctcaccttgcctcctgataatctaccttggcttcctgcaggtcttttaatttgcataatcataaagatcttttaatttgcataatcataatcgtcttttaatttgcataatcataagactcttttaatttgcataatcataactatcttttaatttgcataatcataaggcgcgccatgcttcatcagactct

SEQ ID NO: 11853 - DNA, 198 bp, Artificial Sequence; identical to SEQ ID NO: 11852
  Synthetic polynucleotide

SEQ ID NO: 11854 - DNA, 172 bp, Artificial Sequence
  Synthetic polynucleotide
atcatctcaccttgcctcctgctcaacataaaccggcgcctgcaggcacagctgacagacacagctgactcgcacagctgacgaccacagctgacctacacagctgacactcacagctgactgccacagctgacgtacacagctgacggcgcgccatgcttcatcagactct

SEQ ID NO: 11855 - DNA, 172 bp, Artificial Sequence; identical to SEQ ID NO: 11854
  Synthetic polynucleotide

SEQ ID NO: 11856 - DNA, 172 bp, Artificial Sequence
  Synthetic polynucleotide
atcatctcaccttgcctcctgaatttccgttagtagctcctgcaggccgcgccgccagaccgcgccgcctcgccgcgccgccgacccgcgccgccctaccgcgccgccactccgcgccgcctgcccgcgccgccgtaccgcgccgccggcgcgccatgcttcatcagactct

SEQ ID NO: 11857 - DNA, 172 bp, Artificial Sequence; identical to SEQ ID NO: 11856
  Synthetic polynucleotide

SEQ ID NO: 11858 - DNA, 200 bp, Artificial Sequence
  Synthetic polynucleotide
atcatctcaccttgcctcctgagacagactctggagctcctgcaggggggagggggcggggccggagaggggagggggcggggccggtcgggggagggggcggggccgggacggggagggggcggggccggctaggggagggggcggggccggactggggagggggcggggccggggcgcgccatgcttcatcagactct

SEQ ID NO: 11859 - DNA, 200 bp, Artificial Sequence; identical to SEQ ID NO: 11858
  Synthetic polynucleotide

SEQ ID NO: 11860 - DNA, 172 bp, Artificial Sequence
  Synthetic polynucleotide
atcatctcaccttgcctcctgaataatggatgggcacgcctgcaggggcacgtgccagaggcacgtgcctcgggcacgtgccgacggcacgtgccctaggcacgtgccactggcacgtgcctgcggcacgtgccgtaggcacgtgccggcgcgccatgcttcatcagactct

SEQ ID NO: 11861 - DNA, 172 bp, Artificial Sequence; identical to SEQ ID NO: 11860
  Synthetic polynucleotide

SEQ ID NO: 11862 - DNA, 185 bp, Artificial Sequence
  Synthetic polynucleotide
atcatctcaccttgcctcctgataggatacgaccgtatcctgcaggctaggaattacttggtagactaggaattacttggttcgctaggaattacttggtgacctaggaattacttggtctactaggaattacttggtactctaggaattacttggttgcggcgcgccatgcttcatcagactct

SEQ ID NO: 11863 - DNA, 185 bp, Artificial Sequence; identical to SEQ ID NO: 11862
  Synthetic polynucleotide

SEQ ID NO: 11864 - DNA, 185 bp, Artificial Sequence
  Synthetic polynucleotide
atcatctcaccttgcctcctgtacggctaaccaggtggcctgcaggacgttaattaccccaaagaacgttaattaccccaatcgacgttaattaccccaagacacgttaattaccccaactaacgttaattaccccaaactacgttaattaccccaatgcggcgcgccatgcttcatcagactct

SEQ ID NO: 11865 - DNA, 185 bp, Artificial Sequence; identical to SEQ ID NO: 11864
  Synthetic polynucleotide

SEQ ID NO: 11866 - DNA, 188 bp, Artificial Sequence
  Synthetic polynucleotide
atcatctcaccttgcctcctgtgattgccagatcgcgtcctgcaggcgctttgttctcagacgctttgttctctcgcgctttgttctcgaccgctttgttctcctacgctttgttctcactcgctttgttctctgccgctttgttctcgtacgctttgttctcggcgcgccatgcttcatcagactct

SEQ ID NO: 11867 - DNA, 188 bp, Artificial Sequence; identical to SEQ ID NO: 11866
  Synthetic polynucleotide

SEQ ID NO: 11868 - DNA, 188 bp, Artificial Sequence
  Synthetic polynucleotide
atcatctcaccttgcctcctgtcgcggttaactctgcgcctgcaggcgggtgacgtccagacgggtgacgtcctcgcgggtgacgtccgaccgggtgacgtccctacgggtgacgtccactcgggtgacgtcctgccgggtgacgtccgtacgggtgacgtccggcgcgccatgcttcatcagactct

SEQ ID NO: 11869 - DNA, 188 bp, Artificial Sequence; identical to SEQ ID NO: 11868
  Synthetic polynucleotide

SEQ ID NO: 11870 - DNA, 190 bp, Artificial Sequence
  Synthetic polynucleotide
atcatctcaccttgcctcctgcgaacgtctagcaacatcctgcaggccgaaaccgaaactagaccgaaaccgaaacttcgccgaaaccgaaactgacccgaaaccgaaactctaccgaaaccgaaactactccgaaaccgaaacttgcccgaaaccgaaactgtaggcgcgccatgcttcatcagactct

SEQ ID NO: 11871 - DNA, 190 bp, Artificial Sequence; identical to SEQ ID NO: 11870
  Synthetic polynucleotide

SEQ ID NO: 11872 - DNA, 180 bp, Artificial Sequence
  Synthetic polynucleotide
atcatctcaccttgcctcctgtatctaaagcgggaaatcctgcaggcacttccggttagacacttccggtttcgcacttccggttgaccacttccggttctacacttccggttactcacttccggtttgccacttccggttgtacacttccggttggcgcgccatgcttcatcagactct

SEQ ID NO: 11873 - DNA, 180 bp, Artificial Sequence; identical to SEQ ID NO: 11872
  Synthetic polynucleotide

SEQ ID NO: 11874 - DNA, 188 bp, Artificial Sequence
  Synthetic polynucleotide
atcatctcaccttgcctcctgactaacatattaccgcccctgcaggggacgtcacccgagaggacgtcacccgtcgggacgtcacccggacggacgtcacccgctaggacgtcacccgactggacgtcacccgtgcggacgtcacccggtaggacgtcacccgggcgcgccatgcttcatcagactct

SEQ ID NO: 11875 - DNA, 188 bp, Artificial Sequence; identical to SEQ ID NO: 11874
  Synthetic polynucleotide

SEQ ID NO: 11876 - DNA, 196 bp, Artificial Sequence
  Synthetic polynucleotide
atcatctcaccttgcctcctgagatgatgtgatgcctacctgcaggcttccgggaaatgagacttccgggaaatgtcgcttccgggaaatggaccttccgggaaatgctacttccgggaaatgactcttccgggaaatgtgccttccgggaaatggtacttccgggaaatgggcgcgccatgcttcatcagactct

SEQ ID NO: 11877 - DNA, 196 bp, Artificial Sequence; identical to SEQ ID NO: 11876
  Synthetic polynucleotide

SEQ ID NO: 11878 - DNA, 200 bp, Artificial Sequence
  Synthetic polynucleotide
atcatctcaccttgcctcctgacagtttcgttatgaaccctgcaggtcaggtcacagtgacctgtagatcaggtcacagtgacctgttcgtcaggtcacagtgacctgtgactcaggtcacagtgacctgtctatcaggtcacagtgacctgtacttcaggtcacagtgacctgtggcgcgccatgcttcatcagactct

SEQ ID NO: 11879 - DNA, 200 bp, Artificial Sequence; identical to SEQ ID NO: 11878
  Synthetic polynucleotide

SEQ ID NO: 11880 - DNA, 188 bp, Artificial Sequence
  Synthetic polynucleotide
atcatctcaccttgcctcctgacccgatgtgtatgatacctgcaggagtttcgctttcagaagtttcgctttctcgagtttcgctttcgacagtttcgctttcctaagtttcgctttcactagtttcgctttctgcagtttcgctttcgtaagtttcgctttcggcgcgccatgcttcatcagactct

SEQ ID NO: 11881 - DNA, 188 bp, Artificial Sequence; identical to SEQ ID NO: 11880
  Synthetic polynucleotide

SEQ ID NO: 11882 - DNA, 164 bp, Artificial Sequence
  Synthetic polynucleotide
atcatctcaccttgcctcctgactaggtagcctggtcacctgcaggctgaaacagagactgaaacagtcgctgaaacaggacctgaaacagctactgaaacagactctgaaacagtgcctgaaacaggtactgaaacagggcgcgccatgcttcatcagactct

SEQ ID NO: 11883 - DNA, 164 bp, Artificial Sequence; identical to SEQ ID NO: 11882
  Synthetic polynucleotide

SEQ ID NO: 11884 - DNA, 156 bp, Artificial Sequence
  Synthetic polynucleotide
atcatctcaccttgcctcctgaagtggtcagaatacgccctgcaggatttatgtagaatttatgttcgatttatgtgacatttatgtctaatttatgtactatttatgttgcatttatgtgtaatttatgtggcgcgccatgcttcatcagactct

SEQ ID NO: 11885 - DNA, 156 bp, Artificial Sequence; identical to SEQ ID NO: 11884
  Synthetic polynucleotide

SEQ ID NO: 11886 - DNA, 156 bp, Artificial Sequence
  Synthetic polynucleotide
atcatctcaccttgcctcctgacatcttcccagatatgcctgcagggttaactaagagttaactatcggttaactagacgttaactactagttaactaactgttaactatgcgttaactagtagttaactaggcgcgccatgcttcatcagactct

SEQ ID NO: 11887 - DNA, 156 bp, Artificial Sequence; identical to SEQ ID NO: 11886
  Synthetic polynucleotide

SEQ ID NO: 11888 - DNA, 140 bp, Artificial Sequence
  Synthetic polynucleotide
atcatctcaccttgcctcctgaatatagtgcgatagcccctgcaggcgtcatagacgtcattcgcgtcatgaccgtcatctacgtcatactcgtcattgccgtcatgtacgtcatggcgcgccatgcttcatcagactct

SEQ ID NO: 11889 - DNA, 140 bp, Artificial Sequence; identical to SEQ ID NO: 11888
  Synthetic polynucleotide

SEQ ID NO: 11890 - DNA, 190 bp, Artificial Sequence
  Synthetic polynucleotide
atcatctcaccttgcctcctggcgacattggattcctgcctgcaggaactacaactcccaagaaactacaactcccatcgaactacaactcccagacaactacaactcccactaaactacaactcccaactaactacaactcccatgcaactacaactcccagtaggcgcgccatgcttcatcagactct

SEQ ID NO: 11891 - DNA, 190 bp, Artificial Sequence; identical to SEQ ID NO: 11890
  Synthetic polynucleotide

SEQ ID NO: 11892 - DNA, 197 bp, Artificial Sequence
  Synthetic polynucleotide
atcatctcaccttgcctcctgccttccctgtttcaatccctgcaggcgccccctggtggccagacgccccctggtggcctcgcgccccctggtggccgaccgccccctggtggccctacgccccctggtggccactcgccccctggtggcctgccgccccctggtggccgtaggcgcgccatgcttcatcagactct

SEQ ID NO: 11893 - DNA, 197 bp, Artificial Sequence; identical to SEQ ID NO: 11892
  Synthetic polynucleotide

SEQ ID NO: 11894 - DNA, 172 bp, Artificial Sequence
  Synthetic polynucleotide
atcatctcaccttgcctcctgctgacgagaggcataatcctgcaggtgcaggttgaagatgcaggttgatcgtgcaggttgagactgcaggttgactatgcaggttgaacttgcaggttgatgctgcaggttgagtatgcaggttgaggcgcgccatgcttcatcagactct

SEQ ID NO: 11895 - DNA, 172 bp, Artificial Sequence; identical to SEQ ID NO: 11894
  Synthetic polynucleotide

SEQ ID NO: 11896 - DNA, 188 bp, Artificial Sequence
  Synthetic polynucleotide
atcatctcaccttgcctcctgaacagtcaccaaccacgcctgcaggcaatggaaaattagacaatggaaaatttcgcaatggaaaattgaccaatggaaaattctacaatggaaaattactcaatggaaaatttgccaatggaaaattgtacaatggaaaattggcgcgccatgcttcatcagactct

SEQ ID NO: 11897 - DNA, 188 bp, Artificial Sequence; identical to SEQ ID NO: 11896
  Synthetic polynucleotide

SEQ ID NO: 11898 - DNA, 188 bp, Artificial Sequence
  Synthetic polynucleotide
atcatctcaccttgcctcctgctttgccaacaggcagtcctgcaggcgccccccccccagacgcccccccccctcgcgccccccccccgaccgccccccccccctacgccccccccccactcgcccccccccctgccgccccccccccgtacgccccccccccggcgcgccatgcttcatcagactct

SEQ ID NO: 11899 - DNA, 188 bp, Artificial Sequence; identical to SEQ ID NO: 11898
  Synthetic polynucleotide

SEQ ID NO: 11900 - DNA, 197 bp, Artificial Sequence
  Synthetic polynucleotide
atcatctcaccttgcctcctgggtaacgctgcgtttgccctgcagggtcacgcttggctgcagagtcacgcttggctgctcggtcacgcttggctgcgacgtcacgcttggctgcctagtcacgcttggctgcactgtcacgcttggctgctgcgtcacgcttggctgcgtaggcgcgccatgcttcatcagactct

SEQ ID NO: 11901 - DNA, 197 bp, Artificial Sequence; identical to SEQ ID NO: 11900
  Synthetic polynucleotide

SEQ ID NO: 11902 - DNA, 164 bp, Artificial Sequence
  Synthetic polynucleotide
atcatctcaccttgcctcctgccagaggatagacgtcccctgcaggaatgcagtgagaaatgcagtgtcgaatgcagtggacaatgcagtgctaaatgcagtgactaatgcagtgtgcaatgcagtggtaaatgcagtgggcgcgccatgcttcatcagactct

SEQ ID NO: 11903 - DNA, 164 bp, Artificial Sequence; identical to SEQ ID NO: 11902
  Synthetic polynucleotide

SEQ ID NO: 11904 - DNA, 156 bp, Artificial Sequence
  Synthetic polynucleotide
atcatctcaccttgcctcctgagcatttgcaccgccgtcctgcaggttaaccagagattaaccagtcgttaaccaggacttaaccagctattaaccagactttaaccagtgcttaaccaggtattaaccagggcgcgccatgcttcatcagactct

SEQ ID NO: 11905 - DNA, 156 bp, Artificial Sequence; identical to SEQ ID NO: 11904
  Synthetic polynucleotide

SEQ ID NO: 11906 - DNA, 180 bp, Artificial Sequence
  Synthetic polynucleotide
atcatctcaccttgcctcctgtgtggagccatttatcgcctgcaggggtgactcatgagaggtgactcatgtcgggtgactcatggacggtgactcatgctaggtgactcatgactggtgactcatgtgcggtgactcatggtaggtgactcatgggcgcgccatgcttcatcagactct

SEQ ID NO: 11907 - DNA, 180 bp, Artificial Sequence; identical to SEQ ID NO: 11906
  Synthetic polynucleotide

SEQ ID NO: 11908 - DNA, 200 bp, Artificial Sequence
  Synthetic polynucleotide
atcatctcaccttgcctcctgttaggaagacagtatcgcctgcaggtctccctttcttcccttccccttctctcctagatctccctttcttcccttccccttctctccttcgtctccctttcttcccttccccttctctcctgactctccctttcttcccttccccttctctcctggcgcgccatgcttcatcagactct

SEQ ID NO: 11909 - DNA, 200 bp, Artificial Sequence; identical to SEQ ID NO: 11908
  Synthetic polynucleotide

SEQ ID NO: 11910 - DNA, 172 bp, Artificial Sequence
  Synthetic polynucleotide
atcatctcaccttgcctcctgtgacctctcttcttgatcctgcaggattcatctttagaattcatcttttcgattcatctttgacattcatctttctaattcatctttactattcatcttttgcattcatctttgtaattcatctttggcgcgccatgcttcatcagactct

SEQ ID NO: 11911 - DNA, 172 bp, Artificial Sequence; identical to SEQ ID NO: 11910
  Synthetic polynucleotide

SEQ ID NO: 11912 - DNA, 197 bp, Artificial Sequence
  Synthetic polynucleotide
atcatctcaccttgcctcctgcgttgtcaatcgaaacacctgcaggagcgccccctggtggagaagcgccccctggtggtcgagcgccccctggtgggacagcgccccctggtggctaagcgccccctggtggactagcgccccctggtggtgcagcgccccctggtgggtaggcgcgccatgcttcatcagactct

SEQ ID NO: 11913 - DNA, 197 bp, Artificial Sequence; identical to SEQ ID NO: 11912
  Synthetic polynucleotide

SEQ ID NO: 11914 - DNA, 188 bp, Artificial Sequence
  Synthetic polynucleotide
atcatctcaccttgcctcctgacccataagccaatacacctgcaggcgcccgccggcgagacgcccgccggcgtcgcgcccgccggcggaccgcccgccggcgctacgcccgccggcgactcgcccgccggcgtgccgcccgccggcggtacgcccgccggcgggcgcgccatgcttcatcagactct

SEQ ID NO: 11915 - DNA, 188 bp, Artificial Sequence; identical to SEQ ID NO: 11914
  Synthetic polynucleotide

SEQ ID NO: 11916 - DNA, 197 bp, Artificial Sequence
  Synthetic polynucleotide
atcatctcaccttgcctcctgacgatcgatgttggcctcctgcaggtaactcacgcatgactgtagataactcacgcatgactgttcgtaactcacgcatgactgtgactaactcacgcatgactgtctataactcacgcatgactgtacttaactcacgcatgactgttgcggcgcgccatgcttcatcagactct

SEQ ID NO: 11917 - DNA, 197 bp, Artificial Sequence; identical to SEQ ID NO: 11916
  Synthetic polynucleotide

SEQ ID NO: 11918 - DNA, 197 bp, Artificial Sequence
  Synthetic polynucleotide
atcatctcaccttgcctcctgcgagttctgggcgtagtcctgcaggatcccctcaggcggtagaatcccctcaggcggttcgatcccctcaggcggtgacatcccctcaggcggtctaatcccctcaggcggtactatcccctcaggcggttgcatcccctcaggcggtgtaggcgcgccatgcttcatcagactct

SEQ ID NO: 11919 - DNA, 197 bp, Artificial Sequence; identical to SEQ ID NO: 11918
  Synthetic polynucleotide

SEQ ID NO: 11920 - DNA, 180 bp, Artificial Sequence
  Synthetic polynucleotide
atcatctcaccttgcctcctggatgcatcgcactcttacctgcaggggtgactcatcagaggtgactcatctcgggtgactcatcgacggtgactcatcctaggtgactcatcactggtgactcatctgcggtgactcatcgtaggtgactcatcggcgcgccatgcttcatcagactct

SEQ ID NO: 11921 - DNA, 180 bp, Artificial Sequence; identical to SEQ ID NO: 11920
  Synthetic polynucleotide

SEQ ID NO: 11922 - DNA, 172 bp, Artificial Sequence
  Synthetic polynucleotide
atcatctcaccttgcctcctgttcatcctaggcctgtccctgcaggagcccgtgcgagaagcccgtgcgtcgagcccgtgcggacagcccgtgcgctaagcccgtgcgactagcccgtgcgtgcagcccgtgcggtaagcccgtgcgggcgcgccatgcttcatcagactct

SEQ ID NO: 11923 - DNA, 172 bp, Artificial Sequence; identical to SEQ ID NO: 11922
  Synthetic polynucleotide

SEQ ID NO: 11924 - DNA, 172 bp, Artificial Sequence
  Synthetic polynucleotide
atcatctcaccttgcctcctgctcacagctaatggctgcctgcaggatgaataaatagaatgaataaattcgatgaataaatgacatgaataaatctaatgaataaatactatgaataaattgcatgaataaatgtaatgaataaatggcgcgccatgcttcatcagactct

SEQ ID NO: 11925 - DNA, 172 bp, Artificial Sequence; identical to SEQ ID NO: 11924
  Synthetic polynucleotide

SEQ ID NO: 11926 - DNA, 180 bp, Artificial Sequence
  Synthetic polynucleotide
atcatctcaccttgcctcctggcctaagggctgttcgacctgcagggccctgccgccagagccctgccgcctcggccctgccgccgacgccctgccgccctagccctgccgccactgccctgccgcctgcgccctgccgccgtagccctgccgccggcgcgccatgcttcatcagactct

SEQ ID NO: 11927 - DNA, 180 bp, Artificial Sequence; identical to SEQ ID NO: 11926
  Synthetic polynucleotide

SEQ ID NO: 11928 - DNA, 148 bp, Artificial Sequence
  Synthetic polynucleotide
atcatctcaccttgcctcctgtgattcaataccgtgttcctgcaggccgccgcagaccgccgctcgccgccgcgacccgccgcctaccgccgcactccgccgctgcccgccgcgtaccgccgcggcgcgccatgcttcatcagactct

SEQ ID NO: 11929 - DNA, 148 bp, Artificial Sequence; identical to SEQ ID NO: 11928
  Synthetic polynucleotide

SEQ ID NO: 11930 - DNA, 172 bp, Artificial Sequence
  Synthetic polynucleotide
atcatctcaccttgcctcctgctcaattgactcagaaccctgcaggggcgcgtgccagaggcgcgtgcctcgggcgcgtgccgacggcgcgtgccctaggcgcgtgccactggcgcgtgcctgcggcgcgtgccgtaggcgcgtgccggcgcgccatgcttcatcagactct

SEQ ID NO: 11931 - DNA, 172 bp, Artificial Sequence; identical to SEQ ID NO: 11930
  Synthetic polynucleotide

SEQ ID NO: 11932 - DNA, 191 bp, Artificial Sequence
  Synthetic polynucleotide
atcatctcaccttgcctcctggagagtcatccctacgccctgcaggggagaaatttctagaatagaggagaaatttctagaattcgggagaaatttctagaatgacggagaaatttctagaatctaggagaaatttctagaatactggagaaatttctagaattgcggcgcgccatgcttcatcagactct

SEQ ID NO: 11933 - DNA, 191 bp, Artificial Sequence; identical to SEQ ID NO: 11932
  Synthetic polynucleotide

SEQ ID NO: 11934 - DNA, 172 bp, Artificial Sequence
  Synthetic polynucleotide
atcatctcaccttgcctcctgctccactgagctagcgtcctgcagggggaatttccagagggaatttcctcggggaatttccgacgggaatttccctagggaatttccactgggaatttcctgcgggaatttccgtagggaatttccggcgcgccatgcttcatcagactct

SEQ ID NO: 11935 - DNA, 172 bp, Artificial Sequence; identical to SEQ ID NO: 11934
  Synthetic polynucleotide

SEQ ID NO: 11936 - DNA, 190 bp, Artificial Sequence
  Synthetic polynucleotide
atcatctcaccttgcctcctgaaagcgaattaccgaaacctgcaggtaattgttctaaacagataattgttctaaactcgtaattgttctaaacgactaattgttctaaacctataattgttctaaacacttaattgttctaaactgctaattgttctaaacgtaggcgcgccatgcttcatcagactct

SEQ ID NO: 11937 - DNA, 190 bp, Artificial Sequence; identical to SEQ ID NO: 11936
  Synthetic polynucleotide

SEQ ID NO: 11938 - DNA, 196 bp, Artificial Sequence
  Synthetic polynucleotide
atcatctcaccttgcctcctgaccaggctggatgctaccctgcaggatgacatcatcttagaatgacatcatctttcgatgacatcatcttgacatgacatcatcttctaatgacatcatcttactatgacatcatctttgcatgacatcatcttgtaatgacatcatcttggcgcgccatgcttcatcagactct

SEQ ID NO: 11939 - DNA, 196 bp, Artificial Sequence; identical to SEQ ID NO: 11938
  Synthetic polynucleotide

SEQ ID NO: 11940 - DNA, 156 bp, Artificial Sequence
  Synthetic polynucleotide
atcatctcaccttgcctcctgagtagattgtccagagccctgcaggttacgtaaagattacgtaatcgttacgtaagacttacgtaactattacgtaaactttacgtaatgcttacgtaagtattacgtaaggcgcgccatgcttcatcagactct

SEQ ID NO: 11941 - DNA, 156 bp, Artificial Sequence; identical to SEQ ID NO: 11940
  Synthetic polynucleotide

SEQ ID NO: 11942 - DNA, 191 bp, Artificial Sequence
  Synthetic polynucleotide
atcatctcaccttgcctcctgctgcgttcgtggtagaacctgcagggaactacaattcccagaaggcagagaactacaattcccagaaggctcggaactacaattcccagaaggcgacgaactacaattcccagaaggcctagaactacaattcccagaaggcactggcgcgccatgcttcatcagactct

SEQ ID NO: 11943 - DNA, 191 bp, Artificial Sequence; identical to SEQ ID NO: 11942
  Synthetic polynucleotide

SEQ ID NO: 11944 - DNA, 191 bp, Artificial Sequence
  Synthetic polynucleotide
atcatctcaccttgcctcctgctcgatttactagggtgcctgcaggtgacctctggtgaccttagatgacctctggtgacctttcgtgacctctggtgaccttgactgacctctggtgaccttctatgacctctggtgaccttacttgacctctggtgacctttgcggcgcgccatgcttcatcagactct

SEQ ID NO: 11945 - DNA, 191 bp, Artificial Sequence; identical to SEQ ID NO: 11944
  Synthetic polynucleotide

SEQ ID NO: 11946 - DNA, 191 bp, Artificial Sequence
  Synthetic polynucleotide
atcatctcaccttgcctcctgttattgtcggacgccaccctgcaggacgcagctgtcaatatcagaacgcagctgtcaatatctcgacgcagctgtcaatatcgacacgcagctgtcaatatcctaacgcagctgtcaatatcactacgcagctgtcaatatctgcggcgcgccatgcttcatcagactct

SEQ ID NO: 11947 - DNA, 191 bp, Artificial Sequence; identical to SEQ ID NO: 11946
  Synthetic polynucleotide

SEQ ID NO: 11948 - DNA, 191 bp, Artificial Sequence
  Synthetic polynucleotide
atcatctcaccttgcctcctgatcaaagcggcgggatacctgcaggaggtcaccgagaggtcaagaaggtcaccgagaggtcatcgaggtcaccgagaggtcagacaggtcaccgagaggtcactaaggtcaccgagaggtcaactaggtcaccgagaggtcatgcggcgcgccatgcttcatcagactct

SEQ ID NO: 11949 - DNA, 191 bp, Artificial Sequence; identical to SEQ ID NO: 11948
  Synthetic polynucleotide

SEQ ID NO: 11950 - DNA, 188 bp, Artificial Sequence
  Synthetic polynucleotide
atcatctcaccttgcctcctgtcagcagactccgaatgcctgcaggtcttcctgcgagagatcttcctgcgagtcgtcttcctgcgaggactcttcctgcgagctatcttcctgcgagacttcttcctgcgagtgctcttcctgcgaggtatcttcctgcgagggcgcgccatgcttcatcagactct

SEQ ID NO: 11951 - DNA, 188 bp, Artificial Sequence; identical to SEQ ID NO: 11950
  Synthetic polynucleotide

SEQ ID NO: 11952 - DNA, 188 bp, Artificial Sequence
  Synthetic polynucleotide
atcatctcaccttgcctcctgttaggaactgtcaatgacctgcagggaccacgtgacaagagaccacgtgacatcggaccacgtgacagacgaccacgtgacactagaccacgtgacaactgaccacgtgacatgcgaccacgtgacagtagaccacgtgacaggcgcgccatgcttcatcagactct

SEQ ID NO: 11953 - DNA, 188 bp, Artificial Sequence; identical to SEQ ID NO: 11952
  Synthetic polynucleotide

SEQ ID NO: 11954 - DNA, 164 bp, Artificial Sequence
  Synthetic polynucleotide
atcatctcaccttgcctcctgttctacattagcctaaccctgcaggagccaatcaagaagccaatcatcgagccaatcagacagccaatcactaagccaatcaactagccaatcatgcagccaatcagtaagccaatcaggcgcgccatgcttcatcagactct

SEQ ID NO: 11955 - DNA, 164 bp, Artificial Sequence; identical to SEQ ID NO: 11954
  Synthetic polynucleotide

SEQ ID NO: 11956 - DNA, 188 bp, Artificial Sequence
  Synthetic polynucleotide
atcatctcaccttgcctcctggtttctgagagaggctgcctgcaggtttgccaaatttagatttgccaaattttcgtttgccaaatttgactttgccaaatttctatttgccaaatttacttttgccaaattttgctttgccaaatttgtatttgccaaatttggcgcgccatgcttcatcagactct

SEQ ID NO: 11957 - DNA, 188 bp, Artificial Sequence; identical to SEQ ID NO: 11956
  Synthetic polynucleotide

SEQ ID NO: 11958 - DNA, 148 bp, Artificial Sequence
  Synthetic polynucleotide
atcatctcaccttgcctcctgctgcggtttggagacatcctgcaggtgagtcaagatgagtcatcgtgagtcagactgagtcactatgagtcaacttgagtcatgctgagtcagtatgagtcaggcgcgccatgcttcatcagactct

SEQ ID NO: 11959 - DNA, 148 bp, Artificial Sequence; identical to SEQ ID NO: 11958
  Synthetic polynucleotide

SEQ ID NO: 11960 - DNA, 190 bp, Artificial Sequence
  Synthetic polynucleotide
atcatctcaccttgcctcctgatttcaagttgacagctcctgcaggggtaattattaaccagaggtaattattaacctcgggtaattattaaccgacggtaattattaaccctaggtaattattaaccactggtaattattaacctgcggtaattattaaccgtaggcgcgccatgcttcatcagactct

SEQ ID NO: 11961 - DNA, 190 bp, Artificial Sequence; identical to SEQ ID NO: 11960
  Synthetic polynucleotide

SEQ ID NO: 11962 - DNA, 185 bp, Artificial Sequence
  Synthetic polynucleotide
atcatctcaccttgcctcctgggtaaccgatcttgctgcctgcaggcccagggtaacagccgagacccagggtaacagccgtcgcccagggtaacagccggaccccagggtaacagccgctacccagggtaacagccgactcccagggtaacagccgtgcggcgcgccatgcttcatcagactct

SEQ ID NO: 11963 - DNA, 185 bp, Artificial Sequence; identical to SEQ ID NO: 11962
  Synthetic polynucleotide

SEQ ID NO: 11964 - DNA, 190 bp, Artificial Sequence
  Synthetic polynucleotide
atcatctcaccttgcctcctgcagttgctcgtgggcatcctgcagggccaccagggggcgagagccaccagggggcgtcggccaccagggggcggacgccaccagggggcgctagccaccagggggcgactgccaccagggggcgtgcgccaccagggggcggtaggcgcgccatgcttcatcagactct

SEQ ID NO: 11965 - DNA, 190 bp, Artificial Sequence; identical to SEQ ID NO: 11964
  Synthetic polynucleotide

SEQ ID NO: 11966 - DNA, 172 bp, Artificial Sequence
  Synthetic polynucleotide
atcatctcaccttgcctcctggattgaccctcactccccctgcaggtccaattaacagatccaattaactcgtccaattaacgactccaattaacctatccaattaacacttccaattaactgctccaattaacgtatccaattaacggcgcgccatgcttcatcagactct

SEQ ID NO: 11967 - DNA, 172 bp, Artificial Sequence; identical to SEQ ID NO: 11966
  Synthetic polynucleotide

SEQ ID NO: 11968 - DNA, 180 bp, Artificial Sequence
  Synthetic polynucleotide
atcatctcaccttgcctcctgcgtcgctcgtacataagcctgcaggagaccacccagagaagaccacccagtcgagaccacccaggacagaccacccagctaagaccacccagactagaccacccagtgcagaccacccaggtaagaccacccagggcgcgccatgcttcatcagactct

SEQ ID NO: 11969 - DNA, 180 bp, Artificial Sequence; identical to SEQ ID NO: 11968
  Synthetic polynucleotide

SEQ ID NO: 11970 - DNA, 172 bp, Artificial Sequence
  Synthetic polynucleotide
atcatctcaccttgcctcctgtgacacgaatacctcttcctgcaggccgcggcggcagaccgcggcggctcgccgcggcggcgacccgcggcggcctaccgcggcggcactccgcggcggctgcccgcggcggcgtaccgcggcggcggcgcgccatgcttcatcagactct

SEQ ID NO: 11971 - DNA, 172 bp, Artificial Sequence; identical to SEQ ID NO: 11970
  Synthetic polynucleotide

SEQ ID NO: 11972 - DNA, 196 bp, Artificial Sequence
  Synthetic polynucleotide
atcatctcaccttgcctcctggatgtgaagagacgactcctgcaggcaccacgtgggcaagacaccacgtgggcatcgcaccacgtgggcagaccaccacgtgggcactacaccacgtgggcaactcaccacgtgggcatgccaccacgtgggcagtacaccacgtgggcaggcgcgccatgcttcatcagactct

SEQ ID NO: 11973 - DNA, 196 bp, Artificial Sequence; identical to SEQ ID NO: 11972
  Synthetic polynucleotide

SEQ ID NO: 11974 - DNA, 156 bp, Artificial Sequence
  Synthetic polynucleotide
atcatctcaccttgcctcctgcccggtactttaagaatcctgcaggttacgtacagattacgtactcgttacgtacgacttacgtacctattacgtacactttacgtactgcttacgtacgtattacgtacggcgcgccatgcttcatcagactct

SEQ ID NO: 11975 - DNA, 156 bp, Artificial Sequence; identical to SEQ ID NO: 11974
  Synthetic polynucleotide

SEQ ID NO: 11976 - DNA, 172 bp, Artificial Sequence
  Synthetic polynucleotide
atcatctcaccttgcctcctggaggattaggttctccccctgcaggtaagatctttagataagatcttttcgtaagatctttgactaagatctttctataagatctttacttaagatcttttgctaagatctttgtataagatctttggcgcgccatgcttcatcagactct

SEQ ID NO: 11977 - DNA, 172 bp, Artificial Sequence; identical to SEQ ID NO: 11976
  Synthetic polynucleotide

SEQ ID NO: 11978 - DNA, 172 bp, Artificial Sequence
  Synthetic polynucleotide
atcatctcaccttgcctcctgcttaagaaaccggactacctgcaggcttccggctcagacttccggctctcgcttccggctcgaccttccggctcctacttccggctcactcttccggctctgccttccggctcgtacttccggctcggcgcgccatgcttcatcagactct

SEQ ID NO: 11979 - DNA, 172 bp, Artificial Sequence; identical to SEQ ID NO: 11978
  Synthetic polynucleotide

SEQ ID NO: 11980 - DNA, 156 bp, Artificial Sequence
  Synthetic polynucleotide
atcatctcaccttgcctcctgacctagggagcttccgacctgcaggtaattagcagataattagctcgtaattagcgactaattagcctataattagcacttaattagctgctaattagcgtataattagcggcgcgccatgcttcatcagactct

SEQ ID NO: 11981 - DNA, 156 bp, Artificial Sequence; identical to SEQ ID NO: 11980
  Synthetic polynucleotide

SEQ ID NO: 11982 - DNA, 156 bp, Artificial Sequence
  Synthetic polynucleotide
atcatctcaccttgcctcctggcaccgctgaacaactacctgcaggttgacctcagattgacctctcgttgacctcgacttgacctcctattgacctcactttgacctctgcttgacctcgtattgacctcggcgcgccatgcttcatcagactct

SEQ ID NO: 11983 - DNA, 156 bp, Artificial Sequence; identical to SEQ ID NO: 11982
  Synthetic polynucleotide

SEQ ID NO: 11984 - DNA, 172 bp, Artificial Sequence
  Synthetic polynucleotide
atcatctcaccttgcctcctgtagcacctagaggcttccctgcaggagcacgtggtagaagcacgtggttcgagcacgtggtgacagcacgtggtctaagcacgtggtactagcacgtggttgcagcacgtggtgtaagcacgtggtggcgcgccatgcttcatcagactct

SEQ ID NO: 11985 - DNA, 172 bp, Artificial Sequence; identical to SEQ ID NO: 11984
  Synthetic polynucleotide

SEQ ID NO: 11986 - DNA, 190 bp, Artificial Sequence
  Synthetic polynucleotide
atcatctcaccttgcctcctgtccatccggaacctgtacctgcagggttctatttatagcagagttctatttatagctcggttctatttatagcgacgttctatttatagcctagttctatttatagcactgttctatttatagctgcgttctatttatagcgtaggcgcgccatgcttcatcagactct

SEQ ID NO: 11987 - DNA, 190 bp, Artificial Sequence; identical to SEQ ID NO: 11986
  Synthetic polynucleotide

SEQ ID NO: 11988 - DNA, 140 bp, Artificial Sequence
  Synthetic polynucleotide
atcatctcaccttgcctcctgggtagcttcatgttgagcctgcaggtgcataagatgcatatcgtgcatagactgcatactatgcataacttgcatatgctgcatagtatgcataggcgcgccatgcttcatcagactct

SEQ ID NO: 11989 - DNA, 140 bp, Artificial Sequence; identical to SEQ ID NO: 11988
  Synthetic polynucleotide

SEQ ID NO: 11990 - DNA, 172 bp, Artificial Sequence
  Synthetic polynucleotide
atcatctcaccttgcctcctggtatgacagtatttgcacctgcaggaacatatgttagaaacatatgtttcgaacatatgttgacaacatatgttctaaacatatgttactaacatatgtttgcaacatatgttgtaaacatatgttggcgcgccatgcttcatcagactct

SEQ ID NO: 11991 - DNA, 172 bp, Artificial Sequence; identical to SEQ ID NO: 11990
  Synthetic polynucleotide

SEQ ID NO: 11992 - DNA, 196 bp, Artificial Sequence
  Synthetic polynucleotide
atcatctcaccttgcctcctgcactctcccgtaatcttcctgcaggagatgcaatccccagaagatgcaatcccctcgagatgcaatccccgacagatgcaatccccctaagatgcaatccccactagatgcaatcccctgcagatgcaatccccgtaagatgcaatccccggcgcgccatgcttcatcagactct

SEQ ID NO: 11993 - DNA, 196 bp, Artificial Sequence; identical to SEQ ID NO: 11992
  Synthetic polynucleotide

SEQ ID NO: 11994 - DNA, 156 bp, Artificial Sequence
  Synthetic polynucleotide
atcatctcaccttgcctcctgagtttaaagtgactgaccctgcaggttgacctgagattgacctgtcgttgacctggacttgacctgctattgacctgactttgacctgtgcttgacctggtattgacctgggcgcgccatgcttcatcagactct

SEQ ID NO: 11995 - DNA, 156 bp, Artificial Sequence; identical to SEQ ID NO: 11994
  Synthetic polynucleotide

SEQ ID NO: 11996 - DNA, 179 bp, Artificial Sequence
  Synthetic polynucleotide
atcatctcaccttgcctcctggtccaagccatagtagccctgcaggacaaaataaatcacagcatatgccagaacaaaataaatcacagcatatgcctcgacaaaataaatcacagcatatgccgacacaaaataaatcacagcatatgccctaggcgcgccatgcttcatcagactct

SEQ ID NO: 11997 - DNA, 179 bp, Artificial Sequence; identical to SEQ ID NO: 11996
  Synthetic polynucleotide

SEQ ID NO: 11998 - DNA, 180 bp, Artificial Sequence
  Synthetic polynucleotide
atcatctcaccttgcctcctggagacttgttgcacctacctgcaggagaccacccacagaagaccacccactcgagaccacccacgacagaccacccacctaagaccacccacactagaccacccactgcagaccacccacgtaagaccacccacggcgcgccatgcttcatcagactct

SEQ ID NO: 11999 - DNA, 180 bp, Artificial Sequence; identical to SEQ ID NO: 11998
  Synthetic polynucleotide

SEQ ID NO: 12000 - DNA, 148 bp, Artificial Sequence
  Synthetic polynucleotide
atcatctcaccttgcctcctgggctgatcagaactgggcctgcaggaggatgtagaaggatgttcgaggatgtgacaggatgtctaaggatgtactaggatgttgcaggatgtgtaaggatgtggcgcgccatgcttcatcagactct

SEQ ID NO: 12001 - DNA, 148 bp, Artificial Sequence; identical to SEQ ID NO: 12000
  Synthetic polynucleotide

SEQ ID NO: 12002 - DNA, 190 bp, Artificial Sequence
  Synthetic polynucleotide
atcatctcaccttgcctcctgcgttcgcacgtagctgtcctgcaggggacttccggttggagaggacttccggttggtcgggacttccggttgggacggacttccggttggctaggacttccggttggactggacttccggttggtgcggacttccggttgggtaggcgcgccatgcttcatcagactct

SEQ ID NO: 12003 - DNA, 190 bp, Artificial Sequence; identical to SEQ ID NO: 12002
  Synthetic polynucleotide

SEQ ID NO: 12004 - DNA, 191 bp, Artificial Sequence
  Synthetic polynucleotide
atcatctcaccttgcctcctggatggctgactcattctcctgcaggcgaattaattaagaaacagacgaattaattaagaaactcgcgaattaattaagaaacgaccgaattaattaagaaacctacgaattaattaagaaacactcgaattaattaagaaactgcggcgcgccatgcttcatcagactct

SEQ ID NO: 12005 - DNA, 191 bp, Artificial Sequence; identical to SEQ ID NO: 12004
  Synthetic polynucleotide

SEQ ID NO: 12006 - DNA, 185 bp, Artificial Sequence
  Synthetic polynucleotide
atcatctcaccttgcctcctggtgaattagctcgagaccctgcaggatgagctaattaccgtagaatgagctaattaccgttcgatgagctaattaccgtgacatgagctaattaccgtctaatgagctaattaccgtactatgagctaattaccgttgcggcgcgccatgcttcatcagactct

SEQ ID NO: 12007 - DNA, 185 bp, Artificial Sequence; identical to SEQ ID NO: 12006
  Synthetic polynucleotide

SEQ ID NO: 12008 - DNA, 164 bp, Artificial Sequence
  Synthetic polynucleotide
atcatctcaccttgcctcctgacttgttccatttgtcacctgcagggctgattggagagctgattggtcggctgattgggacgctgattggctagctgattggactgctgattggtgcgctgattgggtagctgattggggcgcgccatgcttcatcagactct

SEQ ID NO: 12009 - DNA, 164 bp, Artificial Sequence; identical to SEQ ID NO: 12008
  Synthetic polynucleotide

SEQ ID NO: 12010 - DNA, 156 bp, Artificial Sequence
  Synthetic polynucleotide
atcatctcaccttgcctcctgcatgtgcgaggatgcagcctgcaggtaattagaagataattagatcgtaattagagactaattagactataattagaacttaattagatgctaattagagtataattagaggcgcgccatgcttcatcagactct

SEQ ID NO: 12011 - DNA, 156 bp, Artificial Sequence; identical to SEQ ID NO: 12010
  Synthetic polynucleotide

SEQ ID NO: 12012 - DNA, 172 bp, Artificial Sequence
  Synthetic polynucleotide
atcatctcaccttgcctcctggtttcgcgctgacaccacctgcagggccaatcagaagagccaatcagatcggccaatcagagacgccaatcagactagccaatcagaactgccaatcagatgcgccaatcagagtagccaatcagaggcgcgccatgcttcatcagactct

SEQ ID NO: 12013 - DNA, 172 bp, Artificial Sequence; identical to SEQ ID NO: 12012
  Synthetic polynucleotide

SEQ ID NO: 12014 - DNA, 172 bp, Artificial Sequence
  Synthetic polynucleotide
atcatctcaccttgcctcctgtccctaatgccatcagacctgcaggaacatatgtcagaaacatatgtctcgaacatatgtcgacaacatatgtcctaaacatatgtcactaacatatgtctgcaacatatgtcgtaaacatatgtcggcgcgccatgcttcatcagactct

SEQ ID NO: 12015 - DNA, 172 bp, Artificial Sequence; identical to SEQ ID NO: 12014
  Synthetic polynucleotide

SEQ ID NO: 12016 - DNA, 156 bp, Artificial Sequence
  Synthetic polynucleotide
atcatctcaccttgcctcctgcgtacgttcgttcttcgcctgcaggattaatccagaattaatcctcgattaatccgacattaatccctaattaatccactattaatcctgcattaatccgtaattaatccggcgcgccatgcttcatcagactct

SEQ ID NO: 12017 - DNA, 156 bp, Artificial Sequence; identical to SEQ ID NO: 12016
  Synthetic polynucleotide

SEQ ID NO: 12018 - DNA, 156 bp, Artificial Sequence
  Synthetic polynucleotide
atcatctcaccttgcctcctgacagggcctccagaacacctgcaggttgaccttagattgacctttcgttgaccttgacttgaccttctattgaccttactttgacctttgcttgaccttgtattgaccttggcgcgccatgcttcatcagactct

SEQ ID NO: 12019 - DNA, 156 bp, Artificial Sequence; identical to SEQ ID NO: 12018
  Synthetic polynucleotide

SEQ ID NO: 12020 - DNA, 156 bp, Artificial Sequence
  Synthetic polynucleotide
atcatctcaccttgcctcctgagagtcatccgactcatcctgcaggtaattagtagataattagttcgtaattagtgactaattagtctataattagtacttaattagttgctaattagtgtataattagtggcgcgccatgcttcatcagactct

SEQ ID NO: 12021 - DNA, 156 bp, Artificial Sequence; identical to SEQ ID NO: 12020
  Synthetic polynucleotide

SEQ ID NO: 12022 - DNA, 164 bp, Artificial Sequence
  Synthetic polynucleotide
atcatctcaccttgcctcctgggcgctggtaatctagccctgcagggaccacccaagagaccacccatcggaccacccagacgaccacccactagaccacccaactgaccacccatgcgaccacccagtagaccacccaggcgcgccatgcttcatcagactct

SEQ ID NO: 12023 - DNA, 164 bp, Artificial Sequence; identical to SEQ ID NO: 12022
  Synthetic polynucleotide

SEQ ID NO: 12024 - DNA, 164 bp, Artificial Sequence
  Synthetic polynucleotide
atcatctcaccttgcctcctgggtgaggtaatgtcgcccctgcagggaccaccccagagaccacccctcggaccaccccgacgaccaccccctagaccaccccactgaccacccctgcgaccaccccgtagaccaccccggcgcgccatgcttcatcagactct

SEQ ID NO: 12025 - DNA, 164 bp, Artificial Sequence; identical to SEQ ID NO: 12024
  Synthetic polynucleotide

SEQ ID NO: 12026 - DNA, 156 bp, Artificial Sequence
  Synthetic polynucleotide
atcatctcaccttgcctcctgaccctgtatggcccagtcctgcagggcacgtccagagcacgtcctcggcacgtccgacgcacgtccctagcacgtccactgcacgtcctgcgcacgtccgtagcacgtccggcgcgccatgcttcatcagactct

SEQ ID NO: 12027 - DNA, 156 bp, Artificial Sequence; identical to SEQ ID NO: 12026
  Synthetic polynucleotide

SEQ ID NO: 12028 - DNA, 191 bp, Artificial Sequence
  Synthetic polynucleotide
atcatctcaccttgcctcctggtattatactggcggctcctgcagggaacaatggtattgttcagagaacaatggtattgttctcggaacaatggtattgttcgacgaacaatggtattgttcctagaacaatggtattgttcactgaacaatggtattgttctgcggcgcgccatgcttcatcagactct

SEQ ID NO: 12029 - DNA, 191 bp, Artificial Sequence; identical to SEQ ID NO: 12028
  Synthetic polynucleotide

SEQ ID NO: 12030 - DNA, 191 bp, Artificial Sequence
  Synthetic polynucleotide
atcatctcaccttgcctcctgtaatgccgtcttcttgacctgcaggtatggggtatctatttaagatatggggtatctatttatcgtatggggtatctatttagactatggggtatctatttactatatggggtatctatttaacttatggggtatctatttatgcggcgcgccatgcttcatcagactct

SEQ ID NO: 12031 - DNA, 191 bp, Artificial Sequence; identical to SEQ ID NO: 12030
  Synthetic polynucleotide

SEQ ID NO: 12032 - DNA, 197 bp, Artificial Sequence
  Synthetic polynucleotide
atcatctcaccttgcctcctgtgcaaagcatcgaacatcctgcaggcgtcacgcttgactgctcagacgtcacgcttgactgctctcgcgtcacgcttgactgctcgaccgtcacgcttgactgctcctacgtcacgcttgactgctcactcgtcacgcttgactgctctgcggcgcgccatgcttcatcagactct

SEQ ID NO: 12033 - DNA, 197 bp, Artificial Sequence; identical to SEQ ID NO: 12032
  Synthetic polynucleotide

SEQ ID NO: 12034 - DNA, 190 bp, Artificial Sequence
  Synthetic polynucleotide
atcatctcaccttgcctcctgagtggtgtgtcggatggcctgcagggctgccccctggtgagagctgccccctggtgtcggctgccccctggtggacgctgccccctggtgctagctgccccctggtgactgctgccccctggtgtgcgctgccccctggtggtaggcgcgccatgcttcatcagactct

SEQ ID NO: 12035 - DNA, 190 bp, Artificial Sequence; identical to SEQ ID NO: 12034
  Synthetic polynucleotide

SEQ ID NO: 12036 - DNA, 164 bp, Artificial Sequence
  Synthetic polynucleotide
atcatctcaccttgcctcctgtcgataaggagaatcaacctgcaggaaagtgataagaaaagtgatatcgaaagtgatagacaaagtgatactaaaagtgataactaaagtgatatgcaaagtgatagtaaaagtgataggcgcgccatgcttcatcagactct

SEQ ID NO: 12037 - DNA, 164 bp, Artificial Sequence; identical to SEQ ID NO: 12036
  Synthetic polynucleotide

SEQ ID NO: 12038 - DNA, 156 bp, Artificial Sequence
  Synthetic polynucleotide
atcatctcaccttgcctcctgcaaggacgctcattatgcctgcaggtgtcaaaaagatgtcaaaatcgtgtcaaaagactgtcaaaactatgtcaaaaacttgtcaaaatgctgtcaaaagtatgtcaaaaggcgcgccatgcttcatcagactct

SEQ ID NO: 12039 - DNA, 156 bp, Artificial Sequence; identical to SEQ ID NO: 12038
  Synthetic polynucleotide

SEQ ID NO: 12040 - DNA, 180 bp, Artificial Sequence
  Synthetic polynucleotide
atcatctcaccttgcctcctgattatctgttgtccttgcctgcaggggttttattggagaggttttattggtcgggttttattgggacggttttattggctaggttttattggactggttttattggtgcggttttattgggtaggttttattggggcgcgccatgcttcatcagactct

SEQ ID NO: 12041 - DNA, 180 bp, Artificial Sequence; identical to SEQ ID NO: 12040
  Synthetic polynucleotide

SEQ ID NO: 12042 - DNA, 197 bp, Artificial Sequence
  Synthetic polynucleotide
atcatctcaccttgcctcctgaagacgtaactgggacgcctgcaggttttgttacagtgtcagattttgttacagtgtctcgttttgttacagtgtcgacttttgttacagtgtcctattttgttacagtgtcactttttgttacagtgtctgcttttgttacagtgtcgtaggcgcgccatgcttcatcagactct

SEQ ID NO: 12043 - DNA, 197 bp, Artificial Sequence; identical to SEQ ID NO: 12042
  Synthetic polynucleotide

SEQ ID NO: 12044 - DNA, 191 bp, Artificial Sequence
  Synthetic polynucleotide
atcatctcaccttgcctcctgtccctttcaaggaactgcctgcaggacattcctgacattccaagaacattcctgacattccatcgacattcctgacattccagacacattcctgacattccactaacattcctgacattccaactacattcctgacattccatgcggcgcgccatgcttcatcagactct

SEQ ID NO: 12045 - DNA, 191 bp, Artificial Sequence; identical to SEQ ID NO: 12044
  Synthetic polynucleotide

SEQ ID NO: 12046 - DNA, 188 bp, Artificial Sequence
  Synthetic polynucleotide
atcatctcaccttgcctcctgccgaaagagcaacacatcctgcaggatgcataatttaagaatgcataatttatcgatgcataatttagacatgcataatttactaatgcataatttaactatgcataatttatgcatgcataatttagtaatgcataatttaggcgcgccatgcttcatcagactct

SEQ ID NO: 12047 - DNA, 188 bp, Artificial Sequence; identical to SEQ ID NO: 12046
  Synthetic polynucleotide

SEQ ID NO: 12048 - DNA, 156 bp, Artificial Sequence
  Synthetic polynucleotide
atcatctcaccttgcctcctgacgttacgccgtccaaacctgcagggcgaggttagagcgaggtttcggcgaggttgacgcgaggttctagcgaggttactgcgaggtttgcgcgaggttgtagcgaggttggcgcgccatgcttcatcagactct

SEQ ID NO: 12049 - DNA, 156 bp, Artificial Sequence; identical to SEQ ID NO: 12048
  Synthetic polynucleotide

SEQ ID NO: 12050 - DNA, 197 bp, Artificial Sequence
  Synthetic polynucleotide
atcatctcaccttgcctcctgaccctataatatcgcttcctgcaggcgttgcctagcaacgagacgttgcctagcaacgtcgcgttgcctagcaacggaccgttgcctagcaacgctacgttgcctagcaacgactcgttgcctagcaacgtgccgttgcctagcaacggtaggcgcgccatgcttcatcagactct

SEQ ID NO: 12051 - DNA, 197 bp, Artificial Sequence; identical to SEQ ID NO: 12050
  Synthetic polynucleotide

SEQ ID NO: 12052 - DNA, 188 bp, Artificial Sequence
  Synthetic polynucleotide
atcatctcaccttgcctcctgtcccgtggccaactaaacctgcaggcgaccatctgttagacgaccatctgtttcgcgaccatctgttgaccgaccatctgttctacgaccatctgttactcgaccatctgtttgccgaccatctgttgtacgaccatctgttggcgcgccatgcttcatcagactct

SEQ ID NO: 12053 - DNA, 188 bp, Artificial Sequence; identical to SEQ ID NO: 12052
  Synthetic polynucleotide

SEQ ID NO: 12054 - DNA, 164 bp, Artificial Sequence
  Synthetic polynucleotide
atcatctcaccttgcctcctggaattcacgaggtcgtacctgcaggggggattaaagaggggattaatcgggggattaagacggggattaactaggggattaaactggggattaatgcggggattaagtaggggattaaggcgcgccatgcttcatcagactct

SEQ ID NO: 12055 - DNA, 164 bp, Artificial Sequence; identical to SEQ ID NO: 12054
  Synthetic polynucleotide

SEQ ID NO: 12056 - DNA, 188 bp, Artificial Sequence
  Synthetic polynucleotide
atcatctcaccttgcctcctgctggccttctatatcgtcctgcagggcggcaggggagagagcggcaggggagtcggcggcaggggaggacgcggcaggggagctagcggcaggggagactgcggcaggggagtgcgcggcaggggaggtagcggcaggggagggcgcgccatgcttcatcagactct

SEQ ID NO: 12057 - DNA, 188 bp, Artificial Sequence; identical to SEQ ID NO: 12056
  Synthetic polynucleotide

SEQ ID NO: 12058 - DNA, 172 bp, Artificial Sequence
  Synthetic polynucleotide
atcatctcaccttgcctcctggcaagactcttgttggtcctgcaggctcaagtgctagactcaagtgcttcgctcaagtgctgacctcaagtgctctactcaagtgctactctcaagtgcttgcctcaagtgctgtactcaagtgctggcgcgccatgcttcatcagactct

SEQ ID NO: 12059 - DNA, 172 bp, Artificial Sequence; identical to SEQ ID NO: 12058
  Synthetic polynucleotide

SEQ ID NO: 12060 - DNA, 172 bp, Artificial Sequence
  Synthetic polynucleotide
atcatctcaccttgcctcctgatgagttggccttcttccctgcaggctcacaccttagactcacacctttcgctcacaccttgacctcacaccttctactcacaccttactctcacacctttgcctcacaccttgtactcacaccttggcgcgccatgcttcatcagactct

SEQ ID NO: 12061 - DNA, 172 bp, Artificial Sequence; identical to SEQ ID NO: 12060
  Synthetic polynucleotide

SEQ ID NO: 12062 - DNA, 164 bp, Artificial Sequence
  Synthetic polynucleotide
atcatctcaccttgcctcctgaacggagtgctgttaaccctgcaggttttattacagattttattactcgttttattacgacttttattacctattttattacactttttattactgcttttattacgtattttattacggcgcgccatgcttcatcagactct

SEQ ID NO: 12063 - DNA, 164 bp, Artificial Sequence; identical to SEQ ID NO: 12062
  Synthetic polynucleotide

SEQ ID NO: 12064 - DNA, 197 bp, Artificial Sequence
  Synthetic polynucleotide
atcatctcaccttgcctcctgcggttatgcaggtatgtcctgcagggaggatgagtcaccaagagaggatgagtcaccatcggaggatgagtcaccagacgaggatgagtcaccactagaggatgagtcaccaactgaggatgagtcaccatgcgaggatgagtcaccagtaggcgcgccatgcttcatcagactct

SEQ ID NO: 12065 - DNA, 197 bp, Artificial Sequence; identical to SEQ ID NO: 12064
  Synthetic polynucleotide

SEQ ID NO: 12066 - DNA, 191 bp, Artificial Sequence
  Synthetic polynucleotide
atcatctcaccttgcctcctgcactcactgaccattgacctgcaggaaaaaaaatcaataacaagacagaaaaaaaaatcaataacaagactcgaaaaaaaatcaataacaagacgacaaaaaaaatcaataacaagacctaaaaaaaaatcaataacaagacactggcgcgccatgcttcatcagactct

SEQ ID NO: 12067 - DNA, 191 bp, Artificial Sequence; identical to SEQ ID NO: 12066
  Synthetic polynucleotide

SEQ ID NO: 12068 - DNA, 172 bp, Artificial Sequence
  Synthetic polynucleotide
atcatctcaccttgcctcctggtggcgttaggaattcccctgcaggcttaagtgctagacttaagtgcttcgcttaagtgctgaccttaagtgctctacttaagtgctactcttaagtgcttgccttaagtgctgtacttaagtgctggcgcgccatgcttcatcagactct

SEQ ID NO: 12069 - DNA, 172 bp, Artificial Sequence; identical to SEQ ID NO: 12068
  Synthetic polynucleotide

SEQ ID NO: 12070 - DNA, 164 bp, Artificial Sequence
  Synthetic polynucleotide
atcatctcaccttgcctcctggctgatcttccgataaccctgcaggtggggggtcagatggggggtctcgtggggggtcgactggggggtcctatggggggtcacttggggggtctgctggggggtcgtatggggggtcggcgcgccatgcttcatcagactct

SEQ ID NO: 12071 - DNA, 164 bp, Artificial Sequence; identical to SEQ ID NO: 12070
  Synthetic polynucleotide

SEQ ID NO: 12072 - DNA, 191 bp, Artificial Sequence
  Synthetic polynucleotide
atcatctcaccttgcctcctggaaacccggattccagccctgcaggcattaattatgcatgagagacattaattatgcatgagtcgcattaattatgcatgaggaccattaattatgcatgagctacattaattatgcatgagactcattaattatgcatgagtgcggcgcgccatgcttcatcagactct

SEQ ID NO: 12073 - DNA, 191 bp, Artificial Sequence; identical to SEQ ID NO: 12072
  Synthetic polynucleotide

SEQ ID NO: 12074 - DNA, 197 bp, Artificial Sequence
  Synthetic polynucleotide
atcatctcaccttgcctcctgcactctatcgactaagacctgcaggacagtcatgcgtgagttaagaacagtcatgcgtgagttatcgacagtcatgcgtgagttagacacagtcatgcgtgagttactaacagtcatgcgtgagttaactacagtcatgcgtgagttatgcggcgcgccatgcttcatcagactct

SEQ ID NO: 12075 - DNA, 197 bp, Artificial Sequence; identical to SEQ ID NO: 12074
  Synthetic polynucleotide

SEQ ID NO: 12076 - DNA, 164 bp, Artificial Sequence
  Synthetic polynucleotide
atcatctcaccttgcctcctgctaactgagagagcccacctgcagggtacgtgacagagtacgtgactcggtacgtgacgacgtacgtgacctagtacgtgacactgtacgtgactgcgtacgtgacgtagtacgtgacggcgcgccatgcttcatcagactct

SEQ ID NO: 12077 - DNA, 164 bp, Artificial Sequence; identical to SEQ ID NO: 12076
  Synthetic polynucleotide

SEQ ID NO: 12078 - DNA, 172 bp, Artificial Sequence
  Synthetic polynucleotide
atcatctcaccttgcctcctggctgatttatactatggcctgcaggaaggggggcaagaaaggggggcatcgaaggggggcagacaaggggggcactaaaggggggcaactaaggggggcatgcaaggggggcagtaaaggggggcaggcgcgccatgcttcatcagactct

SEQ ID NO: 12079 - DNA, 172 bp, Artificial Sequence; identical to SEQ ID NO: 12078
  Synthetic polynucleotide

SEQ ID NO: 12080 - DNA, 186 bp, Artificial Sequence
  Synthetic polynucleotide
atcatctcaccttgcctcctgcggcttgggatttgtgtcctgcaggagggacgcagctgctccccaagaagggacgcagctgctccccatcgagggacgcagctgctccccagacagggacgcagctgctccccactaagggacgcagctgctccccaactggcgcgccatgcttcatcagactct

SEQ ID NO: 12081 - DNA, 186 bp, Artificial Sequence; identical to SEQ ID NO: 12080
  Synthetic polynucleotide

SEQ ID NO: 12082 - DNA, 186 bp, Artificial Sequence
  Synthetic polynucleotide
atcatctcaccttgcctcctgcccgaagtgcagttgctcctgcaggtgacctcaatttgacctttgagatgacctcaatttgacctttgtcgtgacctcaatttgacctttggactgacctcaatttgacctttgctatgacctcaatttgacctttgactggcgcgccatgcttcatcagactct

SEQ ID NO: 12083 - DNA, 186 bp, Artificial Sequence; identical to SEQ ID NO: 12082
  Synthetic polynucleotide

SEQ ID NO: 12084 - DNA, 188 bp, Artificial Sequence
  Synthetic polynucleotide
atcatctcaccttgcctcctgtagatgccaagttgcgccctgcaggtgccacgtaatcagatgccacgtaatctcgtgccacgtaatcgactgccacgtaatcctatgccacgtaatcacttgccacgtaatctgctgccacgtaatcgtatgccacgtaatcggcgcgccatgcttcatcagactct

SEQ ID NO: 12085 - DNA, 188 bp, Artificial Sequence; identical to SEQ ID NO: 12084
  Synthetic polynucleotide

SEQ ID NO: 12086 - DNA, 197 bp, Artificial Sequence
  Synthetic polynucleotide
atcatctcaccttgcctcctgcggcacagagcacttcacctgcaggtgaaatgtttatttaagatgaaatgtttatttatcgtgaaatgtttatttagactgaaatgtttatttactatgaaatgtttatttaacttgaaatgtttatttatgctgaaatgtttatttagtaggcgcgccatgcttcatcagactct

SEQ ID NO: 12087 - DNA, 197 bp, Artificial Sequence; identical to SEQ ID NO: 12086
  Synthetic polynucleotide

SEQ ID NO: 12088 - DNA, 164 bp, Artificial Sequence
  Synthetic polynucleotide
atcatctcaccttgcctcctgttcagcgccgaagactgcctgcaggttcaaggacagattcaaggactcgttcaaggacgacttcaaggacctattcaaggacactttcaaggactgcttcaaggacgtattcaaggacggcgcgccatgcttcatcagactct

SEQ ID NO: 12089 - DNA, 164 bp, Artificial Sequence; identical to SEQ ID NO: 12088
  Synthetic polynucleotide

SEQ ID NO: 12090 - DNA, 200 bp, Artificial Sequence
  Synthetic polynucleotide
atcatctcaccttgcctcctgcaagtcgcgaaccgaaccctgcaggacagggtcaaaggtcacgaagaacagggtcaaaggtcacgatcgacagggtcaaaggtcacgagacacagggtcaaaggtcacgactaacagggtcaaaggtcacgaactacagggtcaaaggtcacgaggcgcgccatgcttcatcagactct

SEQ ID NO: 12091 - DNA, 200 bp, Artificial Sequence; identical to SEQ ID NO: 12090
  Synthetic polynucleotide

SEQ ID NO: 12092 - DNA, 196 bp, Artificial Sequence
  Synthetic polynucleotide
atcatctcaccttgcctcctgcggagggacataagcttcctgcaggtttcaaggcccccagatttcaaggccccctcgtttcaaggcccccgactttcaaggcccccctatttcaaggcccccacttttcaaggccccctgctttcaaggcccccgtatttcaaggcccccggcgcgccatgcttcatcagactct

SEQ ID NO: 12093 - DNA, 196 bp, Artificial Sequence; identical to SEQ ID NO: 12092
  Synthetic polynucleotide

SEQ ID NO: 12094 - DNA, 185 bp, Artificial Sequence
  Synthetic polynucleotide
atcatctcaccttgcctcctggtttaaccacccaagagcctgcaggtgaacccgatgaactcagatgaacccgatgaactctcgtgaacccgatgaactcgactgaacccgatgaactcctatgaacccgatgaactcacttgaacccgatgaactctgcggcgcgccatgcttcatcagactct

SEQ ID NO: 12095 - DNA, 185 bp, Artificial Sequence; identical to SEQ ID NO: 12094
  Synthetic polynucleotide

SEQ ID NO: 12096 - DNA, 191 bp, Artificial Sequence
  Synthetic polynucleotide
atcatctcaccttgcctcctgtgctgcagtccttcaagcctgcaggctggcgccccctggtggagactggcgccccctggtggtcgctggcgccccctggtgggacctggcgccccctggtggctactggcgccccctggtggactctggcgccccctggtggtgcggcgcgccatgcttcatcagactct

SEQ ID NO: 12097 - DNA, 191 bp, Artificial Sequence; identical to SEQ ID NO: 12096
  Synthetic polynucleotide

SEQ ID NO: 12098 - DNA, 164 bp, Artificial Sequence
  Synthetic polynucleotide
atcatctcaccttgcctcctggggaggtgtatatgtttcctgcaggcatataaggagacatataaggtcgcatataagggaccatataaggctacatataaggactcatataaggtgccatataagggtacatataaggggcgcgccatgcttcatcagactct

SEQ ID NO: 12099 - DNA, 164 bp, Artificial Sequence; identical to SEQ ID NO: 12098
  Synthetic polynucleotide

SEQ ID NO: 12100 - DNA, 197 bp, Artificial Sequence
  Synthetic polynucleotide
atcatctcaccttgcctcctgacaccttgaccagatctcctgcaggttcagtttcactttcagattcagtttcactttctcgttcagtttcactttcgacttcagtttcactttcctattcagtttcactttcactttcagtttcactttctgcttcagtttcactttcgtaggcgcgccatgcttcatcagactct

SEQ ID NO: 12101 - DNA, 197 bp, Artificial Sequence; identical to SEQ ID NO: 12100
  Synthetic polynucleotide

SEQ ID NO: 12102 - DNA, 188 bp, Artificial Sequence
  Synthetic polynucleotide
atcatctcaccttgcctcctgtcttcaggctttgctgacctgcaggaaccacttcctgagaaaccacttcctgtcgaaccacttcctggacaaccacttcctgctaaaccacttcctgactaaccacttcctgtgcaaccacttcctggtaaaccacttcctgggcgcgccatgcttcatcagactct

SEQ ID NO: 12103 - DNA, 188 bp, Artificial Sequence; identical to SEQ ID NO: 12102
  Synthetic polynucleotide

SEQ ID NO: 12104 - DNA, 172 bp, Artificial Sequence
  Synthetic polynucleotide
atcatctcaccttgcctcctgggttcattatgctgtatcctgcagggtggggggtaagagtggggggtatcggtggggggtagacgtggggggtactagtggggggtaactgtggggggtatgcgtggggggtagtagtggggggtaggcgcgccatgcttcatcagactct

SEQ ID NO: 12105 - DNA, 172 bp, Artificial Sequence; identical to SEQ ID NO: 12104
  Synthetic polynucleotide

SEQ ID NO: 12106 - DNA, 164 bp, Artificial Sequence
  Synthetic polynucleotide
atcatctcaccttgcctcctgagttcgtacggctcagacctgcaggggtcacgtgagaggtcacgtgtcgggtcacgtggacggtcacgtgctaggtcacgtgactggtcacgtgtgcggtcacgtggtaggtcacgtgggcgcgccatgcttcatcagactct

SEQ ID NO: 12107 - DNA, 164 bp, Artificial Sequence; identical to SEQ ID NO: 12106
  Synthetic polynucleotide

SEQ ID NO: 12108 - DNA, 156 bp, Artificial Sequence
  Synthetic polynucleotide
atcatctcaccttgcctcctggttgccgctcattgttgcctgcaggaggggtcaagaaggggtcatcgaggggtcagacaggggtcactaaggggtcaactaggggtcatgcaggggtcagtaaggggtcaggcgcgccatgcttcatcagactct

SEQ ID NO: 12109 - DNA, 156 bp, Artificial Sequence; identical to SEQ ID NO: 12108
  Synthetic polynucleotide

SEQ ID NO: 12110 - DNA, 156 bp, Artificial Sequence
  Synthetic polynucleotide
atcatctcaccttgcctcctgcacctcatcgtaggtggcctgcagggaacaataagagaacaatatcggaacaatagacgaacaatactagaacaataactgaacaatatgcgaacaatagtagaacaataggcgcgccatgcttcatcagactct

SEQ ID NO: 12111 - DNA, 156 bp, Artificial Sequence; identical to SEQ ID NO: 12110
  Synthetic polynucleotide

SEQ ID NO: 12112 - DNA, 188 bp, Artificial Sequence
  Synthetic polynucleotide
atcatctcaccttgcctcctgaagacagcttcgtcgtacctgcagggacctgtcactgagagacctgtcactgtcggacctgtcactggacgacctgtcactgctagacctgtcactgactgacctgtcactgtgcgacctgtcactggtagacctgtcactgggcgcgccatgcttcatcagactct

SEQ ID NO: 12113 - DNA, 188 bp, Artificial Sequence; identical to SEQ ID NO: 12112
  Synthetic polynucleotide

SEQ ID NO: 12114 - DNA, 191 bp, Artificial Sequence
  Synthetic polynucleotide
atcatctcaccttgcctcctgttcgtgacccagcagctcctgcaggaaaacgaaaatcgatttagaaaaacgaaaatcgattttcgaaaacgaaaatcgatttgacaaaacgaaaatcgatttctaaaaacgaaaatcgatttactaaaacgaaaatcgattttgcggcgcgccatgcttcatcagactct

SEQ ID NO: 12115 - DNA, 191 bp, Artificial Sequence; identical to SEQ ID NO: 12114
  Synthetic polynucleotide

SEQ ID NO: 12116 - DNA, 164 bp, Artificial Sequence
  Synthetic polynucleotide
atcatctcaccttgcctcctgtcgggacgtatgtttctcctgcagggcctggaatagagcctggaattcggcctggaatgacgcctggaatctagcctggaatactgcctggaattgcgcctggaatgtagcctggaatggcgcgccatgcttcatcagactct

SEQ ID NO: 12117 - DNA, 164 bp, Artificial Sequence; identical to SEQ ID NO: 12116
  Synthetic polynucleotide

SEQ ID NO: 12118 - DNA, 191 bp, Artificial Sequence
  Synthetic polynucleotide
atcatctcaccttgcctcctgtttgcgcggtacttccacctgcaggtatagagataagaattgagatatagagataagaattgtcgtatagagataagaattggactatagagataagaattgctatatagagataagaattgacttatagagataagaattgtgcggcgcgccatgcttcatcagactct

SEQ ID NO: 12119 - DNA, 191 bp, Artificial Sequence; identical to SEQ ID NO: 12118
  Synthetic polynucleotide

SEQ ID NO: 12120 - DNA, 156 bp, Artificial Sequence
  Synthetic polynucleotide
atcatctcaccttgcctcctgtccgtagtaaagagaatcctgcagggaacaatgagagaacaatgtcggaacaatggacgaacaatgctagaacaatgactgaacaatgtgcgaacaatggtagaacaatgggcgcgccatgcttcatcagactct

SEQ ID NO: 12121 - DNA, 156 bp, Artificial Sequence; identical to SEQ ID NO: 12120
  Synthetic polynucleotide

SEQ ID NO: 12122 - DNA, 185 bp, Artificial Sequence
  Synthetic polynucleotide
atcatctcaccttgcctcctgtcggtctatccctgctacctgcaggatgactgcacattcatagaatgactgcacattcattcgatgactgcacattcatgacatgactgcacattcatctaatgactgcacattcatactatgactgcacattcattgcggcgcgccatgcttcatcagactct

SEQ ID NO: 12123 - DNA, 185 bp, Artificial Sequence; identical to SEQ ID NO: 12122
  Synthetic polynucleotide

SEQ ID NO: 12124 - DNA, 187 bp, Artificial Sequence
  Synthetic polynucleotide
atcatctcaccttgcctcctggatcgaccaagtctgtacctgcaggttattaattggttataatggttaaatagattattaattggttataatggttaaattcgttattaattggttataatggttaaatgacttattaattggttataatggttaaatctaggcgcgccatgcttcatcagactct

SEQ ID NO: 12125 - DNA, 187 bp, Artificial Sequence; identical to SEQ ID NO: 12124
  Synthetic polynucleotide

SEQ ID NO: 12126 - DNA, 190 bp, Artificial Sequence
  Synthetic polynucleotide
atcatctcaccttgcctcctgcctagaaggatacagagcctgcaggcaaatctcgcgagaagacaaatctcgcgagatcgcaaatctcgcgagagaccaaatctcgcgagactacaaatctcgcgagaactcaaatctcgcgagatgccaaatctcgcgagagtaggcgcgccatgcttcatcagactct

SEQ ID NO: 12127 - DNA, 190 bp, Artificial Sequence; identical to SEQ ID NO: 12126
  Synthetic polynucleotide

SEQ ID NO: 12128 - DNA, 191 bp, Artificial Sequence
  Synthetic polynucleotide
atcatctcaccttgcctcctggggtgttgagctaagtacctgcaggcattattaattaattcgagacattattaattaattcgtcgcattattaattaattcggaccattattaattaattcgctacattattaattaattcgactcattattaattaattcgtgcggcgcgccatgcttcatcagactct

SEQ ID NO: 12129 - DNA, 191 bp, Artificial Sequence; identical to SEQ ID NO: 12128
  Synthetic polynucleotide

SEQ ID NO: 12130 - DNA, 188 bp, Artificial Sequence
  Synthetic polynucleotide
atcatctcaccttgcctcctgctaggtagtttacagcgcctgcaggctgcacctggcgagactgcacctggcgtcgctgcacctggcggacctgcacctggcgctactgcacctggcgactctgcacctggcgtgcctgcacctggcggtactgcacctggcgggcgcgccatgcttcatcagactct

SEQ ID NO: 12131 - DNA, 188 bp, Artificial Sequence; identical to SEQ ID NO: 12130
  Synthetic polynucleotide

SEQ ID NO: 12132 - DNA, 172 bp, Artificial Sequence
  Synthetic polynucleotide
atcatctcaccttgcctcctgagaggccgttaacgtgccctgcaggccatagcaacagaccatagcaactcgccatagcaacgacccatagcaacctaccatagcaacactccatagcaactgcccatagcaacgtaccatagcaacggcgcgccatgcttcatcagactct

SEQ ID NO: 12133 - DNA, 172 bp, Artificial Sequence; identical to SEQ ID NO: 12132
  Synthetic polynucleotide

SEQ ID NO: 12134 - DNA, 172 bp, Artificial Sequence
  Synthetic polynucleotide
atcatctcaccttgcctcctgatgttcaacggactgggcctgcaggaggaaaatttagaaggaaaattttcgaggaaaatttgacaggaaaatttctaaggaaaatttactaggaaaattttgcaggaaaatttgtaaggaaaatttggcgcgccatgcttcatcagactct

SEQ ID NO: 12135 - DNA, 172 bp, Artificial Sequence; identical to SEQ ID NO: 12134
  Synthetic polynucleotide

SEQ ID NO: 12136 - DNA, 196 bp, Artificial Sequence
  Synthetic polynucleotide
atcatctcaccttgcctcctgcttggtgtatgggttgtcctgcagggggcgctgtccatggtgctgaaagagggcgctgtccatggtgctgaatcggggcgctgtccatggtgctgaagacgggcgctgtccatggtgctgaactagggcgctgtccatggtgctgaaactggcgcgccatgcttcatcagactct

SEQ ID NO: 12137 - DNA, 196 bp, Artificial Sequence; identical to SEQ ID NO: 12136
  Synthetic polynucleotide

SEQ ID NO: 12138 - DNA, 191 bp, Artificial Sequence
  Synthetic polynucleotide
atcatctcaccttgcctcctgaatccttctgtagattccctgcaggtgcgatgatttcgccttagatgcgatgatttcgcctttcgtgcgatgatttcgccttgactgcgatgatttcgccttctatgcgatgatttcgccttacttgcgatgatttcgcctttgcggcgcgccatgcttcatcagactct

SEQ ID NO: 12139 - DNA, 191 bp, Artificial Sequence; identical to SEQ ID NO: 12138
  Synthetic polynucleotide

SEQ ID NO: 12140 - DNA, 188 bp, Artificial Sequence
  Synthetic polynucleotide
atcatctcaccttgcctcctgatagtcgccgtacgatgcctgcagggatgatttatgaagagatgatttatgatcggatgatttatgagacgatgatttatgactagatgatttatgaactgatgatttatgatgcgatgatttatgagtagatgatttatgaggcgcgccatgcttcatcagactct

SEQ ID NO: 12141 - DNA, 188 bp, Artificial Sequence; identical to SEQ ID NO: 12140
  Synthetic polynucleotide

SEQ ID NO: 12142 - DNA, 196 bp, Artificial Sequence
  Synthetic polynucleotide
atcatctcaccttgcctcctgtttacgtaacctcctctcctgcaggccccaagtgaaggagaccccaagtgaaggtcgccccaagtgaagggacccccaagtgaaggctaccccaagtgaaggactccccaagtgaaggtgcccccaagtgaagggtaccccaagtgaaggggcgcgccatgcttcatcagactct

SEQ ID NO: 12143 - DNA, 196 bp, Artificial Sequence; identical to SEQ ID NO: 12142
  Synthetic polynucleotide

SEQ ID NO: 12144 - DNA, 172 bp, Artificial Sequence
  Synthetic polynucleotide
atcatctcaccttgcctcctgacttacaatattgcccacctgcaggggggaggaggagaggggaggaggtcgggggaggagggacggggaggaggctaggggaggaggactggggaggaggtgcggggaggagggtaggggaggaggggcgcgccatgcttcatcagactct

SEQ ID NO: 12145 - DNA, 172 bp, Artificial Sequence; identical to SEQ ID NO: 12144
  Synthetic polynucleotide

SEQ ID NO: 12146 - DNA, 197 bp, Artificial Sequence
  Synthetic polynucleotide
atcatctcaccttgcctcctgtatccggcggtgataggcctgcaggaccacttccgggtcaagaaccacttccgggtcatcgaccacttccgggtcagacaccacttccgggtcactaaccacttccgggtcaactaccacttccgggtcatgcaccacttccgggtcagtaggcgcgccatgcttcatcagactct

SEQ ID NO: 12147 - DNA, 197 bp, Artificial Sequence; identical to SEQ ID NO: 12146
  Synthetic polynucleotide

SEQ ID NO: 12148 - DNA, 185 bp, Artificial Sequence
  Synthetic polynucleotide
atcatctcaccttgcctcctgtccctcgtagcatactacctgcaggcggctgttaccctgggagacggctgttaccctgggtcgcggctgttaccctggggaccggctgttaccctgggctacggctgttaccctgggactcggctgttaccctgggtgcggcgcgccatgcttcatcagactct

SEQ ID NO: 12149 - DNA, 185 bp, Artificial Sequence; identical to SEQ ID NO: 12148
  Synthetic polynucleotide

SEQ ID NO: 12150 - DNA, 180 bp, Artificial Sequence
  Synthetic polynucleotide
atcatctcaccttgcctcctgcacagactcacccaccacctgcaggcatgactcatcagacatgactcatctcgcatgactcatcgaccatgactcatcctacatgactcatcactcatgactcatctgccatgactcatcgtacatgactcatcggcgcgccatgcttcatcagactct

SEQ ID NO: 12151 - DNA, 180 bp, Artificial Sequence; identical to SEQ ID NO: 12150
  Synthetic polynucleotide

SEQ ID NO: 12152 - DNA, 185 bp, Artificial Sequence
  Synthetic polynucleotide
atcatctcaccttgcctcctggaatagctgttcctgcccctgcaggatcagccaatcagagcagaatcagccaatcagagctcgatcagccaatcagagcgacatcagccaatcagagcctaatcagccaatcagagcactatcagccaatcagagctgcggcgcgccatgcttcatcagactct

SEQ ID NO: 12153 - DNA, 185 bp, Artificial Sequence; identical to SEQ ID NO: 12152
  Synthetic polynucleotide

SEQ ID NO: 12154 - DNA, 172 bp, Artificial Sequence
  Synthetic polynucleotide
atcatctcaccttgcctcctgtcctgggctgatccgaacctgcaggacttccccttagaacttcccctttcgacttccccttgacacttccccttctaacttccccttactacttcccctttgcacttccccttgtaacttccccttggcgcgccatgcttcatcagactct

SEQ ID NO: 12155 - DNA, 172 bp, Artificial Sequence; identical to SEQ ID NO: 12154
  Synthetic polynucleotide

SEQ ID NO: 12156 - DNA, 197 bp, Artificial Sequence
  Synthetic polynucleotide
atcatctcaccttgcctcctgagccgcgaactaatttccctgcaggcttatctgcccccaccagagacttatctgcccccaccagtcgcttatctgcccccaccaggaccttatctgcccccaccagctacttatctgcccccaccagactcttatctgcccccaccagtgcggcgcgccatgcttcatcagactct

SEQ ID NO: 12157 - DNA, 197 bp, Artificial Sequence; identical to SEQ ID NO: 12156
  Synthetic polynucleotide

SEQ ID NO: 12158 - DNA, 164 bp, Artificial Sequence
  Synthetic polynucleotide
atcatctcaccttgcctcctgacgcctgctgtttatggcctgcaggcatgtaattagacatgtaatttcgcatgtaattgaccatgtaattctacatgtaattactcatgtaatttgccatgtaattgtacatgtaattggcgcgccatgcttcatcagactct

SEQ ID NO: 12159 - DNA, 164 bp, Artificial Sequence; identical to SEQ ID NO: 12158
  Synthetic polynucleotide

SEQ ID NO: 12160 - DNA, 200 bp, Artificial Sequence
  Synthetic polynucleotide
atcatctcaccttgcctcctggggcacatagagattaacctgcaggggggtgaggttggattttgggttaatttttagaggggtgaggttggattttgggttaattttttcgggggtgaggttggattttgggttaatttttgacggggtgaggttggattttgggttaatttttggcgcgccatgcttcatcagactct

SEQ ID NO: 12161 - DNA, 200 bp, Artificial Sequence; identical to SEQ ID NO: 12160
  Synthetic polynucleotide

SEQ ID NO: 12162 - DNA, 190 bp, Artificial Sequence
  Synthetic polynucleotide
atcatctcaccttgcctcctgtacgctggttgttcgtccctgcaggctgggaaatcccctagactgggaaatccccttcgctgggaaatcccctgacctgggaaatcccctctactgggaaatcccctactctgggaaatccccttgcctgggaaatcccctgtaggcgcgccatgcttcatcagactct

SEQ ID NO: 12163 - DNA, 190 bp, Artificial Sequence; identical to SEQ ID NO: 12162
  Synthetic polynucleotide

SEQ ID NO: 12164 - DNA, 191 bp, Artificial Sequence
  Synthetic polynucleotide
atcatctcaccttgcctcctggagcggcaagctggaatcctgcaggagttgccttatatggtcagaagttgccttatatggtctcgagttgccttatatggtcgacagttgccttatatggtcctaagttgccttatatggtcactagttgccttatatggtctgcggcgcgccatgcttcatcagactct

SEQ ID NO: 12165 - DNA, 191 bp, Artificial Sequence; identical to SEQ ID NO: 12164
  Synthetic polynucleotide

SEQ ID NO: 12166 - DNA, 172 bp, Artificial Sequence
  Synthetic polynucleotide
atcatctcaccttgcctcctgcgatttagtcatggctacctgcaggatgactcattagaatgactcatttcgatgactcattgacatgactcattctaatgactcattactatgactcatttgcatgactcattgtaatgactcattggcgcgccatgcttcatcagactct

SEQ ID NO: 12167 - DNA, 172 bp, Artificial Sequence; identical to SEQ ID NO: 12166
  Synthetic polynucleotide

SEQ ID NO: 12168 - DNA, 172 bp, Artificial Sequence
  Synthetic polynucleotide
atcatctcaccttgcctcctggggcctcttacacgagacctgcagggcgccccctgagagcgccccctgtcggcgccccctggacgcgccccctgctagcgccccctgactgcgccccctgtgcgcgccccctggtagcgccccctgggcgcgccatgcttcatcagactct

SEQ ID NO: 12169 - DNA, 172 bp, Artificial Sequence; identical to SEQ ID NO: 12168
  Synthetic polynucleotide

SEQ ID NO: 12170 - DNA, 197 bp, Artificial Sequence
  Synthetic polynucleotide
atcatctcaccttgcctcctgtgtgcgtgagagcacgacctgcaggtttcacttcctctttagatttcacttcctcttttcgtttcacttcctctttgactttcacttcctctttctatttcacttcctctttacttttcacttcctcttttgctttcacttcctctttgtaggcgcgccatgcttcatcagactct

SEQ ID NO: 12171 - DNA, 197 bp, Artificial Sequence; identical to SEQ ID NO: 12170
  Synthetic polynucleotide

SEQ ID NO: 12172 - DNA, 156 bp, Artificial Sequence
  Synthetic polynucleotide
atcatctcaccttgcctcctgtgtcaccgaaggattcacctgcagggtgaaagtagagtgaaagttcggtgaaagtgacgtgaaagtctagtgaaagtactgtgaaagttgcgtgaaagtgtagtgaaagtggcgcgccatgcttcatcagactct

SEQ ID NO: 12173 - DNA, 156 bp, Artificial Sequence; identical to SEQ ID NO: 12172
  Synthetic polynucleotide

SEQ ID NO: 12174 - DNA, 180 bp, Artificial Sequence
  Synthetic polynucleotide
atcatctcaccttgcctcctgtcaggagttgaacggtacctgcaggatatgcaaattagaatatgcaaatttcgatatgcaaattgacatatgcaaattctaatatgcaaattactatatgcaaatttgcatatgcaaattgtaatatgcaaattggcgcgccatgcttcatcagactct

SEQ ID NO: 12175 - DNA, 180 bp, Artificial Sequence; identical to SEQ ID NO: 12174
  Synthetic polynucleotide

SEQ ID NO: 12176 - DNA, 172 bp, Artificial Sequence
  Synthetic polynucleotide
atcatctcaccttgcctcctgtcctaatcacgacgatccctgcaggcaattaatgaagacaattaatgatcgcaattaatgagaccaattaatgactacaattaatgaactcaattaatgatgccaattaatgagtacaattaatgaggcgcgccatgcttcatcagactct

SEQ ID NO: 12177 - DNA, 172 bp, Artificial Sequence; identical to SEQ ID NO: 12176
  Synthetic polynucleotide

SEQ ID NO: 12178 - DNA, 180 bp, Artificial Sequence
  Synthetic polynucleotide
atcatctcaccttgcctcctgtttaccggaagaaaccgcctgcagggcaggcgccgcagagcaggcgccgctcggcaggcgccgcgacgcaggcgccgcctagcaggcgccgcactgcaggcgccgctgcgcaggcgccgcgtagcaggcgccgcggcgcgccatgcttcatcagactct

SEQ ID NO: 12179 - DNA, 180 bp, Artificial Sequence; identical to SEQ ID NO: 12178
  Synthetic polynucleotide

SEQ ID NO: 12180 - DNA, 191 bp, Artificial Sequence
  Synthetic polynucleotide
atcatctcaccttgcctcctgagctgcaaaggaagctgcctgcaggaaagctaattagcgaaaagaaaagctaattagcgaaatcgaaagctaattagcgaaagacaaagctaattagcgaaactaaaagctaattagcgaaaactaaagctaattagcgaaatgcggcgcgccatgcttcatcagactct

SEQ ID NO: 12181 - DNA, 191 bp, Artificial Sequence; identical to SEQ ID NO: 12180
  Synthetic polynucleotide

SEQ ID NO: 12182 - DNA, 190 bp, Artificial Sequence
  Synthetic polynucleotide
atcatctcaccttgcctcctgccacggtattgataaaccctgcaggaatataaacatacaagaaatataaacatacatcgaatataaacatacagacaatataaacatacactaaatataaacatacaactaatataaacatacatgcaatataaacatacagtaggcgcgccatgcttcatcagactct

SEQ ID NO: 12183 - DNA, 190 bp, Artificial Sequence; identical to SEQ ID NO: 12182
  Synthetic polynucleotide

SEQ ID NO: 12184 - DNA, 200 bp, Artificial Sequence
  Synthetic polynucleotide
atcatctcaccttgcctcctgctgcgatatcactccctcctgcaggcatctccttatatggccatagacatctccttatatggccattcgcatctccttatatggccatgaccatctccttatatggccatctacatctccttatatggccatactcatctccttatatggccatggcgcgccatgcttcatcagactct

SEQ ID NO: 12185 - DNA, 200 bp, Artificial Sequence; identical to SEQ ID NO: 12184
  Synthetic polynucleotide

SEQ ID NO: 12186 - DNA, 180 bp, Artificial Sequence
  Synthetic polynucleotide
atcatctcaccttgcctcctgggtgagattcaggacctcctgcaggtgtttactttgagatgtttactttgtcgtgtttactttggactgtttactttgctatgtttactttgacttgtttactttgtgctgtttactttggtatgtttactttgggcgcgccatgcttcatcagactct

SEQ ID NO: 12187 - DNA, 180 bp, Artificial Sequence; identical to SEQ ID NO: 12186
  Synthetic polynucleotide

SEQ ID NO: 12188 - DNA, 188 bp, Artificial Sequence
  Synthetic polynucleotide
atcatctcaccttgcctcctgaacaaggtcatcagattcctgcagggccgccatcttgagagccgccatcttgtcggccgccatcttggacgccgccatcttgctagccgccatcttgactgccgccatcttgtgcgccgccatcttggtagccgccatcttgggcgcgccatgcttcatcagactct

SEQ ID NO: 12189 - DNA, 188 bp, Artificial Sequence; identical to SEQ ID NO: 12188
  Synthetic polynucleotide

SEQ ID NO: 12190 - DNA, 196 bp, Artificial Sequence
  Synthetic polynucleotide
atcatctcaccttgcctcctgcaatcgaacggtggaaacctgcaggaaaaatcaaaggtagaaaaaatcaaaggttcgaaaaatcaaaggtgacaaaaatcaaaggtctaaaaaatcaaaggtactaaaaatcaaaggttgcaaaaatcaaaggtgtaaaaaatcaaaggtggcgcgccatgcttcatcagactct

SEQ ID NO: 12191 - DNA, 196 bp, Artificial Sequence; identical to SEQ ID NO: 12190
  Synthetic polynucleotide

SEQ ID NO: 12192 - DNA, 197 bp, Artificial Sequence
  Synthetic polynucleotide
atcatctcaccttgcctcctgatcctattgccctgacgcctgcaggtgtgtataattatgaattagatgtgtataattatgaatttcgtgtgtataattatgaattgactgtgtataattatgaattctatgtgtataattatgaattacttgtgtataattatgaatttgcggcgcgccatgcttcatcagactct

SEQ ID NO: 12193 - DNA, 197 bp, Artificial Sequence; identical to SEQ ID NO: 12192
  Synthetic polynucleotide

SEQ ID NO: 12194 - DNA, 132 bp, Artificial Sequence
  Synthetic polynucleotide
atcatctcaccttgcctcctgtggagtagtccgaaagtcctgcaggtgataagatgatatcgtgatagactgatactatgataacttgatatgctgatagtatgataggcgcgccatgcttcatcagactct

SEQ ID NO: 12195 - DNA, 132 bp, Artificial Sequence; identical to SEQ ID NO: 12194
  Synthetic polynucleotide

SEQ ID NO: 12196 - DNA, 172 bp, Artificial Sequence
  Synthetic polynucleotide
atcatctcaccttgcctcctgctcaatggacctgagtgcctgcaggctcagctggtagactcagctggttcgctcagctggtgacctcagctggtctactcagctggtactctcagctggttgcctcagctggtgtactcagctggtggcgcgccatgcttcatcagactct

SEQ ID NO: 12197 - DNA, 172 bp, Artificial Sequence; identical to SEQ ID NO: 12196
  Synthetic polynucleotide

SEQ ID NO: 12198 - DNA, 180 bp, Artificial Sequence
  Synthetic polynucleotide
atcatctcaccttgcctcctgctgagcgacacataatgcctgcagggtgggtggtctagagtgggtggtcttcggtgggtggtctgacgtgggtggtctctagtgggtggtctactgtgggtggtcttgcgtgggtggtctgtagtgggtggtctggcgcgccatgcttcatcagactct

SEQ ID NO: 12199 - DNA, 180 bp, Artificial Sequence; identical to SEQ ID NO: 12198
  Synthetic polynucleotide

SEQ ID NO: 12200 - DNA, 172 bp, Artificial Sequence
  Synthetic polynucleotide
atcatctcaccttgcctcctgaccaatccgtttaggtacctgcaggatgactcatcagaatgactcatctcgatgactcatcgacatgactcatcctaatgactcatcactatgactcatctgcatgactcatcgtaatgactcatcggcgcgccatgcttcatcagactct

SEQ ID NO: 12201 - DNA, 172 bp, Artificial Sequence; identical to SEQ ID NO: 12200
  Synthetic polynucleotide

SEQ ID NO: 12202 - DNA, 172 bp, Artificial Sequence
  Synthetic polynucleotide
atcatctcaccttgcctcctgaggtagtgtctttatctcctgcaggatgactcataagaatgactcatatcgatgactcatagacatgactcatactaatgactcataactatgactcatatgcatgactcatagtaatgactcataggcgcgccatgcttcatcagactct

SEQ ID NO: 12203 - DNA, 172 bp, Artificial Sequence; identical to SEQ ID NO: 12202
  Synthetic polynucleotide

SEQ ID NO: 12204 - DNA, 172 bp, Artificial Sequence
  Synthetic polynucleotide
atcatctcaccttgcctcctgtgatcttcgactttgtgcctgcaggccgcccacgcagaccgcccacgctcgccgcccacgcgacccgcccacgcctaccgcccacgcactccgcccacgctgcccgcccacgcgtaccgcccacgcggcgcgccatgcttcatcagactct

SEQ ID NO: 12205 - DNA, 172 bp, Artificial Sequence; identical to SEQ ID NO: 12204
  Synthetic polynucleotide

SEQ ID NO: 12206 - DNA, 197 bp, Artificial Sequence
  Synthetic polynucleotide
atcatctcaccttgcctcctgctttaacggtttagtgccctgcaggacaggaagtgattgcagaacaggaagtgattgctcgacaggaagtgattgcgacacaggaagtgattgcctaacaggaagtgattgcactacaggaagtgattgctgcacaggaagtgattgcgtaggcgcgccatgcttcatcagactct

SEQ ID NO: 12207 - DNA, 197 bp, Artificial Sequence; identical to SEQ ID NO: 12206
  Synthetic polynucleotide

SEQ ID NO: 12208 - DNA, 188 bp, Artificial Sequence
  Synthetic polynucleotide
atcatctcaccttgcctcctggctgctattctactcctcctgcaggccccttgagtcaagaccccttgagtcatcgccccttgagtcagacccccttgagtcactaccccttgagtcaactccccttgagtcatgcccccttgagtcagtaccccttgagtcaggcgcgccatgcttcatcagactct

SEQ ID NO: 12209 - DNA, 188 bp, Artificial Sequence; identical to SEQ ID NO: 12208
  Synthetic polynucleotide

SEQ ID NO: 12210 - DNA, 172 bp, Artificial Sequence
  Synthetic polynucleotide
atcatctcaccttgcctcctgaatttgacctcctcccgcctgcaggggcacgtggtagaggcacgtggttcgggcacgtggtgacggcacgtggtctaggcacgtggtactggcacgtggttgcggcacgtggtgtaggcacgtggtggcgcgccatgcttcatcagactct

SEQ ID NO: 12211 - DNA, 172 bp, Artificial Sequence; identical to SEQ ID NO: 12210
  Synthetic polynucleotide

SEQ ID NO: 12212 - DNA, 191 bp, Artificial Sequence
  Synthetic polynucleotide
atcatctcaccttgcctcctggtcgaagtccagtccatcctgcaggaaaatgtaaacaaacagagaaaaatgtaaacaaacagtcgaaaatgtaaacaaacaggacaaaatgtaaacaaacagctaaaaatgtaaacaaacagactaaaatgtaaacaaacagtgcggcgcgccatgcttcatcagactct

SEQ ID NO: 12213 - DNA, 191 bp, Artificial Sequence; identical to SEQ ID NO: 12212
  Synthetic polynucleotide

SEQ ID NO: 12214 - DNA, 188 bp, Artificial Sequence
  Synthetic polynucleotide
atcatctcaccttgcctcctgatttcattgtgacccaccctgcaggtgcgcgtctataagatgcgcgtctatatcgtgcgcgtctatagactgcgcgtctatactatgcgcgtctataacttgcgcgtctatatgctgcgcgtctatagtatgcgcgtctataggcgcgccatgcttcatcagactct

SEQ ID NO: 12215 - DNA, 188 bp, Artificial Sequence; identical to SEQ ID NO: 12214
  Synthetic polynucleotide

SEQ ID NO: 12216 - DNA, 156 bp, Artificial Sequence
  Synthetic polynucleotide
atcatctcaccttgcctcctgacatgaaagagtccagtcctgcagggcacgtgtagagcacgtgttcggcacgtgtgacgcacgtgtctagcacgtgtactgcacgtgttgcgcacgtgtgtagcacgtgtggcgcgccatgcttcatcagactct

SEQ ID NO: 12217 - DNA, 156 bp, Artificial Sequence; identical to SEQ ID NO: 12216
  Synthetic polynucleotide

SEQ ID NO: 12218 - DNA, 188 bp, Artificial Sequence
  Synthetic polynucleotide
atcatctcaccttgcctcctgtcgaacactaagtgagtcctgcaggctctgattggttagactctgattggtttcgctctgattggttgacctctgattggttctactctgattggttactctctgattggtttgcctctgattggttgtactctgattggttggcgcgccatgcttcatcagactct

SEQ ID NO: 12219 - DNA, 188 bp, Artificial Sequence; identical to SEQ ID NO: 12218
  Synthetic polynucleotide

SEQ ID NO: 12220 - DNA, 172 bp, Artificial Sequence
  Synthetic polynucleotide
atcatctcaccttgcctcctgctattcgaacttaatcccctgcagggacatatgttagagacatatgtttcggacatatgttgacgacatatgttctagacatatgttactgacatatgtttgcgacatatgttgtagacatatgttggcgcgccatgcttcatcagactct

SEQ ID NO: 12221 - DNA, 172 bp, Artificial Sequence; identical to SEQ ID NO: 12220
  Synthetic polynucleotide

SEQ ID NO: 12222 - DNA, 196 bp, Artificial Sequence
  Synthetic polynucleotide
atcatctcaccttgcctcctgttgccaattgtacccgccctgcagggtgggattagtgaagagtgggattagtgatcggtgggattagtgagacgtgggattagtgactagtgggattagtgaactgtgggattagtgatgcgtgggattagtgagtagtgggattagtgaggcgcgccatgcttcatcagactct

SEQ ID NO: 12223 - DNA, 196 bp, Artificial Sequence; identical to SEQ ID NO: 12222
  Synthetic polynucleotide

SEQ ID NO: 12224 - DNA, 180 bp, Artificial Sequence
  Synthetic polynucleotide
atcatctcaccttgcctcctgccggttaggtgctgtctcctgcaggtgtttacttttagatgtttactttttcgtgtttacttttgactgtttacttttctatgtttacttttacttgtttactttttgctgtttacttttgtatgtttacttttggcgcgccatgcttcatcagactct

SEQ ID NO: 12225 - DNA, 180 bp, Artificial Sequence; identical to SEQ ID NO: 12224
  Synthetic polynucleotide

SEQ ID NO: 12226 - DNA, 180 bp, Artificial Sequence
  Synthetic polynucleotide
atcatctcaccttgcctcctgaatgcgctctccatttgcctgcagggtaaataaacaagagtaaataaacatcggtaaataaacagacgtaaataaacactagtaaataaacaactgtaaataaacatgcgtaaataaacagtagtaaataaacaggcgcgccatgcttcatcagactct

SEQ ID NO: 12227 - DNA, 180 bp, Artificial Sequence; identical to SEQ ID NO: 12226
  Synthetic polynucleotide

SEQ ID NO: 12228 - DNA, 197 bp, Artificial Sequence
  Synthetic polynucleotide
atcatctcaccttgcctcctgcactccgaccgcataaacctgcaggagcgccccctggtggccaagaagcgccccctggtggccatcgagcgccccctggtggccagacagcgccccctggtggccactaagcgccccctggtggccaactagcgccccctggtggccatgcggcgcgccatgcttcatcagactct

SEQ ID NO: 12229 - DNA, 197 bp, Artificial Sequence; identical to SEQ ID NO: 12228
  Synthetic polynucleotide

SEQ ID NO: 12230 - DNA, 197 bp, Artificial Sequence
  Synthetic polynucleotide
atcatctcaccttgcctcctggtttcagtgtagtgagtcctgcaggtttattactttgtttgtaagatttattactttgtttgtatcgtttattactttgtttgtagactttattactttgtttgtactatttattactttgtttgtaacttttattactttgtttgtatgcggcgcgccatgcttcatcagactct

SEQ ID NO: 12231 - DNA, 197 bp, Artificial Sequence; identical to SEQ ID NO: 12230
  Synthetic polynucleotide

SEQ ID NO: 12232 - DNA, 188 bp, Artificial Sequence
  Synthetic polynucleotide
atcatctcaccttgcctcctgaacaggatgacttagatcctgcaggtattgcgtaaccagatattgcgtaacctcgtattgcgtaaccgactattgcgtaaccctatattgcgtaaccacttattgcgtaacctgctattgcgtaaccgtatattgcgtaaccggcgcgccatgcttcatcagactct

SEQ ID NO: 12233 - DNA, 188 bp, Artificial Sequence; identical to SEQ ID NO: 12232
  Synthetic polynucleotide

SEQ ID NO: 12234 - DNA, 156 bp, Artificial Sequence
  Synthetic polynucleotide
atcatctcaccttgcctcctgcattaccggacgacgaacctgcagggcacgtgaagagcacgtgatcggcacgtgagacgcacgtgactagcacgtgaactgcacgtgatgcgcacgtgagtagcacgtgaggcgcgccatgcttcatcagactct

SEQ ID NO: 12235 - DNA, 156 bp, Artificial Sequence; identical to SEQ ID NO: 12234
  Synthetic polynucleotide

SEQ ID NO: 12236 - DNA, 197 bp, Artificial Sequence
  Synthetic polynucleotide
atcatctcaccttgcctcctgccatgtatacctttcatcctgcaggcaaagtaaacatggaagacaaagtaaacatggatcgcaaagtaaacatggagaccaaagtaaacatggactacaaagtaaacatggaactcaaagtaaacatggatgccaaagtaaacatggagtaggcgcgccatgcttcatcagactct

SEQ ID NO: 12237 - DNA, 197 bp, Artificial Sequence; identical to SEQ ID NO: 12236
  Synthetic polynucleotide

SEQ ID NO: 12238 - DNA, 196 bp, Artificial Sequence
  Synthetic polynucleotide
atcatctcaccttgcctcctggtctggttcattataggcctgcaggaggtcaaagtccaagaaggtcaaagtccatcgaggtcaaagtccagacaggtcaaagtccactaaggtcaaagtccaactaggtcaaagtccatgcaggtcaaagtccagtaaggtcaaagtccaggcgcgccatgcttcatcagactct

SEQ ID NO: 12239 - DNA, 196 bp, Artificial Sequence; identical to SEQ ID NO: 12238
  Synthetic polynucleotide

SEQ ID NO: 12240 - DNA, 180 bp, Artificial Sequence
  Synthetic polynucleotide
atcatctcaccttgcctcctgagccattagtttagccacctgcaggccagctgccccagaccagctgcccctcgccagctgccccgacccagctgccccctaccagctgccccactccagctgcccctgcccagctgccccgtaccagctgccccggcgcgccatgcttcatcagactct

SEQ ID NO: 12241 - DNA, 180 bp, Artificial Sequence; identical to SEQ ID NO: 12240
  Synthetic polynucleotide

SEQ ID NO: 12242 - DNA, 180 bp, Artificial Sequence
  Synthetic polynucleotide
atcatctcaccttgcctcctggacgacattggaggtaacctgcaggagcctcaggcaagaagcctcaggcatcgagcctcaggcagacagcctcaggcactaagcctcaggcaactagcctcaggcatgcagcctcaggcagtaagcctcaggcaggcgcgccatgcttcatcagactct

SEQ ID NO: 12243 - DNA, 180 bp, Artificial Sequence; identical to SEQ ID NO: 12242
  Synthetic polynucleotide

SEQ ID NO: 12244 - DNA, 164 bp, Artificial Sequence
  Synthetic polynucleotide
atcatctcaccttgcctcctggggtgctatctcacgctcctgcaggttaatgggtagattaatgggttcgttaatgggtgacttaatgggtctattaatgggtactttaatgggttgcttaatgggtgtattaatgggtggcgcgccatgcttcatcagactct

SEQ ID NO: 12245 - DNA, 164 bp, Artificial Sequence; identical to SEQ ID NO: 12244
  Synthetic polynucleotide

SEQ ID NO: 12246 - DNA, 156 bp, Artificial Sequence
  Synthetic polynucleotide
atcatctcaccttgcctcctgaaggttactttgaagggcctgcagggcacgtggagagcacgtggtcggcacgtgggacgcacgtggctagcacgtggactgcacgtggtgcgcacgtgggtagcacgtggggcgcgccatgcttcatcagactct

SEQ ID NO: 12247 - DNA, 156 bp, Artificial Sequence; identical to SEQ ID NO: 12246
  Synthetic polynucleotide

SEQ ID NO: 12248 - DNA, 190 bp, Artificial Sequence
  Synthetic polynucleotide
atcatctcaccttgcctcctgaaagaaggtcttctctacctgcagggaagccataacggcagagaagccataacggctcggaagccataacggcgacgaagccataacggcctagaagccataacggcactgaagccataacggctgcgaagccataacggcgtaggcgcgccatgcttcatcagactct

SEQ ID NO: 12249 - DNA, 190 bp, Artificial Sequence; identical to SEQ ID NO: 12248
  Synthetic polynucleotide

SEQ ID NO: 12250 - DNA, 190 bp, Artificial Sequence
  Synthetic polynucleotide
atcatctcaccttgcctcctgaacgtgggctatcgtgccctgcaggtggtcacgtgacggagatggtcacgtgacggtcgtggtcacgtgacgggactggtcacgtgacggctatggtcacgtgacggacttggtcacgtgacggtgctggtcacgtgacgggtaggcgcgccatgcttcatcagactct

SEQ ID NO: 12251 - DNA, 190 bp, Artificial Sequence; identical to SEQ ID NO: 12250
  Synthetic polynucleotide

SEQ ID NO: 12252 - DNA, 156 bp, Artificial Sequence
  Synthetic polynucleotide
atcatctcaccttgcctcctgggagtaagtcactttcgcctgcaggcatgtaatagacatgtaattcgcatgtaatgaccatgtaatctacatgtaatactcatgtaattgccatgtaatgtacatgtaatggcgcgccatgcttcatcagactct

SEQ ID NO: 12253 - DNA, 156 bp, Artificial Sequence; identical to SEQ ID NO: 12252
  Synthetic polynucleotide

SEQ ID NO: 12254 - DNA, 185 bp, Artificial Sequence
  Synthetic polynucleotide
atcatctcaccttgcctcctggaatcggactttgagtacctgcaggatttgcataacaatggagaatttgcataacaatggtcgatttgcataacaatgggacatttgcataacaatggctaatttgcataacaatggactatttgcataacaatggtgcggcgcgccatgcttcatcagactct

SEQ ID NO: 12255 - DNA, 185 bp, Artificial Sequence; identical to SEQ ID NO: 12254
  Synthetic polynucleotide

SEQ ID NO: 12256 - DNA, 180 bp, Artificial Sequence
  Synthetic polynucleotide
atcatctcaccttgcctcctggcacggtcaattctagacctgcaggggtataaattcagaggtataaattctcgggtataaattcgacggtataaattcctaggtataaattcactggtataaattctgcggtataaattcgtaggtataaattcggcgcgccatgcttcatcagactct

SEQ ID NO: 12257 - DNA, 180 bp, Artificial Sequence; identical to SEQ ID NO: 12256
  Synthetic polynucleotide

SEQ ID NO: 12258 - DNA, 197 bp, Artificial Sequence
  Synthetic polynucleotide
atcatctcaccttgcctcctgtttacttcgaaactcctcctgcaggtgacctttgcttgaccttagatgacctttgcttgacctttcgtgacctttgcttgaccttgactgacctttgcttgaccttctatgacctttgcttgaccttacttgacctttgcttgacctttgcggcgcgccatgcttcatcagactct

SEQ ID NO: 12259 - DNA, 197 bp, Artificial Sequence; identical to SEQ ID NO: 12258
  Synthetic polynucleotide

SEQ ID NO: 12260 - DNA, 196 bp, Artificial Sequence
  Synthetic polynucleotide
atcatctcaccttgcctcctgagtgatggagtaacatacctgcaggtgctgactcagcaagatgctgactcagcatcgtgctgactcagcagactgctgactcagcactatgctgactcagcaacttgctgactcagcatgctgctgactcagcagtatgctgactcagcaggcgcgccatgcttcatcagactct

SEQ ID NO: 12261 - DNA, 196 bp, Artificial Sequence; identical to SEQ ID NO: 12260
  Synthetic polynucleotide

SEQ ID NO: 12262 - DNA, 191 bp, Artificial Sequence
  Synthetic polynucleotide
atcatctcaccttgcctcctgatggactgtcagggttgcctgcaggaaaatgctgactcagcattttagaaaaatgctgactcagcatttttcgaaaatgctgactcagcattttgacaaaatgctgactcagcattttctaaaaatgctgactcagcattttactggcgcgccatgcttcatcagactct

SEQ ID NO: 12263 - DNA, 191 bp, Artificial Sequence; identical to SEQ ID NO: 12262
  Synthetic polynucleotide

SEQ ID NO: 12264 - DNA, 21 bp, Artificial Sequence
  Synthetic
atcatctcaccttgcctcctg

SEQ ID NO: 12265 - DNA, 8 bp, Artificial Sequence
  Synthetic
ccacgtgc

SEQ ID NO: 12266 - DNA, 86 bp, Artificial Sequence
  Synthetic
ccacgtgcagaccacgtgctcgccacgtgcgacccacgtgcctaccacgtgcactccacgtgctgcccacgtgcgtaccacgtgcg

SEQ ID NO: 12267 - DNA, 13 bp, Artificial Sequence
  Synthetic
tgctgagtcagca

SEQ ID NO: 12268 - DNA, 126 bp, Artificial Sequence
  Synthetic
tgctgagtcagcaagatgctgagtcagcatcgtgctgagtcagcagactgctgagtcagcactatgctgagtcagcaacttgctgagtcagcatgctgctgagtcagcagtatgctgagtcagcag

SEQ ID NO: 12269 - DNA, 14 bp, Artificial sequence
  Synthetic
atttcgtatccccg

SEQ ID NO: 12270 - DNA, 15 bp, Artificial sequence
  Synthetic
taattacgctaatta

SEQ ID NO: 12271 - DNA, 9 bp, Artificial sequence
  Synthetic
ccctaatga

SEQ ID NO: 12272 - DNA, 7 bp, Artificial sequence
  Synthetic
caattaa

SEQ ID NO: 12273 - DNA, 9 bp, Artificial sequence
  Synthetic
gtccttgaa

SEQ ID NO: 12274 - DNA, 7 bp, Artificial sequence
  Synthetic
caattac

SEQ ID NO: 12275 - DNA, 18 bp, Artificial sequence
  Synthetic
ctgaactttcctgacccc

SEQ ID NO: 12276 - DNA, 7 bp, Artificial sequence
  Synthetic
caattag

SEQ ID NO: 12277 - DNA, 11 bp, Artificial sequence
  Synthetic
aactatcgata

SEQ ID NO: 12278 - DNA, 16 bp, Artificial sequence
  Synthetic
ctgaagtaattattcc

SEQ ID NO: 12279 - DNA, 11 bp, Artificial sequence
  Synthetic
gctaattagcc

SEQ ID NO: 12280 - DNA, 8 bp, Artificial sequence
  Synthetic
atgatacc

SEQ ID NO: 12281 - DNA, 9 bp, Artificial sequence
  Synthetic
atttgatac

SEQ ID NO: 12282 - DNA, 7 bp, Artificial sequence
  Synthetic
cccccgc

SEQ ID NO: 12283 - DNA, 12 bp, Artificial sequence
  Synthetic
ataagaggaaat

SEQ ID NO: 12284 - DNA, 14 bp, Artificial sequence
  Synthetic
ggttaatgattaac

SEQ ID NO: 12285 - DNA, 15 bp, Artificial sequence
  Synthetic
gtagggcaaaggtca

SEQ ID NO: 12286 - DNA, 12 bp, Artificial sequence
  Synthetic
ggggactttcca

SEQ ID NO: 12287 - DNA, 18 bp, Artificial sequence
  Synthetic
cagtccgaaggtcaccgc

SEQ ID NO: 12288 - DNA, 11 bp, Artificial sequence
  Synthetic
ggccccaccca

SEQ ID NO: 12289 - DNA, 7 bp, Artificial sequence
  Synthetic
acaaaga

SEQ ID NO: 12290 - DNA, 13 bp, Artificial sequence
  Synthetic
ctaatctaattaa

SEQ ID NO: 12291 - DNA, 8 bp, Artificial sequence
  Synthetic
ctaatccc

SEQ ID NO: 12292 - DNA, 14 bp, Artificial sequence
  Synthetic
actaaccaatcaga

SEQ ID NO: 12293 - DNA, 15 bp, Artificial sequence
  Synthetic
tgaccccgccaacaa

SEQ ID NO: 12294 - DNA, 13 bp, Artificial sequence
  Synthetic
cataatttatgca

SEQ ID NO: 12295 - DNA, 15 bp, Artificial sequence
  Synthetic
aaagtaataaatcat

SEQ ID NO: 12296 - DNA, 9 bp, Artificial sequence
  Synthetic
ctaattaac

SEQ ID NO: 12297 - DNA, 13 bp, Artificial sequence
  Synthetic
aacatgtataaaa

SEQ ID NO: 12298 - DNA, 10 bp, Artificial sequence
  Synthetic
atcacgtgat

SEQ ID NO: 12299 - DNA, 8 bp, Artificial sequence
  Synthetic
ccacctgc

SEQ ID NO: 12300 - DNA, 15 bp, Artificial sequence
  Synthetic
ccattgttatgcaaa

SEQ ID NO: 12301 - DNA, 6 bp, Artificial sequence
  Synthetic
ctgtca

SEQ ID NO: 12302 - DNA, 14 bp, Artificial sequence
  Synthetic
atgaattaatgcat

SEQ ID NO: 12303 - DNA, 7 bp, Artificial sequence
  Synthetic
ctaatta

SEQ ID NO: 12304 - DNA, 16 bp, Artificial sequence
  Synthetic
attttattgttctaaa

SEQ ID NO: 12305 - DNA, 10 bp, Artificial sequence
  Synthetic
atcacgtgac

SEQ ID NO: 12306 - DNA, 8 bp, Artificial sequence
  Synthetic
attagtac

SEQ ID NO: 12307 - DNA, 6 bp, Artificial sequence
  Synthetic
gtatca

SEQ ID NO: 12308 - DNA, 14 bp, Artificial sequence
  Synthetic
cttcgtggggggtc

SEQ ID NO: 12309 - DNA, 11 bp, Artificial sequence
  Synthetic
aaaccacagac

SEQ ID NO: 12310 - DNA, 17 bp, Artificial sequence
  Synthetic
gaacaataccattgttc

SEQ ID NO: 12311 - DNA, 17 bp, Artificial sequence
  Synthetic
cgaattaattaaaaacc

SEQ ID NO: 12312 - DNA, 13 bp, Artificial sequence
  Synthetic
ataagtaggtcaa

SEQ ID NO: 12313 - DNA, 15 bp, Artificial sequence
  Synthetic
agaaccttctagaag

SEQ ID NO: 12314 - DNA, 13 bp, Artificial sequence
  Synthetic
aaccaattaaaaa

SEQ ID NO: 12315 - DNA, 11 bp, Artificial sequence
  Synthetic
acaaaccacag

SEQ ID NO: 12316 - DNA, 16 bp, Artificial sequence
  Synthetic
ccattgtttacttaag

SEQ ID NO: 12317 - DNA, 13 bp, Artificial sequence
  Synthetic
agatgcaatcccc

SEQ ID NO: 12318 - DNA, 9 bp, Artificial sequence
  Synthetic
aattaatta

SEQ ID NO: 12319 - DNA, 12 bp, Artificial sequence
  Synthetic
aaagatcaaagg

SEQ ID NO: 12320 - DNA, 16 bp, Artificial sequence
  Synthetic
aagctataaatagact

SEQ ID NO: 12321 - DNA, 8 bp, Artificial sequence
  Synthetic
cctcagcc

SEQ ID NO: 12322 - DNA, 15 bp, Artificial sequence
  Synthetic
gcctagagcggcccc

SEQ ID NO: 12323 - DNA, 8 bp, Artificial sequence
  Synthetic
gggtatca

SEQ ID NO: 12324 - DNA, 16 bp, Artificial sequence
  Synthetic
cccacggttactgccg

SEQ ID NO: 12325 - DNA, 14 bp, Artificial sequence
  Synthetic
ggactacagctccc

SEQ ID NO: 12326 - DNA, 9 bp, Artificial sequence
  Synthetic
aattcaaat

SEQ ID NO: 12327 - DNA, 15 bp, Artificial sequence
  Synthetic
gagtctaatgaccca

SEQ ID NO: 12328 - DNA, 18 bp, Artificial sequence
  Synthetic
caaggtcacggtgacctg

SEQ ID NO: 12329 - DNA, 16 bp, Artificial sequence
  Synthetic
cttaattataattaaa

SEQ ID NO: 12330 - DNA, 8 bp, Artificial sequence
  Synthetic
ggattccc

SEQ ID NO: 12331 - DNA, 12 bp, Artificial sequence
  Synthetic
atctcgtttgga

SEQ ID NO: 12332 - DNA, 11 bp, Artificial sequence
  Synthetic
cggcacctgcc

SEQ ID NO: 12333 - DNA, 9 bp, Artificial sequence
  Synthetic
atcgcgtta

SEQ ID NO: 12334 - DNA, 15 bp, Artificial sequence
  Synthetic
atgatccgggaccac

SEQ ID NO: 12335 - DNA, 11 bp, Artificial sequence
  Synthetic
gtccccaggga

SEQ ID NO: 12336 - DNA, 14 bp, Artificial sequence
  Synthetic
ctaatattgctaaa

SEQ ID NO: 12337 - DNA, 12 bp, Artificial sequence
  Synthetic
gtccccagggac

SEQ ID NO: 12338 - DNA, 16 bp, Artificial sequence
  Synthetic
gaattaattaattaaa

SEQ ID NO: 12339 - DNA, 13 bp, Artificial sequence
  Synthetic
gaaaagtgaaacc

SEQ ID NO: 12340 - DNA, 12 bp, Artificial sequence
  Synthetic
cccaattaggaa

SEQ ID NO: 12341 - DNA, 15 bp, Artificial sequence
  Synthetic
agtcacttcctgcta

SEQ ID NO: 12342 - DNA, 9 bp, Artificial sequence
  Synthetic
aacagctga

SEQ ID NO: 12343 - DNA, 11 bp, Artificial sequence
  Synthetic
ccacttccggc

SEQ ID NO: 12344 - DNA, 14 bp, Artificial sequence
  Synthetic
aatgcgtgggcgta

SEQ ID NO: 12345 - DNA, 10 bp, Artificial sequence
  Synthetic
accatggaca

SEQ ID NO: 12346 - DNA, 10 bp, Artificial sequence
  Synthetic
gccaattaac

SEQ ID NO: 12347 - DNA, 14 bp, Artificial sequence
  Synthetic
aaaaagaggaagta

SEQ ID NO: 12348 - DNA, 9 bp, Artificial sequence
  Synthetic
ggtgaccta

SEQ ID NO: 12349 - DNA, 8 bp, Artificial sequence
  Synthetic
tgtcataa

SEQ ID NO: 12350 - DNA, 8 bp, Artificial sequence
  Synthetic
aaaggggc

SEQ ID NO: 12351 - DNA, 13 bp, Artificial sequence
  Synthetic
aaaggcgcgaaaa

SEQ ID NO: 12352 - DNA, 8 bp, Artificial sequence
  Synthetic
ggtaagta

SEQ ID NO: 12353 - DNA, 8 bp, Artificial sequence
  Synthetic
gcacctgc

SEQ ID NO: 12354 - DNA, 16 bp, Artificial sequence
  Synthetic
gcgctagcggacgtta

SEQ ID NO: 12355 - DNA, 16 bp, Artificial sequence
  Synthetic
aattgagtgggcgtag

SEQ ID NO: 12356 - DNA, 18 bp, Artificial sequence
  Synthetic
aattcataattatacaca

SEQ ID NO: 12357 - DNA, 14 bp, Artificial sequence
  Synthetic
taacttcctcttaa

SEQ ID NO: 12358 - DNA, 10 bp, Artificial sequence
  Synthetic
gttaattaga

SEQ ID NO: 12359 - DNA, 14 bp, Artificial sequence
  Synthetic
aatacccgcatgtg

SEQ ID NO: 12360 - DNA, 12 bp, Artificial sequence
  Synthetic
tagggctgcaaa

SEQ ID NO: 12361 - DNA, 17 bp, Artificial sequence
  Synthetic
caaatccagacatcaga

SEQ ID NO: 12362 - DNA, 17 bp, Artificial sequence
  Synthetic
aaaaagaggaagtgaaa

SEQ ID NO: 12363 - DNA, 17 bp, Artificial sequence
  Synthetic
gacgataatgaggttgc

SEQ ID NO: 12364 - DNA, 15 bp, Artificial sequence
  Synthetic
aaccgcttccgggtc

SEQ ID NO: 12365 - DNA, 13 bp, Artificial sequence
  Synthetic
gggggccttgaaa

SEQ ID NO: 12366 - DNA, 10 bp, Artificial sequence
  Synthetic
accatatggc

SEQ ID NO: 12367 - DNA, 9 bp, Artificial sequence
  Synthetic
ggtaattaa

SEQ ID NO: 12368 - DNA, 12 bp, Artificial sequence
  Synthetic
aaccacgtgctc

SEQ ID NO: 12369 - DNA, 16 bp, Artificial sequence
  Synthetic
atttgcataacaaagg

SEQ ID NO: 12370 - DNA, 18 bp, Artificial sequence
  Synthetic
cccaacggcggttggggg

SEQ ID NO: 12371 - DNA, 16 bp, Artificial sequence
  Synthetic
acgttttacgacttta

SEQ ID NO: 12372 - DNA, 10 bp, Artificial sequence
  Synthetic
aattaaagca

SEQ ID NO: 12373 - DNA, 8 bp, Artificial sequence
  Synthetic
gttaatta

SEQ ID NO: 12374 - DNA, 10 bp, Artificial sequence
  Synthetic
accatatggt

SEQ ID NO: 12375 - DNA, 18 bp, Artificial sequence
  Synthetic
catgcccaaataaggcaa

SEQ ID NO: 12376 - DNA, 16 bp, Artificial sequence
  Synthetic
accggtttaaaccggt

SEQ ID NO: 12377 - DNA, 17 bp, Artificial sequence
  Synthetic
aatatacatgtaaaaca

SEQ ID NO: 12378 - DNA, 15 bp, Artificial sequence
  Synthetic
aagtctgtggttagc

SEQ ID NO: 12379 - DNA, 14 bp, Artificial sequence
  Synthetic
cgatgacgtcatca

SEQ ID NO: 12380 - DNA, 12 bp, Artificial sequence
  Synthetic
aatttgtttaca

SEQ ID NO: 12381 - DNA, 11 bp, Artificial sequence
  Synthetic
atgagtcaccc

SEQ ID NO: 12382 - DNA, 9 bp, Artificial sequence
  Synthetic
aataaactc

SEQ ID NO: 12383 - DNA, 10 bp, Artificial sequence
  Synthetic
cagccaatca

SEQ ID NO: 12384 - DNA, 14 bp, Artificial sequence
  Synthetic
aggaagggaaagga

SEQ ID NO: 12385 - DNA, 14 bp, Artificial sequence
  Synthetic
cccccgcccccgcc

SEQ ID NO: 12386 - DNA, 15 bp, Artificial sequence
  Synthetic
atgccaaaaatagaa

SEQ ID NO: 12387 - DNA, 16 bp, Artificial sequence
  Synthetic
ataaatcacagcactc

SEQ ID NO: 12388 - DNA, 24 bp, Artificial sequence
  Synthetic
acaaaataaatcacagcatatgcc

SEQ ID NO: 12389 - DNA, 10 bp, Artificial sequence
  Synthetic
ggtgagtcac

SEQ ID NO: 12390 - DNA, 20 bp, Artificial sequence
  Synthetic
agacatgcccagacatgccc

SEQ ID NO: 12391 - DNA, 11 bp, Artificial sequence
  Synthetic
aaatcactgca

SEQ ID NO: 12392 - DNA, 8 bp, Artificial sequence
  Synthetic
ctgacccc

SEQ ID NO: 12393 - DNA, 13 bp, Artificial sequence
  Synthetic
ccacttccggttc

SEQ ID NO: 12394 - DNA, 14 bp, Artificial sequence
  Synthetic
atgatcgaatcaaa

SEQ ID NO: 12395 - DNA, 11 bp, Artificial sequence
  Synthetic
cctccggcccg

SEQ ID NO: 12396 - DNA, 10 bp, Artificial sequence
  Synthetic
caaatatttg

SEQ ID NO: 12397 - DNA, 17 bp, Artificial sequence
  Synthetic
aaatctattgttcacta

SEQ ID NO: 12398 - DNA, 15 bp, Artificial sequence
  Synthetic
cgccccctggtggcc

SEQ ID NO: 12399 - DNA, 11 bp, Artificial sequence
  Synthetic
cttcacaccta

SEQ ID NO: 12400 - DNA, 11 bp, Artificial sequence
  Synthetic
aagtagtgccc

SEQ ID NO: 12401 - DNA, 10 bp, Artificial sequence
  Synthetic
ccgcccccgc

SEQ ID NO: 12402 - DNA, 11 bp, Artificial sequence
  Synthetic
agaccccccac

SEQ ID NO: 12403 - DNA, 21 bp, Artificial sequence
  Synthetic
ggcgctctccgtggtgctgaa

SEQ ID NO: 12404 - DNA, 11 bp, Artificial sequence
  Synthetic
atatataataa

SEQ ID NO: 12405 - DNA, 17 bp, Artificial sequence
  Synthetic
ataagaacaaaggacta

SEQ ID NO: 12406 - DNA, 19 bp, Artificial sequence
  Synthetic
aaatgctgactcagcacaa

SEQ ID NO: 12407 - DNA, 12 bp, Artificial sequence
  Synthetic
aatgccagaccc

SEQ ID NO: 12408 - DNA, 22 bp, Artificial sequence
  Synthetic
accccaaaccaccccccccccc

SEQ ID NO: 12409 - DNA, 11 bp, Artificial sequence
  Synthetic
gaataattacc

SEQ ID NO: 12410 - DNA, 13 bp, Artificial sequence
  Synthetic
ccacctgttgcac

SEQ ID NO: 12411 - DNA, 10 bp, Artificial sequence
  Synthetic
gcccataaaa

SEQ ID NO: 12412 - DNA, 16 bp, Artificial sequence
  Synthetic
aacaatattcattgtt

SEQ ID NO: 12413 - DNA, 11 bp, Artificial sequence
  Synthetic
taaataggtca

SEQ ID NO: 12414 - DNA, 15 bp, Artificial sequence
  Synthetic
ttgctgactcagcaa

SEQ ID NO: 12415 - DNA, 20 bp, Artificial sequence
  Synthetic
gggggtcacccagaggtcac

SEQ ID NO: 12416 - DNA, 9 bp, Artificial sequence
  Synthetic
acccggatc

SEQ ID NO: 12417 - DNA, 10 bp, Artificial sequence
  Synthetic
ccgcgccgcc

SEQ ID NO: 12418 - DNA, 27 bp, Artificial sequence
  Synthetic
gttgcgggtacagagtgttctagggaa

SEQ ID NO: 12419 - DNA, 8 bp, Artificial sequence
  Synthetic
aggtgcgg

SEQ ID NO: 12420 - DNA, 10 bp, Artificial sequence
  Synthetic
ccttatctgc

SEQ ID NO: 12421 - DNA, 10 bp, Artificial sequence
  Synthetic
ctgacctgaa

SEQ ID NO: 12422 - DNA, 17 bp, Artificial sequence
  Synthetic
aatcgttaatcccttta

SEQ ID NO: 12423 - DNA, 10 bp, Artificial sequence
  Synthetic
gcgcgcgcgc

SEQ ID NO: 12424 - DNA, 7 bp, Artificial sequence
  Synthetic
cacttaa

SEQ ID NO: 12425 - DNA, 16 bp, Artificial sequence
  Synthetic
tgacctttaaaggtca

SEQ ID NO: 12426 - DNA, 14 bp, Artificial sequence
  Synthetic
catgtaaataatgc

SEQ ID NO: 12427 - DNA, 12 bp, Artificial sequence
  Synthetic
taagtaaacaaa

SEQ ID NO: 12428 - DNA, 17 bp, Artificial sequence
  Synthetic
aaaatacatgtaatact

SEQ ID NO: 12429 - DNA, 9 bp, Artificial sequence
  Synthetic
accaattag

SEQ ID NO: 12430 - DNA, 15 bp, Artificial sequence
  Synthetic
aacaatgcaattgtt

SEQ ID NO: 12431 - DNA, 8 bp, Artificial sequence
  Synthetic
acctgtca

SEQ ID NO: 12432 - DNA, 12 bp, Artificial sequence
  Synthetic
tttggcgccaaa

SEQ ID NO: 12433 - DNA, 8 bp, Artificial sequence
  Synthetic
ccacctgg

SEQ ID NO: 12434 - DNA, 10 bp, Artificial sequence
  Synthetic
atcaccccac

SEQ ID NO: 12435 - DNA, 14 bp, Artificial sequence
  Synthetic
aagtcaataagtca

SEQ ID NO: 12436 - DNA, 8 bp, Artificial sequence
  Synthetic
atttatgg

SEQ ID NO: 12437 - DNA, 9 bp, Artificial sequence
  Synthetic
ctaattaaa

SEQ ID NO: 12438 - DNA, 15 bp, Artificial sequence
  Synthetic
aagaggaagtgaaac

SEQ ID NO: 12439 - DNA, 16 bp, Artificial sequence
  Synthetic
aactagctgtcaatac

SEQ ID NO: 12440 - DNA, 10 bp, Artificial sequence
  Synthetic
atcaccccat

SEQ ID NO: 12441 - DNA, 11 bp, Artificial sequence
  Synthetic
atattaattaa

SEQ ID NO: 12442 - DNA, 10 bp, Artificial sequence
  Synthetic
cacgcacgca

SEQ ID NO: 12443 - DNA, 9 bp, Artificial sequence
  Synthetic
ctaattaag

SEQ ID NO: 12444 - DNA, 8 bp, Artificial sequence
  Synthetic
aattacaa

SEQ ID NO: 12445 - DNA, 8 bp, Artificial sequence
  Synthetic
caattaag

SEQ ID NO: 12446 - DNA, 11 bp, Artificial sequence
  Synthetic
agagcacgtgg

SEQ ID NO: 12447 - DNA, 8 bp, Artificial sequence
  Synthetic
caattaaa

SEQ ID NO: 12448 - DNA, 13 bp, Artificial sequence
  Synthetic
gtgggattagtga

SEQ ID NO: 12449 - DNA, 10 bp, Artificial sequence
  Synthetic
gctaatcccc

SEQ ID NO: 12450 - DNA, 24 bp, Artificial sequence
  Synthetic
ggccttttgttgtcaatcaaaaca

SEQ ID NO: 12451 - DNA, 9 bp, Artificial sequence
  Synthetic
acaggaagt

SEQ ID NO: 12452 - DNA, 9 bp, Artificial sequence
  Synthetic
ctgttgcca

SEQ ID NO: 12453 - DNA, 10 bp, Artificial sequence
  Synthetic
agtaattagc

SEQ ID NO: 12454 - DNA, 20 bp, Artificial sequence
  Synthetic
tcatctttgtttacttttaa

SEQ ID NO: 12455 - DNA, 12 bp, Artificial sequence
  Synthetic
ctcgcaggaaga

SEQ ID NO: 12456 - DNA, 20 bp, Artificial sequence
  Synthetic
tttcacacctaggtgtgaaa

SEQ ID NO: 12457 - DNA, 12 bp, Artificial sequence
  Synthetic
cggcagatggcc

SEQ ID NO: 12458 - DNA, 8 bp, Artificial sequence
  Synthetic
accgcttc

SEQ ID NO: 12459 - DNA, 11 bp, Artificial sequence
  Synthetic
ctgcagctgtc

SEQ ID NO: 12460 - DNA, 13 bp, Artificial sequence
  Synthetic
atatcaaggtcat

SEQ ID NO: 12461 - DNA, 15 bp, Artificial sequence
  Synthetic
gccagcagctggcgc

SEQ ID NO: 12462 - DNA, 16 bp, Artificial sequence
  Synthetic
gctcattacgaatgac

SEQ ID NO: 12463 - DNA, 13 bp, Artificial sequence
  Synthetic
atgaactttgacc

SEQ ID NO: 12464 - DNA, 8 bp, Artificial sequence
  Synthetic
actttcac

SEQ ID NO: 12465 - DNA, 17 bp, Artificial sequence
  Synthetic
agcgccacctagtggta

SEQ ID NO: 12466 - DNA, 14 bp, Artificial sequence
  Synthetic
acccacaacacata

SEQ ID NO: 12467 - DNA, 11 bp, Artificial sequence
  Synthetic
catgactcatc

SEQ ID NO: 12468 - DNA, 15 bp, Artificial sequence
  Synthetic
gggggcaaaggtcac

SEQ ID NO: 12469 - DNA, 14 bp, Artificial sequence
  Synthetic
gcgtacgtgcggca

SEQ ID NO: 12470 - DNA, 23 bp, Artificial sequence
  Synthetic
cccggagggcttcctggaggagg

SEQ ID NO: 12471 - DNA, 14 bp, Artificial sequence
  Synthetic
aactcatgcgtgaa

SEQ ID NO: 12472 - DNA, 17 bp, Artificial sequence
  Synthetic
aaaaagtaaacaaaccc

SEQ ID NO: 12473 - DNA, 10 bp, Artificial sequence
  Synthetic
atgacgtcac

SEQ ID NO: 12474 - DNA, 12 bp, Artificial sequence
  Synthetic
ccgcacgtacgc

SEQ ID NO: 12475 - DNA, 21 bp, Artificial sequence
  Synthetic
tagtgccccctagtggccaaa

SEQ ID NO: 12476 - DNA, 14 bp, Artificial sequence
  Synthetic
gcgctgacgtaacc

SEQ ID NO: 12477 - DNA, 22 bp, Artificial sequence
  Synthetic
actgttactaaaaatagaaact

SEQ ID NO: 12478 - DNA, 17 bp, Artificial sequence
  Synthetic
aaacaatgcaattgttt

SEQ ID NO: 12479 - DNA, 10 bp, Artificial sequence
  Synthetic
acttggcacc

SEQ ID NO: 12480 - DNA, 10 bp, Artificial sequence
  Synthetic
atgacgtcat

SEQ ID NO: 12481 - DNA, 11 bp, Artificial sequence
  Synthetic
agtaccgttat

SEQ ID NO: 12482 - DNA, 13 bp, Artificial sequence
  Synthetic
atcccccccaccg

SEQ ID NO: 12483 - DNA, 9 bp, Artificial sequence
  Synthetic
aaaccgcaa

SEQ ID NO: 12484 - DNA, 15 bp, Artificial sequence
  Synthetic
taatgatgatcacta

SEQ ID NO: 12485 - DNA, 12 bp, Artificial sequence
  Synthetic
ctcccctgccgc

SEQ ID NO: 12486 - DNA, 14 bp, Artificial sequence
  Synthetic
tgatgacgtcatca

SEQ ID NO: 12487 - DNA, 13 bp, Artificial sequence
  Synthetic
cagctccccaggg

SEQ ID NO: 12488 - DNA, 12 bp, Artificial sequence
  Synthetic
gcttttcccaca

SEQ ID NO: 12489 - DNA, 11 bp, Artificial sequence
  Synthetic
ctcctcgcccc

SEQ ID NO: 12490 - DNA, 13 bp, Artificial sequence
  Synthetic
gaaacacagtagc

SEQ ID NO: 12491 - DNA, 10 bp, Artificial sequence
  Synthetic
aatggaaaat

SEQ ID NO: 12492 - DNA, 17 bp, Artificial sequence
  Synthetic
aatagggtatcaatatt

SEQ ID NO: 12493 - DNA, 17 bp, Artificial sequence
  Synthetic
catttaagtacttagta

SEQ ID NO: 12494 - DNA, 10 bp, Artificial sequence
  Synthetic
aacagctgtt

SEQ ID NO: 12495 - DNA, 9 bp, Artificial sequence
  Synthetic
aaacaaatt

SEQ ID NO: 12496 - DNA, 15 bp, Artificial sequence
  Synthetic
catttcccggaaacc

SEQ ID NO: 12497 - DNA, 16 bp, Artificial sequence
  Synthetic
aagaacatcctgttcc

SEQ ID NO: 12498 - DNA, 18 bp, Artificial sequence
  Synthetic
aaaaatggcgccaaaatg

SEQ ID NO: 12499 - DNA, 14 bp, Artificial sequence
  Synthetic
aaatcacgtgatat

SEQ ID NO: 12500 - DNA, 17 bp, Artificial sequence
  Synthetic
attgttaatccctctaa

SEQ ID NO: 12501 - DNA, 10 bp, Artificial sequence
  Synthetic
gccacgccca

SEQ ID NO: 12502 - DNA, 9 bp, Artificial sequence
  Synthetic
cgctgttaa

SEQ ID NO: 12503 - DNA, 7 bp, Artificial sequence
  Synthetic
caataaa

SEQ ID NO: 12504 - DNA, 21 bp, Artificial sequence
  Synthetic
caggaaactgaacagctgtcc

SEQ ID NO: 12505 - DNA, 14 bp, Artificial sequence
  Synthetic
aatataaacataca

SEQ ID NO: 12506 - DNA, 12 bp, Artificial sequence
  Synthetic
ggaaatgggccc

SEQ ID NO: 12507 - DNA, 17 bp, Artificial sequence
  Synthetic
aaacaattgcagtgttt

SEQ ID NO: 12508 - DNA, 17 bp, Artificial sequence
  Synthetic
accggttgatcacctga

SEQ ID NO: 12509 - DNA, 9 bp, Artificial sequence
  Synthetic
caagatggc

SEQ ID NO: 12510 - DNA, 10 bp, Artificial sequence
  Synthetic
tatgacgtaa

SEQ ID NO: 12511 - DNA, 14 bp, Artificial sequence
  Synthetic
ccagttcaaaccag

SEQ ID NO: 12512 - DNA, 12 bp, Artificial sequence
  Synthetic
ggctatttttaa

SEQ ID NO: 12513 - DNA, 12 bp, Artificial sequence
  Synthetic
gtattcccaaac

SEQ ID NO: 12514 - DNA, 15 bp, Artificial sequence
  Synthetic
gcctttgttttgcaa

SEQ ID NO: 12515 - DNA, 15 bp, Artificial sequence
  Synthetic
acgatgagtcatgct

SEQ ID NO: 12516 - DNA, 10 bp, Artificial sequence
  Synthetic
cgctatccgc

SEQ ID NO: 12517 - DNA, 13 bp, Artificial sequence
  Synthetic
gggtgagggggaa

SEQ ID NO: 12518 - DNA, 9 bp, Artificial sequence
  Synthetic
acggtagca

SEQ ID NO: 12519 - DNA, 9 bp, Artificial sequence
  Synthetic
catagcaac

SEQ ID NO: 12520 - DNA, 14 bp, Artificial sequence
  Synthetic
aaccacaaacccca

SEQ ID NO: 12521 - DNA, 8 bp, Artificial sequence
  Synthetic
ctaggtca

SEQ ID NO: 12522 - DNA, 23 bp, Artificial sequence
  Synthetic
atataattatgcaaattaaaaga

SEQ ID NO: 12523 - DNA, 12 bp, Artificial sequence
  Synthetic
ccttcttcctta

SEQ ID NO: 12524 - DNA, 12 bp, Artificial sequence
  Synthetic
cccaggaagtgc

SEQ ID NO: 12525 - DNA, 10 bp, Artificial sequence
  Synthetic
cgcacgtggc

SEQ ID NO: 12526 - DNA, 15 bp, Artificial sequence
  Synthetic
gaccccccgctgtgc

SEQ ID NO: 12527 - DNA, 20 bp, Artificial sequence
  Synthetic
atagcgccccctggtggcca

SEQ ID NO: 12528 - DNA, 14 bp, Artificial sequence
  Synthetic
cggccacgtgaccc

SEQ ID NO: 12529 - DNA, 16 bp, Artificial sequence
  Synthetic
agggggattagctgcc

SEQ ID NO: 12530 - DNA, 8 bp, Artificial sequence
  Synthetic
ctaattaa

SEQ ID NO: 12531 - DNA, 8 bp, Artificial sequence
  Synthetic
ctaattac

SEQ ID NO: 12532 - DNA, 8 bp, Artificial sequence
  Synthetic
ctaattag

SEQ ID NO: 12533 - DNA, 17 bp, Artificial sequence
  Synthetic
gagcattaattaaggca

SEQ ID NO: 12534 - DNA, 12 bp, Artificial sequence
  Synthetic
gaccacgtgaca

SEQ ID NO: 12535 - DNA, 10 bp, Artificial sequence
  Synthetic
cacagcgggg

SEQ ID NO: 12536 - DNA, 21 bp, Artificial sequence
  Synthetic
cctgctgggagttgtagtccc

SEQ ID NO: 12537 - DNA, 11 bp, Artificial sequence
  Synthetic
cggacacaatc

SEQ ID NO: 12538 - DNA, 8 bp, Artificial sequence
  Synthetic
atatcaaa

SEQ ID NO: 12539 - DNA, 9 bp, Artificial sequence
  Synthetic
acacgtggc

SEQ ID NO: 12540 - DNA, 18 bp, Artificial sequence
  Synthetic
acccccttatcagactat

SEQ ID NO: 12541 - DNA, 11 bp, Artificial sequence
  Synthetic
gttatgtaaca

SEQ ID NO: 12542 - DNA, 10 bp, Artificial sequence
  Synthetic
acctgtcaat

SEQ ID NO: 12543 - DNA, 10 bp, Artificial sequence
  Synthetic
atctagaaca

SEQ ID NO: 12544 - DNA, 16 bp, Artificial sequence
  Synthetic
gaatattataattata

SEQ ID NO: 12545 - DNA, 10 bp, Artificial sequence
  Synthetic
tctaattaaa

SEQ ID NO: 12546 - DNA, 8 bp, Artificial sequence
  Synthetic
gcaattaa

SEQ ID NO: 12547 - DNA, 12 bp, Artificial sequence
  Synthetic
caaaatggcggc

SEQ ID NO: 12548 - DNA, 10 bp, Artificial sequence
  Synthetic
ccctgaggca

SEQ ID NO: 12549 - DNA, 10 bp, Artificial sequence
  Synthetic
tgaggtcaca

SEQ ID NO: 12550 - DNA, 16 bp, Artificial sequence
  Synthetic
atctcgtttcccacag

SEQ ID NO: 12551 - DNA, 15 bp, Artificial sequence
  Synthetic
ccacttccggttccg

SEQ ID NO: 12552 - DNA, 10 bp, Artificial sequence
  Synthetic
ccacttaaga

SEQ ID NO: 12553 - DNA, 17 bp, Artificial sequence
  Synthetic
atcgataactgatcgat

SEQ ID NO: 12554 - DNA, 13 bp, Artificial sequence
  Synthetic
ctaattaaattaa

SEQ ID NO: 12555 - DNA, 15 bp, Artificial sequence
  Synthetic
aggggatttccaagg

SEQ ID NO: 12556 - DNA, 19 bp, Artificial sequence
  Synthetic
acagggtcaaaggtcaaga

SEQ ID NO: 12557 - DNA, 13 bp, Artificial sequence
  Synthetic
ctaattaaattag

SEQ ID NO: 12558 - DNA, 8 bp, Artificial sequence
  Synthetic
cacttaag

SEQ ID NO: 12559 - DNA, 9 bp, Artificial sequence
  Synthetic
atcataaaa

SEQ ID NO: 12560 - DNA, 10 bp, Artificial sequence
  Synthetic
cctccgccgc

SEQ ID NO: 12561 - DNA, 17 bp, Artificial sequence
  Synthetic
aatagggtatcatatat

SEQ ID NO: 12562 - DNA, 17 bp, Artificial sequence
  Synthetic
agtaattaattaattcg

SEQ ID NO: 12563 - DNA, 15 bp, Artificial sequence
  Synthetic
gcacccttgggtgcc

SEQ ID NO: 12564 - DNA, 10 bp, Artificial sequence
  Synthetic
ggacagcgcc

SEQ ID NO: 12565 - DNA, 17 bp, Artificial sequence
  Synthetic
aaaacgaaaatcgattt

SEQ ID NO: 12566 - DNA, 16 bp, Artificial sequence
  Synthetic
gattgaggtcacgcca

SEQ ID NO: 12567 - DNA, 9 bp, Artificial sequence
  Synthetic
ctaattatc

SEQ ID NO: 12568 - DNA, 11 bp, Artificial sequence
  Synthetic
gatcaccccac

SEQ ID NO: 12569 - DNA, 9 bp, Artificial sequence
  Synthetic
cacgtgatc

SEQ ID NO: 12570 - DNA, 9 bp, Artificial sequence
  Synthetic
atatatata

SEQ ID NO: 12571 - DNA, 15 bp, Artificial sequence
  Synthetic
attggtgcgtgacgg

SEQ ID NO: 12572 - DNA, 10 bp, Artificial sequence
  Synthetic
ggaaatcccc

SEQ ID NO: 12573 - DNA, 21 bp, Artificial sequence
  Synthetic
acagcgccccctggtggccac

SEQ ID NO: 12574 - DNA, 11 bp, Artificial sequence
  Synthetic
caaaggtcaga

SEQ ID NO: 12575 - DNA, 25 bp, Artificial sequence
  Synthetic
ccgccatcttggttaagggcagagg

SEQ ID NO: 12576 - DNA, 14 bp, Artificial sequence
  Synthetic
acgaaagcgaaagt

SEQ ID NO: 12577 - DNA, 10 bp, Artificial sequence
  Synthetic
agggggcggg

SEQ ID NO: 12578 - DNA, 17 bp, Artificial sequence
  Synthetic
atttgcataacaaagga

SEQ ID NO: 12579 - DNA, 10 bp, Artificial sequence
  Synthetic
cccataaaaa

SEQ ID NO: 12580 - DNA, 8 bp, Artificial sequence
  Synthetic
gtgaatga

SEQ ID NO: 12581 - DNA, 8 bp, Artificial sequence
  Synthetic
atgacgta

SEQ ID NO: 12582 - DNA, 10 bp, Artificial sequence
  Synthetic
catagcaacc

SEQ ID NO: 12583 - DNA, 30 bp, Artificial sequence
  Synthetic
aaaaattaacccaaaatccaacctcacccc

SEQ ID NO: 12584 - DNA, 10 bp, Artificial sequence
  Synthetic
catagcaacg

SEQ ID NO: 12585 - DNA, 10 bp, Artificial sequence
  Synthetic
gtggggggta

SEQ ID NO: 12586 - DNA, 10 bp, Artificial sequence
  Synthetic
agaggaagtg

SEQ ID NO: 12587 - DNA, 17 bp, Artificial sequence
  Synthetic
acattcctgacattcca

SEQ ID NO: 12588 - DNA, 11 bp, Artificial sequence
  Synthetic
gtttggcgcga

SEQ ID NO: 12589 - DNA, 15 bp, Artificial sequence
  Synthetic
tcatactggagagaa

SEQ ID NO: 12590 - DNA, 11 bp, Artificial sequence
  Synthetic
cgcctcaggca

SEQ ID NO: 12591 - DNA, 9 bp, Artificial sequence
  Synthetic
acagttaca

SEQ ID NO: 12592 - DNA, 9 bp, Artificial sequence
  Synthetic
atgaccttg

SEQ ID NO: 12593 - DNA, 12 bp, Artificial sequence
  Synthetic
aatccccacccc

SEQ ID NO: 12594 - DNA, 12 bp, Artificial sequence
  Synthetic
actttcactttc

SEQ ID NO: 12595 - DNA, 19 bp, Artificial sequence
  Synthetic
atcaatatgcaaatttcgg

SEQ ID NO: 12596 - DNA, 12 bp, Artificial sequence
  Synthetic
aatccccacccg

SEQ ID NO: 12597 - DNA, 15 bp, Artificial sequence
  Synthetic
atgaatatgcatata

SEQ ID NO: 12598 - DNA, 16 bp, Artificial sequence
  Synthetic
atttacgacaaatagc

SEQ ID NO: 12599 - DNA, 19 bp, Artificial sequence
  Synthetic
tcacaccttaaaggtgtga

SEQ ID NO: 12600 - DNA, 17 bp, Artificial sequence
  Synthetic
cacgtgctaaccacgtg

SEQ ID NO: 12601 - DNA, 15 bp, Artificial sequence
  Synthetic
ttcgaaccgttcgaa

SEQ ID NO: 12602 - DNA, 14 bp, Artificial sequence
  Synthetic
aggattgtgcaata

SEQ ID NO: 12603 - DNA, 8 bp, Artificial sequence
  Synthetic
atagcaac

SEQ ID NO: 12604 - DNA, 10 bp, Artificial sequence
  Synthetic
attacgcaat

SEQ ID NO: 12605 - DNA, 8 bp, Artificial sequence
  Synthetic
aaaaacaa

SEQ ID NO: 12606 - DNA, 12 bp, Artificial sequence
  Synthetic
gaattaatgacc

SEQ ID NO: 12607 - DNA, 11 bp, Artificial sequence
  Synthetic
cctcccgcccg

SEQ ID NO: 12608 - DNA, 13 bp, Artificial sequence
  Synthetic
ttaatctaattaa

SEQ ID NO: 12609 - DNA, 10 bp, Artificial sequence
  Synthetic
aacatatggt

SEQ ID NO: 12610 - DNA, 15 bp, Artificial sequence
  Synthetic
aaataaatcacagca

SEQ ID NO: 12611 - DNA, 11 bp, Artificial sequence
  Synthetic
aaagcgtcgtt

SEQ ID NO: 12612 - DNA, 11 bp, Artificial sequence
  Synthetic
taattaaatta

SEQ ID NO: 12613 - DNA, 11 bp, Artificial sequence
  Synthetic
tatgcaaatca

SEQ ID NO: 12614 - DNA, 10 bp, Artificial sequence
  Synthetic
aacatatggc

SEQ ID NO: 12615 - DNA, 10 bp, Artificial sequence
  Synthetic
aaagtaaaca

SEQ ID NO: 12616 - DNA, 10 bp, Artificial sequence
  Synthetic
agaggtcaat

SEQ ID NO: 12617 - DNA, 9 bp, Artificial sequence
  Synthetic
gcacgcaac

SEQ ID NO: 12618 - DNA, 14 bp, Artificial sequence
  Synthetic
gtaaagatagggga

SEQ ID NO: 12619 - DNA, 11 bp, Artificial sequence
  Synthetic
actgagtcatc

SEQ ID NO: 12620 - DNA, 8 bp, Artificial sequence
  Synthetic
cggaaatc

SEQ ID NO: 12621 - DNA, 15 bp, Artificial sequence
  Synthetic
aagaaaagaaaaaaa

SEQ ID NO: 12622 - DNA, 14 bp, Artificial sequence
  Synthetic
ccccggacagcgcc

SEQ ID NO: 12623 - DNA, 10 bp, Artificial sequence
  Synthetic
attacgtaac

SEQ ID NO: 12624 - DNA, 8 bp, Artificial sequence
  Synthetic
caggtgag

SEQ ID NO: 12625 - DNA, 15 bp, Artificial sequence
  Synthetic
agccacacccaggca

SEQ ID NO: 12626 - DNA, 10 bp, Artificial sequence
  Synthetic
aatgagtcat

SEQ ID NO: 12627 - DNA, 13 bp, Artificial sequence
  Synthetic
gttaatcattaac

SEQ ID NO: 12628 - DNA, 9 bp, Artificial sequence
  Synthetic
attaattag

SEQ ID NO: 12629 - DNA, 8 bp, Artificial sequence
  Synthetic
cgtgggaa

SEQ ID NO: 12630 - DNA, 9 bp, Artificial sequence
  Synthetic
attaattac

SEQ ID NO: 12631 - DNA, 14 bp, Artificial sequence
  Synthetic
aaaaacagtagccg

SEQ ID NO: 12632 - DNA, 15 bp, Artificial sequence
  Synthetic
aaaaaaaaaaaaacc

SEQ ID NO: 12633 - DNA, 11 bp, Artificial sequence
  Synthetic
ccagctgcccc

SEQ ID NO: 12634 - DNA, 8 bp, Artificial sequence
  Synthetic
ccacgtgc

SEQ ID NO: 12635 - DNA, 14 bp, Artificial sequence
  Synthetic
cccacagcctcgtc

SEQ ID NO: 12636 - DNA, 17 bp, Artificial sequence
  Synthetic
ctgacctgaagtgaccc

SEQ ID NO: 12637 - DNA, 19 bp, Artificial sequence
  Synthetic
ctagaacacagtgtaccca

SEQ ID NO: 12638 - DNA, 8 bp, Artificial sequence
  Synthetic
acattcca

SEQ ID NO: 12639 - DNA, 8 bp, Artificial sequence
  Synthetic
tcacgcga

SEQ ID NO: 12640 - DNA, 15 bp, Artificial sequence
  Synthetic
atgctgagtcagcga

SEQ ID NO: 12641 - DNA, 11 bp, Artificial sequence
  Synthetic
ggtcacgtgac

SEQ ID NO: 12642 - DNA, 11 bp, Artificial sequence
  Synthetic
gagcacgtggc

SEQ ID NO: 12643 - DNA, 10 bp, Artificial sequence
  Synthetic
acggattagc

SEQ ID NO: 12644 - DNA, 16 bp, Artificial sequence
  Synthetic
cgccactaattagtac

SEQ ID NO: 12645 - DNA, 10 bp, Artificial sequence
  Synthetic
ccgcaataaa

SEQ ID NO: 12646 - DNA, 15 bp, Artificial sequence
  Synthetic
cactgcgcatgcgca

SEQ ID NO: 12647 - DNA, 10 bp, Artificial sequence
  Synthetic
agccaatgag

SEQ ID NO: 12648 - DNA, 12 bp, Artificial sequence
  Synthetic
tattacataaca

SEQ ID NO: 12649 - DNA, 13 bp, Artificial sequence
  Synthetic
agggggcggggcc

SEQ ID NO: 12650 - DNA, 16 bp, Artificial sequence
  Synthetic
agtaattaattacttc

SEQ ID NO: 12651 - DNA, 10 bp, Artificial sequence
  Synthetic
gccccgcccc

SEQ ID NO: 12652 - DNA, 16 bp, Artificial sequence
  Synthetic
aaattcaagtggctta

SEQ ID NO: 12653 - DNA, 14 bp, Artificial sequence
  Synthetic
aaatgggcgtggcc

SEQ ID NO: 12654 - DNA, 18 bp, Artificial sequence
  Synthetic
cgtcacgcatgagtgctc

SEQ ID NO: 12655 - DNA, 9 bp, Artificial sequence
  Synthetic
ataattgcc

SEQ ID NO: 12656 - DNA, 9 bp, Artificial sequence
  Synthetic
cttacgcaa

SEQ ID NO: 12657 - DNA, 27 bp, Artificial sequence
  Synthetic
aggggaggtacacggtgttcttttggg

SEQ ID NO: 12658 - DNA, 17 bp, Artificial sequence
  Synthetic
taaatagataccccata

SEQ ID NO: 12659 - DNA, 17 bp, Artificial sequence
  Synthetic
cgcattaattaattacc

SEQ ID NO: 12660 - DNA, 14 bp, Artificial sequence
  Synthetic
gggccgtgtgcaga

SEQ ID NO: 12661 - DNA, 10 bp, Artificial sequence
  Synthetic
tgagtaaaca

SEQ ID NO: 12662 - DNA, 15 bp, Artificial sequence
  Synthetic
cattgcctcagggca

SEQ ID NO: 12663 - DNA, 9 bp, Artificial sequence
  Synthetic
tgtaaacaa

SEQ ID NO: 12664 - DNA, 10 bp, Artificial sequence
  Synthetic
ccccgcgccc

SEQ ID NO: 12665 - DNA, 16 bp, Artificial sequence
  Synthetic
aaaaatccggatgtac

SEQ ID NO: 12666 - DNA, 18 bp, Artificial sequence
  Synthetic
tagtagccatggcaacaa

SEQ ID NO: 12667 - DNA, 21 bp, Artificial sequence
  Synthetic
cgaaggctgcggggtcagcac

SEQ ID NO: 12668 - DNA, 10 bp, Artificial sequence
  Synthetic
atgactcata

SEQ ID NO: 12669 - DNA, 15 bp, Artificial sequence
  Synthetic
agctgtcactcacct

SEQ ID NO: 12670 - DNA, 10 bp, Artificial sequence
  Synthetic
atgactcatc

SEQ ID NO: 12671 - DNA, 9 bp, Artificial sequence
  Synthetic
cgcgcgcac

SEQ ID NO: 12672 - DNA, 8 bp, Artificial sequence
  Synthetic
atctgata

SEQ ID NO: 12673 - DNA, 15 bp, Artificial sequence
  Synthetic
ggaaaacgaaactga

SEQ ID NO: 12674 - DNA, 11 bp, Artificial sequence
  Synthetic
tatagggataa

SEQ ID NO: 12675 - DNA, 9 bp, Artificial sequence
  Synthetic
accacgtgg

SEQ ID NO: 12676 - DNA, 16 bp, Artificial sequence
  Synthetic
attggactttggaccc

SEQ ID NO: 12677 - DNA, 10 bp, Artificial sequence
  Synthetic
aagcacatgg

SEQ ID NO: 12678 - DNA, 15 bp, Artificial sequence
  Synthetic
ctgttgctaggcaga

SEQ ID NO: 12679 - DNA, 12 bp, Artificial sequence
  Synthetic
ctgcacctgtgc

SEQ ID NO: 12680 - DNA, 13 bp, Artificial sequence
  Synthetic
aaacccgcatatt

SEQ ID NO: 12681 - DNA, 8 bp, Artificial sequence
  Synthetic
acctagtg

SEQ ID NO: 12682 - DNA, 19 bp, Artificial sequence
  Synthetic
caaggtcagggtgacctgg

SEQ ID NO: 12683 - DNA, 10 bp, Artificial sequence
  Synthetic
aattaattag

SEQ ID NO: 12684 - DNA, 10 bp, Artificial sequence
  Synthetic
aattaattaa

SEQ ID NO: 12685 - DNA, 15 bp, Artificial sequence
  Synthetic
cagtttcactttccc

SEQ ID NO: 12686 - DNA, 14 bp, Artificial sequence
  Synthetic
cttcgcggggggtc

SEQ ID NO: 12687 - DNA, 19 bp, Artificial sequence
  Synthetic
gtgaccttaataaggtcac

SEQ ID NO: 12688 - DNA, 9 bp, Artificial sequence
  Synthetic
cctaatgag

SEQ ID NO: 12689 - DNA, 13 bp, Artificial sequence
  Synthetic
caagatggcggcc

SEQ ID NO: 12690 - DNA, 11 bp, Artificial sequence
  Synthetic
ccgcagctggc

SEQ ID NO: 12691 - DNA, 15 bp, Artificial sequence
  Synthetic
ctctgattggccggc

SEQ ID NO: 12692 - DNA, 10 bp, Artificial sequence
  Synthetic
ccgcggcggc

SEQ ID NO: 12693 - DNA, 8 bp, Artificial sequence
  Synthetic
aagtgata

SEQ ID NO: 12694 - DNA, 8 bp, Artificial sequence
  Synthetic
ctggttaa

SEQ ID NO: 12695 - DNA, 11 bp, Artificial sequence
  Synthetic
acaggaagtgg

SEQ ID NO: 12696 - DNA, 13 bp, Artificial sequence
  Synthetic
gccttaccaaata

SEQ ID NO: 12697 - DNA, 15 bp, Artificial sequence
  Synthetic
atcaataacattgat

SEQ ID NO: 12698 - DNA, 12 bp, Artificial sequence
  Synthetic
agtttcattttc

SEQ ID NO: 12699 - DNA, 9 bp, Artificial sequence
  Synthetic
ccgtcagca

SEQ ID NO: 12700 - DNA, 18 bp, Artificial sequence
  Synthetic
agaaccagctgcggtcag

SEQ ID NO: 12701 - DNA, 10 bp, Artificial sequence
  Synthetic
aatgacgtca

SEQ ID NO: 12702 - DNA, 14 bp, Artificial sequence
  Synthetic
tgaatgttcagtca

SEQ ID NO: 12703 - DNA, 12 bp, Artificial sequence
  Synthetic
ctgcgcatgcgc

SEQ ID NO: 12704 - DNA, 16 bp, Artificial sequence
  Synthetic
caaattcctcgaaaga

SEQ ID NO: 12705 - DNA, 15 bp, Artificial sequence
  Synthetic
ataaaggcgcgcgat

SEQ ID NO: 12706 - DNA, 15 bp, Artificial sequence
  Synthetic
accacttccgggtca

SEQ ID NO: 12707 - DNA, 17 bp, Artificial sequence
  Synthetic
aattattaattaactcg

SEQ ID NO: 12708 - DNA, 12 bp, Artificial sequence
  Synthetic
tcccacgtgtca

SEQ ID NO: 12709 - DNA, 14 bp, Artificial sequence
  Synthetic
atcaaaggagccga

SEQ ID NO: 12710 - DNA, 10 bp, Artificial sequence
  Synthetic
gctgatgcaa

SEQ ID NO: 12711 - DNA, 15 bp, Artificial sequence
  Synthetic
atgaatggaattcat

SEQ ID NO: 12712 - DNA, 10 bp, Artificial sequence
  Synthetic
cctaattatc

SEQ ID NO: 12713 - DNA, 11 bp, Artificial sequence
  Synthetic
cagacggacac

SEQ ID NO: 12714 - DNA, 16 bp, Artificial sequence
  Synthetic
taaggtaataaaatta

SEQ ID NO: 12715 - DNA, 8 bp, Artificial sequence
  Synthetic
aaggtcaa

SEQ ID NO: 12716 - DNA, 8 bp, Artificial sequence
  Synthetic
aaggtcac

SEQ ID NO: 12717 - DNA, 11 bp, Artificial sequence
  Synthetic
accgtgggaaa

SEQ ID NO: 12718 - DNA, 17 bp, Artificial sequence
  Synthetic
gtaattaccgtaattaa

SEQ ID NO: 12719 - DNA, 8 bp, Artificial sequence
  Synthetic
aacacgtg

SEQ ID NO: 12720 - DNA, 14 bp, Artificial sequence
  Synthetic
ccagcagggggcgg

SEQ ID NO: 12721 - DNA, 7 bp, Artificial sequence
  Synthetic
cagtggg

SEQ ID NO: 12722 - DNA, 8 bp, Artificial sequence
  Synthetic
aaggtcat

SEQ ID NO: 12723 - DNA, 19 bp, Artificial sequence
  Synthetic
ccacggcggtgtcacatgc

SEQ ID NO: 12724 - DNA, 8 bp, Artificial sequence
  Synthetic
aagtttca

SEQ ID NO: 12725 - DNA, 18 bp, Artificial sequence
  Synthetic
atagcgccccctggtggc

SEQ ID NO: 12726 - DNA, 11 bp, Artificial sequence
  Synthetic
gtgactcagca

SEQ ID NO: 12727 - DNA, 10 bp, Artificial sequence
  Synthetic
agagataaga

SEQ ID NO: 12728 - DNA, 15 bp, Artificial sequence
  Synthetic
agtgccatctagtgg

SEQ ID NO: 12729 - DNA, 12 bp, Artificial sequence
  Synthetic
cgtacgtgcggc

SEQ ID NO: 12730 - DNA, 20 bp, Artificial sequence
  Synthetic
gtgaccttacataaggtcac

SEQ ID NO: 12731 - DNA, 17 bp, Artificial sequence
  Synthetic
agttgccttatatggtc

SEQ ID NO: 12732 - DNA, 11 bp, Artificial sequence
  Synthetic
gataatattga

SEQ ID NO: 12733 - DNA, 10 bp, Artificial sequence
  Synthetic
aataacggaa

SEQ ID NO: 12734 - DNA, 9 bp, Artificial sequence
  Synthetic
aacacctgg

SEQ ID NO: 12735 - DNA, 10 bp, Artificial sequence
  Synthetic
ccaatcagaa

SEQ ID NO: 12736 - DNA, 10 bp, Artificial sequence
  Synthetic
atgaataaat

SEQ ID NO: 12737 - DNA, 17 bp, Artificial sequence
  Synthetic
aaaatacatgtaaaaat

SEQ ID NO: 12738 - DNA, 13 bp, Artificial sequence
  Synthetic
cctgagaataatc

SEQ ID NO: 12739 - DNA, 18 bp, Artificial sequence
  Synthetic
aaaaatggcgccattttt

SEQ ID NO: 12740 - DNA, 8 bp, Artificial sequence
  Synthetic
aagttcat

SEQ ID NO: 12741 - DNA, 17 bp, Artificial sequence
  Synthetic
aaacataatgaggttgc

SEQ ID NO: 12742 - DNA, 8 bp, Artificial sequence
  Synthetic
aagttcac

SEQ ID NO: 12743 - DNA, 11 bp, Artificial sequence
  Synthetic
agaacaatggg

SEQ ID NO: 12744 - DNA, 16 bp, Artificial sequence
  Synthetic
ctaggggcgcccccaa

SEQ ID NO: 12745 - DNA, 14 bp, Artificial sequence
  Synthetic
acagggagtgagtg

SEQ ID NO: 12746 - DNA, 15 bp, Artificial sequence
  Synthetic
ccgaaaccgaaacta

SEQ ID NO: 12747 - DNA, 16 bp, Artificial sequence
  Synthetic
ttacctgattaggaaa

SEQ ID NO: 12748 - DNA, 9 bp, Artificial sequence
  Synthetic
acccattaa

SEQ ID NO: 12749 - DNA, 8 bp, Artificial sequence
  Synthetic
ggcttccc

SEQ ID NO: 12750 - DNA, 13 bp, Artificial sequence
  Synthetic
ggatgtttgttta

SEQ ID NO: 12751 - DNA, 9 bp, Artificial sequence
  Synthetic
ccgcacgca

SEQ ID NO: 12752 - DNA, 17 bp, Artificial sequence
  Synthetic
aatttaagtacttaaaa

SEQ ID NO: 12753 - DNA, 10 bp, Artificial sequence
  Synthetic
ctataaatag

SEQ ID NO: 12754 - DNA, 9 bp, Artificial sequence
  Synthetic
ctaattacc

SEQ ID NO: 12755 - DNA, 9 bp, Artificial sequence
  Synthetic
gcacttaaa

SEQ ID NO: 12756 - DNA, 20 bp, Artificial sequence
  Synthetic
caggtgatttccgggaaatg

SEQ ID NO: 12757 - DNA, 16 bp, Artificial sequence
  Synthetic
cggacacctgttcttc

SEQ ID NO: 12758 - DNA, 14 bp, Artificial sequence
  Synthetic
ggctaattagcgaa

SEQ ID NO: 12759 - DNA, 13 bp, Artificial sequence
  Synthetic
aacttaccaaaca

SEQ ID NO: 12760 - DNA, 12 bp, Artificial sequence
  Synthetic
ataattggatta

SEQ ID NO: 12761 - DNA, 12 bp, Artificial sequence
  Synthetic
aacagatggtcg

SEQ ID NO: 12762 - DNA, 11 bp, Artificial sequence
  Synthetic
aagtaaacaaa

SEQ ID NO: 12763 - DNA, 12 bp, Artificial sequence
  Synthetic
aaacaaacattc

SEQ ID NO: 12764 - DNA, 15 bp, Artificial sequence
  Synthetic
aaagatcaaagggtt

SEQ ID NO: 12765 - DNA, 7 bp, Artificial sequence
  Synthetic
agaacag

SEQ ID NO: 12766 - DNA, 16 bp, Artificial sequence
  Synthetic
gtcaccatctgttcga

SEQ ID NO: 12767 - DNA, 16 bp, Artificial sequence
  Synthetic
ctcagccaatcagcgc

SEQ ID NO: 12768 - DNA, 8 bp, Artificial sequence
  Synthetic
acacctgc

SEQ ID NO: 12769 - DNA, 7 bp, Artificial sequence
  Synthetic
taataaa

SEQ ID NO: 12770 - DNA, 8 bp, Artificial sequence
  Synthetic
acacctgg

SEQ ID NO: 12771 - DNA, 10 bp, Artificial sequence
  Synthetic
agctgtcaat

SEQ ID NO: 12772 - DNA, 14 bp, Artificial sequence
  Synthetic
ctccctgtcccctc

SEQ ID NO: 12773 - DNA, 8 bp, Artificial sequence
  Synthetic
gatttcca

SEQ ID NO: 12774 - DNA, 15 bp, Artificial sequence
  Synthetic
aaattgctgactcag

SEQ ID NO: 12775 - DNA, 19 bp, Artificial sequence
  Synthetic
aaaaagaggaagtgaaact

SEQ ID NO: 12776 - DNA, 13 bp, Artificial sequence
  Synthetic
ccgccacgagccc

SEQ ID NO: 12777 - DNA, 10 bp, Artificial sequence
  Synthetic
agctgtcaaa

SEQ ID NO: 12778 - DNA, 12 bp, Artificial sequence
  Synthetic
ccacgtcaccac

SEQ ID NO: 12779 - DNA, 15 bp, Artificial sequence
  Synthetic
accgttgctatggta

SEQ ID NO: 12780 - DNA, 17 bp, Artificial sequence
  Synthetic
aaggtcattcaaggtca

SEQ ID NO: 12781 - DNA, 10 bp, Artificial sequence
  Synthetic
tcaacctgca

SEQ ID NO: 12782 - DNA, 9 bp, Artificial sequence
  Synthetic
ttacgcaaa

SEQ ID NO: 12783 - DNA, 10 bp, Artificial sequence
  Synthetic
ctgactcatc

SEQ ID NO: 12784 - DNA, 7 bp, Artificial sequence
  Synthetic
agaggaa

SEQ ID NO: 12785 - DNA, 10 bp, Artificial sequence
  Synthetic
ttccaggaaa

SEQ ID NO: 12786 - DNA, 9 bp, Artificial sequence
  Synthetic
atttaatta

SEQ ID NO: 12787 - DNA, 17 bp, Artificial sequence
  Synthetic
agcagtgggtcccccag

SEQ ID NO: 12788 - DNA, 17 bp, Artificial sequence
  Synthetic
acatgtcatagacatgt

SEQ ID NO: 12789 - DNA, 10 bp, Artificial sequence
  Synthetic
gttatgcaac

SEQ ID NO: 12790 - DNA, 17 bp, Artificial sequence
  Synthetic
tctttggcgtaccctaa

SEQ ID NO: 12791 - DNA, 8 bp, Artificial sequence
  Synthetic
acataaat

SEQ ID NO: 12792 - DNA, 16 bp, Artificial sequence
  Synthetic
aacccaataaaattcg

SEQ ID NO: 12793 - DNA, 11 bp, Artificial sequence
  Synthetic
tgtaatcccaa

SEQ ID NO: 12794 - DNA, 12 bp, Artificial sequence
  Synthetic
caagacgcctta

SEQ ID NO: 12795 - DNA, 9 bp, Artificial sequence
  Synthetic
agatggact

SEQ ID NO: 12796 - DNA, 8 bp, Artificial sequence
  Synthetic
accggaag

SEQ ID NO: 12797 - DNA, 12 bp, Artificial sequence
  Synthetic
gaacacaacaaa

SEQ ID NO: 12798 - DNA, 8 bp, Artificial sequence
  Synthetic
taatcaaa

SEQ ID NO: 12799 - DNA, 15 bp, Artificial sequence
  Synthetic
aacgaaaccgaaact

SEQ ID NO: 12800 - DNA, 17 bp, Artificial sequence
  Synthetic
caattaaataccgatta

SEQ ID NO: 12801 - DNA, 10 bp, Artificial sequence
  Synthetic
taaacaaaga

SEQ ID NO: 12802 - DNA, 15 bp, Artificial sequence
  Synthetic
ccataattaattaca

SEQ ID NO: 12803 - DNA, 11 bp, Artificial sequence
  Synthetic
cttctgggaaa

SEQ ID NO: 12804 - DNA, 13 bp, Artificial sequence
  Synthetic
gaacgttctagaa

SEQ ID NO: 12805 - DNA, 11 bp, Artificial sequence
  Synthetic
tttcccggaaa

SEQ ID NO: 12806 - DNA, 25 bp, Artificial sequence
  Synthetic
aactacaattcccagaatgccccgc

SEQ ID NO: 12807 - DNA, 10 bp, Artificial sequence
  Synthetic
accaattagc

SEQ ID NO: 12808 - DNA, 16 bp, Artificial sequence
  Synthetic
aaattaattgattttg

SEQ ID NO: 12809 - DNA, 10 bp, Artificial sequence
  Synthetic
aacagctgat

SEQ ID NO: 12810 - DNA, 18 bp, Artificial sequence
  Synthetic
ggccaccagggggcgcta

SEQ ID NO: 12811 - DNA, 16 bp, Artificial sequence
  Synthetic
aacaaccaattaattc

SEQ ID NO: 12812 - DNA, 10 bp, Artificial sequence
  Synthetic
gaggtgtgaa

SEQ ID NO: 12813 - DNA, 13 bp, Artificial sequence
  Synthetic
ctatcgcgacata

SEQ ID NO: 12814 - DNA, 20 bp, Artificial sequence
  Synthetic
tcctctttgtttacaattca

SEQ ID NO: 12815 - DNA, 10 bp, Artificial sequence
  Synthetic
acaagagggc

SEQ ID NO: 12816 - DNA, 14 bp, Artificial sequence
  Synthetic
gttgccatggcaac

SEQ ID NO: 12817 - DNA, 8 bp, Artificial sequence
  Synthetic
cacatcaa

SEQ ID NO: 12818 - DNA, 10 bp, Artificial sequence
  Synthetic
aggaagtgaa

SEQ ID NO: 12819 - DNA, 10 bp, Artificial sequence
  Synthetic
ccttataagg

SEQ ID NO: 12820 - DNA, 8 bp, Artificial sequence
  Synthetic
gcgggaaa

SEQ ID NO: 12821 - DNA, 14 bp, Artificial sequence
  Synthetic
tccatggtgctgaa

SEQ ID NO: 12822 - DNA, 9 bp, Artificial sequence
  Synthetic
gtgacgtca

SEQ ID NO: 12823 - DNA, 15 bp, Artificial sequence
  Synthetic
gagaaattaatataa

SEQ ID NO: 12824 - DNA, 20 bp, Artificial sequence
  Synthetic
caaaggtcacgtgacctttg

SEQ ID NO: 12825 - DNA, 15 bp, Artificial sequence
  Synthetic
gatatttctgctcta

SEQ ID NO: 12826 - DNA, 16 bp, Artificial sequence
  Synthetic
aaaagctttctaggaa

SEQ ID NO: 12827 - DNA, 13 bp, Artificial sequence
  Synthetic
ctttcccgccccc

SEQ ID NO: 12828 - DNA, 10 bp, Artificial sequence
  Synthetic
ccacgtgacc

SEQ ID NO: 12829 - DNA, 13 bp, Artificial sequence
  Synthetic
ctaatttaattaa

SEQ ID NO: 12830 - DNA, 14 bp, Artificial sequence
  Synthetic
cccccttgggcccc

SEQ ID NO: 12831 - DNA, 14 bp, Artificial sequence
  Synthetic
aggagggggcagtg

SEQ ID NO: 12832 - DNA, 7 bp, Artificial sequence
  Synthetic
tcataaa

SEQ ID NO: 12833 - DNA, 22 bp, Artificial sequence
  Synthetic
gggcgctgtccatggtgctgaa

SEQ ID NO: 12834 - DNA, 11 bp, Artificial sequence
  Synthetic
gccataaatca

SEQ ID NO: 12835 - DNA, 7 bp, Artificial sequence
  Synthetic
aatatat

SEQ ID NO: 12836 - DNA, 10 bp, Artificial sequence
  Synthetic
actaattaac

SEQ ID NO: 12837 - DNA, 11 bp, Artificial sequence
  Synthetic
aatttgctgac

SEQ ID NO: 12838 - DNA, 13 bp, Artificial sequence
  Synthetic
aggtcaaagtcca

SEQ ID NO: 12839 - DNA, 10 bp, Artificial sequence
  Synthetic
ggattcgaac

SEQ ID NO: 12840 - DNA, 11 bp, Artificial sequence
  Synthetic
aagatggcggc

SEQ ID NO: 12841 - DNA, 14 bp, Artificial sequence
  Synthetic
caaatctcgcgaga

SEQ ID NO: 12842 - DNA, 12 bp, Artificial sequence
  Synthetic
cgttgacgtcac

SEQ ID NO: 12843 - DNA, 10 bp, Artificial sequence
  Synthetic
aacaggtggt

SEQ ID NO: 12844 - DNA, 14 bp, Artificial sequence
  Synthetic
cacagcggggggtc

SEQ ID NO: 12845 - DNA, 12 bp, Artificial sequence
  Synthetic
aatggcgccaaa

SEQ ID NO: 12846 - DNA, 8 bp, Artificial sequence
  Synthetic
gctaatga

SEQ ID NO: 12847 - DNA, 17 bp, Artificial sequence
  Synthetic
aatcgcactgcattccg

SEQ ID NO: 12848 - DNA, 10 bp, Artificial sequence
  Synthetic
ccacgtgatc

SEQ ID NO: 12849 - DNA, 8 bp, Artificial sequence
  Synthetic
tgtcaaaa

SEQ ID NO: 12850 - DNA, 17 bp, Artificial sequence
  Synthetic
caataccggaagtgtaa

SEQ ID NO: 12851 - DNA, 7 bp, Artificial sequence
  Synthetic
gcagaga

SEQ ID NO: 12852 - DNA, 10 bp, Artificial sequence
  Synthetic
cgcccccgca

SEQ ID NO: 12853 - DNA, 17 bp, Artificial sequence
  Synthetic
acggccataaaattaat

SEQ ID NO: 12854 - DNA, 10 bp, Artificial sequence
  Synthetic
ctaattatac

SEQ ID NO: 12855 - DNA, 16 bp, Artificial sequence
  Synthetic
cccagggtaacagccg

SEQ ID NO: 12856 - DNA, 9 bp, Artificial sequence
  Synthetic
acacgtgcc

SEQ ID NO: 12857 - DNA, 17 bp, Artificial sequence
  Synthetic
aatagggtatcaattat

SEQ ID NO: 12858 - DNA, 15 bp, Artificial sequence
  Synthetic
aagtcagcattttta

SEQ ID NO: 12859 - DNA, 9 bp, Artificial sequence
  Synthetic
ggccattaa

SEQ ID NO: 12860 - DNA, 17 bp, Artificial sequence
  Synthetic
cgagttaattaataagc

SEQ ID NO: 12861 - DNA, 14 bp, Artificial sequence
  Synthetic
aaccacaataccaa

SEQ ID NO: 12862 - DNA, 10 bp, Artificial sequence
  Synthetic
acatcaaagg

SEQ ID NO: 12863 - DNA, 18 bp, Artificial sequence
  Synthetic
ccaactttcgatttccta

SEQ ID NO: 12864 - DNA, 16 bp, Artificial sequence
  Synthetic
aattccattgttcaat

SEQ ID NO: 12865 - DNA, 9 bp, Artificial sequence
  Synthetic
cttaatccc

SEQ ID NO: 12866 - DNA, 10 bp, Artificial sequence
  Synthetic
atgactcacc

SEQ ID NO: 12867 - DNA, 9 bp, Artificial sequence
  Synthetic
agacagaca

SEQ ID NO: 12868 - DNA, 7 bp, Artificial sequence
  Synthetic
ccggaag

SEQ ID NO: 12869 - DNA, 14 bp, Artificial sequence
  Synthetic
tgaatagtcattca

SEQ ID NO: 12870 - DNA, 15 bp, Artificial sequence
  Synthetic
taaataaatatttca

SEQ ID NO: 12871 - DNA, 8 bp, Artificial sequence
  Synthetic
attttggg

SEQ ID NO: 12872 - DNA, 13 bp, Artificial sequence
  Synthetic
ataattaaattaa

SEQ ID NO: 12873 - DNA, 13 bp, Artificial sequence
  Synthetic
tgatgacgtggca

SEQ ID NO: 12874 - DNA, 14 bp, Artificial sequence
  Synthetic
gggcatcaatcaaa

SEQ ID NO: 12875 - DNA, 11 bp, Artificial sequence
  Synthetic
gaaatgagtca

SEQ ID NO: 12876 - DNA, 13 bp, Artificial sequence
  Synthetic
aaatgcaatcccc

SEQ ID NO: 12877 - DNA, 10 bp, Artificial sequence
  Synthetic
taatcgataa

SEQ ID NO: 12878 - DNA, 17 bp, Artificial sequence
  Synthetic
ctaaggttctagatcac

SEQ ID NO: 12879 - DNA, 11 bp, Artificial sequence
  Synthetic
aattaattagt

SEQ ID NO: 12880 - DNA, 14 bp, Artificial sequence
  Synthetic
atggaaaattacag

SEQ ID NO: 12881 - DNA, 23 bp, Artificial sequence
  Synthetic
ccccctgacctttgccctctgcc

SEQ ID NO: 12882 - DNA, 10 bp, Artificial sequence
  Synthetic
cttttataga

SEQ ID NO: 12883 - DNA, 9 bp, Artificial sequence
  Synthetic
taattaaga

SEQ ID NO: 12884 - DNA, 8 bp, Artificial sequence
  Synthetic
agctgact

SEQ ID NO: 12885 - DNA, 9 bp, Artificial sequence
  Synthetic
attgtttac

SEQ ID NO: 12886 - DNA, 10 bp, Artificial sequence
  Synthetic
caggaaataa

SEQ ID NO: 12887 - DNA, 10 bp, Artificial sequence
  Synthetic
gtcgtaaaaa

SEQ ID NO: 12888 - DNA, 10 bp, Artificial sequence
  Synthetic
agccccccaa

SEQ ID NO: 12889 - DNA, 14 bp, Artificial sequence
  Synthetic
caggcctcggcccc

SEQ ID NO: 12890 - DNA, 17 bp, Artificial sequence
  Synthetic
aggtcaaactgtgacct

SEQ ID NO: 12891 - DNA, 10 bp, Artificial sequence
  Synthetic
caaatcactg

SEQ ID NO: 12892 - DNA, 15 bp, Artificial sequence
  Synthetic
gggggttgacgcaga

SEQ ID NO: 12893 - DNA, 11 bp, Artificial sequence
  Synthetic
gctcgtaaaac

SEQ ID NO: 12894 - DNA, 11 bp, Artificial sequence
  Synthetic
gctcgtaaaaa

SEQ ID NO: 12895 - DNA, 9 bp, Artificial sequence
  Synthetic
gacagctgc

SEQ ID NO: 12896 - DNA, 15 bp, Artificial sequence
  Synthetic
cccgccacgtgaccc

SEQ ID NO: 12897 - DNA, 16 bp, Artificial sequence
  Synthetic
aagcacctgtcaatat

SEQ ID NO: 12898 - DNA, 16 bp, Artificial sequence
  Synthetic
caggtgacacctgaca

SEQ ID NO: 12899 - DNA, 11 bp, Artificial sequence
  Synthetic
ccgcccccgca

SEQ ID NO: 12900 - DNA, 8 bp, Artificial sequence
  Synthetic
tctcccaa

SEQ ID NO: 12901 - DNA, 10 bp, Artificial sequence
  Synthetic
gccagttgac

SEQ ID NO: 12902 - DNA, 10 bp, Artificial sequence
  Synthetic
aaggtgtcaa

SEQ ID NO: 12903 - DNA, 9 bp, Artificial sequence
  Synthetic
actgttact

SEQ ID NO: 12904 - DNA, 15 bp, Artificial sequence
  Synthetic
gcaggagggtatggc

SEQ ID NO: 12905 - DNA, 21 bp, Artificial sequence
  Synthetic
cggatgacctttgacccctga

SEQ ID NO: 12906 - DNA, 21 bp, Artificial sequence
  Synthetic
ctcctcccctccctcctcccc

SEQ ID NO: 12907 - DNA, 10 bp, Artificial sequence
  Synthetic
atgtaaacaa

SEQ ID NO: 12908 - DNA, 10 bp, Artificial sequence
  Synthetic
ccatggcaac

SEQ ID NO: 12909 - DNA, 17 bp, Artificial sequence
  Synthetic
gacaattaatccctaca

SEQ ID NO: 12910 - DNA, 12 bp, Artificial sequence
  Synthetic
aaatttgctgac

SEQ ID NO: 12911 - DNA, 10 bp, Artificial sequence
  Synthetic
gccacgtgac

SEQ ID NO: 12912 - DNA, 9 bp, Artificial sequence
  Synthetic
aaggaagta

SEQ ID NO: 12913 - DNA, 9 bp, Artificial sequence
  Synthetic
caacaggtg

SEQ ID NO: 12914 - DNA, 9 bp, Artificial sequence
  Synthetic
acagctccc

SEQ ID NO: 12915 - DNA, 15 bp, Artificial sequence
  Synthetic
aatgcaattttttga

SEQ ID NO: 12916 - DNA, 15 bp, Artificial sequence
  Synthetic
aaatctcgcgagaac

SEQ ID NO: 12917 - DNA, 14 bp, Artificial sequence
  Synthetic
ccacctgccgcagg

SEQ ID NO: 12918 - DNA, 16 bp, Artificial sequence
  Synthetic
gaggtcaaaaggtcac

SEQ ID NO: 12919 - DNA, 16 bp, Artificial sequence
  Synthetic
gaggtcaaaaggtcaa

SEQ ID NO: 12920 - DNA, 6 bp, Artificial sequence
  Synthetic
ataaca

SEQ ID NO: 12921 - DNA, 8 bp, Artificial sequence
  Synthetic
gcacgtga

SEQ ID NO: 12922 - DNA, 9 bp, Artificial sequence
  Synthetic
acagctcct

SEQ ID NO: 12923 - DNA, 12 bp, Artificial sequence
  Synthetic
cgccgcccccgc

SEQ ID NO: 12924 - DNA, 17 bp, Artificial sequence
  Synthetic
gaacaataacattgttc

SEQ ID NO: 12925 - DNA, 10 bp, Artificial sequence
  Synthetic
ggcgcgaaac

SEQ ID NO: 12926 - DNA, 10 bp, Artificial sequence
  Synthetic
gatcgatccc

SEQ ID NO: 12927 - DNA, 12 bp, Artificial sequence
  Synthetic
atttttacgacc

SEQ ID NO: 12928 - DNA, 17 bp, Artificial sequence
  Synthetic
caccgttgattgggtcg

SEQ ID NO: 12929 - DNA, 16 bp, Artificial sequence
  Synthetic
gggttactggcggtca

SEQ ID NO: 12930 - DNA, 10 bp, Artificial sequence
  Synthetic
acatccgggt

SEQ ID NO: 12931 - DNA, 16 bp, Artificial sequence
  Synthetic
acgatgacgtcatcga

SEQ ID NO: 12932 - DNA, 10 bp, Artificial sequence
  Synthetic
attattaata

SEQ ID NO: 12933 - DNA, 9 bp, Artificial sequence
  Synthetic
agggtatca

SEQ ID NO: 12934 - DNA, 9 bp, Artificial sequence
  Synthetic
cccgccccc

SEQ ID NO: 12935 - DNA, 12 bp, Artificial sequence
  Synthetic
ggccacttgaga

SEQ ID NO: 12936 - DNA, 11 bp, Artificial sequence
  Synthetic
gcaggcgccgc

SEQ ID NO: 12937 - DNA, 11 bp, Artificial sequence
  Synthetic
cacagctgcag

SEQ ID NO: 12938 - DNA, 16 bp, Artificial sequence
  Synthetic
aaggtaattaccaata

SEQ ID NO: 12939 - DNA, 11 bp, Artificial sequence
  Synthetic
acagataagaa

SEQ ID NO: 12940 - DNA, 11 bp, Artificial sequence
  Synthetic
atgagtcatcc

SEQ ID NO: 12941 - DNA, 17 bp, Artificial sequence
  Synthetic
tgaaccggattaatgaa

SEQ ID NO: 12942 - DNA, 10 bp, Artificial sequence
  Synthetic
agtaattaac

SEQ ID NO: 12943 - DNA, 18 bp, Artificial sequence
  Synthetic
aacatgcccgggcatgtc

SEQ ID NO: 12944 - DNA, 10 bp, Artificial sequence
  Synthetic
gacacgtgcc

SEQ ID NO: 12945 - DNA, 10 bp, Artificial sequence
  Synthetic
ccttagcaac

SEQ ID NO: 12946 - DNA, 10 bp, Artificial sequence
  Synthetic
cttccggctc

SEQ ID NO: 12947 - DNA, 10 bp, Artificial sequence
  Synthetic
atgcgggtac

SEQ ID NO: 12948 - DNA, 21 bp, Artificial sequence
  Synthetic
ggaggaggagggggaggagga

SEQ ID NO: 12949 - DNA, 15 bp, Artificial sequence
  Synthetic
tttgcataacaaaaa

SEQ ID NO: 12950 - DNA, 18 bp, Artificial sequence
  Synthetic
catgcccatataaggcaa

SEQ ID NO: 12951 - DNA, 7 bp, Artificial sequence
  Synthetic
tgtcaaa

SEQ ID NO: 12952 - DNA, 15 bp, Artificial sequence
  Synthetic
atttgcataacaaag

SEQ ID NO: 12953 - DNA, 12 bp, Artificial sequence
  Synthetic
ccatatatgggc

SEQ ID NO: 12954 - DNA, 15 bp, Artificial sequence
  Synthetic
gaaggaagcggaaga

SEQ ID NO: 12955 - DNA, 7 bp, Artificial sequence
  Synthetic
ccaatta

SEQ ID NO: 12956 - DNA, 8 bp, Artificial sequence
  Synthetic
aggtcacg

SEQ ID NO: 12957 - DNA, 15 bp, Artificial sequence
  Synthetic
ctttaatcccttaac

SEQ ID NO: 12958 - DNA, 11 bp, Artificial sequence
  Synthetic
aggtgtgaaga

SEQ ID NO: 12959 - DNA, 20 bp, Artificial sequence
  Synthetic
ggtgctgtccgtggtgctga

SEQ ID NO: 12960 - DNA, 13 bp, Artificial sequence
  Synthetic
cctcaccccaccc

SEQ ID NO: 12961 - DNA, 12 bp, Artificial sequence
  Synthetic
gcgatcacccca

SEQ ID NO: 12962 - DNA, 9 bp, Artificial sequence
  Synthetic
aatcgataa

SEQ ID NO: 12963 - DNA, 13 bp, Artificial sequence
  Synthetic
catccagatgttc

SEQ ID NO: 12964 - DNA, 10 bp, Artificial sequence
  Synthetic
cgcgccaaac

SEQ ID NO: 12965 - DNA, 17 bp, Artificial sequence
  Synthetic
tcccaaagtagctggga

SEQ ID NO: 12966 - DNA, 9 bp, Artificial sequence
  Synthetic
gtaaacaac

SEQ ID NO: 12967 - DNA, 9 bp, Artificial sequence
  Synthetic
gtaaacaaa

SEQ ID NO: 12968 - DNA, 15 bp, Artificial sequence
  Synthetic
cgttgctaggcaacc

SEQ ID NO: 12969 - DNA, 9 bp, Artificial sequence
  Synthetic
ccaattagc

SEQ ID NO: 12970 - DNA, 9 bp, Artificial sequence
  Synthetic
ccaattagg

SEQ ID NO: 12971 - DNA, 12 bp, Artificial sequence
  Synthetic
aaattgacctca

SEQ ID NO: 12972 - DNA, 11 bp, Artificial sequence
  Synthetic
catgagtcacc

SEQ ID NO: 12973 - DNA, 6 bp, Artificial sequence
  Synthetic
taacta

SEQ ID NO: 12974 - DNA, 18 bp, Artificial sequence
  Synthetic
ccccgggcttgcgtgaga

SEQ ID NO: 12975 - DNA, 8 bp, Artificial sequence
  Synthetic
ttacgtaa

SEQ ID NO: 12976 - DNA, 15 bp, Artificial sequence
  Synthetic
ggtttctctccagta

SEQ ID NO: 12977 - DNA, 9 bp, Artificial sequence
  Synthetic
aattttcca

SEQ ID NO: 12978 - DNA, 11 bp, Artificial sequence
  Synthetic
accagatggtc

SEQ ID NO: 12979 - DNA, 15 bp, Artificial sequence
  Synthetic
cacttccgcttccgg

SEQ ID NO: 12980 - DNA, 8 bp, Artificial sequence
  Synthetic
gccattaa

SEQ ID NO: 12981 - DNA, 14 bp, Artificial sequence
  Synthetic
gaacagaatgttcc

SEQ ID NO: 12982 - DNA, 10 bp, Artificial sequence
  Synthetic
tccccgggga

SEQ ID NO: 12983 - DNA, 9 bp, Artificial sequence
  Synthetic
ggccagaca

SEQ ID NO: 12984 - DNA, 10 bp, Artificial sequence
  Synthetic
gcacgtgacc

SEQ ID NO: 12985 - DNA, 8 bp, Artificial sequence
  Synthetic
cgcccacg

SEQ ID NO: 12986 - DNA, 17 bp, Artificial sequence
  Synthetic
tagtagcctggcaacaa

SEQ ID NO: 12987 - DNA, 10 bp, Artificial sequence
  Synthetic
agatattatc

SEQ ID NO: 12988 - DNA, 15 bp, Artificial sequence
  Synthetic
gggtcaacgagttca

SEQ ID NO: 12989 - DNA, 8 bp, Artificial sequence
  Synthetic
aaaggtca

SEQ ID NO: 12990 - DNA, 10 bp, Artificial sequence
  Synthetic
acacgtcatc

SEQ ID NO: 12991 - DNA, 13 bp, Artificial sequence
  Synthetic
tgaataacattca

SEQ ID NO: 12992 - DNA, 10 bp, Artificial sequence
  Synthetic
aaagcaaaca

SEQ ID NO: 12993 - DNA, 8 bp, Artificial sequence
  Synthetic
gttaatga

SEQ ID NO: 12994 - DNA, 17 bp, Artificial sequence
  Synthetic
atctaagttatctctta

SEQ ID NO: 12995 - DNA, 10 bp, Artificial sequence
  Synthetic
gctacgtcac

SEQ ID NO: 12996 - DNA, 12 bp, Artificial sequence
  Synthetic
ctaatttgcata

SEQ ID NO: 12997 - DNA, 17 bp, Artificial sequence
  Synthetic
gatctccatttttggac

SEQ ID NO: 12998 - DNA, 8 bp, Artificial sequence
  Synthetic
cctgctga

SEQ ID NO: 12999 - DNA, 28 bp, Artificial sequence
  Synthetic
aaacagatacctgaagcgtgaccataca

SEQ ID NO: 13000 - DNA, 13 bp, Artificial sequence
  Synthetic
acacaggtaagta

SEQ ID NO: 13001 - DNA, 11 bp, Artificial sequence
  Synthetic
ataaacaagcc

SEQ ID NO: 13002 - DNA, 15 bp, Artificial sequence
  Synthetic
atgaattgcagtcat

SEQ ID NO: 13003 - DNA, 15 bp, Artificial sequence
  Synthetic
agaaagtgaaagtga

SEQ ID NO: 13004 - DNA, 14 bp, Artificial sequence
  Synthetic
ctaatcatcattaa

SEQ ID NO: 13005 - DNA, 8 bp, Artificial sequence
  Synthetic
caacggcc

SEQ ID NO: 13006 - DNA, 14 bp, Artificial sequence
  Synthetic
cactagatggcagc

SEQ ID NO: 13007 - DNA, 18 bp, Artificial sequence
  Synthetic
gtgaccttataaggtcac

SEQ ID NO: 13008 - DNA, 18 bp, Artificial sequence
  Synthetic
agagtgctgattggtcca

SEQ ID NO: 13009 - DNA, 19 bp, Artificial sequence
  Synthetic
gagggcagtgaagcgtgac

SEQ ID NO: 13010 - DNA, 17 bp, Artificial sequence
  Synthetic
atttcctttgatctata

SEQ ID NO: 13011 - DNA, 10 bp, Artificial sequence
  Synthetic
accggaagag

SEQ ID NO: 13012 - DNA, 16 bp, Artificial sequence
  Synthetic
attaacaggtgttcac

SEQ ID NO: 13013 - DNA, 16 bp, Artificial sequence
  Synthetic
gagttcattgagttca

SEQ ID NO: 13014 - DNA, 15 bp, Artificial sequence
  Synthetic
aaccgttaaacggtc

SEQ ID NO: 13015 - DNA, 9 bp, Artificial sequence
  Synthetic
atgagtcag

SEQ ID NO: 13016 - DNA, 17 bp, Artificial sequence
  Synthetic
aaattaacggttttcaa

SEQ ID NO: 13017 - DNA, 10 bp, Artificial sequence
  Synthetic
actgacctcg

SEQ ID NO: 13018 - DNA, 14 bp, Artificial sequence
  Synthetic
catgaatattcata

SEQ ID NO: 13019 - DNA, 13 bp, Artificial sequence
  Synthetic
tgtaaataaacaa

SEQ ID NO: 13020 - DNA, 9 bp, Artificial sequence
  Synthetic
aaagtccag

SEQ ID NO: 13021 - DNA, 20 bp, Artificial sequence
  Synthetic
gatttcccataatgccttgc

SEQ ID NO: 13022 - DNA, 10 bp, Artificial sequence
  Synthetic
agaatgttcg

SEQ ID NO: 13023 - DNA, 9 bp, Artificial sequence
  Synthetic
cagataggg

SEQ ID NO: 13024 - DNA, 20 bp, Artificial sequence
  Synthetic
ccccaaaccacccccccccc

SEQ ID NO: 13025 - DNA, 20 bp, Artificial sequence
  Synthetic
ccccaaaccaccccccccca

SEQ ID NO: 13026 - DNA, 10 bp, Artificial sequence
  Synthetic
cgcccacgca

SEQ ID NO: 13027 - DNA, 16 bp, Artificial sequence
  Synthetic
aacaatgttcagtgtt

SEQ ID NO: 13028 - DNA, 13 bp, Artificial sequence
  Synthetic
catataaacaatg

SEQ ID NO: 13029 - DNA, 9 bp, Artificial sequence
  Synthetic
ccggaaaaa

SEQ ID NO: 13030 - DNA, 13 bp, Artificial sequence
  Synthetic
aggtaaacaaaca

SEQ ID NO: 13031 - DNA, 17 bp, Artificial sequence
  Synthetic
gtgcactaattagtgca

SEQ ID NO: 13032 - DNA, 11 bp, Artificial sequence
  Synthetic
ctgtctggcta

SEQ ID NO: 13033 - DNA, 9 bp, Artificial sequence
  Synthetic
aacatcaaa

SEQ ID NO: 13034 - DNA, 18 bp, Artificial sequence
  Synthetic
gactaagcaaacaatgaa

SEQ ID NO: 13035 - DNA, 12 bp, Artificial sequence
  Synthetic
aacagctgacgc

SEQ ID NO: 13036 - DNA, 12 bp, Artificial sequence
  Synthetic
catgtcatgtaa

SEQ ID NO: 13037 - DNA, 15 bp, Artificial sequence
  Synthetic
acggcaggtgtcccc

SEQ ID NO: 13038 - DNA, 10 bp, Artificial sequence
  Synthetic
aaacatggcg

SEQ ID NO: 13039 - DNA, 13 bp, Artificial sequence
  Synthetic
atggaaatttcca

SEQ ID NO: 13040 - DNA, 6 bp, Artificial sequence
  Synthetic
cacgtg

SEQ ID NO: 13041 - DNA, 12 bp, Artificial sequence
  Synthetic
aaaatgctgact

SEQ ID NO: 13042 - DNA, 7 bp, Artificial sequence
  Synthetic
atataaa

SEQ ID NO: 13043 - DNA, 15 bp, Artificial sequence
  Synthetic
ataagggcgcgcgat

SEQ ID NO: 13044 - DNA, 9 bp, Artificial sequence
  Synthetic
cagataagg

SEQ ID NO: 13045 - DNA, 8 bp, Artificial sequence
  Synthetic
tcaatgaa

SEQ ID NO: 13046 - DNA, 15 bp, Artificial sequence
  Synthetic
atgcccatatatgga

SEQ ID NO: 13047 - DNA, 18 bp, Artificial sequence
  Synthetic
acagtcatgcgtgagtta

SEQ ID NO: 13048 - DNA, 16 bp, Artificial sequence
  Synthetic
caacccctgggtgtgg

SEQ ID NO: 13049 - DNA, 13 bp, Artificial sequence
  Synthetic
tacaaggaagtaa

SEQ ID NO: 13050 - DNA, 17 bp, Artificial sequence
  Synthetic
cattattaattaattcg

SEQ ID NO: 13051 - DNA, 16 bp, Artificial sequence
  Synthetic
tgaccatatatggtca

SEQ ID NO: 13052 - DNA, 16 bp, Artificial sequence
  Synthetic
agagttatttttagag

SEQ ID NO: 13053 - DNA, 22 bp, Artificial sequence
  Synthetic
ggcgcaatgcattgtgggtaaa

SEQ ID NO: 13054 - DNA, 9 bp, Artificial sequence
  Synthetic
agagaaacc

SEQ ID NO: 13055 - DNA, 8 bp, Artificial sequence
  Synthetic
ggattaac

SEQ ID NO: 13056 - DNA, 10 bp, Artificial sequence
  Synthetic
aaggggggca

SEQ ID NO: 13057 - DNA, 17 bp, Artificial sequence
  Synthetic
aggacgctgtaaaggga

SEQ ID NO: 13058 - DNA, 9 bp, Artificial sequence
  Synthetic
cccccgggc

SEQ ID NO: 13059 - DNA, 11 bp, Artificial sequence
  Synthetic
accacttgaaa

SEQ ID NO: 13060 - DNA, 15 bp, Artificial sequence
  Synthetic
ccccgcccccgcacc

SEQ ID NO: 13061 - DNA, 10 bp, Artificial sequence
  Synthetic
accgtttaac

SEQ ID NO: 13062 - DNA, 17 bp, Artificial sequence
  Synthetic
gaaatgttgtttcagac

SEQ ID NO: 13063 - DNA, 11 bp, Artificial sequence
  Synthetic
agggagattcc

SEQ ID NO: 13064 - DNA, 14 bp, Artificial sequence
  Synthetic
ccacttccgggttc

SEQ ID NO: 13065 - DNA, 10 bp, Artificial sequence
  Synthetic
aaccaattaa

SEQ ID NO: 13066 - DNA, 16 bp, Artificial sequence
  Synthetic
gtagtaattaatggaa

SEQ ID NO: 13067 - DNA, 10 bp, Artificial sequence
  Synthetic
aggtaggtac

SEQ ID NO: 13068 - DNA, 10 bp, Artificial sequence
  Synthetic
aacacctgct

SEQ ID NO: 13069 - DNA, 15 bp, Artificial sequence
  Synthetic
gccccgccccctccc

SEQ ID NO: 13070 - DNA, 13 bp, Artificial sequence
  Synthetic
gcacgtgtcgtta

SEQ ID NO: 13071 - DNA, 10 bp, Artificial sequence
  Synthetic
aaaggtcaag

SEQ ID NO: 13072 - DNA, 12 bp, Artificial sequence
  Synthetic
gaggggggcgga

SEQ ID NO: 13073 - DNA, 12 bp, Artificial sequence
  Synthetic
cgtgtggggaaa

SEQ ID NO: 13074 - DNA, 14 bp, Artificial sequence
  Synthetic
ggggtcaaaggtca

SEQ ID NO: 13075 - DNA, 15 bp, Artificial sequence
  Synthetic
caaaagtaaacaaag

SEQ ID NO: 13076 - DNA, 9 bp, Artificial sequence
  Synthetic
ctgcccgca

SEQ ID NO: 13077 - DNA, 13 bp, Artificial sequence
  Synthetic
ccgcccccaggcc

SEQ ID NO: 13078 - DNA, 15 bp, Artificial sequence
  Synthetic
aaagatgatgcaata

SEQ ID NO: 13079 - DNA, 9 bp, Artificial sequence
  Synthetic
aagtcacgt

SEQ ID NO: 13080 - DNA, 8 bp, Artificial sequence
  Synthetic
aagcggaa

SEQ ID NO: 13081 - DNA, 9 bp, Artificial sequence
  Synthetic
aataaacaa

SEQ ID NO: 13082 - DNA, 16 bp, Artificial sequence
  Synthetic
ttaatgagctaattaa

SEQ ID NO: 13083 - DNA, 8 bp, Artificial sequence
  Synthetic
taattaaa

SEQ ID NO: 13084 - DNA, 10 bp, Artificial sequence
  Synthetic
agcagctgga

SEQ ID NO: 13085 - DNA, 10 bp, Artificial sequence
  Synthetic
ctgttctttc

SEQ ID NO: 13086 - DNA, 17 bp, Artificial sequence
  Synthetic
cggtacaccgtgtaccc

SEQ ID NO: 13087 - DNA, 10 bp, Artificial sequence
  Synthetic
aagcaattag

SEQ ID NO: 13088 - DNA, 8 bp, Artificial sequence
  Synthetic
tcacgtga

SEQ ID NO: 13089 - DNA, 15 bp, Artificial sequence
  Synthetic
gaggtcaaaaggtca

SEQ ID NO: 13090 - DNA, 13 bp, Artificial sequence
  Synthetic
ctctccctttccc

SEQ ID NO: 13091 - DNA, 10 bp, Artificial sequence
  Synthetic
accacttgaa

SEQ ID NO: 13092 - DNA, 15 bp, Artificial sequence
  Synthetic
gaggtcaaaggtcaa

SEQ ID NO: 13093 - DNA, 10 bp, Artificial sequence
  Synthetic
actacaactc

SEQ ID NO: 13094 - DNA, 9 bp, Artificial sequence
  Synthetic
caattaaaa

SEQ ID NO: 13095 - DNA, 17 bp, Artificial sequence
  Synthetic
cttcaggggtcaattga

SEQ ID NO: 13096 - DNA, 9 bp, Artificial sequence
  Synthetic
cacttgaaa

SEQ ID NO: 13097 - DNA, 10 bp, Artificial sequence
  Synthetic
ccggggggtc

SEQ ID NO: 13098 - DNA, 17 bp, Artificial sequence
  Synthetic
agaactaattagtggac

SEQ ID NO: 13099 - DNA, 8 bp, Artificial sequence
  Synthetic
aatcgata

SEQ ID NO: 13100 - DNA, 16 bp, Artificial sequence
  Synthetic
atgaatgtgcagtcat

SEQ ID NO: 13101 - DNA, 16 bp, Artificial sequence
  Synthetic
gggtcaacgagttcac

SEQ ID NO: 13102 - DNA, 14 bp, Artificial sequence
  Synthetic
aacgtgactcagca

SEQ ID NO: 13103 - DNA, 17 bp, Artificial sequence
  Synthetic
acgtatgtgcacatctg

SEQ ID NO: 13104 - DNA, 11 bp, Artificial sequence
  Synthetic
aaatcacagca

SEQ ID NO: 13105 - DNA, 10 bp, Artificial sequence
  Synthetic
aagaacaatg

SEQ ID NO: 13106 - DNA, 13 bp, Artificial sequence
  Synthetic
aagcgcgcccccg

SEQ ID NO: 13107 - DNA, 11 bp, Artificial sequence
  Synthetic
agacaagataa

SEQ ID NO: 13108 - DNA, 14 bp, Artificial sequence
  Synthetic
ttttccatggaaaa

SEQ ID NO: 13109 - DNA, 13 bp, Artificial sequence
  Synthetic
gtaaacataaaca

SEQ ID NO: 13110 - DNA, 8 bp, Artificial sequence
  Synthetic
ccatccca

SEQ ID NO: 13111 - DNA, 10 bp, Artificial sequence
  Synthetic
aaggggaagt

SEQ ID NO: 13112 - DNA, 17 bp, Artificial sequence
  Synthetic
taattaattaataatta

SEQ ID NO: 13113 - DNA, 11 bp, Artificial sequence
  Synthetic
gccacgtgacc

SEQ ID NO: 13114 - DNA, 7 bp, Artificial sequence
  Synthetic
atactta

SEQ ID NO: 13115 - DNA, 10 bp, Artificial sequence
  Synthetic
tcagaggtca

SEQ ID NO: 13116 - DNA, 8 bp, Artificial sequence
  Synthetic
caataaca

SEQ ID NO: 13117 - DNA, 10 bp, Artificial sequence
  Synthetic
aatttaaatt

SEQ ID NO: 13118 - DNA, 14 bp, Artificial sequence
  Synthetic
tggcaccatgccaa

SEQ ID NO: 13119 - DNA, 8 bp, Artificial sequence
  Synthetic
atgtttac

SEQ ID NO: 13120 - DNA, 17 bp, Artificial sequence
  Synthetic
agtagttaattagttac

SEQ ID NO: 13121 - DNA, 14 bp, Artificial sequence
  Synthetic
tatgtaaacaacaa

SEQ ID NO: 13122 - DNA, 15 bp, Artificial sequence
  Synthetic
catgtcgggacatgc

SEQ ID NO: 13123 - DNA, 17 bp, Artificial sequence
  Synthetic
agttaattattaaccaa

SEQ ID NO: 13124 - DNA, 15 bp, Artificial sequence
  Synthetic
atcaattgcagtgat

SEQ ID NO: 13125 - DNA, 11 bp, Artificial sequence
  Synthetic
ctaagtaaaca

SEQ ID NO: 13126 - DNA, 11 bp, Artificial sequence
  Synthetic
gcattaatcaa

SEQ ID NO: 13127 - DNA, 13 bp, Artificial sequence
  Synthetic
cagctcattaata

SEQ ID NO: 13128 - DNA, 9 bp, Artificial sequence
  Synthetic
aacccggcc

SEQ ID NO: 13129 - DNA, 17 bp, Artificial sequence
  Synthetic
attatttaattaattac

SEQ ID NO: 13130 - DNA, 17 bp, Artificial sequence
  Synthetic
ttcatactggagagaaa

SEQ ID NO: 13131 - DNA, 15 bp, Artificial sequence
  Synthetic
caggcgccgccgccg

SEQ ID NO: 13132 - DNA, 14 bp, Artificial sequence
  Synthetic
acattgcataatta

SEQ ID NO: 13133 - DNA, 11 bp, Artificial sequence
  Synthetic
aaacaatggaa

SEQ ID NO: 13134 - DNA, 15 bp, Artificial sequence
  Synthetic
aaatggaccaatcag

SEQ ID NO: 13135 - DNA, 17 bp, Artificial sequence
  Synthetic
cgaagtaattaattttc

SEQ ID NO: 13136 - DNA, 10 bp, Artificial sequence
  Synthetic
attccagaca

SEQ ID NO: 13137 - DNA, 10 bp, Artificial sequence
  Synthetic
acccgcatga

SEQ ID NO: 13138 - DNA, 12 bp, Artificial sequence
  Synthetic
aaatttggcaaa

SEQ ID NO: 13139 - DNA, 9 bp, Artificial sequence
  Synthetic
attgcgaaa

SEQ ID NO: 13140 - DNA, 13 bp, Artificial sequence
  Synthetic
gattgtttattta

SEQ ID NO: 13141 - DNA, 10 bp, Artificial sequence
  Synthetic
cgaataggga

SEQ ID NO: 13142 - DNA, 8 bp, Artificial sequence
  Synthetic
aagtgcga

SEQ ID NO: 13143 - DNA, 9 bp, Artificial sequence
  Synthetic
acctgcagg

SEQ ID NO: 13144 - DNA, 15 bp, Artificial sequence
  Synthetic
accgcctgaggggat

SEQ ID NO: 13145 - DNA, 16 bp, Artificial sequence
  Synthetic
ctattttacgacttta

SEQ ID NO: 13146 - DNA, 12 bp, Artificial sequence
  Synthetic
accctcgaaccc

SEQ ID NO: 13147 - DNA, 10 bp, Artificial sequence
  Synthetic
aagcacttaa

SEQ ID NO: 13148 - DNA, 10 bp, Artificial sequence
  Synthetic
cacttccggc

SEQ ID NO: 13149 - DNA, 12 bp, Artificial sequence
  Synthetic
taattgcaatca

SEQ ID NO: 13150 - DNA, 18 bp, Artificial sequence
  Synthetic
cgtcacgcttgactgctc

SEQ ID NO: 13151 - DNA, 6 bp, Artificial sequence
  Synthetic
taataa

SEQ ID NO: 13152 - DNA, 15 bp, Artificial sequence
  Synthetic
aataagggcgtggtc

SEQ ID NO: 13153 - DNA, 16 bp, Artificial sequence
  Synthetic
taattagcgctaatta

SEQ ID NO: 13154 - DNA, 11 bp, Artificial sequence
  Synthetic
ccccccgcctc

SEQ ID NO: 13155 - DNA, 19 bp, Artificial sequence
  Synthetic
taactaggttagtaggtca

SEQ ID NO: 13156 - DNA, 17 bp, Artificial sequence
  Synthetic
aaggcgaaatcatcgca

SEQ ID NO: 13157 - DNA, 7 bp, Artificial sequence
  Synthetic
atcaaag

SEQ ID NO: 13158 - DNA, 8 bp, Artificial sequence
  Synthetic
tcataaaa

SEQ ID NO: 13159 - DNA, 5 bp, Artificial sequence
  Synthetic
tgaca

SEQ ID NO: 13160 - DNA, 9 bp, Artificial sequence
  Synthetic
atttgcata

SEQ ID NO: 13161 - DNA, 16 bp, Artificial sequence
  Synthetic
gagttcatcgggttca

SEQ ID NO: 13162 - DNA, 10 bp, Artificial sequence
  Synthetic
cctcaggcga

SEQ ID NO: 13163 - DNA, 13 bp, Artificial sequence
  Synthetic
attttgcaatctg

SEQ ID NO: 13164 - DNA, 8 bp, Artificial sequence
  Synthetic
accacgtg

SEQ ID NO: 13165 - DNA, 9 bp, Artificial sequence
  Synthetic
atgactcaa

SEQ ID NO: 13166 - DNA, 6 bp, Artificial sequence
  Synthetic
atccac

SEQ ID NO: 13167 - DNA, 12 bp, Artificial sequence
  Synthetic
aaagcaattaag

SEQ ID NO: 13168 - DNA, 8 bp, Artificial sequence
  Synthetic
gctaatta

SEQ ID NO: 13169 - DNA, 9 bp, Artificial sequence
  Synthetic
atgactcat

SEQ ID NO: 13170 - DNA, 12 bp, Artificial sequence
  Synthetic
aatgcgggtgtg

SEQ ID NO: 13171 - DNA, 18 bp, Artificial sequence
  Synthetic
ttataaataaacattcaa

SEQ ID NO: 13172 - DNA, 9 bp, Artificial sequence
  Synthetic
aagcggaag

SEQ ID NO: 13173 - DNA, 11 bp, Artificial sequence
  Synthetic
gaatttatacc

SEQ ID NO: 13174 - DNA, 9 bp, Artificial sequence
  Synthetic
accacctgg

SEQ ID NO: 13175 - DNA, 17 bp, Artificial sequence
  Synthetic
tacatgtgcacataaaa

SEQ ID NO: 13176 - DNA, 20 bp, Artificial sequence
  Synthetic
gatttcccatcatgccttgc

SEQ ID NO: 13177 - DNA, 9 bp, Artificial sequence
  Synthetic
cgataatga

SEQ ID NO: 13178 - DNA, 16 bp, Artificial sequence
  Synthetic
aggttaattgagtaaa

SEQ ID NO: 13179 - DNA, 9 bp, Artificial sequence
  Synthetic
ccacgccca

SEQ ID NO: 13180 - DNA, 9 bp, Artificial sequence
  Synthetic
taggccaca

SEQ ID NO: 13181 - DNA, 9 bp, Artificial sequence
  Synthetic
ggataatcc

SEQ ID NO: 13182 - DNA, 11 bp, Artificial sequence
  Synthetic
gggataatccc

SEQ ID NO: 13183 - DNA, 8 bp, Artificial sequence
  Synthetic
aaacgtag

SEQ ID NO: 13184 - DNA, 9 bp, Artificial sequence
  Synthetic
attgttttg

SEQ ID NO: 13185 - DNA, 9 bp, Artificial sequence
  Synthetic
attgtttta

SEQ ID NO: 13186 - DNA, 21 bp, Artificial sequence
  Synthetic
cgccatcttggatgagggcag

SEQ ID NO: 13187 - DNA, 14 bp, Artificial sequence
  Synthetic
agaaagttctagaa

SEQ ID NO: 13188 - DNA, 13 bp, Artificial sequence
  Synthetic
cacttttaattag

SEQ ID NO: 13189 - DNA, 15 bp, Artificial sequence
  Synthetic
atgctaaaaatagaa

SEQ ID NO: 13190 - DNA, 11 bp, Artificial sequence
  Synthetic
cgatgacgtca

SEQ ID NO: 13191 - DNA, 11 bp, Artificial sequence
  Synthetic
acccggaagta

SEQ ID NO: 13192 - DNA, 13 bp, Artificial sequence
  Synthetic
ggccataaatcac

SEQ ID NO: 13193 - DNA, 11 bp, Artificial sequence
  Synthetic
acccggaagtg

SEQ ID NO: 13194 - DNA, 14 bp, Artificial sequence
  Synthetic
taattggccaatta

SEQ ID NO: 13195 - DNA, 8 bp, Artificial sequence
  Synthetic
ccacgtgg

SEQ ID NO: 13196 - DNA, 13 bp, Artificial sequence
  Synthetic
gaaacctctggaa

SEQ ID NO: 13197 - DNA, 10 bp, Artificial sequence
  Synthetic
attgttctgc

SEQ ID NO: 13198 - DNA, 20 bp, Artificial sequence
  Synthetic
catttccgaattgggaaaca

SEQ ID NO: 13199 - DNA, 10 bp, Artificial sequence
  Synthetic
tcaagtggga

SEQ ID NO: 13200 - DNA, 9 bp, Artificial sequence
  Synthetic
aacaggtgt

SEQ ID NO: 13201 - DNA, 14 bp, Artificial sequence
  Synthetic
aggggaatttcccc

SEQ ID NO: 13202 - DNA, 8 bp, Artificial sequence
  Synthetic
cggattaa

SEQ ID NO: 13203 - DNA, 15 bp, Artificial sequence
  Synthetic
gtttgttttgccaga

SEQ ID NO: 13204 - DNA, 10 bp, Artificial sequence
  Synthetic
accggaagta

SEQ ID NO: 13205 - DNA, 17 bp, Artificial sequence
  Synthetic
caaagctaattagttta

SEQ ID NO: 13206 - DNA, 16 bp, Artificial sequence
  Synthetic
agttattaatgaggtc

SEQ ID NO: 13207 - DNA, 10 bp, Artificial sequence
  Synthetic
accggaagtg

SEQ ID NO: 13208 - DNA, 7 bp, Artificial sequence
  Synthetic
tgactca

SEQ ID NO: 13209 - DNA, 16 bp, Artificial sequence
  Synthetic
gcctgaactggccaga

SEQ ID NO: 13210 - DNA, 7 bp, Artificial sequence
  Synthetic
gcaatta

SEQ ID NO: 13211 - DNA, 20 bp, Artificial sequence
  Synthetic
accgggtcacgtgcagaagc

SEQ ID NO: 13212 - DNA, 15 bp, Artificial sequence
  Synthetic
aggacccggaagtaa

SEQ ID NO: 13213 - DNA, 15 bp, Artificial sequence
  Synthetic
ggcaccagctgcgcc

SEQ ID NO: 13214 - DNA, 10 bp, Artificial sequence
  Synthetic
catccatcaa

SEQ ID NO: 13215 - DNA, 12 bp, Artificial sequence
  Synthetic
atgaatatgcaa

SEQ ID NO: 13216 - DNA, 6 bp, Artificial sequence
  Synthetic
cgcgcc

SEQ ID NO: 13217 - DNA, 10 bp, Artificial sequence
  Synthetic
ttcccggaaa

SEQ ID NO: 13218 - DNA, 7 bp, Artificial sequence
  Synthetic
acaacac

SEQ ID NO: 13219 - DNA, 12 bp, Artificial sequence
  Synthetic
aaccacttcctg

SEQ ID NO: 13220 - DNA, 14 bp, Artificial sequence
  Synthetic
agtttcggtttcgg

SEQ ID NO: 13221 - DNA, 14 bp, Artificial sequence
  Synthetic
agtttcggtttcga

SEQ ID NO: 13222 - DNA, 7 bp, Artificial sequence
  Synthetic
attaata

SEQ ID NO: 13223 - DNA, 25 bp, Artificial sequence
  Synthetic
aacagatggtcgcccaaccactgga

SEQ ID NO: 13224 - DNA, 10 bp, Artificial sequence
  Synthetic
aatattgaca

SEQ ID NO: 13225 - DNA, 10 bp, Artificial sequence
  Synthetic
aaggggcggg

SEQ ID NO: 13226 - DNA, 11 bp, Artificial sequence
  Synthetic
ccacgtgatcc

SEQ ID NO: 13227 - DNA, 12 bp, Artificial sequence
  Synthetic
cattgcgtcagg

SEQ ID NO: 13228 - DNA, 13 bp, Artificial sequence
  Synthetic
ggccccgcccccc

SEQ ID NO: 13229 - DNA, 11 bp, Artificial sequence
  Synthetic
tctcgtaaaaa

SEQ ID NO: 13230 - DNA, 8 bp, Artificial sequence
  Synthetic
ccttatca

SEQ ID NO: 13231 - DNA, 10 bp, Artificial sequence
  Synthetic
ccagatgtca

SEQ ID NO: 13232 - DNA, 14 bp, Artificial sequence
  Synthetic
aacgtaaacaacat

SEQ ID NO: 13233 - DNA, 17 bp, Artificial sequence
  Synthetic
atcttcttatcagttta

SEQ ID NO: 13234 - DNA, 16 bp, Artificial sequence
  Synthetic
accgttaaaaccgtta

SEQ ID NO: 13235 - DNA, 13 bp, Artificial sequence
  Synthetic
cccccgcccccgc

SEQ ID NO: 13236 - DNA, 16 bp, Artificial sequence
  Synthetic
aaattattgttcttaa

SEQ ID NO: 13237 - DNA, 7 bp, Artificial sequence
  Synthetic
cacctgg

SEQ ID NO: 13238 - DNA, 18 bp, Artificial sequence
  Synthetic
ggtgtgaaatttcacacc

SEQ ID NO: 13239 - DNA, 12 bp, Artificial sequence
  Synthetic
tttcccgccaaa

SEQ ID NO: 13240 - DNA, 8 bp, Artificial sequence
  Synthetic
cacctgtc

SEQ ID NO: 13241 - DNA, 11 bp, Artificial sequence
  Synthetic
agccaatcagc

SEQ ID NO: 13242 - DNA, 9 bp, Artificial sequence
  Synthetic
gtgacgtaa

SEQ ID NO: 13243 - DNA, 12 bp, Artificial sequence
  Synthetic
ggtgacgtaacc

SEQ ID NO: 13244 - DNA, 14 bp, Artificial sequence
  Synthetic
caccagggggcagc

SEQ ID NO: 13245 - DNA, 17 bp, Artificial sequence
  Synthetic
atagttaatccccctca

SEQ ID NO: 13246 - DNA, 12 bp, Artificial sequence
  Synthetic
gtaaacaataga

SEQ ID NO: 13247 - DNA, 10 bp, Artificial sequence
  Synthetic
aactctcgcg

SEQ ID NO: 13248 - DNA, 11 bp, Artificial sequence
  Synthetic
agtcgtaaaaa

SEQ ID NO: 13249 - DNA, 9 bp, Artificial sequence
  Synthetic
aaatgctga

SEQ ID NO: 13250 - DNA, 17 bp, Artificial sequence
  Synthetic
tgcactaattagtggaa

SEQ ID NO: 13251 - DNA, 17 bp, Artificial sequence
  Synthetic
aatcaataacattgatc

SEQ ID NO: 13252 - DNA, 9 bp, Artificial sequence
  Synthetic
aaaacaaaa

SEQ ID NO: 13253 - DNA, 15 bp, Artificial sequence
  Synthetic
gggggggggggggga

SEQ ID NO: 13254 - DNA, 24 bp, Artificial sequence
  Synthetic
attggccagcgtggctgtcagtca

SEQ ID NO: 13255 - DNA, 12 bp, Artificial sequence
  Synthetic
agtgggcgtggc

SEQ ID NO: 13256 - DNA, 10 bp, Artificial sequence
  Synthetic
aaaccggata

SEQ ID NO: 13257 - DNA, 10 bp, Artificial sequence
  Synthetic
aaggtgacct

SEQ ID NO: 13258 - DNA, 11 bp, Artificial sequence
  Synthetic
ggccataaaaa

SEQ ID NO: 13259 - DNA, 15 bp, Artificial sequence
  Synthetic
aaccacctgttgctc

SEQ ID NO: 13260 - DNA, 9 bp, Artificial sequence
  Synthetic
agcgattaa

SEQ ID NO: 13261 - DNA, 10 bp, Artificial sequence
  Synthetic
agggttcaaa

SEQ ID NO: 13262 - DNA, 11 bp, Artificial sequence
  Synthetic
tatgaccttga

SEQ ID NO: 13263 - DNA, 14 bp, Artificial sequence
  Synthetic
ctgacctggaactc

SEQ ID NO: 13264 - DNA, 18 bp, Artificial sequence
  Synthetic
aggtcagggtgacctgga

SEQ ID NO: 13265 - DNA, 10 bp, Artificial sequence
  Synthetic
ccaaatcggg

SEQ ID NO: 13266 - DNA, 20 bp, Artificial sequence
  Synthetic
ccccggccccgccccccccc

SEQ ID NO: 13267 - DNA, 12 bp, Artificial sequence
  Synthetic
tgcccccgggca

SEQ ID NO: 13268 - DNA, 8 bp, Artificial sequence
  Synthetic
acttcctg

SEQ ID NO: 13269 - DNA, 15 bp, Artificial sequence
  Synthetic
accgcctcaggcggt

SEQ ID NO: 13270 - DNA, 8 bp, Artificial sequence
  Synthetic
acttcctc

SEQ ID NO: 13271 - DNA, 14 bp, Artificial sequence
  Synthetic
aaagtcaaaagtca

SEQ ID NO: 13272 - DNA, 11 bp, Artificial sequence
  Synthetic
tcaagcgtgaa

SEQ ID NO: 13273 - DNA, 17 bp, Artificial sequence
  Synthetic
tatagatcaaaggaaaa

SEQ ID NO: 13274 - DNA, 20 bp, Artificial sequence
  Synthetic
cattcctgagggatgactta

SEQ ID NO: 13275 - DNA, 10 bp, Artificial sequence
  Synthetic
actgtatcaa

SEQ ID NO: 13276 - DNA, 13 bp, Artificial sequence
  Synthetic
ctgacctctggcc

SEQ ID NO: 13277 - DNA, 13 bp, Artificial sequence
  Synthetic
aaaagtaggtcag

SEQ ID NO: 13278 - DNA, 11 bp, Artificial sequence
  Synthetic
ttcaaggtcaa

SEQ ID NO: 13279 - DNA, 9 bp, Artificial sequence
  Synthetic
atcagctgg

SEQ ID NO: 13280 - DNA, 7 bp, Artificial sequence
  Synthetic
tacgtca

SEQ ID NO: 13281 - DNA, 13 bp, Artificial sequence
  Synthetic
cttccaaaatgac

SEQ ID NO: 13282 - DNA, 10 bp, Artificial sequence
  Synthetic
ggaaattccc

SEQ ID NO: 13283 - DNA, 11 bp, Artificial sequence
  Synthetic
ataaggaagta

SEQ ID NO: 13284 - DNA, 9 bp, Artificial sequence
  Synthetic
atcagctga

SEQ ID NO: 13285 - DNA, 14 bp, Artificial sequence
  Synthetic
atgaataattaatg

SEQ ID NO: 13286 - DNA, 8 bp, Artificial sequence
  Synthetic
atttcctg

SEQ ID NO: 13287 - DNA, 14 bp, Artificial sequence
  Synthetic
aatgccacgtcatc

SEQ ID NO: 13288 - DNA, 10 bp, Artificial sequence
  Synthetic
attatttatg

SEQ ID NO: 13289 - DNA, 8 bp, Artificial sequence
  Synthetic
aattaatc

SEQ ID NO: 13290 - DNA, 9 bp, Artificial sequence
  Synthetic
ccattgttc

SEQ ID NO: 13291 - DNA, 17 bp, Artificial sequence
  Synthetic
catgaataccattcatc

SEQ ID NO: 13292 - DNA, 17 bp, Artificial sequence
  Synthetic
tcccactaattagcgca

SEQ ID NO: 13293 - DNA, 12 bp, Artificial sequence
  Synthetic
gaaataattacc

SEQ ID NO: 13294 - DNA, 9 bp, Artificial sequence
  Synthetic
caccccctg

SEQ ID NO: 13295 - DNA, 15 bp, Artificial sequence
  Synthetic
gcacccctgggtgcc

SEQ ID NO: 13296 - DNA, 11 bp, Artificial sequence
  Synthetic
agatgcttatc

SEQ ID NO: 13297 - DNA, 10 bp, Artificial sequence
  Synthetic
gggaatcccc

SEQ ID NO: 13298 - DNA, 18 bp, Artificial sequence
  Synthetic
ggcgccccctggtggcca

SEQ ID NO: 13299 - DNA, 11 bp, Artificial sequence
  Synthetic
taattagctaa

SEQ ID NO: 13300 - DNA, 16 bp, Artificial sequence
  Synthetic
acgttaattaacccag

SEQ ID NO: 13301 - DNA, 10 bp, Artificial sequence
  Synthetic
acttccggtc

SEQ ID NO: 13302 - DNA, 10 bp, Artificial sequence
  Synthetic
atgagtcacc

SEQ ID NO: 13303 - DNA, 10 bp, Artificial sequence
  Synthetic
cttaattacc

SEQ ID NO: 13304 - DNA, 15 bp, Artificial sequence
  Synthetic
cccccgcccacgcac

SEQ ID NO: 13305 - DNA, 17 bp, Artificial sequence
  Synthetic
aattttcaagtggttaa

SEQ ID NO: 13306 - DNA, 9 bp, Artificial sequence
  Synthetic
acacctgct

SEQ ID NO: 13307 - DNA, 15 bp, Artificial sequence
  Synthetic
ataatccgggaccac

SEQ ID NO: 13308 - DNA, 17 bp, Artificial sequence
  Synthetic
gtcggtaattatagcga

SEQ ID NO: 13309 - DNA, 26 bp, Artificial sequence
  Synthetic
atttaaccattataaccaattaataa

SEQ ID NO: 13310 - DNA, 15 bp, Artificial sequence
  Synthetic
catggagttttccac

SEQ ID NO: 13311 - DNA, 17 bp, Artificial sequence
  Synthetic
aaaatatgcataataaa

SEQ ID NO: 13312 - DNA, 10 bp, Artificial sequence
  Synthetic
aacacctgtg

SEQ ID NO: 13313 - DNA, 12 bp, Artificial sequence
  Synthetic
ccgctcagccgc

SEQ ID NO: 13314 - DNA, 9 bp, Artificial sequence
  Synthetic
ccacttgag

SEQ ID NO: 13315 - DNA, 14 bp, Artificial sequence
  Synthetic
cagggtcagagcgg

SEQ ID NO: 13316 - DNA, 18 bp, Artificial sequence
  Synthetic
aaaggtcaccagaggtca

SEQ ID NO: 13317 - DNA, 13 bp, Artificial sequence
  Synthetic
atatagaacattc

SEQ ID NO: 13318 - DNA, 18 bp, Artificial sequence
  Synthetic
ccttatctgcccccccca

SEQ ID NO: 13319 - DNA, 15 bp, Artificial sequence
  Synthetic
cccctcccccacccc

SEQ ID NO: 13320 - DNA, 11 bp, Artificial sequence
  Synthetic
aattgtgcaat

SEQ ID NO: 13321 - DNA, 12 bp, Artificial sequence
  Synthetic
aaaacgattata

SEQ ID NO: 13322 - DNA, 7 bp, Artificial sequence
  Synthetic
cattaac

SEQ ID NO: 13323 - DNA, 14 bp, Artificial sequence
  Synthetic
cgatgacgtcatcg

SEQ ID NO: 13324 - DNA, 10 bp, Artificial sequence
  Synthetic
cctaattacc

SEQ ID NO: 13325 - DNA, 12 bp, Artificial sequence
  Synthetic
gggtcatgaccc

SEQ ID NO: 13326 - DNA, 13 bp, Artificial sequence
  Synthetic
gacttttctggga

SEQ ID NO: 13327 - DNA, 18 bp, Artificial sequence
  Synthetic
ctggggggggcagataag

SEQ ID NO: 13328 - DNA, 18 bp, Artificial sequence
  Synthetic
ctggtgggggcagataag

SEQ ID NO: 13329 - DNA, 10 bp, Artificial sequence
  Synthetic
tgagtcatca

SEQ ID NO: 13330 - DNA, 18 bp, Artificial sequence
  Synthetic
ccttccttccttccttcc

SEQ ID NO: 13331 - DNA, 14 bp, Artificial sequence
  Synthetic
gggtcacgtgtcca

SEQ ID NO: 13332 - DNA, 11 bp, Artificial sequence
  Synthetic
accccgccccc

SEQ ID NO: 13333 - DNA, 10 bp, Artificial sequence
  Synthetic
agcgtgaccg

SEQ ID NO: 13334 - DNA, 13 bp, Artificial sequence
  Synthetic
cttttctgggaaa

SEQ ID NO: 13335 - DNA, 12 bp, Artificial sequence
  Synthetic
aaattgtgcaat

SEQ ID NO: 13336 - DNA, 9 bp, Artificial sequence
  Synthetic
gtacgtgac

SEQ ID NO: 13337 - DNA, 16 bp, Artificial sequence
  Synthetic
taaccgcaaaccgcaa

SEQ ID NO: 13338 - DNA, 17 bp, Artificial sequence
  Synthetic
aattaattaattaattc

SEQ ID NO: 13339 - DNA, 17 bp, Artificial sequence
  Synthetic
ccgctcccagcggctgc

SEQ ID NO: 13340 - DNA, 8 bp, Artificial sequence
  Synthetic
catcaatc

SEQ ID NO: 13341 - DNA, 11 bp, Artificial sequence
  Synthetic
atcagctggtc

SEQ ID NO: 13342 - DNA, 15 bp, Artificial sequence
  Synthetic
ccctgacctttgccc

SEQ ID NO: 13343 - DNA, 13 bp, Artificial sequence
  Synthetic
agagggggcccta

SEQ ID NO: 13344 - DNA, 15 bp, Artificial sequence
  Synthetic
agtacttccgggtca

SEQ ID NO: 13345 - DNA, 10 bp, Artificial sequence
  Synthetic
acgcgtgacg

SEQ ID NO: 13346 - DNA, 10 bp, Artificial sequence
  Synthetic
agatttgaat

SEQ ID NO: 13347 - DNA, 6 bp, Artificial sequence
  Synthetic
accaca

SEQ ID NO: 13348 - DNA, 17 bp, Artificial sequence
  Synthetic
taaagaacaatagataa

SEQ ID NO: 13349 - DNA, 12 bp, Artificial sequence
  Synthetic
catgactcagac

SEQ ID NO: 13350 - DNA, 8 bp, Artificial sequence
  Synthetic
aacaaagg

SEQ ID NO: 13351 - DNA, 11 bp, Artificial sequence
  Synthetic
gatgactcatc

SEQ ID NO: 13352 - DNA, 21 bp, Artificial sequence
  Synthetic
aaatttcgtcacggttaaggt

SEQ ID NO: 13353 - DNA, 16 bp, Artificial sequence
  Synthetic
cgttaccatggcaacg

SEQ ID NO: 13354 - DNA, 15 bp, Artificial sequence
  Synthetic
tctcgatatgactca

SEQ ID NO: 13355 - DNA, 18 bp, Artificial sequence
  Synthetic
tgaccgccagtgacccca

SEQ ID NO: 13356 - DNA, 8 bp, Artificial sequence
  Synthetic
ggttgcca

SEQ ID NO: 13357 - DNA, 14 bp, Artificial sequence
  Synthetic
gctgtggttttccc

SEQ ID NO: 13358 - DNA, 14 bp, Artificial sequence
  Synthetic
gcacccaagggtgc

SEQ ID NO: 13359 - DNA, 13 bp, Artificial sequence
  Synthetic
tgcccccggggca

SEQ ID NO: 13360 - DNA, 15 bp, Artificial sequence
  Synthetic
agcctcagggcatgg

SEQ ID NO: 13361 - DNA, 12 bp, Artificial sequence
  Synthetic
ggtcaaaggtca

SEQ ID NO: 13362 - DNA, 18 bp, Artificial sequence
  Synthetic
cccccggctagcgtgaga

SEQ ID NO: 13363 - DNA, 8 bp, Artificial sequence
  Synthetic
caatatcg

SEQ ID NO: 13364 - DNA, 10 bp, Artificial sequence
  Synthetic
ccatagcaac

SEQ ID NO: 13365 - DNA, 14 bp, Artificial sequence
  Synthetic
tgagtaaacaaaaa

SEQ ID NO: 13366 - DNA, 11 bp, Artificial sequence
  Synthetic
gcaggaaatga

SEQ ID NO: 13367 - DNA, 8 bp, Artificial sequence
  Synthetic
agagttca

SEQ ID NO: 13368 - DNA, 9 bp, Artificial sequence
  Synthetic
taggataga

SEQ ID NO: 13369 - DNA, 10 bp, Artificial sequence
  Synthetic
cggaagtcgc

SEQ ID NO: 13370 - DNA, 17 bp, Artificial sequence
  Synthetic
cacaattaattaacgcg

SEQ ID NO: 13371 - DNA, 15 bp, Artificial sequence
  Synthetic
gttaatccgattaac

SEQ ID NO: 13372 - DNA, 14 bp, Artificial sequence
  Synthetic
agccttggggaggg

SEQ ID NO: 13373 - DNA, 8 bp, Artificial sequence
  Synthetic
ataattgc

SEQ ID NO: 13374 - DNA, 8 bp, Artificial sequence
  Synthetic
ataattgg

SEQ ID NO: 13375 - DNA, 16 bp, Artificial sequence
  Synthetic
gccatccaaaatgaac

SEQ ID NO: 13376 - DNA, 11 bp, Artificial sequence
  Synthetic
attgcacaata

SEQ ID NO: 13377 - DNA, 14 bp, Artificial sequence
  Synthetic
tcgtaaaactgtca

SEQ ID NO: 13378 - DNA, 17 bp, Artificial sequence
  Synthetic
ggccgttataaccgtta

SEQ ID NO: 13379 - DNA, 16 bp, Artificial sequence
  Synthetic
aaattaattggttttg

SEQ ID NO: 13380 - DNA, 17 bp, Artificial sequence
  Synthetic
agaagaacaaaggacta

SEQ ID NO: 13381 - DNA, 10 bp, Artificial sequence
  Synthetic
ccacgtgctc

SEQ ID NO: 13382 - DNA, 8 bp, Artificial sequence
  Synthetic
ggagttca

SEQ ID NO: 13383 - DNA, 12 bp, Artificial sequence
  Synthetic
cgcccccccccc

SEQ ID NO: 13384 - DNA, 12 bp, Artificial sequence
  Synthetic
acatcaatcaaa

SEQ ID NO: 13385 - DNA, 12 bp, Artificial sequence
  Synthetic
gtctttctagaa

SEQ ID NO: 13386 - DNA, 10 bp, Artificial sequence
  Synthetic
cagataagaa

SEQ ID NO: 13387 - DNA, 11 bp, Artificial sequence
  Synthetic
accaattaaaa

SEQ ID NO: 13388 - DNA, 17 bp, Artificial sequence
  Synthetic
caagttaattaataatc

SEQ ID NO: 13389 - DNA, 9 bp, Artificial sequence
  Synthetic
cctggttaa

SEQ ID NO: 13390 - DNA, 8 bp, Artificial sequence
  Synthetic
ccgcgcgc

SEQ ID NO: 13391 - DNA, 15 bp, Artificial sequence
  Synthetic
aaaaacggattattg

SEQ ID NO: 13392 - DNA, 9 bp, Artificial sequence
  Synthetic
actagaggg

SEQ ID NO: 13393 - DNA, 7 bp, Artificial sequence
  Synthetic
ctgtcac

SEQ ID NO: 13394 - DNA, 17 bp, Artificial sequence
  Synthetic
aatcaatttcagtgatt

SEQ ID NO: 13395 - DNA, 7 bp, Artificial sequence
  Synthetic
ctgtcaa

SEQ ID NO: 13396 - DNA, 13 bp, Artificial sequence
  Synthetic
tgccctcagggca

SEQ ID NO: 13397 - DNA, 7 bp, Artificial sequence
  Synthetic
ggtatca

SEQ ID NO: 13398 - DNA, 9 bp, Artificial sequence
  Synthetic
cgctaatta

SEQ ID NO: 13399 - DNA, 11 bp, Artificial sequence
  Synthetic
tcctgtttaca

SEQ ID NO: 13400 - DNA, 7 bp, Artificial sequence
  Synthetic
tggaaaa

SEQ ID NO: 13401 - DNA, 20 bp, Artificial sequence
  Synthetic
ataaaaaacaacacaaataa

SEQ ID NO: 13402 - DNA, 10 bp, Artificial sequence
  Synthetic
ctaattaaga

SEQ ID NO: 13403 - DNA, 18 bp, Artificial sequence
  Synthetic
aattttggcgccaaaatg

SEQ ID NO: 13404 - DNA, 12 bp, Artificial sequence
  Synthetic
caacgtccgcgg

SEQ ID NO: 13405 - DNA, 15 bp, Artificial sequence
  Synthetic
ccgggccacgtgacc

SEQ ID NO: 13406 - DNA, 8 bp, Artificial sequence
  Synthetic
acttccgg

SEQ ID NO: 13407 - DNA, 10 bp, Artificial sequence
  Synthetic
ccccaccccc

SEQ ID NO: 13408 - DNA, 16 bp, Artificial sequence
  Synthetic
aaggtaattacctaat

SEQ ID NO: 13409 - DNA, 15 bp, Artificial sequence
  Synthetic
gatgagtcacccccc

SEQ ID NO: 13410 - DNA, 16 bp, Artificial sequence
  Synthetic
acgactaattaggagt

SEQ ID NO: 13411 - DNA, 19 bp, Artificial sequence
  Synthetic
gcggacgttcaacgtccgc

SEQ ID NO: 13412 - DNA, 12 bp, Artificial sequence
  Synthetic
cgggtgacgtcc

SEQ ID NO: 13413 - DNA, 12 bp, Artificial sequence
  Synthetic
ccgattttttcc

SEQ ID NO: 13414 - DNA, 12 bp, Artificial sequence
  Synthetic
aatgtaaacata

SEQ ID NO: 13415 - DNA, 8 bp, Artificial sequence
  Synthetic
gcgcgaaa

SEQ ID NO: 13416 - DNA, 17 bp, Artificial sequence
  Synthetic
gcccccacctccccgcc

SEQ ID NO: 13417 - DNA, 16 bp, Artificial sequence
  Synthetic
agcaccatggacagcg

SEQ ID NO: 13418 - DNA, 12 bp, Artificial sequence
  Synthetic
agatgcaatccc

SEQ ID NO: 13419 - DNA, 16 bp, Artificial sequence
  Synthetic
ctgtccatggtgctga

SEQ ID NO: 13420 - DNA, 11 bp, Artificial sequence
  Synthetic
attttacgacc

SEQ ID NO: 13421 - DNA, 23 bp, Artificial sequence
  Synthetic
tcttttaatttgcataatcataa

SEQ ID NO: 13422 - DNA, 16 bp, Artificial sequence
  Synthetic
gcccactagagggcac

SEQ ID NO: 13423 - DNA, 18 bp, Artificial sequence
  Synthetic
ggtatttggcaatgcaca

SEQ ID NO: 13424 - DNA, 6 bp, Artificial sequence
  Synthetic
ggggca

SEQ ID NO: 13425 - DNA, 7 bp, Artificial sequence
  Synthetic
gtaaaca

SEQ ID NO: 13426 - DNA, 9 bp, Artificial sequence
  Synthetic
gaccaccca

SEQ ID NO: 13427 - DNA, 17 bp, Artificial sequence
  Synthetic
ataaatgacacctatca

SEQ ID NO: 13428 - DNA, 9 bp, Artificial sequence
  Synthetic
gaccacccc

SEQ ID NO: 13429 - DNA, 12 bp, Artificial sequence
  Synthetic
cgcccgccggcg

SEQ ID NO: 13430 - DNA, 14 bp, Artificial sequence
  Synthetic
catttacataaaca

SEQ ID NO: 13431 - DNA, 11 bp, Artificial sequence
  Synthetic
aagtaattact

SEQ ID NO: 13432 - DNA, 17 bp, Artificial sequence
  Synthetic
gaattttaattaaaccc

SEQ ID NO: 13433 - DNA, 15 bp, Artificial sequence
  Synthetic
atttctcaggaaatg

SEQ ID NO: 13434 - DNA, 18 bp, Artificial sequence
  Synthetic
gaggggtgcccgcaggcc

SEQ ID NO: 13435 - DNA, 7 bp, Artificial sequence
  Synthetic
aagtgaa

SEQ ID NO: 13436 - DNA, 16 bp, Artificial sequence
  Synthetic
accaagtaattcctag

SEQ ID NO: 13437 - DNA, 9 bp, Artificial sequence
  Synthetic
cacacctgg

SEQ ID NO: 13438 - DNA, 17 bp, Artificial sequence
  Synthetic
gaggggggcggggctaa

SEQ ID NO: 13439 - DNA, 18 bp, Artificial sequence
  Synthetic
gtgacctcataaggtcac

SEQ ID NO: 13440 - DNA, 17 bp, Artificial sequence
  Synthetic
tacactaattagtggca

SEQ ID NO: 13441 - DNA, 14 bp, Artificial sequence
  Synthetic
aaccacaacacata

SEQ ID NO: 13442 - DNA, 7 bp, Artificial sequence
  Synthetic
aatgata

SEQ ID NO: 13443 - DNA, 8 bp, Artificial sequence
  Synthetic
aggaagtc

SEQ ID NO: 13444 - DNA, 8 bp, Artificial sequence
  Synthetic
caggaagg

SEQ ID NO: 13445 - DNA, 14 bp, Artificial sequence
  Synthetic
gaaagtgaaagtga

SEQ ID NO: 13446 - DNA, 7 bp, Artificial sequence
  Synthetic
agcaaac

SEQ ID NO: 13447 - DNA, 8 bp, Artificial sequence
  Synthetic
aaattcct

SEQ ID NO: 13448 - DNA, 11 bp, Artificial sequence
  Synthetic
tctcacctgaa

SEQ ID NO: 13449 - DNA, 21 bp, Artificial sequence
  Synthetic
cccggcgccccctggtggccg

SEQ ID NO: 13450 - DNA, 17 bp, Artificial sequence
  Synthetic
gggaacacggtgtaccc

SEQ ID NO: 13451 - DNA, 9 bp, Artificial sequence
  Synthetic
gaaaaaatc

SEQ ID NO: 13452 - DNA, 18 bp, Artificial sequence
  Synthetic
gcaattaaaaaccaatta

SEQ ID NO: 13453 - DNA, 6 bp, Artificial sequence
  Synthetic
tgccaa

SEQ ID NO: 13454 - DNA, 11 bp, Artificial sequence
  Synthetic
cactgacgtca

SEQ ID NO: 13455 - DNA, 15 bp, Artificial sequence
  Synthetic
ccccgggcacccggg

SEQ ID NO: 13456 - DNA, 10 bp, Artificial sequence
  Synthetic
attaattaat

SEQ ID NO: 13457 - DNA, 13 bp, Artificial sequence
  Synthetic
acctcattacgag

SEQ ID NO: 13458 - DNA, 19 bp, Artificial sequence
  Synthetic
caaaagcaatcaaccgtga

SEQ ID NO: 13459 - DNA, 10 bp, Artificial sequence
  Synthetic
cgttgctaag

SEQ ID NO: 13460 - DNA, 18 bp, Artificial sequence
  Synthetic
gtgacctacttcctggca

SEQ ID NO: 13461 - DNA, 11 bp, Artificial sequence
  Synthetic
ccggaagtggc

SEQ ID NO: 13462 - DNA, 14 bp, Artificial sequence
  Synthetic
catgcatatgcaaa

SEQ ID NO: 13463 - DNA, 16 bp, Artificial sequence
  Synthetic
ggtgtgatatcacacc

SEQ ID NO: 13464 - DNA, 22 bp, Artificial sequence
  Synthetic
gaggggcgcagctgcgccccaa

SEQ ID NO: 13465 - DNA, 18 bp, Artificial sequence
  Synthetic
aggacaaagttcacttga

SEQ ID NO: 13466 - DNA, 14 bp, Artificial sequence
  Synthetic
aaatggcgccattt

SEQ ID NO: 13467 - DNA, 15 bp, Artificial sequence
  Synthetic
tgctgactcagcaaa

SEQ ID NO: 13468 - DNA, 9 bp, Artificial sequence
  Synthetic
caaaggtca

SEQ ID NO: 13469 - DNA, 8 bp, Artificial sequence
  Synthetic
attacaag

SEQ ID NO: 13470 - DNA, 9 bp, Artificial sequence
  Synthetic
aacatatgg

SEQ ID NO: 13471 - DNA, 12 bp, Artificial sequence
  Synthetic
aattgcgtcact

SEQ ID NO: 13472 - DNA, 11 bp, Artificial sequence
  Synthetic
gggaaattccc

SEQ ID NO: 13473 - DNA, 10 bp, Artificial sequence
  Synthetic
ccctggcaac

SEQ ID NO: 13474 - DNA, 10 bp, Artificial sequence
  Synthetic
aatgactcat

SEQ ID NO: 13475 - DNA, 15 bp, Artificial sequence
  Synthetic
cgtcgccatggcaac

SEQ ID NO: 13476 - DNA, 7 bp, Artificial sequence
  Synthetic
acttcct

SEQ ID NO: 13477 - DNA, 16 bp, Artificial sequence
  Synthetic
agaccccccacgaagc

SEQ ID NO: 13478 - DNA, 12 bp, Artificial sequence
  Synthetic
atttttcctctg

SEQ ID NO: 13479 - DNA, 11 bp, Artificial sequence
  Synthetic
agcaattaaaa

SEQ ID NO: 13480 - DNA, 16 bp, Artificial sequence
  Synthetic
acggtaattagctcat

SEQ ID NO: 13481 - DNA, 12 bp, Artificial sequence
  Synthetic
gatttaacataa

SEQ ID NO: 13482 - DNA, 8 bp, Artificial sequence
  Synthetic
aaaatagc

SEQ ID NO: 13483 - DNA, 15 bp, Artificial sequence
  Synthetic
cccggtcacgtgacc

SEQ ID NO: 13484 - DNA, 11 bp, Artificial sequence
  Synthetic
aatttgcatat

SEQ ID NO: 13485 - DNA, 10 bp, Artificial sequence
  Synthetic
aatgacacta

SEQ ID NO: 13486 - DNA, 9 bp, Artificial sequence
  Synthetic
ccaatcagc

SEQ ID NO: 13487 - DNA, 16 bp, Artificial sequence
  Synthetic
acggtaattagctcag

SEQ ID NO: 13488 - DNA, 6 bp, Artificial sequence
  Synthetic
caatta

SEQ ID NO: 13489 - DNA, 10 bp, Artificial sequence
  Synthetic
gcagataaca

SEQ ID NO: 13490 - DNA, 10 bp, Artificial sequence
  Synthetic
gattgcgtaa

SEQ ID NO: 13491 - DNA, 10 bp, Artificial sequence
  Synthetic
ctgagtcacc

SEQ ID NO: 13492 - DNA, 24 bp, Artificial sequence
  Synthetic
attaaatgacacgtcatctttcag

SEQ ID NO: 13493 - DNA, 16 bp, Artificial sequence
  Synthetic
gtcttaattagtgcac

SEQ ID NO: 13494 - DNA, 12 bp, Artificial sequence
  Synthetic
cgttacataacg

SEQ ID NO: 13495 - DNA, 16 bp, Artificial sequence
  Synthetic
caaacgtaaacaatcc

SEQ ID NO: 13496 - DNA, 13 bp, Artificial sequence
  Synthetic
caccacgtgggca

SEQ ID NO: 13497 - DNA, 12 bp, Artificial sequence
  Synthetic
gaaacatctgga

SEQ ID NO: 13498 - DNA, 13 bp, Artificial sequence
  Synthetic
ggtattcccagta

SEQ ID NO: 13499 - DNA, 10 bp, Artificial sequence
  Synthetic
aacatggcgg

SEQ ID NO: 13500 - DNA, 10 bp, Artificial sequence
  Synthetic
ccaaatttgg

SEQ ID NO: 13501 - DNA, 9 bp, Artificial sequence
  Synthetic
aaaggtcaa

SEQ ID NO: 13502 - DNA, 9 bp, Artificial sequence
  Synthetic
aaaggtcac

SEQ ID NO: 13503 - DNA, 15 bp, Artificial sequence
  Synthetic
aagcctcgtggccag

SEQ ID NO: 13504 - DNA, 11 bp, Artificial sequence
  Synthetic
cagcaccccgg

SEQ ID NO: 13505 - DNA, 8 bp, Artificial sequence
  Synthetic
cagctggc

SEQ ID NO: 13506 - DNA, 15 bp, Artificial sequence
  Synthetic
ccgccagggggcgcc

SEQ ID NO: 13507 - DNA, 17 bp, Artificial sequence
  Synthetic
ccaccagggggcgccgg

SEQ ID NO: 13508 - DNA, 11 bp, Artificial sequence
  Synthetic
aaacatgtact

SEQ ID NO: 13509 - DNA, 11 bp, Artificial sequence
  Synthetic
attttatggcc

SEQ ID NO: 13510 - DNA, 10 bp, Artificial sequence
  Synthetic
ttgtaaacaa

SEQ ID NO: 13511 - DNA, 17 bp, Artificial sequence
  Synthetic
cgcattaattaattggc

SEQ ID NO: 13512 - DNA, 15 bp, Artificial sequence
  Synthetic
ccagtatgaattctc

SEQ ID NO: 13513 - DNA, 10 bp, Artificial sequence
  Synthetic
tgactcagca

SEQ ID NO: 13514 - DNA, 15 bp, Artificial sequence
  Synthetic
aatcaatagattgga

SEQ ID NO: 13515 - DNA, 9 bp, Artificial sequence
  Synthetic
actaattag

SEQ ID NO: 13516 - DNA, 9 bp, Artificial sequence
  Synthetic
agaggtcac

SEQ ID NO: 13517 - DNA, 9 bp, Artificial sequence
  Synthetic
agaggtcaa

SEQ ID NO: 13518 - DNA, 9 bp, Artificial sequence
  Synthetic
ttcccggaa

SEQ ID NO: 13519 - DNA, 9 bp, Artificial sequence
  Synthetic
attacatga

SEQ ID NO: 13520 - DNA, 20 bp, Artificial sequence
  Synthetic
cccccccccccgcccacgca

SEQ ID NO: 13521 - DNA, 12 bp, Artificial sequence
  Synthetic
gctataaatagc

SEQ ID NO: 13522 - DNA, 9 bp, Artificial sequence
  Synthetic
cacatggcc

SEQ ID NO: 13523 - DNA, 10 bp, Artificial sequence
  Synthetic
agttttattg

SEQ ID NO: 13524 - DNA, 11 bp, Artificial sequence
  Synthetic
caccggaagta

SEQ ID NO: 13525 - DNA, 14 bp, Artificial sequence
  Synthetic
gatgacgtcacccc

SEQ ID NO: 13526 - DNA, 14 bp, Artificial sequence
  Synthetic
gtgccgtgtgcaaa

SEQ ID NO: 13527 - DNA, 10 bp, Artificial sequence
  Synthetic
agcgccccct

SEQ ID NO: 13528 - DNA, 12 bp, Artificial sequence
  Synthetic
aataaacaaaca

SEQ ID NO: 13529 - DNA, 13 bp, Artificial sequence
  Synthetic
gggtcacgtgacc

SEQ ID NO: 13530 - DNA, 6 bp, Artificial sequence
  Synthetic
tgtcaa

SEQ ID NO: 13531 - DNA, 15 bp, Artificial sequence
  Synthetic
ccagccacacccacc

SEQ ID NO: 13532 - DNA, 10 bp, Artificial sequence
  Synthetic
agacaagtcc

SEQ ID NO: 13533 - DNA, 10 bp, Artificial sequence
  Synthetic
ccctatcacg

SEQ ID NO: 13534 - DNA, 12 bp, Artificial sequence
  Synthetic
ggggatttccca

SEQ ID NO: 13535 - DNA, 18 bp, Artificial sequence
  Synthetic
tacaaacaaagtaataaa

SEQ ID NO: 13536 - DNA, 29 bp, Artificial sequence
  Synthetic
cacctgttcaatttggcacggagccaaca

SEQ ID NO: 13537 - DNA, 10 bp, Artificial sequence
  Synthetic
ataatgcata

SEQ ID NO: 13538 - DNA, 10 bp, Artificial sequence
  Synthetic
ttggcgccaa

SEQ ID NO: 13539 - DNA, 17 bp, Artificial sequence
  Synthetic
aaagctaattagcgaaa

SEQ ID NO: 13540 - DNA, 13 bp, Artificial sequence
  Synthetic
aaattcctgggaa

SEQ ID NO: 13541 - DNA, 11 bp, Artificial sequence
  Synthetic
ccgcccacgcc

SEQ ID NO: 13542 - DNA, 13 bp, Artificial sequence
  Synthetic
aagttcaaggtca

SEQ ID NO: 13543 - DNA, 19 bp, Artificial sequence
  Synthetic
ccttatctgcccccaccag

SEQ ID NO: 13544 - DNA, 13 bp, Artificial sequence
  Synthetic
cacaatactaacc

SEQ ID NO: 13545 - DNA, 10 bp, Artificial sequence
  Synthetic
aatgtaaaca

SEQ ID NO: 13546 - DNA, 11 bp, Artificial sequence
  Synthetic
gtaaataaaca

SEQ ID NO: 13547 - DNA, 9 bp, Artificial sequence
  Synthetic
aaggacagg

SEQ ID NO: 13548 - DNA, 8 bp, Artificial sequence
  Synthetic
aagaaatc

SEQ ID NO: 13549 - DNA, 10 bp, Artificial sequence
  Synthetic
agtgaaagtg

SEQ ID NO: 13550 - DNA, 8 bp, Artificial sequence
  Synthetic
aagaaatg

SEQ ID NO: 13551 - DNA, 6 bp, Artificial sequence
  Synthetic
cattcc

SEQ ID NO: 13552 - DNA, 22 bp, Artificial sequence
  Synthetic
ataagaacaccctgtacccgcc

SEQ ID NO: 13553 - DNA, 17 bp, Artificial sequence
  Synthetic
tagaaaaatgccacgaa

SEQ ID NO: 13554 - DNA, 16 bp, Artificial sequence
  Synthetic
aaatgcgtgggcgtaa

SEQ ID NO: 13555 - DNA, 15 bp, Artificial sequence
  Synthetic
ggttaataattaacc

SEQ ID NO: 13556 - DNA, 17 bp, Artificial sequence
  Synthetic
tcttggcaagtatccaa

SEQ ID NO: 13557 - DNA, 22 bp, Artificial sequence
  Synthetic
acccccccttctgattggctga

SEQ ID NO: 13558 - DNA, 16 bp, Artificial sequence
  Synthetic
aaatgcgtgggcgtat

SEQ ID NO: 13559 - DNA, 13 bp, Artificial sequence
  Synthetic
tctatttatagaa

SEQ ID NO: 13560 - DNA, 8 bp, Artificial sequence
  Synthetic
ccacaccc

SEQ ID NO: 13561 - DNA, 13 bp, Artificial sequence
  Synthetic
ccccggcctccgc

SEQ ID NO: 13562 - DNA, 8 bp, Artificial sequence
  Synthetic
agaacaga

SEQ ID NO: 13563 - DNA, 10 bp, Artificial sequence
  Synthetic
cagctgttac

SEQ ID NO: 13564 - DNA, 10 bp, Artificial sequence
  Synthetic
agtcacgtga

SEQ ID NO: 13565 - DNA, 18 bp, Artificial sequence
  Synthetic
cagttgctaggcaacggg

SEQ ID NO: 13566 - DNA, 16 bp, Artificial sequence
  Synthetic
actatgaatgaatgat

SEQ ID NO: 13567 - DNA, 14 bp, Artificial sequence
  Synthetic
cctcggacagctgc

SEQ ID NO: 13568 - DNA, 9 bp, Artificial sequence
  Synthetic
attgttctc

SEQ ID NO: 13569 - DNA, 11 bp, Artificial sequence
  Synthetic
atgactcaccc

SEQ ID NO: 13570 - DNA, 10 bp, Artificial sequence
  Synthetic
accacgtgcc

SEQ ID NO: 13571 - DNA, 10 bp, Artificial sequence
  Synthetic
accagctgtg

SEQ ID NO: 13572 - DNA, 8 bp, Artificial sequence
  Synthetic
ccagtagc

SEQ ID NO: 13573 - DNA, 11 bp, Artificial sequence
  Synthetic
tccctaataaa

SEQ ID NO: 13574 - DNA, 19 bp, Artificial sequence
  Synthetic
aaagaggaagtgaaactag

SEQ ID NO: 13575 - DNA, 11 bp, Artificial sequence
  Synthetic
ggggatttcca

SEQ ID NO: 13576 - DNA, 9 bp, Artificial sequence
  Synthetic
ccacttgaa

SEQ ID NO: 13577 - DNA, 11 bp, Artificial sequence
  Synthetic
aaaacacctgt

SEQ ID NO: 13578 - DNA, 12 bp, Artificial sequence
  Synthetic
agttacgtcacc

SEQ ID NO: 13579 - DNA, 18 bp, Artificial sequence
  Synthetic
ccgggacagtctgttctc

SEQ ID NO: 13580 - DNA, 15 bp, Artificial sequence
  Synthetic
gtgactgttactata

SEQ ID NO: 13581 - DNA, 15 bp, Artificial sequence
  Synthetic
ccaccagggggcgcc

SEQ ID NO: 13582 - DNA, 11 bp, Artificial sequence
  Synthetic
ccatatggtac

SEQ ID NO: 13583 - DNA, 8 bp, Artificial sequence
  Synthetic
ccgccccc

SEQ ID NO: 13584 - DNA, 10 bp, Artificial sequence
  Synthetic
actgacctct

SEQ ID NO: 13585 - DNA, 13 bp, Artificial sequence
  Synthetic
aaggtgtgaaaat

SEQ ID NO: 13586 - DNA, 17 bp, Artificial sequence
  Synthetic
gaacaattgcagtgttc

SEQ ID NO: 13587 - DNA, 11 bp, Artificial sequence
  Synthetic
atgaccttgaa

SEQ ID NO: 13588 - DNA, 17 bp, Artificial sequence
  Synthetic
aatgaattgcagtcatt

SEQ ID NO: 13589 - DNA, 21 bp, Artificial sequence
  Synthetic
aaacggttcaggaagttcatc

SEQ ID NO: 13590 - DNA, 10 bp, Artificial sequence
  Synthetic
agctcattat

SEQ ID NO: 13591 - DNA, 11 bp, Artificial sequence
  Synthetic
ccagggggcag

SEQ ID NO: 13592 - DNA, 10 bp, Artificial sequence
  Synthetic
gaaagtgaaa

SEQ ID NO: 13593 - DNA, 10 bp, Artificial sequence
  Synthetic
aattttaatg

SEQ ID NO: 13594 - DNA, 13 bp, Artificial sequence
  Synthetic
ggggggggggcca

SEQ ID NO: 13595 - DNA, 8 bp, Artificial sequence
  Synthetic
tgtaaaca

SEQ ID NO: 13596 - DNA, 12 bp, Artificial sequence
  Synthetic
gatgatttatga

SEQ ID NO: 13597 - DNA, 15 bp, Artificial sequence
  Synthetic
gcagccggcgccgcc

SEQ ID NO: 13598 - DNA, 16 bp, Artificial sequence
  Synthetic
aacaatgaacattgtt

SEQ ID NO: 13599 - DNA, 8 bp, Artificial sequence
  Synthetic
cacgtgac

SEQ ID NO: 13600 - DNA, 16 bp, Artificial sequence
  Synthetic
aatggactttgacccc

SEQ ID NO: 13601 - DNA, 16 bp, Artificial sequence
  Synthetic
taagtaattagttata

SEQ ID NO: 13602 - DNA, 10 bp, Artificial sequence
  Synthetic
taatcgatta

SEQ ID NO: 13603 - DNA, 10 bp, Artificial sequence
  Synthetic
ctaattagta

SEQ ID NO: 13604 - DNA, 14 bp, Artificial sequence
  Synthetic
aaccgttaaccgtt

SEQ ID NO: 13605 - DNA, 12 bp, Artificial sequence
  Synthetic
gaccaatcagaa

SEQ ID NO: 13606 - DNA, 9 bp, Artificial sequence
  Synthetic
ctaattagc

SEQ ID NO: 13607 - DNA, 10 bp, Artificial sequence
  Synthetic
ccaccagggg

SEQ ID NO: 13608 - DNA, 5 bp, Artificial sequence
  Synthetic
tatca

SEQ ID NO: 13609 - DNA, 12 bp, Artificial sequence
  Synthetic
aaaaatagccct

SEQ ID NO: 13610 - DNA, 13 bp, Artificial sequence
  Synthetic
ctctttgttacga

SEQ ID NO: 13611 - DNA, 10 bp, Artificial sequence
  Synthetic
ccgtaccacc

SEQ ID NO: 13612 - DNA, 10 bp, Artificial sequence
  Synthetic
taacacctca

SEQ ID NO: 13613 - DNA, 10 bp, Artificial sequence
  Synthetic
accccgcccc

SEQ ID NO: 13614 - DNA, 16 bp, Artificial sequence
  Synthetic
ttttacagtagcaaaa

SEQ ID NO: 13615 - DNA, 9 bp, Artificial sequence
  Synthetic
accggaaat

SEQ ID NO: 13616 - DNA, 8 bp, Artificial sequence
  Synthetic
aatttaga

SEQ ID NO: 13617 - DNA, 8 bp, Artificial sequence
  Synthetic
atatgata

SEQ ID NO: 13618 - DNA, 14 bp, Artificial sequence
  Synthetic
agtaaatattaact

SEQ ID NO: 13619 - DNA, 10 bp, Artificial sequence
  Synthetic
caagcgtgac

SEQ ID NO: 13620 - DNA, 14 bp, Artificial sequence
  Synthetic
aggttcaaaggtca

SEQ ID NO: 13621 - DNA, 18 bp, Artificial sequence
  Synthetic
tcttggcaagaagccaaa

SEQ ID NO: 13622 - DNA, 8 bp, Artificial sequence
  Synthetic
acacgtgg

SEQ ID NO: 13623 - DNA, 8 bp, Artificial sequence
  Synthetic
acacgtga

SEQ ID NO: 13624 - DNA, 10 bp, Artificial sequence
  Synthetic
gggaaagccc

SEQ ID NO: 13625 - DNA, 8 bp, Artificial sequence
  Synthetic
acacgtgc

SEQ ID NO: 13626 - DNA, 11 bp, Artificial sequence
  Synthetic
accacgtggtc

SEQ ID NO: 13627 - DNA, 15 bp, Artificial sequence
  Synthetic
caaagtaaacatgga

SEQ ID NO: 13628 - DNA, 10 bp, Artificial sequence
  Synthetic
gttaattgga

SEQ ID NO: 13629 - DNA, 12 bp, Artificial sequence
  Synthetic
cctaagtaaaca

SEQ ID NO: 13630 - DNA, 15 bp, Artificial sequence
  Synthetic
agctaaaaatagcat

SEQ ID NO: 13631 - DNA, 13 bp, Artificial sequence
  Synthetic
actgtgggaaacg

SEQ ID NO: 13632 - DNA, 15 bp, Artificial sequence
  Synthetic
actcacgcaatactg

SEQ ID NO: 13633 - DNA, 13 bp, Artificial sequence
  Synthetic
ctcatttcaaaaa

SEQ ID NO: 13634 - DNA, 16 bp, Artificial sequence
  Synthetic
aattacctgtcaatac

SEQ ID NO: 13635 - DNA, 9 bp, Artificial sequence
  Synthetic
atgttccca

SEQ ID NO: 13636 - DNA, 17 bp, Artificial sequence
  Synthetic
caaagtaattaattatc

SEQ ID NO: 13637 - DNA, 11 bp, Artificial sequence
  Synthetic
aaatgagcaac

SEQ ID NO: 13638 - DNA, 10 bp, Artificial sequence
  Synthetic
aacatctggt

SEQ ID NO: 13639 - DNA, 11 bp, Artificial sequence
  Synthetic
aaaaccgttaa

SEQ ID NO: 13640 - DNA, 10 bp, Artificial sequence
  Synthetic
ctcaactggc

SEQ ID NO: 13641 - DNA, 18 bp, Artificial sequence
  Synthetic
gacatgtccagacatgtc

SEQ ID NO: 13642 - DNA, 19 bp, Artificial sequence
  Synthetic
agtttcgatatgagtcatc

SEQ ID NO: 13643 - DNA, 10 bp, Artificial sequence
  Synthetic
ccaataaaac

SEQ ID NO: 13644 - DNA, 10 bp, Artificial sequence
  Synthetic
ccaataaaaa

SEQ ID NO: 13645 - DNA, 9 bp, Artificial sequence
  Synthetic
aattacatg

SEQ ID NO: 13646 - DNA, 9 bp, Artificial sequence
  Synthetic
aaagtcccc

SEQ ID NO: 13647 - DNA, 15 bp, Artificial sequence
  Synthetic
ctgatttgcatattc

SEQ ID NO: 13648 - DNA, 10 bp, Artificial sequence
  Synthetic
atggaatgtg

SEQ ID NO: 13649 - DNA, 15 bp, Artificial sequence
  Synthetic
ccagggtatcagccg

SEQ ID NO: 13650 - DNA, 10 bp, Artificial sequence
  Synthetic
ccacagcagg

SEQ ID NO: 13651 - DNA, 9 bp, Artificial sequence
  Synthetic
aaacaaaca

SEQ ID NO: 13652 - DNA, 15 bp, Artificial sequence
  Synthetic
gccaccagagggcgc

SEQ ID NO: 13653 - DNA, 9 bp, Artificial sequence
  Synthetic
agccaatca

SEQ ID NO: 13654 - DNA, 15 bp, Artificial sequence
  Synthetic
aaaataatcgatata

SEQ ID NO: 13655 - DNA, 12 bp, Artificial sequence
  Synthetic
aaatgacagctc

SEQ ID NO: 13656 - DNA, 16 bp, Artificial sequence
  Synthetic
catttagcagcaatta

SEQ ID NO: 13657 - DNA, 16 bp, Artificial sequence
  Synthetic
ataattaatgacctcc

SEQ ID NO: 13658 - DNA, 14 bp, Artificial sequence
  Synthetic
ccgtcacgtgacca

SEQ ID NO: 13659 - DNA, 14 bp, Artificial sequence
  Synthetic
ccagccaatcagag

SEQ ID NO: 13660 - DNA, 15 bp, Artificial sequence
  Synthetic
cctagcaacaggtga

SEQ ID NO: 13661 - DNA, 15 bp, Artificial sequence
  Synthetic
aaaaacacctgcgcc

SEQ ID NO: 13662 - DNA, 13 bp, Artificial sequence
  Synthetic
ggccacgtgaccc

SEQ ID NO: 13663 - DNA, 15 bp, Artificial sequence
  Synthetic
aagttcaaggtcagc

SEQ ID NO: 13664 - DNA, 8 bp, Artificial sequence
  Synthetic
gtacccta

SEQ ID NO: 13665 - DNA, 9 bp, Artificial sequence
  Synthetic
ccacctgcc

SEQ ID NO: 13666 - DNA, 16 bp, Artificial sequence
  Synthetic
gcattaattagttcgc

SEQ ID NO: 13667 - DNA, 10 bp, Artificial sequence
  Synthetic
agtcagcaaa

SEQ ID NO: 13668 - DNA, 8 bp, Artificial sequence
  Synthetic
ccaattag

SEQ ID NO: 13669 - DNA, 15 bp, Artificial sequence
  Synthetic
cggccaccagggggc

SEQ ID NO: 13670 - DNA, 22 bp, Artificial sequence
  Synthetic
aggggacgcagctgcgccccct

SEQ ID NO: 13671 - DNA, 10 bp, Artificial sequence
  Synthetic
gtattgttaa

SEQ ID NO: 13672 - DNA, 14 bp, Artificial sequence
  Synthetic
agatcacgtgatct

SEQ ID NO: 13673 - DNA, 7 bp, Artificial sequence
  Synthetic
aacaatg

SEQ ID NO: 13674 - DNA, 18 bp, Artificial sequence
  Synthetic
aatgtggaaatgagtcag

SEQ ID NO: 13675 - DNA, 7 bp, Artificial sequence
  Synthetic
cacttga

SEQ ID NO: 13676 - DNA, 8 bp, Artificial sequence
  Synthetic
gaacaata

SEQ ID NO: 13677 - DNA, 10 bp, Artificial sequence
  Synthetic
atgtgcacat

SEQ ID NO: 13678 - DNA, 9 bp, Artificial sequence
  Synthetic
accgattag

SEQ ID NO: 13679 - DNA, 11 bp, Artificial sequence
  Synthetic
gccacgtggcc

SEQ ID NO: 13680 - DNA, 17 bp, Artificial sequence
  Synthetic
cataattaattaacgcg

SEQ ID NO: 13681 - DNA, 11 bp, Artificial sequence
  Synthetic
ctcaccccacc

SEQ ID NO: 13682 - DNA, 10 bp, Artificial sequence
  Synthetic
aaaagtcaaa

SEQ ID NO: 13683 - DNA, 8 bp, Artificial sequence
  Synthetic
ctagttaa

SEQ ID NO: 13684 - DNA, 7 bp, Artificial sequence
  Synthetic
cgttggc

SEQ ID NO: 13685 - DNA, 21 bp, Artificial sequence
  Synthetic
aattttcacgcatgagttcac

SEQ ID NO: 13686 - DNA, 8 bp, Artificial sequence
  Synthetic
aggggtca

SEQ ID NO: 13687 - DNA, 13 bp, Artificial sequence
  Synthetic
catttcccggaag

SEQ ID NO: 13688 - DNA, 14 bp, Artificial sequence
  Synthetic
ctctgacgtcaccc

SEQ ID NO: 13689 - DNA, 6 bp, Artificial sequence
  Synthetic
ctttga

SEQ ID NO: 13690 - DNA, 11 bp, Artificial sequence
  Synthetic
ctaggtgtgaa

SEQ ID NO: 13691 - DNA, 10 bp, Artificial sequence
  Synthetic
taaataaaca

SEQ ID NO: 13692 - DNA, 13 bp, Artificial sequence
  Synthetic
gatgactcacaca

SEQ ID NO: 13693 - DNA, 10 bp, Artificial sequence
  Synthetic
aaattttcct

SEQ ID NO: 13694 - DNA, 10 bp, Artificial sequence
  Synthetic
cgcccgaggc

SEQ ID NO: 13695 - DNA, 15 bp, Artificial sequence
  Synthetic
cctttgttatgcaaa

SEQ ID NO: 13696 - DNA, 20 bp, Artificial sequence
  Synthetic
aggtgtgaaaaaaggtgtga

SEQ ID NO: 13697 - DNA, 22 bp, Artificial sequence
  Synthetic
ggaagagtcacgtgaccaatac

SEQ ID NO: 13698 - DNA, 12 bp, Artificial sequence
  Synthetic
atgcgtgggcgg

SEQ ID NO: 13699 - DNA, 9 bp, Artificial sequence
  Synthetic
acatctgtc

SEQ ID NO: 13700 - DNA, 15 bp, Artificial sequence
  Synthetic
accatggacagcgcc

SEQ ID NO: 13701 - DNA, 17 bp, Artificial sequence
  Synthetic
aaaggtcaaaggtcaac

SEQ ID NO: 13702 - DNA, 17 bp, Artificial sequence
  Synthetic
gccacaggaagtaacac

SEQ ID NO: 13703 - DNA, 11 bp, Artificial sequence
  Synthetic
caccatatggc

SEQ ID NO: 13704 - DNA, 8 bp, Artificial sequence
  Synthetic
accacaaa

SEQ ID NO: 13705 - DNA, 9 bp, Artificial sequence
  Synthetic
aggcaggaa

SEQ ID NO: 13706 - DNA, 10 bp, Artificial sequence
  Synthetic
tggccttgaa

SEQ ID NO: 13707 - DNA, 10 bp, Artificial sequence
  Synthetic
ccacttgaaa

SEQ ID NO: 13708 - DNA, 19 bp, Artificial sequence
  Synthetic
gccgaggcctggggccccc

SEQ ID NO: 13709 - DNA, 13 bp, Artificial sequence
  Synthetic
ccaccagggggcg

SEQ ID NO: 13710 - DNA, 22 bp, Artificial sequence
  Synthetic
atggggcgcagctgcgcccctc

SEQ ID NO: 13711 - DNA, 11 bp, Artificial sequence
  Synthetic
cttcccgcccc

SEQ ID NO: 13712 - DNA, 15 bp, Artificial sequence
  Synthetic
gccaccagggggcgc

SEQ ID NO: 13713 - DNA, 14 bp, Artificial sequence
  Synthetic
aatatgcaaattat

SEQ ID NO: 13714 - DNA, 7 bp, Artificial sequence
  Synthetic
tacgtaa

SEQ ID NO: 13715 - DNA, 14 bp, Artificial sequence
  Synthetic
ggcccaaggtcaca

SEQ ID NO: 13716 - DNA, 10 bp, Artificial sequence
  Synthetic
gataattaca

SEQ ID NO: 13717 - DNA, 8 bp, Artificial sequence
  Synthetic
acagcgtc

SEQ ID NO: 13718 - DNA, 14 bp, Artificial sequence
  Synthetic
aatatgcaaattag

SEQ ID NO: 13719 - DNA, 18 bp, Artificial sequence
  Synthetic
ctcaagttcaagttcacc

SEQ ID NO: 13720 - DNA, 14 bp, Artificial sequence
  Synthetic
tgtaaatattgaca

SEQ ID NO: 13721 - DNA, 13 bp, Artificial sequence
  Synthetic
aagatgatgtcat

SEQ ID NO: 13722 - DNA, 15 bp, Artificial sequence
  Synthetic
acccccccggggggg

SEQ ID NO: 13723 - DNA, 7 bp, Artificial sequence
  Synthetic
cagataa

SEQ ID NO: 13724 - DNA, 15 bp, Artificial sequence
  Synthetic
tgctaaaaatagcaa

SEQ ID NO: 13725 - DNA, 15 bp, Artificial sequence
  Synthetic
atgccaaaaatagca

SEQ ID NO: 13726 - DNA, 16 bp, Artificial sequence
  Synthetic
catttaacaccaatta

SEQ ID NO: 13727 - DNA, 16 bp, Artificial sequence
  Synthetic
cgttgccatggcaacg

SEQ ID NO: 13728 - DNA, 16 bp, Artificial sequence
  Synthetic
cgttgccatggcaacc

SEQ ID NO: 13729 - DNA, 9 bp, Artificial sequence
  Synthetic
ctgaaacag

SEQ ID NO: 13730 - DNA, 16 bp, Artificial sequence
  Synthetic
aggttaattagctgat

SEQ ID NO: 13731 - DNA, 13 bp, Artificial sequence
  Synthetic
aattcccagaaaa

SEQ ID NO: 13732 - DNA, 8 bp, Artificial sequence
  Synthetic
agataagg

SEQ ID NO: 13733 - DNA, 8 bp, Artificial sequence
  Synthetic
agataaga

SEQ ID NO: 13734 - DNA, 18 bp, Artificial sequence
  Synthetic
agcgccccctggtggcca

SEQ ID NO: 13735 - DNA, 12 bp, Artificial sequence
  Synthetic
aaaactaggtca

SEQ ID NO: 13736 - DNA, 9 bp, Artificial sequence
  Synthetic
agccaaacc

SEQ ID NO: 13737 - DNA, 9 bp, Artificial sequence
  Synthetic
cccaccctc

SEQ ID NO: 13738 - DNA, 10 bp, Artificial sequence
  Synthetic
cttcctggaa

SEQ ID NO: 13739 - DNA, 15 bp, Artificial sequence
  Synthetic
cagtttcagtttctc

SEQ ID NO: 13740 - DNA, 9 bp, Artificial sequence
  Synthetic
gtaataaaa

SEQ ID NO: 13741 - DNA, 9 bp, Artificial sequence
  Synthetic
ctcataaaa

SEQ ID NO: 13742 - DNA, 25 bp, Artificial sequence
  Synthetic
ggttattaattggttatattggtta

SEQ ID NO: 13743 - DNA, 8 bp, Artificial sequence
  Synthetic
ctggtggc

SEQ ID NO: 13744 - DNA, 14 bp, Artificial sequence
  Synthetic
cgaccacgtggtca

SEQ ID NO: 13745 - DNA, 10 bp, Artificial sequence
  Synthetic
ggcacgtgac

SEQ ID NO: 13746 - DNA, 16 bp, Artificial sequence
  Synthetic
aaaaataaatataagg

SEQ ID NO: 13747 - DNA, 10 bp, Artificial sequence
  Synthetic
gaggtgtcaa

SEQ ID NO: 13748 - DNA, 14 bp, Artificial sequence
  Synthetic
acattgcacaatct

SEQ ID NO: 13749 - DNA, 10 bp, Artificial sequence
  Synthetic
accacgtgtc

SEQ ID NO: 13750 - DNA, 11 bp, Artificial sequence
  Synthetic
atgactcactc

SEQ ID NO: 13751 - DNA, 9 bp, Artificial sequence
  Synthetic
agaacaatg

SEQ ID NO: 13752 - DNA, 12 bp, Artificial sequence
  Synthetic
cctgggtggtcc

SEQ ID NO: 13753 - DNA, 21 bp, Artificial sequence
  Synthetic
ccccatttcccggaaatcacc

SEQ ID NO: 13754 - DNA, 8 bp, Artificial sequence
  Synthetic
gccataaa

SEQ ID NO: 13755 - DNA, 8 bp, Artificial sequence
  Synthetic
gtacgtaa

SEQ ID NO: 13756 - DNA, 18 bp, Artificial sequence
  Synthetic
aggtcacggtgacctggg

SEQ ID NO: 13757 - DNA, 10 bp, Artificial sequence
  Synthetic
cctaattaaa

SEQ ID NO: 13758 - DNA, 9 bp, Artificial sequence
  Synthetic
ggggattaa

SEQ ID NO: 13759 - DNA, 8 bp, Artificial sequence
  Synthetic
gaggtcac

SEQ ID NO: 13760 - DNA, 8 bp, Artificial sequence
  Synthetic
gaggtcaa

SEQ ID NO: 13761 - DNA, 10 bp, Artificial sequence
  Synthetic
ccacttccgg

SEQ ID NO: 13762 - DNA, 14 bp, Artificial sequence
  Synthetic
atgccacgtcatca

SEQ ID NO: 13763 - DNA, 14 bp, Artificial sequence
  Synthetic
aggatgatgcaatc

SEQ ID NO: 13764 - DNA, 16 bp, Artificial sequence
  Synthetic
aaaaagtaaacaaacc

SEQ ID NO: 13765 - DNA, 14 bp, Artificial sequence
  Synthetic
aaaaaatcaataaa

SEQ ID NO: 13766 - DNA, 11 bp, Artificial sequence
  Synthetic
cgtgagtcatc

SEQ ID NO: 13767 - DNA, 16 bp, Artificial sequence
  Synthetic
taggtaataaaattca

SEQ ID NO: 13768 - DNA, 9 bp, Artificial sequence
  Synthetic
gccccaggc

SEQ ID NO: 13769 - DNA, 16 bp, Artificial sequence
  Synthetic
aggctaatccccaacg

SEQ ID NO: 13770 - DNA, 16 bp, Artificial sequence
  Synthetic
agaattttattggtag

SEQ ID NO: 13771 - DNA, 8 bp, Artificial sequence
  Synthetic
gcacgtcc

SEQ ID NO: 13772 - DNA, 15 bp, Artificial sequence
  Synthetic
aacaatggtagtgtt

SEQ ID NO: 13773 - DNA, 24 bp, Artificial sequence
  Synthetic
acggggcgcagggatttgttgccc

SEQ ID NO: 13774 - DNA, 8 bp, Artificial sequence
  Synthetic
ggcaatta

SEQ ID NO: 13775 - DNA, 10 bp, Artificial sequence
  Synthetic
cgccgccgcc

SEQ ID NO: 13776 - DNA, 10 bp, Artificial sequence
  Synthetic
accagctgag

SEQ ID NO: 13777 - DNA, 10 bp, Artificial sequence
  Synthetic
gcccccgggc

SEQ ID NO: 13778 - DNA, 15 bp, Artificial sequence
  Synthetic
aaagggctgcggccc

SEQ ID NO: 13779 - DNA, 10 bp, Artificial sequence
  Synthetic
aattttggca

SEQ ID NO: 13780 - DNA, 11 bp, Artificial sequence
  Synthetic
ggccaatcccc

SEQ ID NO: 13781 - DNA, 15 bp, Artificial sequence
  Synthetic
aaggatgagtcaccg

SEQ ID NO: 13782 - DNA, 16 bp, Artificial sequence
  Synthetic
cgcggtcacgtgaccc

SEQ ID NO: 13783 - DNA, 13 bp, Artificial sequence
  Synthetic
aaattgttacatt

SEQ ID NO: 13784 - DNA, 10 bp, Artificial sequence
  Synthetic
aattttggct

SEQ ID NO: 13785 - DNA, 9 bp, Artificial sequence
  Synthetic
tctcccaaa

SEQ ID NO: 13786 - DNA, 15 bp, Artificial sequence
  Synthetic
aaaaagaggaagtgg

SEQ ID NO: 13787 - DNA, 19 bp, Artificial sequence
  Synthetic
tagcgccccctggtggcca

SEQ ID NO: 13788 - DNA, 13 bp, Artificial sequence
  Synthetic
agatgatagagcc

SEQ ID NO: 13789 - DNA, 8 bp, Artificial sequence
  Synthetic
atatgcat

SEQ ID NO: 13790 - DNA, 14 bp, Artificial sequence
  Synthetic
acagataagaatct

SEQ ID NO: 13791 - DNA, 10 bp, Artificial sequence
  Synthetic
ccaaggtcac

SEQ ID NO: 13792 - DNA, 8 bp, Artificial sequence
  Synthetic
acgtaata

SEQ ID NO: 13793 - DNA, 17 bp, Artificial sequence
  Synthetic
caggagcagctgctgag

SEQ ID NO: 13794 - DNA, 10 bp, Artificial sequence
  Synthetic
ccctagcaac

SEQ ID NO: 13795 - DNA, 14 bp, Artificial sequence
  Synthetic
ggttgccatggtaa

SEQ ID NO: 13796 - DNA, 8 bp, Artificial sequence
  Synthetic
cttaatta

SEQ ID NO: 13797 - DNA, 17 bp, Artificial sequence
  Synthetic
ccttggcaacttgccag

SEQ ID NO: 13798 - DNA, 14 bp, Artificial sequence
  Synthetic
agggggatcgatgg

SEQ ID NO: 13799 - DNA, 10 bp, Artificial sequence
  Synthetic
cttatctcta

SEQ ID NO: 13800 - DNA, 11 bp, Artificial sequence
  Synthetic
ggccacaccca

SEQ ID NO: 13801 - DNA, 10 bp, Artificial sequence
  Synthetic
gctaattacc

SEQ ID NO: 13802 - DNA, 16 bp, Artificial sequence
  Synthetic
atgtacagtagcaaag

SEQ ID NO: 13803 - DNA, 13 bp, Artificial sequence
  Synthetic
ctaagtaaacaag

SEQ ID NO: 13804 - DNA, 11 bp, Artificial sequence
  Synthetic
aaccacttaag

SEQ ID NO: 13805 - DNA, 17 bp, Artificial sequence
  Synthetic
gagcgttaattaatgta

SEQ ID NO: 13806 - DNA, 11 bp, Artificial sequence
  Synthetic
ggggaatcccc

SEQ ID NO: 13807 - DNA, 15 bp, Artificial sequence
  Synthetic
ggttgccatggcgac

SEQ ID NO: 13808 - DNA, 17 bp, Artificial sequence
  Synthetic
aaggtcacgaaaggtca

SEQ ID NO: 13809 - DNA, 14 bp, Artificial sequence
  Synthetic
gttaattacctcca

SEQ ID NO: 13810 - DNA, 9 bp, Artificial sequence
  Synthetic
acacctgtc

SEQ ID NO: 13811 - DNA, 15 bp, Artificial sequence
  Synthetic
gggtccaaaggtcaa

SEQ ID NO: 13812 - DNA, 14 bp, Artificial sequence
  Synthetic
aggggatttcccag

SEQ ID NO: 13813 - DNA, 7 bp, Artificial sequence
  Synthetic
gtataaa

SEQ ID NO: 13814 - DNA, 10 bp, Artificial sequence
  Synthetic
attgtgtccg

SEQ ID NO: 13815 - DNA, 13 bp, Artificial sequence
  Synthetic
agttacgtaattg

SEQ ID NO: 13816 - DNA, 12 bp, Artificial sequence
  Synthetic
gcgaccaccgaa

SEQ ID NO: 13817 - DNA, 16 bp, Artificial sequence
  Synthetic
aaggtcaaaaggtcaa

SEQ ID NO: 13818 - DNA, 6 bp, Artificial sequence
  Synthetic
acaaag

SEQ ID NO: 13819 - DNA, 14 bp, Artificial sequence
  Synthetic
gtaaacatgtttac

SEQ ID NO: 13820 - DNA, 14 bp, Artificial sequence
  Synthetic
ctgcacccgctgcc

SEQ ID NO: 13821 - DNA, 10 bp, Artificial sequence
  Synthetic
cagataaggc

SEQ ID NO: 13822 - DNA, 11 bp, Artificial sequence
  Synthetic
ggtcacatgac

SEQ ID NO: 13823 - DNA, 8 bp, Artificial sequence
  Synthetic
acgtcatc

SEQ ID NO: 13824 - DNA, 8 bp, Artificial sequence
  Synthetic
caaggtca

SEQ ID NO: 13825 - DNA, 11 bp, Artificial sequence
  Synthetic
cttgcgtgaga

SEQ ID NO: 13826 - DNA, 10 bp, Artificial sequence
  Synthetic
acgcgccaaa

SEQ ID NO: 13827 - DNA, 16 bp, Artificial sequence
  Synthetic
gtcaattaattaatca

SEQ ID NO: 13828 - DNA, 10 bp, Artificial sequence
  Synthetic
gacgcgtgcc

SEQ ID NO: 13829 - DNA, 8 bp, Artificial sequence
  Synthetic
ctaattgc

SEQ ID NO: 13830 - DNA, 16 bp, Artificial sequence
  Synthetic
aggccacgtgccggat

SEQ ID NO: 13831 - DNA, 14 bp, Artificial sequence
  Synthetic
ggccatataaggac

SEQ ID NO: 13832 - DNA, 17 bp, Artificial sequence
  Synthetic
gagtattatgggatgga

SEQ ID NO: 13833 - DNA, 17 bp, Artificial sequence
  Synthetic
atccttaagtggttaag

SEQ ID NO: 13834 - DNA, 15 bp, Artificial sequence
  Synthetic
acaggaagtgattgc

SEQ ID NO: 13835 - DNA, 11 bp, Artificial sequence
  Synthetic
tgacctttaaa

SEQ ID NO: 13836 - DNA, 11 bp, Artificial sequence
  Synthetic
agcaataaaaa

SEQ ID NO: 13837 - DNA, 19 bp, Artificial sequence
  Synthetic
aggtgtgaaattcacacct

SEQ ID NO: 13838 - DNA, 8 bp, Artificial sequence
  Synthetic
ctgataag

SEQ ID NO: 13839 - DNA, 13 bp, Artificial sequence
  Synthetic
atatgcaaatgaa

SEQ ID NO: 13840 - DNA, 10 bp, Artificial sequence
  Synthetic
atcatgtaat

SEQ ID NO: 13841 - DNA, 17 bp, Artificial sequence
  Synthetic
aaaataacggtttccat

SEQ ID NO: 13842 - DNA, 13 bp, Artificial sequence
  Synthetic
atatgcaaatgag

SEQ ID NO: 13843 - DNA, 10 bp, Artificial sequence
  Synthetic
cctaatccgc

SEQ ID NO: 13844 - DNA, 15 bp, Artificial sequence
  Synthetic
catctccttatatgg

SEQ ID NO: 13845 - DNA, 10 bp, Artificial sequence
  Synthetic
ctaattacgc

SEQ ID NO: 13846 - DNA, 17 bp, Artificial sequence
  Synthetic
gggaacacaatgttccc

SEQ ID NO: 13847 - DNA, 10 bp, Artificial sequence
  Synthetic
gccccaccca

SEQ ID NO: 13848 - DNA, 8 bp, Artificial sequence
  Synthetic
attcaaat

SEQ ID NO: 13849 - DNA, 30 bp, Artificial sequence
  Synthetic
aggagagaaggggaagggaagaaagggaga

SEQ ID NO: 13850 - DNA, 14 bp, Artificial sequence
  Synthetic
ccccaaaccacccc

SEQ ID NO: 13851 - DNA, 22 bp, Artificial sequence
  Synthetic
aataaagaacaatagaatttca

SEQ ID NO: 13852 - DNA, 9 bp, Artificial sequence
  Synthetic
atgccaacc

SEQ ID NO: 13853 - DNA, 16 bp, Artificial sequence
  Synthetic
caggtaattacctcag

SEQ ID NO: 13854 - DNA, 10 bp, Artificial sequence
  Synthetic
aaggaaatga

SEQ ID NO: 13855 - DNA, 13 bp, Artificial sequence
  Synthetic
aaattagcataat

SEQ ID NO: 13856 - DNA, 14 bp, Artificial sequence
  Synthetic
ttccatatatggaa

SEQ ID NO: 13857 - DNA, 17 bp, Artificial sequence
  Synthetic
ccctgccccccccttcc

SEQ ID NO: 13858 - DNA, 17 bp, Artificial sequence
  Synthetic
acaagcaattaaagaat

SEQ ID NO: 13859 - DNA, 13 bp, Artificial sequence
  Synthetic
atgcaacaggtgg

SEQ ID NO: 13860 - DNA, 8 bp, Artificial sequence
  Synthetic
tggtacca

SEQ ID NO: 13861 - DNA, 13 bp, Artificial sequence
  Synthetic
atgaattgcagtc

SEQ ID NO: 13862 - DNA, 10 bp, Artificial sequence
  Synthetic
gcgcacgcgc

SEQ ID NO: 13863 - DNA, 21 bp, Artificial sequence
  Synthetic
agtgacaggcccgccggccaa

SEQ ID NO: 13864 - DNA, 11 bp, Artificial sequence
  Synthetic
ccttcccgccc

SEQ ID NO: 13865 - DNA, 12 bp, Artificial sequence
  Synthetic
gatgacgtcatc

SEQ ID NO: 13866 - DNA, 13 bp, Artificial sequence
  Synthetic
aatgattgatgca

SEQ ID NO: 13867 - DNA, 14 bp, Artificial sequence
  Synthetic
aagggggcgtggcc

SEQ ID NO: 13868 - DNA, 17 bp, Artificial sequence
  Synthetic
aaaatgtaaacaaacag

SEQ ID NO: 13869 - DNA, 10 bp, Artificial sequence
  Synthetic
gtcataaaaa

SEQ ID NO: 13870 - DNA, 15 bp, Artificial sequence
  Synthetic
aacaaaatggcggcc

SEQ ID NO: 13871 - DNA, 19 bp, Artificial sequence
  Synthetic
acaggtcactgtgacctga

SEQ ID NO: 13872 - DNA, 18 bp, Artificial sequence
  Synthetic
aaaggtcaagagaggtca

SEQ ID NO: 13873 - DNA, 11 bp, Artificial sequence
  Synthetic
ccgcccacgca

SEQ ID NO: 13874 - DNA, 15 bp, Artificial sequence
  Synthetic
cccgcatacaacgaa

SEQ ID NO: 13875 - DNA, 9 bp, Artificial sequence
  Synthetic
aagtttcac

SEQ ID NO: 13876 - DNA, 11 bp, Artificial sequence
  Synthetic
aacacctgtca

SEQ ID NO: 13877 - DNA, 15 bp, Artificial sequence
  Synthetic
aagtgaaagtgaaag

SEQ ID NO: 13878 - DNA, 9 bp, Artificial sequence
  Synthetic
gcacgtgca

SEQ ID NO: 13879 - DNA, 8 bp, Artificial sequence
  Synthetic
agagggcg

SEQ ID NO: 13880 - DNA, 12 bp, Artificial sequence
  Synthetic
aatatgcaaatt

SEQ ID NO: 13881 - DNA, 10 bp, Artificial sequence
  Synthetic
ctgtcactca

SEQ ID NO: 13882 - DNA, 15 bp, Artificial sequence
  Synthetic
ctgggaaatccccta

SEQ ID NO: 13883 - DNA, 10 bp, Artificial sequence
  Synthetic
tgacccggaa

SEQ ID NO: 13884 - DNA, 18 bp, Artificial sequence
  Synthetic
atcgataaaattatcgat

SEQ ID NO: 13885 - DNA, 22 bp, Artificial sequence
  Synthetic
gcaaggcattctgggaagtgta

SEQ ID NO: 13886 - DNA, 9 bp, Artificial sequence
  Synthetic
gaccaatta

SEQ ID NO: 13887 - DNA, 10 bp, Artificial sequence
  Synthetic
ggtgacgtga

SEQ ID NO: 13888 - DNA, 7 bp, Artificial sequence
  Synthetic
cacgtgc

SEQ ID NO: 13889 - DNA, 11 bp, Artificial sequence
  Synthetic
agccaatggga

SEQ ID NO: 13890 - DNA, 14 bp, Artificial sequence
  Synthetic
gaaccggaagtggc

SEQ ID NO: 13891 - DNA, 15 bp, Artificial sequence
  Synthetic
accagccaatcagag

SEQ ID NO: 13892 - DNA, 9 bp, Artificial sequence
  Synthetic
accagctgc

SEQ ID NO: 13893 - DNA, 15 bp, Artificial sequence
  Synthetic
cagccaagcgtgacc

SEQ ID NO: 13894 - DNA, 10 bp, Artificial sequence
  Synthetic
cataaacaaa

SEQ ID NO: 13895 - DNA, 8 bp, Artificial sequence
  Synthetic
agaggaag

SEQ ID NO: 13896 - DNA, 10 bp, Artificial sequence
  Synthetic
caattaatga

SEQ ID NO: 13897 - DNA, 10 bp, Artificial sequence
  Synthetic
accacgtgct

SEQ ID NO: 13898 - DNA, 18 bp, Artificial sequence
  Synthetic
gggattcgaacccgggac

SEQ ID NO: 13899 - DNA, 15 bp, Artificial sequence
  Synthetic
aaggggatttccaaa

SEQ ID NO: 13900 - DNA, 8 bp, Artificial sequence
  Synthetic
catttcta

SEQ ID NO: 13901 - DNA, 7 bp, Artificial sequence
  Synthetic
gaggtca

SEQ ID NO: 13902 - DNA, 15 bp, Artificial sequence
  Synthetic
aaggggatttccaag

SEQ ID NO: 13903 - DNA, 9 bp, Artificial sequence
  Synthetic
agtaaacaa

SEQ ID NO: 13904 - DNA, 13 bp, Artificial sequence
  Synthetic
gccactagagggc

SEQ ID NO: 13905 - DNA, 9 bp, Artificial sequence
  Synthetic
agttttcca

SEQ ID NO: 13906 - DNA, 10 bp, Artificial sequence
  Synthetic
actaattaaa

SEQ ID NO: 13907 - DNA, 10 bp, Artificial sequence
  Synthetic
actaattaag

SEQ ID NO: 13908 - DNA, 19 bp, Artificial sequence
  Synthetic
ggacatgcccaggcatgcc

SEQ ID NO: 13909 - DNA, 16 bp, Artificial sequence
  Synthetic
aaagtaaacaaaaatt

SEQ ID NO: 13910 - DNA, 10 bp, Artificial sequence
  Synthetic
cccccccacg

SEQ ID NO: 13911 - DNA, 10 bp, Artificial sequence
  Synthetic
cccccccaca

SEQ ID NO: 13912 - DNA, 14 bp, Artificial sequence
  Synthetic
gaagccataacggc

SEQ ID NO: 13913 - DNA, 18 bp, Artificial sequence
  Synthetic
tatgtaaatattgacata

SEQ ID NO: 13914 - DNA, 9 bp, Artificial sequence
  Synthetic
cgcgccaaa

SEQ ID NO: 13915 - DNA, 10 bp, Artificial sequence
  Synthetic
aaaccgcaaa

SEQ ID NO: 13916 - DNA, 19 bp, Artificial sequence
  Synthetic
ccgcggttgccatggcaac

SEQ ID NO: 13917 - DNA, 11 bp, Artificial sequence
  Synthetic
gccacacccac

SEQ ID NO: 13918 - DNA, 9 bp, Artificial sequence
  Synthetic
acacgtcac

SEQ ID NO: 13919 - DNA, 11 bp, Artificial sequence
  Synthetic
agcaattaaca

SEQ ID NO: 13920 - DNA, 10 bp, Artificial sequence
  Synthetic
cgcatgcgca

SEQ ID NO: 13921 - DNA, 10 bp, Artificial sequence
  Synthetic
cccgcccccc

SEQ ID NO: 13922 - DNA, 11 bp, Artificial sequence
  Synthetic
gcccacgtgac

SEQ ID NO: 13923 - DNA, 12 bp, Artificial sequence
  Synthetic
catgactcagca

SEQ ID NO: 13924 - DNA, 7 bp, Artificial sequence
  Synthetic
acatcct

SEQ ID NO: 13925 - DNA, 13 bp, Artificial sequence
  Synthetic
ggtcaaaggtcac

SEQ ID NO: 13926 - DNA, 15 bp, Artificial sequence
  Synthetic
gtccatggtgctgaa

SEQ ID NO: 13927 - DNA, 10 bp, Artificial sequence
  Synthetic
gtcccgcaac

SEQ ID NO: 13928 - DNA, 14 bp, Artificial sequence
  Synthetic
agtaccgttatttg

SEQ ID NO: 13929 - DNA, 17 bp, Artificial sequence
  Synthetic
cgtcacgcatgactgca

SEQ ID NO: 13930 - DNA, 15 bp, Artificial sequence
  Synthetic
gaaaatgaaactgaa

SEQ ID NO: 13931 - DNA, 13 bp, Artificial sequence
  Synthetic
ccccaagtgaagg

SEQ ID NO: 13932 - DNA, 17 bp, Artificial sequence
  Synthetic
aaggtcaccagaggtca

SEQ ID NO: 13933 - DNA, 11 bp, Artificial sequence
  Synthetic
agcctcaggca

SEQ ID NO: 13934 - DNA, 13 bp, Artificial sequence
  Synthetic
ctcgacctaatta

SEQ ID NO: 13935 - DNA, 10 bp, Artificial sequence
  Synthetic
cagtcaagcg

SEQ ID NO: 13936 - DNA, 27 bp, Artificial sequence
  Synthetic
cccccaagaacaccatgtccccccccc

SEQ ID NO: 13937 - DNA, 12 bp, Artificial sequence
  Synthetic
taaatcactgca

SEQ ID NO: 13938 - DNA, 12 bp, Artificial sequence
  Synthetic
ccggacacaatc

SEQ ID NO: 13939 - DNA, 13 bp, Artificial sequence
  Synthetic
ttaattaaattaa

SEQ ID NO: 13940 - DNA, 21 bp, Artificial sequence
  Synthetic
ggcgctgtccatggtgctgaa

SEQ ID NO: 13941 - DNA, 15 bp, Artificial sequence
  Synthetic
cctagcaacagatga

SEQ ID NO: 13942 - DNA, 8 bp, Artificial sequence
  Synthetic
aattgata

SEQ ID NO: 13943 - DNA, 11 bp, Artificial sequence
  Synthetic
gagacatgtcc

SEQ ID NO: 13944 - DNA, 10 bp, Artificial sequence
  Synthetic
gcggacgtta

SEQ ID NO: 13945 - DNA, 10 bp, Artificial sequence
  Synthetic
atcacatgac

SEQ ID NO: 13946 - DNA, 28 bp, Artificial sequence
  Synthetic
ggggcggctacgcatcattgcgcctcga

SEQ ID NO: 13947 - DNA, 9 bp, Artificial sequence
  Synthetic
tcgtgctca

SEQ ID NO: 13948 - DNA, 10 bp, Artificial sequence
  Synthetic
agcacgtgac

SEQ ID NO: 13949 - DNA, 11 bp, Artificial sequence
  Synthetic
ctgagtaaaca

SEQ ID NO: 13950 - DNA, 12 bp, Artificial sequence
  Synthetic
cgccaggtgcag

SEQ ID NO: 13951 - DNA, 10 bp, Artificial sequence
  Synthetic
aagcaattaa

SEQ ID NO: 13952 - DNA, 17 bp, Artificial sequence
  Synthetic
cagcagccgccggcgcg

SEQ ID NO: 13953 - DNA, 17 bp, Artificial sequence
  Synthetic
aattttacatgtattta

SEQ ID NO: 13954 - DNA, 8 bp, Artificial sequence
  Synthetic
caggtcaa

SEQ ID NO: 13955 - DNA, 10 bp, Artificial sequence
  Synthetic
gaacacctgc

SEQ ID NO: 13956 - DNA, 19 bp, Artificial sequence
  Synthetic
acgaagccattaagccctc

SEQ ID NO: 13957 - DNA, 8 bp, Artificial sequence
  Synthetic
gatttccc

SEQ ID NO: 13958 - DNA, 15 bp, Artificial sequence
  Synthetic
agtgcgtgggcgtag

SEQ ID NO: 13959 - DNA, 18 bp, Artificial sequence
  Synthetic
aattttggcgccaaaact

SEQ ID NO: 13960 - DNA, 17 bp, Artificial sequence
  Synthetic
actttggtttcgatcag

SEQ ID NO: 13961 - DNA, 20 bp, Artificial sequence
  Synthetic
aatggaaaattattttccct

SEQ ID NO: 13962 - DNA, 10 bp, Artificial sequence
  Synthetic
gcgtgggaga

SEQ ID NO: 13963 - DNA, 9 bp, Artificial sequence
  Synthetic
gggcaaccc

SEQ ID NO: 13964 - DNA, 9 bp, Artificial sequence
  Synthetic
acaggtggt

SEQ ID NO: 13965 - DNA, 14 bp, Artificial sequence
  Synthetic
gtgccacgtcatca

SEQ ID NO: 13966 - DNA, 9 bp, Artificial sequence
  Synthetic
attgcgtaa

SEQ ID NO: 13967 - DNA, 25 bp, Artificial sequence
  Synthetic
gtcgcttctcacacctctgatggca

SEQ ID NO: 13968 - DNA, 18 bp, Artificial sequence
  Synthetic
gggaacattatgtcctaa

SEQ ID NO: 13969 - DNA, 17 bp, Artificial sequence
  Synthetic
ataggacacgtcatcat

SEQ ID NO: 13970 - DNA, 10 bp, Artificial sequence
  Synthetic
gaggtcatgc

SEQ ID NO: 13971 - DNA, 14 bp, Artificial sequence
  Synthetic
cacattcctgcgcc

SEQ ID NO: 13972 - DNA, 14 bp, Artificial sequence
  Synthetic
taattagctaatta

SEQ ID NO: 13973 - DNA, 11 bp, Artificial sequence
  Synthetic
gtccgccatta

SEQ ID NO: 13974 - DNA, 10 bp, Artificial sequence
  Synthetic
gcacttgagc

SEQ ID NO: 13975 - DNA, 15 bp, Artificial sequence
  Synthetic
aggtcaccctgacct

SEQ ID NO: 13976 - DNA, 9 bp, Artificial sequence
  Synthetic
atgcgtggg

SEQ ID NO: 13977 - DNA, 8 bp, Artificial sequence
  Synthetic
cagataag

SEQ ID NO: 13978 - DNA, 17 bp, Artificial sequence
  Synthetic
cattaattatgcatgag

SEQ ID NO: 13979 - DNA, 15 bp, Artificial sequence
  Synthetic
caagatggcggcccc

SEQ ID NO: 13980 - DNA, 15 bp, Artificial sequence
  Synthetic
agttaatcattaact

SEQ ID NO: 13981 - DNA, 14 bp, Artificial sequence
  Synthetic
caggatgagtcacc

SEQ ID NO: 13982 - DNA, 10 bp, Artificial sequence
  Synthetic
gaccgaaacc

SEQ ID NO: 13983 - DNA, 8 bp, Artificial sequence
  Synthetic
accaatta

SEQ ID NO: 13984 - DNA, 8 bp, Artificial sequence
  Synthetic
gcacttaa

SEQ ID NO: 13985 - DNA, 12 bp, Artificial sequence
  Synthetic
aaacaaacatcc

SEQ ID NO: 13986 - DNA, 15 bp, Artificial sequence
  Synthetic
atcgcctcaggcaat

SEQ ID NO: 13987 - DNA, 7 bp, Artificial sequence
  Synthetic
aattaaa

SEQ ID NO: 13988 - DNA, 15 bp, Artificial sequence
  Synthetic
caccaatatgtatgg

SEQ ID NO: 13989 - DNA, 12 bp, Artificial sequence
  Synthetic
gaccacgtggtc

SEQ ID NO: 13990 - DNA, 21 bp, Artificial sequence
  Synthetic
aaactacaattcccagaatgc

SEQ ID NO: 13991 - DNA, 17 bp, Artificial sequence
  Synthetic
caaactaattaattatc

SEQ ID NO: 13992 - DNA, 10 bp, Artificial sequence
  Synthetic
accacgtgat

SEQ ID NO: 13993 - DNA, 11 bp, Artificial sequence
  Synthetic
ggcacgtgcca

SEQ ID NO: 13994 - DNA, 9 bp, Artificial sequence
  Synthetic
taacggtca

SEQ ID NO: 13995 - DNA, 12 bp, Artificial sequence
  Synthetic
attgtaaacaaa

SEQ ID NO: 13996 - DNA, 11 bp, Artificial sequence
  Synthetic
aacagctgcag

SEQ ID NO: 13997 - DNA, 11 bp, Artificial sequence
  Synthetic
cacttccggcc

SEQ ID NO: 13998 - DNA, 8 bp, Artificial sequence
  Synthetic
cacttgag

SEQ ID NO: 13999 - DNA, 15 bp, Artificial sequence
  Synthetic
aacaatgaaattgtt

SEQ ID NO: 14000 - DNA, 17 bp, Artificial sequence
  Synthetic
aatccctttgatctatc

SEQ ID NO: 14001 - DNA, 16 bp, Artificial sequence
  Synthetic
gagtccaaagtccatc

SEQ ID NO: 14002 - DNA, 15 bp, Artificial sequence
  Synthetic
tacgtaactgacgta

SEQ ID NO: 14003 - DNA, 8 bp, Artificial sequence
  Synthetic
gtcattaa

SEQ ID NO: 14004 - DNA, 12 bp, Artificial sequence
  Synthetic
aatgacgtcacc

SEQ ID NO: 14005 - DNA, 9 bp, Artificial sequence
  Synthetic
cgtgacccc

SEQ ID NO: 14006 - DNA, 12 bp, Artificial sequence
  Synthetic
cccggtgaaccc

SEQ ID NO: 14007 - DNA, 8 bp, Artificial sequence
  Synthetic
cttatctc

SEQ ID NO: 14008 - DNA, 13 bp, Artificial sequence
  Synthetic
aaattaattaatc

SEQ ID NO: 14009 - DNA, 9 bp, Artificial sequence
  Synthetic
cgtacgtca

SEQ ID NO: 14010 - DNA, 15 bp, Artificial sequence
  Synthetic
aggtggctgccccac

SEQ ID NO: 14011 - DNA, 8 bp, Artificial sequence
  Synthetic
aacggaag

SEQ ID NO: 14012 - DNA, 12 bp, Artificial sequence
  Synthetic
aaaaaaacacaa

SEQ ID NO: 14013 - DNA, 15 bp, Artificial sequence
  Synthetic
ctgggaattgtagtc

SEQ ID NO: 14014 - DNA, 12 bp, Artificial sequence
  Synthetic
aaataagtatat

SEQ ID NO: 14015 - DNA, 10 bp, Artificial sequence
  Synthetic
aaagtcaatt

SEQ ID NO: 14016 - DNA, 9 bp, Artificial sequence
  Synthetic
agggccccc

SEQ ID NO: 14017 - DNA, 16 bp, Artificial sequence
  Synthetic
gaattaattagttgca

SEQ ID NO: 14018 - DNA, 17 bp, Artificial sequence
  Synthetic
aatgcaataaaatttat

SEQ ID NO: 14019 - DNA, 10 bp, Artificial sequence
  Synthetic
aaatctcgcg

SEQ ID NO: 14020 - DNA, 16 bp, Artificial sequence
  Synthetic
ccctccgcctgggggc

SEQ ID NO: 14021 - DNA, 8 bp, Artificial sequence
  Synthetic
aggtgtca

SEQ ID NO: 14022 - DNA, 12 bp, Artificial sequence
  Synthetic
atgtaaacaagc

SEQ ID NO: 14023 - DNA, 17 bp, Artificial sequence
  Synthetic
catcaataacattgatc

SEQ ID NO: 14024 - DNA, 17 bp, Artificial sequence
  Synthetic
gccaccagggggcgcca

SEQ ID NO: 14025 - DNA, 10 bp, Artificial sequence
  Synthetic
acagataagg

SEQ ID NO: 14026 - DNA, 8 bp, Artificial sequence
  Synthetic
ccactaga

SEQ ID NO: 14027 - DNA, 10 bp, Artificial sequence
  Synthetic
acagataaga

SEQ ID NO: 14028 - DNA, 12 bp, Artificial sequence
  Synthetic
ccctcaagagcc

SEQ ID NO: 14029 - DNA, 7 bp, Artificial sequence
  Synthetic
cacctgc

SEQ ID NO: 14030 - DNA, 16 bp, Artificial sequence
  Synthetic
gtagtaattaatgcaa

SEQ ID NO: 14031 - DNA, 10 bp, Artificial sequence
  Synthetic
atgaatatgc

SEQ ID NO: 14032 - DNA, 17 bp, Artificial sequence
  Synthetic
ataaacaattgtaaaca

SEQ ID NO: 14033 - DNA, 10 bp, Artificial sequence
  Synthetic
atgccagacc

SEQ ID NO: 14034 - DNA, 10 bp, Artificial sequence
  Synthetic
taggaacata

SEQ ID NO: 14035 - DNA, 9 bp, Artificial sequence
  Synthetic
gataaacaa

SEQ ID NO: 14036 - DNA, 18 bp, Artificial sequence
  Synthetic
actgttaattattaacca

SEQ ID NO: 14037 - DNA, 10 bp, Artificial sequence
  Synthetic
atcacgcgat

SEQ ID NO: 14038 - DNA, 15 bp, Artificial sequence
  Synthetic
caaaatcgaaactaa

SEQ ID NO: 14039 - DNA, 9 bp, Artificial sequence
  Synthetic
ccaggtgca

SEQ ID NO: 14040 - DNA, 10 bp, Artificial sequence
  Synthetic
aaatcccctc

SEQ ID NO: 14041 - DNA, 10 bp, Artificial sequence
  Synthetic
aacggtagca

SEQ ID NO: 14042 - DNA, 14 bp, Artificial sequence
  Synthetic
agggtcaatgacct

SEQ ID NO: 14043 - DNA, 12 bp, Artificial sequence
  Synthetic
aaaatgaaactg

SEQ ID NO: 14044 - DNA, 8 bp, Artificial sequence
  Synthetic
agaaaaat

SEQ ID NO: 14045 - DNA, 11 bp, Artificial sequence
  Synthetic
acgcccacgca

SEQ ID NO: 14046 - DNA, 9 bp, Artificial sequence
  Synthetic
aattgacat

SEQ ID NO: 14047 - DNA, 17 bp, Artificial sequence
  Synthetic
gatgattaatcccttca

SEQ ID NO: 14048 - DNA, 8 bp, Artificial sequence
  Synthetic
ataatgaa

SEQ ID NO: 14049 - DNA, 11 bp, Artificial sequence
  Synthetic
aacacctgttg

SEQ ID NO: 14050 - DNA, 9 bp, Artificial sequence
  Synthetic
actcattga

SEQ ID NO: 14051 - DNA, 8 bp, Artificial sequence
  Synthetic
ggggtcaa

SEQ ID NO: 14052 - DNA, 14 bp, Artificial sequence
  Synthetic
atgccctagggcaa

SEQ ID NO: 14053 - DNA, 8 bp, Artificial sequence
  Synthetic
ggggtcac

SEQ ID NO: 14054 - DNA, 11 bp, Artificial sequence
  Synthetic
attaactacac

SEQ ID NO: 14055 - DNA, 15 bp, Artificial sequence
  Synthetic
accgcaccatctgtc

SEQ ID NO: 14056 - DNA, 12 bp, Artificial sequence
  Synthetic
aattttccattg

SEQ ID NO: 14057 - DNA, 14 bp, Artificial sequence
  Synthetic
ccaaccggaagtcc

SEQ ID NO: 14058 - DNA, 11 bp, Artificial sequence
  Synthetic
ccatatgtcac

SEQ ID NO: 14059 - DNA, 13 bp, Artificial sequence
  Synthetic
cgaaatcacggcc

SEQ ID NO: 14060 - DNA, 9 bp, Artificial sequence
  Synthetic
tccacttaa

SEQ ID NO: 14061 - DNA, 11 bp, Artificial sequence
  Synthetic
cacgtggttcc

SEQ ID NO: 14062 - DNA, 17 bp, Artificial sequence
  Synthetic
aacgctaattagcggtg

SEQ ID NO: 14063 - DNA, 15 bp, Artificial sequence
  Synthetic
cccacttcctgtctc

SEQ ID NO: 14064 - DNA, 21 bp, Artificial sequence
  Synthetic
cggccaccagggggcgccgga

SEQ ID NO: 14065 - DNA, 14 bp, Artificial sequence
  Synthetic
ccataaaactgtca

SEQ ID NO: 14066 - DNA, 7 bp, Artificial sequence
  Synthetic
attacaa

SEQ ID NO: 14067 - DNA, 10 bp, Artificial sequence
  Synthetic
aaaacaatgg

SEQ ID NO: 14068 - DNA, 17 bp, Artificial sequence
  Synthetic
gaaatttaatccctcta

SEQ ID NO: 14069 - DNA, 17 bp, Artificial sequence
  Synthetic
tattatgggatggataa

SEQ ID NO: 14070 - DNA, 17 bp, Artificial sequence
  Synthetic
caattcttatctctata

SEQ ID NO: 14071 - DNA, 7 bp, Artificial sequence
  Synthetic
cacgtga

SEQ ID NO: 14072 - DNA, 21 bp, Artificial sequence
  Synthetic
ccagatggcacggacacaaca

SEQ ID NO: 14073 - DNA, 11 bp, Artificial sequence
  Synthetic
ccagggggcgc

SEQ ID NO: 14074 - DNA, 11 bp, Artificial sequence
  Synthetic
taatctaatta

SEQ ID NO: 14075 - DNA, 14 bp, Artificial sequence
  Synthetic
gcgaaacatctgga

SEQ ID NO: 14076 - DNA, 7 bp, Artificial sequence
  Synthetic
cacgtgg

SEQ ID NO: 14077 - DNA, 17 bp, Artificial sequence
  Synthetic
agtgccgtgtgcaaaac

SEQ ID NO: 14078 - DNA, 7 bp, Artificial sequence
  Synthetic
gcatgac

SEQ ID NO: 14079 - DNA, 17 bp, Artificial sequence
  Synthetic
ataagtgataccctatc

SEQ ID NO: 14080 - DNA, 10 bp, Artificial sequence
  Synthetic
accaattaag

SEQ ID NO: 14081 - DNA, 10 bp, Artificial sequence
  Synthetic
accaattaac

SEQ ID NO: 14082 - DNA, 11 bp, Artificial sequence
  Synthetic
accatctgccg

SEQ ID NO: 14083 - DNA, 24 bp, Artificial sequence
  Synthetic
cggccccgccccccccctggcccc

SEQ ID NO: 14084 - DNA, 13 bp, Artificial sequence
  Synthetic
cccacgtacgcac

SEQ ID NO: 14085 - DNA, 9 bp, Artificial sequence
  Synthetic
tcaaggtca

SEQ ID NO: 14086 - DNA, 17 bp, Artificial sequence
  Synthetic
gataattaatcccttcc

SEQ ID NO: 14087 - DNA, 9 bp, Artificial sequence
  Synthetic
ggcaattaa

SEQ ID NO: 14088 - DNA, 14 bp, Artificial sequence
  Synthetic
agcatgactcagca

SEQ ID NO: 14089 - DNA, 10 bp, Artificial sequence
  Synthetic
aaccacgtga

SEQ ID NO: 14090 - DNA, 10 bp, Artificial sequence
  Synthetic
aaccacgtgg

SEQ ID NO: 14091 - DNA, 10 bp, Artificial sequence
  Synthetic
acccggaaat

SEQ ID NO: 14092 - DNA, 14 bp, Artificial sequence
  Synthetic
tataagtaggtcaa

SEQ ID NO: 14093 - DNA, 10 bp, Artificial sequence
  Synthetic
attcatgtgc

SEQ ID NO: 14094 - DNA, 11 bp, Artificial sequence
  Synthetic
cagggtgtggc

SEQ ID NO: 14095 - DNA, 10 bp, Artificial sequence
  Synthetic
gtcattaaga

SEQ ID NO: 14096 - DNA, 16 bp, Artificial sequence
  Synthetic
caggtgacctttgaga

SEQ ID NO: 14097 - DNA, 10 bp, Artificial sequence
  Synthetic
ccccgcccgc

SEQ ID NO: 14098 - DNA, 17 bp, Artificial sequence
  Synthetic
ataaacaagtgtaaaca

SEQ ID NO: 14099 - DNA, 8 bp, Artificial sequence
  Synthetic
acccgcat

SEQ ID NO: 14100 - DNA, 14 bp, Artificial sequence
  Synthetic
aagtgggcgtggcc

SEQ ID NO: 14101 - DNA, 10 bp, Artificial sequence
  Synthetic
cagcaccagg

SEQ ID NO: 14102 - DNA, 10 bp, Artificial sequence
  Synthetic
atatgcaaat

SEQ ID NO: 14103 - DNA, 12 bp, Artificial sequence
  Synthetic
ccttcccgccca

SEQ ID NO: 14104 - DNA, 10 bp, Artificial sequence
  Synthetic
caaaggtcaa

SEQ ID NO: 14105 - DNA, 10 bp, Artificial sequence
  Synthetic
caaaggtcag

SEQ ID NO: 14106 - DNA, 14 bp, Artificial sequence
  Synthetic
aggagatgactcat

SEQ ID NO: 14107 - DNA, 8 bp, Artificial sequence
  Synthetic
ctaatggc

SEQ ID NO: 14108 - DNA, 18 bp, Artificial sequence
  Synthetic
taaccgcaaaaaccgcaa

SEQ ID NO: 14109 - DNA, 15 bp, Artificial sequence
  Synthetic
aagtatgagtcatca

SEQ ID NO: 14110 - DNA, 9 bp, Artificial sequence
  Synthetic
ccctccccc

SEQ ID NO: 14111 - DNA, 17 bp, Artificial sequence
  Synthetic
attttagttaactaagg

SEQ ID NO: 14112 - DNA, 11 bp, Artificial sequence
  Synthetic
aagaggattag

SEQ ID NO: 14113 - DNA, 15 bp, Artificial sequence
  Synthetic
gaggatgagtcacca

SEQ ID NO: 14114 - DNA, 9 bp, Artificial sequence
  Synthetic
gccgttaga

SEQ ID NO: 14115 - DNA, 17 bp, Artificial sequence
  Synthetic
gggaacattatgtaccc

SEQ ID NO: 14116 - DNA, 30 bp, Artificial sequence
  Synthetic
tgccaactcccccattagtgctcgactcca

SEQ ID NO: 14117 - DNA, 17 bp, Artificial sequence
  Synthetic
aagagggattaattatc

SEQ ID NO: 14118 - DNA, 16 bp, Artificial sequence
  Synthetic
cagcattaattagtag

SEQ ID NO: 14119 - DNA, 9 bp, Artificial sequence
  Synthetic
aggatgaat

SEQ ID NO: 14120 - DNA, 10 bp, Artificial sequence
  Synthetic
cttaattagc

SEQ ID NO: 14121 - DNA, 8 bp, Artificial sequence
  Synthetic
ctgtttac

SEQ ID NO: 14122 - DNA, 22 bp, Artificial sequence
  Synthetic
ctttatttcttatctctaaaaa

SEQ ID NO: 14123 - DNA, 11 bp, Artificial sequence
  Synthetic
atgactcatcc

SEQ ID NO: 14124 - DNA, 11 bp, Artificial sequence
  Synthetic
agataaggcct

SEQ ID NO: 14125 - DNA, 17 bp, Artificial sequence
  Synthetic
aaaattgctgagtcatg

SEQ ID NO: 14126 - DNA, 12 bp, Artificial sequence
  Synthetic
cagcagctgctg

SEQ ID NO: 14127 - DNA, 10 bp, Artificial sequence
  Synthetic
cacacacctg

SEQ ID NO: 14128 - DNA, 10 bp, Artificial sequence
  Synthetic
atcaaggtca

SEQ ID NO: 14129 - DNA, 15 bp, Artificial sequence
  Synthetic
cagatctcgcgagag

SEQ ID NO: 14130 - DNA, 7 bp, Artificial sequence
  Synthetic
acaggtg

SEQ ID NO: 14131 - DNA, 15 bp, Artificial sequence
  Synthetic
gccaccagggggcac

SEQ ID NO: 14132 - DNA, 15 bp, Artificial sequence
  Synthetic
aatttgattgatggg

SEQ ID NO: 14133 - DNA, 8 bp, Artificial sequence
  Synthetic
caacagaa

SEQ ID NO: 14134 - DNA, 10 bp, Artificial sequence
  Synthetic
agcacttaag

SEQ ID NO: 14135 - DNA, 16 bp, Artificial sequence
  Synthetic
aggttaattaactcaa

SEQ ID NO: 14136 - DNA, 11 bp, Artificial sequence
  Synthetic
aatgtatcaat

SEQ ID NO: 14137 - DNA, 18 bp, Artificial sequence
  Synthetic
acatgtccatggacatgt

SEQ ID NO: 14138 - DNA, 9 bp, Artificial sequence
  Synthetic
cacgtgacc

SEQ ID NO: 14139 - DNA, 10 bp, Artificial sequence
  Synthetic
ataattcata

SEQ ID NO: 14140 - DNA, 14 bp, Artificial sequence
  Synthetic
tcgaggctagacca

SEQ ID NO: 14141 - DNA, 15 bp, Artificial sequence
  Synthetic
tcagcaccatggaca

SEQ ID NO: 14142 - DNA, 10 bp, Artificial sequence
  Synthetic
aaagatgaat

SEQ ID NO: 14143 - DNA, 10 bp, Artificial sequence
  Synthetic
gccacgtggc

SEQ ID NO: 14144 - DNA, 17 bp, Artificial sequence
  Synthetic
aatcaattgcagtgatt

SEQ ID NO: 14145 - DNA, 11 bp, Artificial sequence
  Synthetic
catgcgggtac

SEQ ID NO: 14146 - DNA, 14 bp, Artificial sequence
  Synthetic
atggcgcgtgccgc

SEQ ID NO: 14147 - DNA, 10 bp, Artificial sequence
  Synthetic
cccaattagc

SEQ ID NO: 14148 - DNA, 13 bp, Artificial sequence
  Synthetic
caaggttggttgc

SEQ ID NO: 14149 - DNA, 16 bp, Artificial sequence
  Synthetic
ccaccagggggcgccg

SEQ ID NO: 14150 - DNA, 10 bp, Artificial sequence
  Synthetic
aaaactacaa

SEQ ID NO: 14151 - DNA, 11 bp, Artificial sequence
  Synthetic
tgtttgcttaa

SEQ ID NO: 14152 - DNA, 15 bp, Artificial sequence
  Synthetic
aaaatgtatcaaatt

SEQ ID NO: 14153 - DNA, 11 bp, Artificial sequence
  Synthetic
gcgcctgcgca

SEQ ID NO: 14154 - DNA, 11 bp, Artificial sequence
  Synthetic
accacctgttg

SEQ ID NO: 14155 - DNA, 9 bp, Artificial sequence
  Synthetic
aaccggtta

SEQ ID NO: 14156 - DNA, 10 bp, Artificial sequence
  Synthetic
agcggaagtg

SEQ ID NO: 14157 - DNA, 13 bp, Artificial sequence
  Synthetic
ataaacaaacaga

SEQ ID NO: 14158 - DNA, 13 bp, Artificial sequence
  Synthetic
aaaaaataaacaa

SEQ ID NO: 14159 - DNA, 10 bp, Artificial sequence
  Synthetic
actagttaac

SEQ ID NO: 14160 - DNA, 11 bp, Artificial sequence
  Synthetic
aatgtaaacaa

SEQ ID NO: 14161 - DNA, 14 bp, Artificial sequence
  Synthetic
tgaatgtgcagtca

SEQ ID NO: 14162 - DNA, 11 bp, Artificial sequence
  Synthetic
gtgattggtta

SEQ ID NO: 14163 - DNA, 15 bp, Artificial sequence
  Synthetic
aaggtgacgtcatca

SEQ ID NO: 14164 - DNA, 10 bp, Artificial sequence
  Synthetic
ggcacgcgcc

SEQ ID NO: 14165 - DNA, 16 bp, Artificial sequence
  Synthetic
ccgatgacgtcatccc

SEQ ID NO: 14166 - DNA, 16 bp, Artificial sequence
  Synthetic
gggcacgcaaccctta

SEQ ID NO: 14167 - DNA, 11 bp, Artificial sequence
  Synthetic
cagccaatgag

SEQ ID NO: 14168 - DNA, 15 bp, Artificial sequence
  Synthetic
ccggcaggtgtccgc

SEQ ID NO: 14169 - DNA, 12 bp, Artificial sequence
  Synthetic
ccccttgagtca

SEQ ID NO: 14170 - DNA, 18 bp, Artificial sequence
  Synthetic
aaaaattgctgactcagc

SEQ ID NO: 14171 - DNA, 10 bp, Artificial sequence
  Synthetic
ggcaacgccc

SEQ ID NO: 14172 - DNA, 13 bp, Artificial sequence
  Synthetic
aaattgctgacgt

SEQ ID NO: 14173 - DNA, 16 bp, Artificial sequence
  Synthetic
aaaaaagaaaatgaaa

SEQ ID NO: 14174 - DNA, 10 bp, Artificial sequence
  Synthetic
aaccttatat

SEQ ID NO: 14175 - DNA, 12 bp, Artificial sequence
  Synthetic
acgcagctgcgc

SEQ ID NO: 14176 - DNA, 10 bp, Artificial sequence
  Synthetic
tattaatcga

SEQ ID NO: 14177 - DNA, 10 bp, Artificial sequence
  Synthetic
ggcacgtgcc

SEQ ID NO: 14178 - DNA, 15 bp, Artificial sequence
  Synthetic
aaatatgcaaatcac

SEQ ID NO: 14179 - DNA, 16 bp, Artificial sequence
  Synthetic
cagaacagattgtacc

SEQ ID NO: 14180 - DNA, 6 bp, Artificial sequence
  Synthetic
taatta

SEQ ID NO: 14181 - DNA, 13 bp, Artificial sequence
  Synthetic
taaacaaaaacaa

SEQ ID NO: 14182 - DNA, 6 bp, Artificial sequence
  Synthetic
gatggc

SEQ ID NO: 14183 - DNA, 14 bp, Artificial sequence
  Synthetic
ggggtttccctacc

SEQ ID NO: 14184 - DNA, 8 bp, Artificial sequence
  Synthetic
tgacgtca

SEQ ID NO: 14185 - DNA, 9 bp, Artificial sequence
  Synthetic
aagtccagt

SEQ ID NO: 14186 - DNA, 8 bp, Artificial sequence
  Synthetic
ttaataaa

SEQ ID NO: 14187 - DNA, 14 bp, Artificial sequence
  Synthetic
gaggtcatgacccc

SEQ ID NO: 14188 - DNA, 17 bp, Artificial sequence
  Synthetic
cccctcctgatgccccc

SEQ ID NO: 14189 - DNA, 8 bp, Artificial sequence
  Synthetic
tataaata

SEQ ID NO: 14190 - DNA, 11 bp, Artificial sequence
  Synthetic
gatcacgtgac

SEQ ID NO: 14191 - DNA, 12 bp, Artificial sequence
  Synthetic
acggacacaatg

SEQ ID NO: 14192 - DNA, 8 bp, Artificial sequence
  Synthetic
gtacgtca

SEQ ID NO: 14193 - DNA, 16 bp, Artificial sequence
  Synthetic
ctcgtgacctttgaga

SEQ ID NO: 14194 - DNA, 10 bp, Artificial sequence
  Synthetic
aaatgactgg

SEQ ID NO: 14195 - DNA, 13 bp, Artificial sequence
  Synthetic
atcagataagggg

SEQ ID NO: 14196 - DNA, 11 bp, Artificial sequence
  Synthetic
tgatgacgcaa

SEQ ID NO: 14197 - DNA, 6 bp, Artificial sequence
  Synthetic
agatag

SEQ ID NO: 14198 - DNA, 13 bp, Artificial sequence
  Synthetic
aggggatttccaa

SEQ ID NO: 14199 - DNA, 11 bp, Artificial sequence
  Synthetic
ccgctgactcc

SEQ ID NO: 14200 - DNA, 8 bp, Artificial sequence
  Synthetic
gtcagcaa

SEQ ID NO: 14201 - DNA, 8 bp, Artificial sequence
  Synthetic
caattagc

SEQ ID NO: 14202 - DNA, 12 bp, Artificial sequence
  Synthetic
tttcgcgccaaa

SEQ ID NO: 14203 - DNA, 12 bp, Artificial sequence
  Synthetic
ccttacgtcacc

SEQ ID NO: 14204 - DNA, 10 bp, Artificial sequence
  Synthetic
aagtaggtca

SEQ ID NO: 14205 - DNA, 13 bp, Artificial sequence
  Synthetic
aagtaaataaaca

SEQ ID NO: 14206 - DNA, 13 bp, Artificial sequence
  Synthetic
atgtgtttgttta

SEQ ID NO: 14207 - DNA, 16 bp, Artificial sequence
  Synthetic
atcaatgtgcagtgat

SEQ ID NO: 14208 - DNA, 16 bp, Artificial sequence
  Synthetic
cgaattttatggctcc

SEQ ID NO: 14209 - DNA, 8 bp, Artificial sequence
  Synthetic
aggtgtga

SEQ ID NO: 14210 - DNA, 16 bp, Artificial sequence
  Synthetic
aaattttattaccgtt

SEQ ID NO: 14211 - DNA, 15 bp, Artificial sequence
  Synthetic
ggttaatgattacca

SEQ ID NO: 14212 - DNA, 12 bp, Artificial sequence
  Synthetic
aagattgcgcaa

SEQ ID NO: 14213 - DNA, 17 bp, Artificial sequence
  Synthetic
ccaattaattaattacg

SEQ ID NO: 14214 - DNA, 6 bp, Artificial sequence
  Synthetic
aattat

SEQ ID NO: 14215 - DNA, 15 bp, Artificial sequence
  Synthetic
cctctccctcctccc

SEQ ID NO: 14216 - DNA, 12 bp, Artificial sequence
  Synthetic
gggaaatcccca

SEQ ID NO: 14217 - DNA, 12 bp, Artificial sequence
  Synthetic
gggaaatccccc

SEQ ID NO: 14218 - DNA, 6 bp, Artificial sequence
  Synthetic
aattaa

SEQ ID NO: 14219 - DNA, 14 bp, Artificial sequence
  Synthetic
tgctttctaggaaa

SEQ ID NO: 14220 - DNA, 6 bp, Artificial sequence
  Synthetic
aattag

SEQ ID NO: 14221 - DNA, 9 bp, Artificial sequence
  Synthetic
agcgtgacg

SEQ ID NO: 14222 - DNA, 16 bp, Artificial sequence
  Synthetic
ttcaattgttctaaaa

SEQ ID NO: 14223 - DNA, 13 bp, Artificial sequence
  Synthetic
agcccaaggtcac

SEQ ID NO: 14224 - DNA, 23 bp, Artificial sequence
  Synthetic
gccgccatcttgggtgcgggcaa

SEQ ID NO: 14225 - DNA, 16 bp, Artificial sequence
  Synthetic
aaacctcgtaaaattt

SEQ ID NO: 14226 - DNA, 9 bp, Artificial sequence
  Synthetic
cccataaaa

SEQ ID NO: 14227 - DNA, 10 bp, Artificial sequence
  Synthetic
agcaattaac

SEQ ID NO: 14228 - DNA, 10 bp, Artificial sequence
  Synthetic
acctttgacc

SEQ ID NO: 14229 - DNA, 10 bp, Artificial sequence
  Synthetic
aattgataca

SEQ ID NO: 14230 - DNA, 10 bp, Artificial sequence
  Synthetic
ctgacgtcac

SEQ ID NO: 14231 - DNA, 10 bp, Artificial sequence
  Synthetic
aatgtatcaa

SEQ ID NO: 14232 - DNA, 21 bp, Artificial sequence
  Synthetic
agcagttaataattaaccata

SEQ ID NO: 14233 - DNA, 10 bp, Artificial sequence
  Synthetic
gctaattaac

SEQ ID NO: 14234 - DNA, 16 bp, Artificial sequence
  Synthetic
aatttcaagtggctta

SEQ ID NO: 14235 - DNA, 16 bp, Artificial sequence
  Synthetic
acgttaattaccccaa

SEQ ID NO: 14236 - DNA, 11 bp, Artificial sequence
  Synthetic
accagggggcg

SEQ ID NO: 14237 - DNA, 11 bp, Artificial sequence
  Synthetic
gcagataagga

SEQ ID NO: 14238 - DNA, 17 bp, Artificial sequence
  Synthetic
aaaacatcgtttttaag

SEQ ID NO: 14239 - DNA, 19 bp, Artificial sequence
  Synthetic
ggggatcgcgtgacaaccc

SEQ ID NO: 14240 - DNA, 17 bp, Artificial sequence
  Synthetic
cgaattaattaacaata

SEQ ID NO: 14241 - DNA, 9 bp, Artificial sequence
  Synthetic
tgacgtaca

SEQ ID NO: 14242 - DNA, 21 bp, Artificial sequence
  Synthetic
gaactacaattcccagaaggc

SEQ ID NO: 14243 - DNA, 14 bp, Artificial sequence
  Synthetic
cattgtaatgcaaa

SEQ ID NO: 14244 - DNA, 13 bp, Artificial sequence
  Synthetic
aaaattaattaat

SEQ ID NO: 14245 - DNA, 17 bp, Artificial sequence
  Synthetic
aggtcacggagaggtca

SEQ ID NO: 14246 - DNA, 17 bp, Artificial sequence
  Synthetic
gtagttaatccccttaa

SEQ ID NO: 14247 - DNA, 27 bp, Artificial sequence
  Synthetic
ccacgaagaacaccatgtccccacccc

SEQ ID NO: 14248 - DNA, 18 bp, Artificial sequence
  Synthetic
atgccacgcccctttttg

SEQ ID NO: 14249 - DNA, 12 bp, Artificial sequence
  Synthetic
ccacctgagccc

SEQ ID NO: 14250 - DNA, 15 bp, Artificial sequence
  Synthetic
agaacaccctgtacc

SEQ ID NO: 14251 - DNA, 8 bp, Artificial sequence
  Synthetic
cctgtcaa

SEQ ID NO: 14252 - DNA, 16 bp, Artificial sequence
  Synthetic
agataagataagataa

SEQ ID NO: 14253 - DNA, 14 bp, Artificial sequence
  Synthetic
gaatgacacagcga

SEQ ID NO: 14254 - DNA, 6 bp, Artificial sequence
  Synthetic
tatgca

SEQ ID NO: 14255 - DNA, 11 bp, Artificial sequence
  Synthetic
aatgagtcaca

SEQ ID NO: 14256 - DNA, 14 bp, Artificial sequence
  Synthetic
ttttggcgccaaaa

SEQ ID NO: 14257 - DNA, 9 bp, Artificial sequence
  Synthetic
ccaattaaa

SEQ ID NO: 14258 - DNA, 8 bp, Artificial sequence
  Synthetic
actaatta

SEQ ID NO: 14259 - DNA, 11 bp, Artificial sequence
  Synthetic
tccaatccaca

SEQ ID NO: 14260 - DNA, 10 bp, Artificial sequence
  Synthetic
aaagataagc

SEQ ID NO: 14261 - DNA, 16 bp, Artificial sequence
  Synthetic
acaatgtatcaatttg

SEQ ID NO: 14262 - DNA, 8 bp, Artificial sequence
  Synthetic
aatgtatc

SEQ ID NO: 14263 - DNA, 20 bp, Artificial sequence
  Synthetic
agcagccaagatggccgcgg

SEQ ID NO: 14264 - DNA, 8 bp, Artificial sequence
  Synthetic
cttgtcaa

SEQ ID NO: 14265 - DNA, 10 bp, Artificial sequence
  Synthetic
tatgcaaata

SEQ ID NO: 14266 - DNA, 10 bp, Artificial sequence
  Synthetic
cgcagctgcg

SEQ ID NO: 14267 - DNA, 19 bp, Artificial sequence
  Synthetic
gagggcagccaagcgtgac

SEQ ID NO: 14268 - DNA, 10 bp, Artificial sequence
  Synthetic
ggtcacgtac

SEQ ID NO: 14269 - DNA, 16 bp, Artificial sequence
  Synthetic
aaaacaggaagtacgt

SEQ ID NO: 14270 - DNA, 8 bp, Artificial sequence
  Synthetic
gagatcaa

SEQ ID NO: 14271 - DNA, 13 bp, Artificial sequence
  Synthetic
gggtcaaaggtca

SEQ ID NO: 14272 - DNA, 17 bp, Artificial sequence
  Synthetic
acctttgtttacattta

SEQ ID NO: 14273 - DNA, 20 bp, Artificial sequence
  Synthetic
gcggacgttgcaacgtccgc

SEQ ID NO: 14274 - DNA, 21 bp, Artificial sequence
  Synthetic
ctggggggggcagataaggca

SEQ ID NO: 14275 - DNA, 15 bp, Artificial sequence
  Synthetic
agtgggcggggccaa

SEQ ID NO: 14276 - DNA, 5 bp, Artificial sequence
  Synthetic
accaa

SEQ ID NO: 14277 - DNA, 12 bp, Artificial sequence
  Synthetic
cattacgtaacc

SEQ ID NO: 14278 - DNA, 7 bp, Artificial sequence
  Synthetic
gtatcac

SEQ ID NO: 14279 - DNA, 12 bp, Artificial sequence
  Synthetic
cattacgtaaca

SEQ ID NO: 14280 - DNA, 10 bp, Artificial sequence
  Synthetic
ggaagtgaaa

SEQ ID NO: 14281 - DNA, 11 bp, Artificial sequence
  Synthetic
accgtgaccac

SEQ ID NO: 14282 - DNA, 16 bp, Artificial sequence
  Synthetic
gcccgtttcgcgccaa

SEQ ID NO: 14283 - DNA, 10 bp, Artificial sequence
  Synthetic
cagggggcgc

SEQ ID NO: 14284 - DNA, 14 bp, Artificial sequence
  Synthetic
gctataaatagaac

SEQ ID NO: 14285 - DNA, 22 bp, Artificial sequence
  Synthetic
tactgattatgcatatttttaa

SEQ ID NO: 14286 - DNA, 10 bp, Artificial sequence
  Synthetic
caataaacaa

SEQ ID NO: 14287 - DNA, 15 bp, Artificial sequence
  Synthetic
gaggaattaaaatac

SEQ ID NO: 14288 - DNA, 10 bp, Artificial sequence
  Synthetic
gcaatatcga

SEQ ID NO: 14289 - DNA, 10 bp, Artificial sequence
  Synthetic
aattgctgac

SEQ ID NO: 14290 - DNA, 13 bp, Artificial sequence
  Synthetic
aggggaatcccct

SEQ ID NO: 14291 - DNA, 8 bp, Artificial sequence
  Synthetic
attaatta

SEQ ID NO: 14292 - DNA, 10 bp, Artificial sequence
  Synthetic
aacacgtgtt

SEQ ID NO: 14293 - DNA, 15 bp, Artificial sequence
  Synthetic
atgacgcataccccc

SEQ ID NO: 14294 - DNA, 11 bp, Artificial sequence
  Synthetic
gatgagtcacc

SEQ ID NO: 14295 - DNA, 15 bp, Artificial sequence
  Synthetic
ggcgggaaattggaa

SEQ ID NO: 14296 - DNA, 10 bp, Artificial sequence
  Synthetic
accgtttagc

SEQ ID NO: 14297 - DNA, 14 bp, Artificial sequence
  Synthetic
caacaatgtaacaa

SEQ ID NO: 14298 - DNA, 17 bp, Artificial sequence
  Synthetic
aggtcatgcaaaggtca

SEQ ID NO: 14299 - DNA, 11 bp, Artificial sequence
  Synthetic
aaaaacaaaca

SEQ ID NO: 14300 - DNA, 11 bp, Artificial sequence
  Synthetic
acgttacataa

SEQ ID NO: 14301 - DNA, 14 bp, Artificial sequence
  Synthetic
caaaatgacatgca

SEQ ID NO: 14302 - DNA, 15 bp, Artificial sequence
  Synthetic
ccagctcaaaccagc

SEQ ID NO: 14303 - DNA, 16 bp, Artificial sequence
  Synthetic
aatgatgcgggtacga

SEQ ID NO: 14304 - DNA, 9 bp, Artificial sequence
  Synthetic
agcaaacag

SEQ ID NO: 14305 - DNA, 9 bp, Artificial sequence
  Synthetic
gcacgtgac

SEQ ID NO: 14306 - DNA, 15 bp, Artificial sequence
  Synthetic
cacttccgggaaatg

SEQ ID NO: 14307 - DNA, 24 bp, Artificial sequence
  Synthetic
aggtagagaattaggtgataaaaa

SEQ ID NO: 14308 - DNA, 11 bp, Artificial sequence
  Synthetic
gtggggtgata

SEQ ID NO: 14309 - DNA, 8 bp, Artificial sequence
  Synthetic
gtcataaa

SEQ ID NO: 14310 - DNA, 10 bp, Artificial sequence
  Synthetic
aggggtcacg

SEQ ID NO: 14311 - DNA, 10 bp, Artificial sequence
  Synthetic
aggtgtgaaa

SEQ ID NO: 14312 - DNA, 14 bp, Artificial sequence
  Synthetic
cccgcttcagtgac

SEQ ID NO: 14313 - DNA, 14 bp, Artificial sequence
  Synthetic
ccacaggcaggtgc

SEQ ID NO: 14314 - DNA, 7 bp, Artificial sequence
  Synthetic
aggtcac

SEQ ID NO: 14315 - DNA, 12 bp, Artificial sequence
  Synthetic
taatttgcataa

SEQ ID NO: 14316 - DNA, 8 bp, Artificial sequence
  Synthetic
ttgcgaaa

SEQ ID NO: 14317 - DNA, 17 bp, Artificial sequence
  Synthetic
acattcctcgcattcca

SEQ ID NO: 14318 - DNA, 8 bp, Artificial sequence
  Synthetic
tcattaaa

SEQ ID NO: 14319 - DNA, 9 bp, Artificial sequence
  Synthetic
accagcagg

SEQ ID NO: 14320 - DNA, 12 bp, Artificial sequence
  Synthetic
cgctttgttctc

SEQ ID NO: 14321 - DNA, 18 bp, Artificial sequence
  Synthetic
aaaggtcatttgaggtca

SEQ ID NO: 14322 - DNA, 11 bp, Artificial sequence
  Synthetic
gggagataaga

SEQ ID NO: 14323 - DNA, 13 bp, Artificial sequence
  Synthetic
gcagcagctgtca

SEQ ID NO: 14324 - DNA, 14 bp, Artificial sequence
  Synthetic
aatgtaaacaacac

SEQ ID NO: 14325 - DNA, 10 bp, Artificial sequence
  Synthetic
aattttccac

SEQ ID NO: 14326 - DNA, 19 bp, Artificial sequence
  Synthetic
actacaactcccagcaggc

SEQ ID NO: 14327 - DNA, 17 bp, Artificial sequence
  Synthetic
aagaacaggttgttgta

SEQ ID NO: 14328 - DNA, 12 bp, Artificial sequence
  Synthetic
gattacgtaacc

SEQ ID NO: 14329 - DNA, 10 bp, Artificial sequence
  Synthetic
actaattacc

SEQ ID NO: 14330 - DNA, 6 bp, Artificial sequence
  Synthetic
tcccca

SEQ ID NO: 14331 - DNA, 12 bp, Artificial sequence
  Synthetic
gttgccagggaa

SEQ ID NO: 14332 - DNA, 16 bp, Artificial sequence
  Synthetic
caatgcattgtgggta

SEQ ID NO: 14333 - DNA, 10 bp, Artificial sequence
  Synthetic
gccaatcaga

SEQ ID NO: 14334 - DNA, 11 bp, Artificial sequence
  Synthetic
accatatggcg

SEQ ID NO: 14335 - DNA, 15 bp, Artificial sequence
  Synthetic
agaacatcatgtact

SEQ ID NO: 14336 - DNA, 5 bp, Artificial sequence
  Synthetic
ggata

SEQ ID NO: 14337 - DNA, 12 bp, Artificial sequence
  Synthetic
aaacaaacaatc

SEQ ID NO: 14338 - DNA, 14 bp, Artificial sequence
  Synthetic
aatgcgggggcgga

SEQ ID NO: 14339 - DNA, 13 bp, Artificial sequence
  Synthetic
aggtcaaaggtca

SEQ ID NO: 14340 - DNA, 11 bp, Artificial sequence
  Synthetic
gtgtggggaaa

SEQ ID NO: 14341 - DNA, 14 bp, Artificial sequence
  Synthetic
acaacagctgttgc

SEQ ID NO: 14342 - DNA, 19 bp, Artificial sequence
  Synthetic
gcgctgtccgtggtgctga

SEQ ID NO: 14343 - DNA, 15 bp, Artificial sequence
  Synthetic
aaggtcaaaaggtca

SEQ ID NO: 14344 - DNA, 10 bp, Artificial sequence
  Synthetic
gtcacgtgac

SEQ ID NO: 14345 - DNA, 14 bp, Artificial sequence
  Synthetic
actaattacctcaa

SEQ ID NO: 14346 - DNA, 8 bp, Artificial sequence
  Synthetic
ttaattaa

SEQ ID NO: 14347 - DNA, 16 bp, Artificial sequence
  Synthetic
atttgcataacaatgg

SEQ ID NO: 14348 - DNA, 20 bp, Artificial sequence
  Synthetic
taaaggaaagccaaaagtga

SEQ ID NO: 14349 - DNA, 15 bp, Artificial sequence
  Synthetic
ataaaccgaaaccaa

SEQ ID NO: 14350 - DNA, 14 bp, Artificial sequence
  Synthetic
ccatataaggcaaa

SEQ ID NO: 14351 - DNA, 6 bp, Artificial sequence
  Synthetic
atgacg

SEQ ID NO: 14352 - DNA, 8 bp, Artificial sequence
  Synthetic
cagctgcc

SEQ ID NO: 14353 - DNA, 8 bp, Artificial sequence
  Synthetic
gtaatcaa

SEQ ID NO: 14354 - DNA, 9 bp, Artificial sequence
  Synthetic
tcgtaaaca

SEQ ID NO: 14355 - DNA, 16 bp, Artificial sequence
  Synthetic
aggttaattggttaaa

SEQ ID NO: 14356 - DNA, 17 bp, Artificial sequence
  Synthetic
aaacaatgacattgttt

SEQ ID NO: 14357 - DNA, 15 bp, Artificial sequence
  Synthetic
gccccctggtggcca

SEQ ID NO: 14358 - DNA, 17 bp, Artificial sequence
  Synthetic
aatatacatgtaatatt

SEQ ID NO: 14359 - DNA, 15 bp, Artificial sequence
  Synthetic
aaactacatttccca

SEQ ID NO: 14360 - DNA, 15 bp, Artificial sequence
  Synthetic
ctggcactgtgccaa

SEQ ID NO: 14361 - DNA, 14 bp, Artificial sequence
  Synthetic
gcgtttatggcgac

SEQ ID NO: 14362 - DNA, 15 bp, Artificial sequence
  Synthetic
catgccctggggcca

SEQ ID NO: 14363 - DNA, 14 bp, Artificial sequence
  Synthetic
ggaaagtgaaagca

SEQ ID NO: 14364 - DNA, 14 bp, Artificial sequence
  Synthetic
ccatttcctggaaa

SEQ ID NO: 14365 - DNA, 10 bp, Artificial sequence
  Synthetic
attttacgac

SEQ ID NO: 14366 - DNA, 12 bp, Artificial sequence
  Synthetic
ctaccatcaatc

SEQ ID NO: 14367 - DNA, 13 bp, Artificial sequence
  Synthetic
ccccctcacctgc

SEQ ID NO: 14368 - DNA, 11 bp, Artificial sequence
  Synthetic
ccaccagaggg

SEQ ID NO: 14369 - DNA, 21 bp, Artificial sequence
  Synthetic
atttcccatcatgccttgcga

SEQ ID NO: 14370 - DNA, 8 bp, Artificial sequence
  Synthetic
cacctgcc

SEQ ID NO: 14371 - DNA, 18 bp, Artificial sequence
  Synthetic
cattgaccttttgacctc

SEQ ID NO: 14372 - DNA, 9 bp, Artificial sequence
  Synthetic
agtgccaat

SEQ ID NO: 14373 - DNA, 9 bp, Artificial sequence
  Synthetic
cgtgccaag

SEQ ID NO: 14374 - DNA, 15 bp, Artificial sequence
  Synthetic
tcagcaccacggaca

SEQ ID NO: 14375 - DNA, 18 bp, Artificial sequence
  Synthetic
aggtgttctgttaacact

SEQ ID NO: 14376 - DNA, 8 bp, Artificial sequence
  Synthetic
atgacaca

SEQ ID NO: 14377 - DNA, 13 bp, Artificial sequence
  Synthetic
agaaagggttaat

SEQ ID NO: 14378 - DNA, 8 bp, Artificial sequence
  Synthetic
aatcaaaa

SEQ ID NO: 14379 - DNA, 17 bp, Artificial sequence
  Synthetic
aggattttacgacctta

SEQ ID NO: 14380 - DNA, 15 bp, Artificial sequence
  Synthetic
aagaacagaatgttc

SEQ ID NO: 14381 - DNA, 22 bp, Artificial sequence
  Synthetic
cggagagggggagggggggggc

SEQ ID NO: 14382 - DNA, 11 bp, Artificial sequence
  Synthetic
aacatcaaagg

SEQ ID NO: 14383 - DNA, 17 bp, Artificial sequence
  Synthetic
tccaactaattagctca

SEQ ID NO: 14384 - DNA, 13 bp, Artificial sequence
  Synthetic
atatattcatgag

SEQ ID NO: 14385 - DNA, 19 bp, Artificial sequence
  Synthetic
tgtgcagtcatgcgtgaaa

SEQ ID NO: 14386 - DNA, 14 bp, Artificial sequence
  Synthetic
aaatggcgggaaac

SEQ ID NO: 14387 - DNA, 10 bp, Artificial sequence
  Synthetic
aaccacttaa

SEQ ID NO: 14388 - DNA, 17 bp, Artificial sequence
  Synthetic
gggggcacgtggcatta

SEQ ID NO: 14389 - DNA, 14 bp, Artificial sequence
  Synthetic
ttttcccgccaaaa

SEQ ID NO: 14390 - DNA, 11 bp, Artificial sequence
  Synthetic
ataaggaaaaa

SEQ ID NO: 14391 - DNA, 12 bp, Artificial sequence
  Synthetic
aagatcaaaggg

SEQ ID NO: 14392 - DNA, 10 bp, Artificial sequence
  Synthetic
aaacgaaact

SEQ ID NO: 14393 - DNA, 10 bp, Artificial sequence
  Synthetic
catgcgggta

SEQ ID NO: 14394 - DNA, 15 bp, Artificial sequence
  Synthetic
ataaacaattaatca

SEQ ID NO: 14395 - DNA, 21 bp, Artificial sequence
  Synthetic
aaaaaaaatcaataacaagac

SEQ ID NO: 14396 - DNA, 8 bp, Artificial sequence
  Synthetic
agaggtca

SEQ ID NO: 14397 - DNA, 14 bp, Artificial sequence
  Synthetic
ggttaataattaac

SEQ ID NO: 14398 - DNA, 15 bp, Artificial sequence
  Synthetic
cagcatgactcagca

SEQ ID NO: 14399 - DNA, 7 bp, Artificial sequence
  Synthetic
aatttcc

SEQ ID NO: 14400 - DNA, 24 bp, Artificial sequence
  Synthetic
aatttcacacctaggtgtgactag

SEQ ID NO: 14401 - DNA, 8 bp, Artificial sequence
  Synthetic
ataaacaa

SEQ ID NO: 14402 - DNA, 17 bp, Artificial sequence
  Synthetic
aaaaatgataccccatc

SEQ ID NO: 14403 - DNA, 8 bp, Artificial sequence
  Synthetic
taattaga

SEQ ID NO: 14404 - DNA, 8 bp, Artificial sequence
  Synthetic
aaaccaca

SEQ ID NO: 14405 - DNA, 8 bp, Artificial sequence
  Synthetic
cttaatga

SEQ ID NO: 14406 - DNA, 17 bp, Artificial sequence
  Synthetic
atgctaaaaatagattg

SEQ ID NO: 14407 - DNA, 14 bp, Artificial sequence
  Synthetic
attttacggaaaat

SEQ ID NO: 14408 - DNA, 12 bp, Artificial sequence
  Synthetic
aaaccacttaaa

SEQ ID NO: 14409 - DNA, 8 bp, Artificial sequence
  Synthetic
agtgggga

SEQ ID NO: 14410 - DNA, 10 bp, Artificial sequence
  Synthetic
ccaattaccg

SEQ ID NO: 14411 - DNA, 9 bp, Artificial sequence
  Synthetic
acagataac

SEQ ID NO: 14412 - DNA, 14 bp, Artificial sequence
  Synthetic
aaagttttattgcc

SEQ ID NO: 14413 - DNA, 17 bp, Artificial sequence
  Synthetic
aggtacacggtgtaccc

SEQ ID NO: 14414 - DNA, 9 bp, Artificial sequence
  Synthetic
caggtgagg

SEQ ID NO: 14415 - DNA, 13 bp, Artificial sequence
  Synthetic
aataagtatataa

SEQ ID NO: 14416 - DNA, 17 bp, Artificial sequence
  Synthetic
gaaattttacgacctaa

SEQ ID NO: 14417 - DNA, 11 bp, Artificial sequence
  Synthetic
gccacgccccc

SEQ ID NO: 14418 - DNA, 15 bp, Artificial sequence
  Synthetic
cgttgcctagcaacg

SEQ ID NO: 14419 - DNA, 17 bp, Artificial sequence
  Synthetic
aaccggttaaaccggtt

SEQ ID NO: 14420 - DNA, 9 bp, Artificial sequence
  Synthetic
agcaattaa

SEQ ID NO: 14421 - DNA, 8 bp, Artificial sequence
  Synthetic
ctgtcaaa

SEQ ID NO: 14422 - DNA, 9 bp, Artificial sequence
  Synthetic
gcaataaaa

SEQ ID NO: 14423 - DNA, 9 bp, Artificial sequence
  Synthetic
acaagataa

SEQ ID NO: 14424 - DNA, 15 bp, Artificial sequence
  Synthetic
gaccccccgctgcgc

SEQ ID NO: 14425 - DNA, 16 bp, Artificial sequence
  Synthetic
atcagccaatcagagc

SEQ ID NO: 14426 - DNA, 15 bp, Artificial sequence
  Synthetic
atttgcataacaatg

SEQ ID NO: 14427 - DNA, 17 bp, Artificial sequence
  Synthetic
aaggtcacggtgacctg

SEQ ID NO: 14428 - DNA, 16 bp, Artificial sequence
  Synthetic
aacaatgtgcagtgtt

SEQ ID NO: 14429 - DNA, 10 bp, Artificial sequence
  Synthetic
ccagctgacg

SEQ ID NO: 14430 - DNA, 20 bp, Artificial sequence
  Synthetic
caaaggtcaaattgaggtca

SEQ ID NO: 14431 - DNA, 15 bp, Artificial sequence
  Synthetic
aagatggcggccgcc

SEQ ID NO: 14432 - DNA, 10 bp, Artificial sequence
  Synthetic
aagaggaagt

SEQ ID NO: 14433 - DNA, 6 bp, Artificial sequence
  Synthetic
attaaa

SEQ ID NO: 14434 - DNA, 9 bp, Artificial sequence
  Synthetic
gccaattaa

SEQ ID NO: 14435 - DNA, 10 bp, Artificial sequence
  Synthetic
cgcttccggc

SEQ ID NO: 14436 - DNA, 16 bp, Artificial sequence
  Synthetic
aaagacctgtcaatcc

SEQ ID NO: 14437 - DNA, 10 bp, Artificial sequence
  Synthetic
cacagctgcg

SEQ ID NO: 14438 - DNA, 8 bp, Artificial sequence
  Synthetic
accccgga

SEQ ID NO: 14439 - DNA, 16 bp, Artificial sequence
  Synthetic
accggcaattaataaa

SEQ ID NO: 14440 - DNA, 14 bp, Artificial sequence
  Synthetic
gaggtcaaaggtca

SEQ ID NO: 14441 - DNA, 23 bp, Artificial sequence
  Synthetic
tctcacacctctgaggtgtgaaa

SEQ ID NO: 14442 - DNA, 15 bp, Artificial sequence
  Synthetic
ccccgccttttatac

SEQ ID NO: 14443 - DNA, 15 bp, Artificial sequence
  Synthetic
aagtgcttccgggtc

SEQ ID NO: 14444 - DNA, 16 bp, Artificial sequence
  Synthetic
aacactgcaattgttc

SEQ ID NO: 14445 - DNA, 14 bp, Artificial sequence
  Synthetic
acgcgcctcgggcg

SEQ ID NO: 14446 - DNA, 15 bp, Artificial sequence
  Synthetic
aacaattgcagtgtt

SEQ ID NO: 14447 - DNA, 9 bp, Artificial sequence
  Synthetic
gacccccca

SEQ ID NO: 14448 - DNA, 13 bp, Artificial sequence
  Synthetic
tgctgactcagca

SEQ ID NO: 14449 - DNA, 9 bp, Artificial sequence
  Synthetic
caacccaaa

SEQ ID NO: 14450 - DNA, 18 bp, Artificial sequence
  Synthetic
aggtgtgaagtcacacct

SEQ ID NO: 14451 - DNA, 17 bp, Artificial sequence
  Synthetic
cccattaattaatcacc

SEQ ID NO: 14452 - DNA, 8 bp, Artificial sequence
  Synthetic
taacaata

SEQ ID NO: 14453 - DNA, 8 bp, Artificial sequence
  Synthetic
atttattg

SEQ ID NO: 14454 - DNA, 16 bp, Artificial sequence
  Synthetic
ggtaagtaaataaaca

SEQ ID NO: 14455 - DNA, 13 bp, Artificial sequence
  Synthetic
tcaataacattga

SEQ ID NO: 14456 - DNA, 21 bp, Artificial sequence
  Synthetic
aatcatttccgggaaatgcca

SEQ ID NO: 14457 - DNA, 15 bp, Artificial sequence
  Synthetic
attccctgaggggaa

SEQ ID NO: 14458 - DNA, 10 bp, Artificial sequence
  Synthetic
gtaataaaaa

SEQ ID NO: 14459 - DNA, 10 bp, Artificial sequence
  Synthetic
gccccgccca

SEQ ID NO: 14460 - DNA, 16 bp, Artificial sequence
  Synthetic
tcacacctaggtgtga

SEQ ID NO: 14461 - DNA, 14 bp, Artificial sequence
  Synthetic
attcccaagggaat

SEQ ID NO: 14462 - DNA, 21 bp, Artificial sequence
  Synthetic
atgggatttccgggaaatggg

SEQ ID NO: 14463 - DNA, 17 bp, Artificial sequence
  Synthetic
taaactaattagctgta

SEQ ID NO: 14464 - DNA, 16 bp, Artificial sequence
  Synthetic
aaagtaattagtgaat

SEQ ID NO: 14465 - DNA, 11 bp, Artificial sequence
  Synthetic
ctcgcgggacc

SEQ ID NO: 14466 - DNA, 7 bp, Artificial sequence
  Synthetic
aagataa

SEQ ID NO: 14467 - DNA, 10 bp, Artificial sequence
  Synthetic
ctaaaaataa

SEQ ID NO: 14468 - DNA, 15 bp, Artificial sequence
  Synthetic
ctaattggcaattaa

SEQ ID NO: 14469 - DNA, 16 bp, Artificial sequence
  Synthetic
cagagctaattacccc

SEQ ID NO: 14470 - DNA, 10 bp, Artificial sequence
  Synthetic
aacaggaagt

SEQ ID NO: 14471 - DNA, 13 bp, Artificial sequence
  Synthetic
agcttgattgatg

SEQ ID NO: 14472 - DNA, 12 bp, Artificial sequence
  Synthetic
actataaataga

SEQ ID NO: 14473 - DNA, 9 bp, Artificial sequence
  Synthetic
atgacgcaa

SEQ ID NO: 14474 - DNA, 8 bp, Artificial sequence
  Synthetic
ccaattac

SEQ ID NO: 14475 - DNA, 16 bp, Artificial sequence
  Synthetic
ctgaggtaattacctc

SEQ ID NO: 14476 - DNA, 10 bp, Artificial sequence
  Synthetic
ataattaata

SEQ ID NO: 14477 - DNA, 14 bp, Artificial sequence
  Synthetic
atttcctgtttgcc

SEQ ID NO: 14478 - DNA, 16 bp, Artificial sequence
  Synthetic
gcagaaagaagtaaca

SEQ ID NO: 14479 - DNA, 9 bp, Artificial sequence
  Synthetic
attacatca

SEQ ID NO: 14480 - DNA, 8 bp, Artificial sequence
  Synthetic
atgcaaat

SEQ ID NO: 14481 - DNA, 17 bp, Artificial sequence
  Synthetic
atgtttacggtaaacaa

SEQ ID NO: 14482 - DNA, 9 bp, Artificial sequence
  Synthetic
aatgcagtg

SEQ ID NO: 14483 - DNA, 14 bp, Artificial sequence
  Synthetic
aaaaaatatttact

SEQ ID NO: 14484 - DNA, 20 bp, Artificial sequence
  Synthetic
agtaggtcaccgtgacctac

SEQ ID NO: 14485 - DNA, 16 bp, Artificial sequence
  Synthetic
aaagctcgtaaaattt

SEQ ID NO: 14486 - DNA, 10 bp, Artificial sequence
  Synthetic
attgtacaat

SEQ ID NO: 14487 - DNA, 9 bp, Artificial sequence
  Synthetic
ggcaataaa

SEQ ID NO: 14488 - DNA, 9 bp, Artificial sequence
  Synthetic
cttacgtca

SEQ ID NO: 14489 - DNA, 7 bp, Artificial sequence
  Synthetic
aatgact

SEQ ID NO: 14490 - DNA, 15 bp, Artificial sequence
  Synthetic
aggtcaaggtcaccc

SEQ ID NO: 14491 - DNA, 10 bp, Artificial sequence
  Synthetic
agcccgtgcg

SEQ ID NO: 14492 - DNA, 18 bp, Artificial sequence
  Synthetic
ctggtggggacagataag

SEQ ID NO: 14493 - DNA, 10 bp, Artificial sequence
  Synthetic
cacagctgac

SEQ ID NO: 14494 - DNA, 10 bp, Artificial sequence
  Synthetic
cgcgcgtggc

SEQ ID NO: 14495 - DNA, 10 bp, Artificial sequence
  Synthetic
gggggcgtaa

SEQ ID NO: 14496 - DNA, 9 bp, Artificial sequence
  Synthetic
cgttaatga

SEQ ID NO: 14497 - DNA, 8 bp, Artificial sequence
  Synthetic
ccgccaaa

SEQ ID NO: 14498 - DNA, 15 bp, Artificial sequence
  Synthetic
atcaatgcaattgat

SEQ ID NO: 14499 - DNA, 12 bp, Artificial sequence
  Synthetic
gctgagtcagca

SEQ ID NO: 14500 - DNA, 17 bp, Artificial sequence
  Synthetic
attctagaaatttctcc

SEQ ID NO: 14501 - DNA, 15 bp, Artificial sequence
  Synthetic
aaagggatgactcat

SEQ ID NO: 14502 - DNA, 9 bp, Artificial sequence
  Synthetic
actcaccac

SEQ ID NO: 14503 - DNA, 7 bp, Artificial sequence
  Synthetic
ccgctaa

SEQ ID NO: 14504 - DNA, 10 bp, Artificial sequence
  Synthetic
accacctgtc

SEQ ID NO: 14505 - DNA, 12 bp, Artificial sequence
  Synthetic
ggccaaagtcca

SEQ ID NO: 14506 - DNA, 9 bp, Artificial sequence
  Synthetic
gcgtaaata

SEQ ID NO: 14507 - DNA, 14 bp, Artificial sequence
  Synthetic
gtttagaacaatta

SEQ ID NO: 14508 - DNA, 8 bp, Artificial sequence
  Synthetic
cagctgtc

SEQ ID NO: 14509 - DNA, 10 bp, Artificial sequence
  Synthetic
tctcgcgaga

SEQ ID NO: 14510 - DNA, 8 bp, Artificial sequence
  Synthetic
ccctcccc

SEQ ID NO: 14511 - DNA, 18 bp, Artificial sequence
  Synthetic
aaggtcatctaaaggtca

SEQ ID NO: 14512 - DNA, 14 bp, Artificial sequence
  Synthetic
aactacaactccca

SEQ ID NO: 14513 - DNA, 9 bp, Artificial sequence
  Synthetic
gcctcaggc

SEQ ID NO: 14514 - DNA, 29 bp, Artificial sequence
  Synthetic
gaacagatcaaactttagcttcaatacaa

SEQ ID NO: 14515 - DNA, 14 bp, Artificial sequence
  Synthetic
ccccgcccacgcac

SEQ ID NO: 14516 - DNA, 6 bp, Artificial sequence
  Synthetic
agttca

SEQ ID NO: 14517 - DNA, 16 bp, Artificial sequence
  Synthetic
ctgtggggggtcgata

SEQ ID NO: 14518 - DNA, 16 bp, Artificial sequence
  Synthetic
caccagggggcgccag

SEQ ID NO: 14519 - DNA, 14 bp, Artificial sequence
  Synthetic
taattaagcaatta

SEQ ID NO: 14520 - DNA, 21 bp, Artificial sequence
  Synthetic
gcctgctgggagttgtagtcc

SEQ ID NO: 14521 - DNA, 11 bp, Artificial sequence
  Synthetic
atgactcagca

SEQ ID NO: 14522 - DNA, 16 bp, Artificial sequence
  Synthetic
atcttgtttatgtata

SEQ ID NO: 14523 - DNA, 22 bp, Artificial sequence
  Synthetic
aggtgctatttttagcaccgga

SEQ ID NO: 14524 - DNA, 17 bp, Artificial sequence
  Synthetic
aatgctgactcagcaca

SEQ ID NO: 14525 - DNA, 11 bp, Artificial sequence
  Synthetic
cttccaggaag

SEQ ID NO: 14526 - DNA, 13 bp, Artificial sequence
  Synthetic
ctgttacgtaatc

SEQ ID NO: 14527 - DNA, 15 bp, Artificial sequence
  Synthetic
ttcgaaacgttcgaa

SEQ ID NO: 14528 - DNA, 15 bp, Artificial sequence
  Synthetic
aacaataacattgtt

SEQ ID NO: 14529 - DNA, 10 bp, Artificial sequence
  Synthetic
agccacttaa

SEQ ID NO: 14530 - DNA, 17 bp, Artificial sequence
  Synthetic
cccacctgccatctagg

SEQ ID NO: 14531 - DNA, 13 bp, Artificial sequence
  Synthetic
cggctctatcatc

SEQ ID NO: 14532 - DNA, 12 bp, Artificial sequence
  Synthetic
atgaatattcat

SEQ ID NO: 14533 - DNA, 14 bp, Artificial sequence
  Synthetic
cgtcgtgggtggtc

SEQ ID NO: 14534 - DNA, 27 bp, Artificial sequence
  Synthetic
cgcacaagaacacaatgtaccctcccg

SEQ ID NO: 14535 - DNA, 16 bp, Artificial sequence
  Synthetic
cattaagtacttaaag

SEQ ID NO: 14536 - DNA, 10 bp, Artificial sequence
  Synthetic
cttaattggc

SEQ ID NO: 14537 - DNA, 13 bp, Artificial sequence
  Synthetic
agtcatactgaaa

SEQ ID NO: 14538 - DNA, 12 bp, Artificial sequence
  Synthetic
atgaatattcaa

SEQ ID NO: 14539 - DNA, 10 bp, Artificial sequence
  Synthetic
acccggaagt

SEQ ID NO: 14540 - DNA, 13 bp, Artificial sequence
  Synthetic
catgactcagcag

SEQ ID NO: 14541 - DNA, 10 bp, Artificial sequence
  Synthetic
aattgggtca

SEQ ID NO: 14542 - DNA, 17 bp, Artificial sequence
  Synthetic
ggggtcagtagaggtca

SEQ ID NO: 14543 - DNA, 8 bp, Artificial sequence
  Synthetic
aaaacaat

SEQ ID NO: 14544 - DNA, 8 bp, Artificial sequence
  Synthetic
catttccg

SEQ ID NO: 14545 - DNA, 5 bp, Artificial sequence
  Synthetic
aaaca

SEQ ID NO: 14546 - DNA, 19 bp, Artificial sequence
  Synthetic
gggggcagccaagcgtgac

SEQ ID NO: 14547 - DNA, 13 bp, Artificial sequence
  Synthetic
gcaaagcaaacaa

SEQ ID NO: 14548 - DNA, 16 bp, Artificial sequence
  Synthetic
attggactttgacccc

SEQ ID NO: 14549 - DNA, 8 bp, Artificial sequence
  Synthetic
gggagcac

SEQ ID NO: 14550 - DNA, 12 bp, Artificial sequence
  Synthetic
tggcacgtgcca

SEQ ID NO: 14551 - DNA, 17 bp, Artificial sequence
  Synthetic
aggtcaactaaaggtca

SEQ ID NO: 14552 - DNA, 21 bp, Artificial sequence
  Synthetic
cgctaatcggaaaacgattag

SEQ ID NO: 14553 - DNA, 9 bp, Artificial sequence
  Synthetic
agagggagg

SEQ ID NO: 14554 - DNA, 11 bp, Artificial sequence
  Synthetic
cgcaggtgtgc

SEQ ID NO: 14555 - DNA, 9 bp, Artificial sequence
  Synthetic
attgttttc

SEQ ID NO: 14556 - DNA, 10 bp, Artificial sequence
  Synthetic
attggcgcgc

SEQ ID NO: 14557 - DNA, 14 bp, Artificial sequence
  Synthetic
cagtttcggttctc

SEQ ID NO: 14558 - DNA, 17 bp, Artificial sequence
  Synthetic
aagattttacgaccttg

SEQ ID NO: 14559 - DNA, 12 bp, Artificial sequence
  Synthetic
cagtgtggtcgc

SEQ ID NO: 14560 - DNA, 9 bp, Artificial sequence
  Synthetic
accacttaa

SEQ ID NO: 14561 - DNA, 17 bp, Artificial sequence
  Synthetic
acaagcaattaatgaat

SEQ ID NO: 14562 - DNA, 17 bp, Artificial sequence
  Synthetic
gaggtcaggtcaggtca

SEQ ID NO: 14563 - DNA, 16 bp, Artificial sequence
  Synthetic
actatgccaacctacc

SEQ ID NO: 14564 - DNA, 10 bp, Artificial sequence
  Synthetic
tgggattaaa

SEQ ID NO: 14565 - DNA, 15 bp, Artificial sequence
  Synthetic
aagaatgagtcatca

SEQ ID NO: 14566 - DNA, 10 bp, Artificial sequence
  Synthetic
caagtgcgtg

SEQ ID NO: 14567 - DNA, 16 bp, Artificial sequence
  Synthetic
aagataagataagata

SEQ ID NO: 14568 - DNA, 10 bp, Artificial sequence
  Synthetic
ccatccatca

SEQ ID NO: 14569 - DNA, 15 bp, Artificial sequence
  Synthetic
ggcgggaaatttgaa

SEQ ID NO: 14570 - DNA, 11 bp, Artificial sequence
  Synthetic
actgagtcacc

SEQ ID NO: 14571 - DNA, 13 bp, Artificial sequence
  Synthetic
acttgggaatacc

SEQ ID NO: 14572 - DNA, 17 bp, Artificial sequence
  Synthetic
gaggtcaaaaggtcaca

SEQ ID NO: 14573 - DNA, 15 bp, Artificial sequence
  Synthetic
gcagccaagcgtgac

SEQ ID NO: 14574 - DNA, 9 bp, Artificial sequence
  Synthetic
gctaatccc

SEQ ID NO: 14575 - DNA, 10 bp, Artificial sequence
  Synthetic
aataattata

SEQ ID NO: 14576 - DNA, 14 bp, Artificial sequence
  Synthetic
gcaccagggacagc

SEQ ID NO: 14577 - DNA, 14 bp, Artificial sequence
  Synthetic
tatgaatattcaaa

SEQ ID NO: 14578 - DNA, 13 bp, Artificial sequence
  Synthetic
tgacagctgtcaa

SEQ ID NO: 14579 - DNA, 9 bp, Artificial sequence
  Synthetic
cgttcgaaa

SEQ ID NO: 14580 - DNA, 16 bp, Artificial sequence
  Synthetic
aggggtcaagggttca

SEQ ID NO: 14581 - DNA, 20 bp, Artificial sequence
  Synthetic
ctccggcgccccctggtggc

SEQ ID NO: 14582 - DNA, 12 bp, Artificial sequence
  Synthetic
aattagcataga

SEQ ID NO: 14583 - DNA, 15 bp, Artificial sequence
  Synthetic
agtgccacctagtgg

SEQ ID NO: 14584 - DNA, 21 bp, Artificial sequence
  Synthetic
ctcgggcgccccctggtggcc

SEQ ID NO: 14585 - DNA, 9 bp, Artificial sequence
  Synthetic
agggattaa

SEQ ID NO: 14586 - DNA, 21 bp, Artificial sequence
  Synthetic
cgggtgacctttgacccctga

SEQ ID NO: 14587 - DNA, 8 bp, Artificial sequence
  Synthetic
gtaattaa

SEQ ID NO: 14588 - DNA, 19 bp, Artificial sequence
  Synthetic
ctgaacttttttgacctca

SEQ ID NO: 14589 - DNA, 8 bp, Artificial sequence
  Synthetic
gtaattac

SEQ ID NO: 14590 - DNA, 12 bp, Artificial sequence
  Synthetic
tattacgtaaca

SEQ ID NO: 14591 - DNA, 18 bp, Artificial sequence
  Synthetic
ggaaagcgaaaccaaaac

SEQ ID NO: 14592 - DNA, 10 bp, Artificial sequence
  Synthetic
aacatatgtc

SEQ ID NO: 14593 - DNA, 15 bp, Artificial sequence
  Synthetic
agaacagaatgttct

SEQ ID NO: 14594 - DNA, 17 bp, Artificial sequence
  Synthetic
aatcgctaattagcgct

SEQ ID NO: 14595 - DNA, 10 bp, Artificial sequence
  Synthetic
tacgcgcgta

SEQ ID NO: 14596 - DNA, 10 bp, Artificial sequence
  Synthetic
aacatatgtt

SEQ ID NO: 14597 - DNA, 16 bp, Artificial sequence
  Synthetic
gcgggcacgtgacaac

SEQ ID NO: 14598 - DNA, 18 bp, Artificial sequence
  Synthetic
accggaagtacatccggt

SEQ ID NO: 14599 - DNA, 8 bp, Artificial sequence
  Synthetic
attaatcc

SEQ ID NO: 14600 - DNA, 17 bp, Artificial sequence
  Synthetic
gccaccagatggcacta

SEQ ID NO: 14601 - DNA, 12 bp, Artificial sequence
  Synthetic
agataaaaggga

SEQ ID NO: 14602 - DNA, 9 bp, Artificial sequence
  Synthetic
gctgattac

SEQ ID NO: 14603 - DNA, 16 bp, Artificial sequence
  Synthetic
cggtttaaaaataacc

SEQ ID NO: 14604 - DNA, 12 bp, Artificial sequence
  Synthetic
aaaaatcaataa

SEQ ID NO: 14605 - DNA, 11 bp, Artificial sequence
  Synthetic
ccaataaaacc

SEQ ID NO: 14606 - DNA, 18 bp, Artificial sequence
  Synthetic
accggaagtacatccggc

SEQ ID NO: 14607 - DNA, 8 bp, Artificial sequence
  Synthetic
cattgtta

SEQ ID NO: 14608 - DNA, 8 bp, Artificial sequence
  Synthetic
cattgttc

SEQ ID NO: 14609 - DNA, 9 bp, Artificial sequence
  Synthetic
ggtaaacaa

SEQ ID NO: 14610 - DNA, 6 bp, Artificial sequence
  Synthetic
cacgca

SEQ ID NO: 14611 - DNA, 12 bp, Artificial sequence
  Synthetic
tgccccctgaca

SEQ ID NO: 14612 - DNA, 12 bp, Artificial sequence
  Synthetic
gaaatccccagc

SEQ ID NO: 14613 - DNA, 12 bp, Artificial sequence
  Synthetic
gttaaatattaa

SEQ ID NO: 14614 - DNA, 14 bp, Artificial sequence
  Synthetic
taagaacaatggga

SEQ ID NO: 14615 - DNA, 10 bp, Artificial sequence
  Synthetic
ccaccccccc

SEQ ID NO: 14616 - DNA, 16 bp, Artificial sequence
  Synthetic
aaggtaattagctcat

SEQ ID NO: 14617 - DNA, 10 bp, Artificial sequence
  Synthetic
agcacttgag

SEQ ID NO: 14618 - DNA, 19 bp, Artificial sequence
  Synthetic
ccatggccaaataaggcaa

SEQ ID NO: 14619 - DNA, 8 bp, Artificial sequence
  Synthetic
aaggggcg

SEQ ID NO: 14620 - DNA, 16 bp, Artificial sequence
  Synthetic
atgcgggtacccgcat

SEQ ID NO: 14621 - DNA, 16 bp, Artificial sequence
  Synthetic
gagaccatctgttccc

SEQ ID NO: 14622 - DNA, 12 bp, Artificial sequence
  Synthetic
cagcggggggtc

SEQ ID NO: 14623 - DNA, 13 bp, Artificial sequence
  Synthetic
aacccggaagtaa

SEQ ID NO: 14624 - DNA, 17 bp, Artificial sequence
  Synthetic
tgacgtgccaggcgaaa

SEQ ID NO: 14625 - DNA, 12 bp, Artificial sequence
  Synthetic
ggttacgcaata

SEQ ID NO: 14626 - DNA, 12 bp, Artificial sequence
  Synthetic
aaataaacaata

SEQ ID NO: 14627 - DNA, 10 bp, Artificial sequence
  Synthetic
tattacgtaa

SEQ ID NO: 14628 - DNA, 11 bp, Artificial sequence
  Synthetic
tttccaggaaa

SEQ ID NO: 14629 - DNA, 13 bp, Artificial sequence
  Synthetic
cggccaaaatgac

SEQ ID NO: 14630 - DNA, 13 bp, Artificial sequence
  Synthetic
tgttgctagggaa

SEQ ID NO: 14631 - DNA, 11 bp, Artificial sequence
  Synthetic
ccacctgtcac

SEQ ID NO: 14632 - DNA, 8 bp, Artificial sequence
  Synthetic
accgttat

SEQ ID NO: 14633 - DNA, 11 bp, Artificial sequence
  Synthetic
acttagtcact

SEQ ID NO: 14634 - DNA, 17 bp, Artificial sequence
  Synthetic
gccacaggaagtgagga

SEQ ID NO: 14635 - DNA, 14 bp, Artificial sequence
  Synthetic
atattgcaaaatca

SEQ ID NO: 14636 - DNA, 18 bp, Artificial sequence
  Synthetic
aagtaggtcaaaggtcac

SEQ ID NO: 14637 - DNA, 16 bp, Artificial sequence
  Synthetic
agggttatttttagag

SEQ ID NO: 14638 - DNA, 16 bp, Artificial sequence
  Synthetic
gggccgtgtgcaaaaa

SEQ ID NO: 14639 - DNA, 17 bp, Artificial sequence
  Synthetic
aaaagtgataccccatt

SEQ ID NO: 14640 - DNA, 17 bp, Artificial sequence
  Synthetic
cataaccacttaacaac

SEQ ID NO: 14641 - DNA, 12 bp, Artificial sequence
  Synthetic
attggcgccaaa

SEQ ID NO: 14642 - DNA, 10 bp, Artificial sequence
  Synthetic
attaacataa

SEQ ID NO: 14643 - DNA, 10 bp, Artificial sequence
  Synthetic
taaaacaaaa

SEQ ID NO: 14644 - DNA, 11 bp, Artificial sequence
  Synthetic
taatttaatca

SEQ ID NO: 14645 - DNA, 14 bp, Artificial sequence
  Synthetic
gtaaacaataaaca

SEQ ID NO: 14646 - DNA, 17 bp, Artificial sequence
  Synthetic
acggctagttaacagct

SEQ ID NO: 14647 - DNA, 8 bp, Artificial sequence
  Synthetic
aaccgaaa

SEQ ID NO: 14648 - DNA, 9 bp, Artificial sequence
  Synthetic
taattaaaa

SEQ ID NO: 14649 - DNA, 17 bp, Artificial sequence
  Synthetic
atccattaattaattga

SEQ ID NO: 14650 - DNA, 11 bp, Artificial sequence
  Synthetic
acccggatgta

SEQ ID NO: 14651 - DNA, 12 bp, Artificial sequence
  Synthetic
aaaggtgtcaaa

SEQ ID NO: 14652 - DNA, 10 bp, Artificial sequence
  Synthetic
attgcacaac

SEQ ID NO: 14653 - DNA, 14 bp, Artificial sequence
  Synthetic
aaaccacgtggttt

SEQ ID NO: 14654 - DNA, 17 bp, Artificial sequence
  Synthetic
gacttaattaattaatc

SEQ ID NO: 14655 - DNA, 12 bp, Artificial sequence
  Synthetic
caccagggggcg

SEQ ID NO: 14656 - DNA, 10 bp, Artificial sequence
  Synthetic
attgcacaat

SEQ ID NO: 14657 - DNA, 15 bp, Artificial sequence
  Synthetic
gaattccaggaaata

SEQ ID NO: 14658 - DNA, 25 bp, Artificial sequence
  Synthetic
acatagtgacacctaggtgtgaaat

SEQ ID NO: 14659 - DNA, 17 bp, Artificial sequence
  Synthetic
aggtcaccgagaggtca

SEQ ID NO: 14660 - DNA, 11 bp, Artificial sequence
  Synthetic
aggaagtgcaa

SEQ ID NO: 14661 - DNA, 10 bp, Artificial sequence
  Synthetic
attacgtaat

SEQ ID NO: 14662 - DNA, 8 bp, Artificial sequence
  Synthetic
accgccca

SEQ ID NO: 14663 - DNA, 30 bp, Artificial sequence
  Synthetic
agaggagaggagaagaggagggaggaagag

SEQ ID NO: 14664 - DNA, 10 bp, Artificial sequence
  Synthetic
actacaattc

SEQ ID NO: 14665 - DNA, 10 bp, Artificial sequence
  Synthetic
ttagcaggaa

SEQ ID NO: 14666 - DNA, 10 bp, Artificial sequence
  Synthetic
agcaattagc

SEQ ID NO: 14667 - DNA, 11 bp, Artificial sequence
  Synthetic
agggtaacagc

SEQ ID NO: 14668 - DNA, 17 bp, Artificial sequence
  Synthetic
ataaattaatcccctcc

SEQ ID NO: 14669 - DNA, 15 bp, Artificial sequence
  Synthetic
aataatcgcgaatat

SEQ ID NO: 14670 - DNA, 15 bp, Artificial sequence
  Synthetic
catggccccagggca

SEQ ID NO: 14671 - DNA, 9 bp, Artificial sequence
  Synthetic
gggggcgga

SEQ ID NO: 14672 - DNA, 10 bp, Artificial sequence
  Synthetic
gctaattagc

SEQ ID NO: 14673 - DNA, 10 bp, Artificial sequence
  Synthetic
gctaattaga

SEQ ID NO: 14674 - DNA, 11 bp, Artificial sequence
  Synthetic
ccagcgcccgc

SEQ ID NO: 14675 - DNA, 12 bp, Artificial sequence
  Synthetic
atgcataattta

SEQ ID NO: 14676 - DNA, 8 bp, Artificial sequence
  Synthetic
aattagtg

SEQ ID NO: 14677 - DNA, 18 bp, Artificial sequence
  Synthetic
atatctagagcggaacgg

SEQ ID NO: 14678 - DNA, 21 bp, Artificial sequence
  Synthetic
ggcgcgcggcggtgacgtgac

SEQ ID NO: 14679 - DNA, 21 bp, Artificial sequence
  Synthetic
ggcggtcatgcgtgcgcgacc

SEQ ID NO: 14680 - DNA, 9 bp, Artificial sequence
  Synthetic
atcaatcaa

SEQ ID NO: 14681 - DNA, 17 bp, Artificial sequence
  Synthetic
acccctaattagcggtg

SEQ ID NO: 14682 - DNA, 8 bp, Artificial sequence
  Synthetic
ataatccc

SEQ ID NO: 14683 - DNA, 15 bp, Artificial sequence
  Synthetic
ccgcgcgccctcccc

SEQ ID NO: 14684 - DNA, 8 bp, Artificial sequence
  Synthetic
ataattat

SEQ ID NO: 14685 - DNA, 18 bp, Artificial sequence
  Synthetic
gtgccagcctatgccaac

SEQ ID NO: 14686 - DNA, 15 bp, Artificial sequence
  Synthetic
ctttcacaccttttc

SEQ ID NO: 14687 - DNA, 14 bp, Artificial sequence
  Synthetic
agaatgttctagaa

SEQ ID NO: 14688 - DNA, 22 bp, Artificial sequence
  Synthetic
accactagatggcactattgca

SEQ ID NO: 14689 - DNA, 9 bp, Artificial sequence
  Synthetic
acaaagggc

SEQ ID NO: 14690 - DNA, 11 bp, Artificial sequence
  Synthetic
atgtaaacaaa

SEQ ID NO: 14691 - DNA, 8 bp, Artificial sequence
  Synthetic
ataattac

SEQ ID NO: 14692 - DNA, 8 bp, Artificial sequence
  Synthetic
ataattaa

SEQ ID NO: 14693 - DNA, 8 bp, Artificial sequence
  Synthetic
ataattag

SEQ ID NO: 14694 - DNA, 17 bp, Artificial sequence
  Synthetic
gtcggtaattatcgcga

SEQ ID NO: 14695 - DNA, 8 bp, Artificial sequence
  Synthetic
agtcacgc

SEQ ID NO: 14696 - DNA, 17 bp, Artificial sequence
  Synthetic
tatcaataacattgata

SEQ ID NO: 14697 - DNA, 17 bp, Artificial sequence
  Synthetic
catcaattgcagtgatc

SEQ ID NO: 14698 - DNA, 8 bp, Artificial sequence
  Synthetic
agtcacgg

SEQ ID NO: 14699 - DNA, 17 bp, Artificial sequence
  Synthetic
tattcaaggtcatgcga

SEQ ID NO: 14700 - DNA, 15 bp, Artificial sequence
  Synthetic
tttccataatggaaa

SEQ ID NO: 14701 - DNA, 9 bp, Artificial sequence
  Synthetic
agacaccac

SEQ ID NO: 14702 - DNA, 11 bp, Artificial sequence
  Synthetic
atatttacata

SEQ ID NO: 14703 - DNA, 15 bp, Artificial sequence
  Synthetic
ctggccatatatggc

SEQ ID NO: 14704 - DNA, 10 bp, Artificial sequence
  Synthetic
agcaggtgcg

SEQ ID NO: 14705 - DNA, 11 bp, Artificial sequence
  Synthetic
ccccggcctcc

SEQ ID NO: 14706 - DNA, 13 bp, Artificial sequence
  Synthetic
actagacgagatg

SEQ ID NO: 14707 - DNA, 12 bp, Artificial sequence
  Synthetic
agcctgtctgcc

SEQ ID NO: 14708 - DNA, 11 bp, Artificial sequence
  Synthetic
ctttcactttc

SEQ ID NO: 14709 - DNA, 17 bp, Artificial sequence
  Synthetic
ccatcgtacgtacactc

SEQ ID NO: 14710 - DNA, 18 bp, Artificial sequence
  Synthetic
aactaattaccattatcg

SEQ ID NO: 14711 - DNA, 12 bp, Artificial sequence
  Synthetic
gattacgtggca

SEQ ID NO: 14712 - DNA, 7 bp, Artificial sequence
  Synthetic
agattgg

SEQ ID NO: 14713 - DNA, 11 bp, Artificial sequence
  Synthetic
aaaagtaaaca

SEQ ID NO: 14714 - DNA, 19 bp, Artificial sequence
  Synthetic
tcacacctaaaaggtgtga

SEQ ID NO: 14715 - DNA, 14 bp, Artificial sequence
  Synthetic
cgatgacgtcagag

SEQ ID NO: 14716 - DNA, 5 bp, Artificial sequence
  Synthetic
taaca

SEQ ID NO: 14717 - DNA, 15 bp, Artificial sequence
  Synthetic
cgcggccacgtgacc

SEQ ID NO: 14718 - DNA, 14 bp, Artificial sequence
  Synthetic
attgtttacgtttg

SEQ ID NO: 14719 - DNA, 17 bp, Artificial sequence
  Synthetic
aagacgctgtaaagcga

SEQ ID NO: 14720 - DNA, 12 bp, Artificial sequence
  Synthetic
atcaaccgatag

SEQ ID NO: 14721 - DNA, 10 bp, Artificial sequence
  Synthetic
gatgacgtca

SEQ ID NO: 14722 - DNA, 9 bp, Artificial sequence
  Synthetic
aggaaatga

SEQ ID NO: 14723 - DNA, 14 bp, Artificial sequence
  Synthetic
aaaaccaaaaaaat

SEQ ID NO: 14724 - DNA, 11 bp, Artificial sequence
  Synthetic
ctgggttgtgc

SEQ ID NO: 14725 - DNA, 7 bp, Artificial sequence
  Synthetic
aaacaat

SEQ ID NO: 14726 - DNA, 8 bp, Artificial sequence
  Synthetic
gggattaa

SEQ ID NO: 14727 - DNA, 5 bp, Artificial sequence
  Synthetic
aatta

SEQ ID NO: 14728 - DNA, 10 bp, Artificial sequence
  Synthetic
gatgacgtaa

SEQ ID NO: 14729 - DNA, 10 bp, Artificial sequence
  Synthetic
caggaagtag

SEQ ID NO: 14730 - DNA, 17 bp, Artificial sequence
  Synthetic
aaggtcaacagaggtca

SEQ ID NO: 14731 - DNA, 11 bp, Artificial sequence
  Synthetic
gtcgcccccac

SEQ ID NO: 14732 - DNA, 7 bp, Artificial sequence
  Synthetic
atttatg

SEQ ID NO: 14733 - DNA, 15 bp, Artificial sequence
  Synthetic
cagttttcgcgcgta

SEQ ID NO: 14734 - DNA, 14 bp, Artificial sequence
  Synthetic
aggggatttccagg

SEQ ID NO: 14735 - DNA, 7 bp, Artificial sequence
  Synthetic
aaacaaa

SEQ ID NO: 14736 - DNA, 12 bp, Artificial sequence
  Synthetic
aggtcaaggtca

SEQ ID NO: 14737 - DNA, 10 bp, Artificial sequence
  Synthetic
cattaatcaa

SEQ ID NO: 14738 - DNA, 16 bp, Artificial sequence
  Synthetic
aggcaacttccctcta

SEQ ID NO: 14739 - DNA, 15 bp, Artificial sequence
  Synthetic
acccaagatggcggc

SEQ ID NO: 14740 - DNA, 7 bp, Artificial sequence
  Synthetic
aaggtca

SEQ ID NO: 14741 - DNA, 13 bp, Artificial sequence
  Synthetic
gaatgagtcagca

SEQ ID NO: 14742 - DNA, 11 bp, Artificial sequence
  Synthetic
aagccataaaa

SEQ ID NO: 14743 - DNA, 8 bp, Artificial sequence
  Synthetic
gcgtcagc

SEQ ID NO: 14744 - DNA, 6 bp, Artificial sequence
  Synthetic
catgac

SEQ ID NO: 14745 - DNA, 10 bp, Artificial sequence
  Synthetic
aggtcattaa

SEQ ID NO: 14746 - DNA, 14 bp, Artificial sequence
  Synthetic
taggacaaaggtca

SEQ ID NO: 14747 - DNA, 15 bp, Artificial sequence
  Synthetic
accaaaatggcggcc

SEQ ID NO: 14748 - DNA, 14 bp, Artificial sequence
  Synthetic
ggggcaaagttcaa

SEQ ID NO: 14749 - DNA, 12 bp, Artificial sequence
  Synthetic
aacccggaagta

SEQ ID NO: 14750 - DNA, 12 bp, Artificial sequence
  Synthetic
aacccggaagtg

SEQ ID NO: 14751 - DNA, 7 bp, Artificial sequence
  Synthetic
cagctgc

SEQ ID NO: 14752 - DNA, 9 bp, Artificial sequence
  Synthetic
ctcattgtc

SEQ ID NO: 14753 - DNA, 15 bp, Artificial sequence
  Synthetic
aattgctgactcagc

SEQ ID NO: 14754 - DNA, 16 bp, Artificial sequence
  Synthetic
caagtggggggggggg

SEQ ID NO: 14755 - DNA, 11 bp, Artificial sequence
  Synthetic
accacgtggct

SEQ ID NO: 14756 - DNA, 12 bp, Artificial sequence
  Synthetic
tgacacctgtca

SEQ ID NO: 14757 - DNA, 11 bp, Artificial sequence
  Synthetic
ggggcgggaaa

SEQ ID NO: 14758 - DNA, 16 bp, Artificial sequence
  Synthetic
ggcggggaaattcccc

SEQ ID NO: 14759 - DNA, 17 bp, Artificial sequence
  Synthetic
gtgcgctaattagtgca

SEQ ID NO: 14760 - DNA, 19 bp, Artificial sequence
  Synthetic
cctcgtcacgcatgatggc

SEQ ID NO: 14761 - DNA, 11 bp, Artificial sequence
  Synthetic
accacgtggcc

SEQ ID NO: 14762 - DNA, 19 bp, Artificial sequence
  Synthetic
cctcgtcacgcatgatgga

SEQ ID NO: 14763 - DNA, 16 bp, Artificial sequence
  Synthetic
aaaatggcgccatttt

SEQ ID NO: 14764 - DNA, 15 bp, Artificial sequence
  Synthetic
aacaatttcagtgtt

SEQ ID NO: 14765 - DNA, 15 bp, Artificial sequence
  Synthetic
acagattcttatctg

SEQ ID NO: 14766 - DNA, 13 bp, Artificial sequence
  Synthetic
cataaaactgtca

SEQ ID NO: 14767 - DNA, 11 bp, Artificial sequence
  Synthetic
gaatgatatcc

SEQ ID NO: 14768 - DNA, 10 bp, Artificial sequence
  Synthetic
agcgcgcgcg

SEQ ID NO: 14769 - DNA, 14 bp, Artificial sequence
  Synthetic
agatcaaggtcata

SEQ ID NO: 14770 - DNA, 11 bp, Artificial sequence
  Synthetic
aagatcaaagg

SEQ ID NO: 14771 - DNA, 8 bp, Artificial sequence
  Synthetic
tgactcaa

SEQ ID NO: 14772 - DNA, 15 bp, Artificial sequence
  Synthetic
aggtcaccgtgacct

SEQ ID NO: 14773 - DNA, 10 bp, Artificial sequence
  Synthetic
gacaggtgta

SEQ ID NO: 14774 - DNA, 15 bp, Artificial sequence
  Synthetic
tgcacacactgaaaa

SEQ ID NO: 14775 - DNA, 15 bp, Artificial sequence
  Synthetic
attgcctgaggcgaa

SEQ ID NO: 14776 - DNA, 15 bp, Artificial sequence
  Synthetic
aggtcaccgtgaccc

SEQ ID NO: 14777 - DNA, 10 bp, Artificial sequence
  Synthetic
atgatacccc

SEQ ID NO: 14778 - DNA, 18 bp, Artificial sequence
  Synthetic
aaggtcaactaaaggtca

SEQ ID NO: 14779 - DNA, 16 bp, Artificial sequence
  Synthetic
aggtgtgaaggtgtga

SEQ ID NO: 14780 - DNA, 16 bp, Artificial sequence
  Synthetic
caattagcaccaatta

SEQ ID NO: 14781 - DNA, 13 bp, Artificial sequence
  Synthetic
aggccaaaggtca

SEQ ID NO: 14782 - DNA, 14 bp, Artificial sequence
  Synthetic
caaggtcattaacc

SEQ ID NO: 14783 - DNA, 10 bp, Artificial sequence
  Synthetic
cacctgctcc

SEQ ID NO: 14784 - DNA, 17 bp, Artificial sequence
  Synthetic
agtttttaattaatttg

SEQ ID NO: 14785 - DNA, 8 bp, Artificial sequence
  Synthetic
cctttgaa

SEQ ID NO: 14786 - DNA, 17 bp, Artificial sequence
  Synthetic
acttagttaactaaaaa

SEQ ID NO: 14787 - DNA, 10 bp, Artificial sequence
  Synthetic
ggtgacgtca

SEQ ID NO: 14788 - DNA, 10 bp, Artificial sequence
  Synthetic
tgtaaacaaa

SEQ ID NO: 14789 - DNA, 11 bp, Artificial sequence
  Synthetic
acacccactct

SEQ ID NO: 14790 - DNA, 8 bp, Artificial sequence
  Synthetic
catgcagc

SEQ ID NO: 14791 - DNA, 15 bp, Artificial sequence
  Synthetic
ccatcaatcaattta

SEQ ID NO: 14792 - DNA, 8 bp, Artificial sequence
  Synthetic
aaaaaaca

SEQ ID NO: 14793 - DNA, 8 bp, Artificial sequence
  Synthetic
acagcgct

SEQ ID NO: 14794 - DNA, 17 bp, Artificial sequence
  Synthetic
aattttcacacctttta

SEQ ID NO: 14795 - DNA, 14 bp, Artificial sequence
  Synthetic
gcccctcccccacc

SEQ ID NO: 14796 - DNA, 14 bp, Artificial sequence
  Synthetic
aaaagtaggtcaga

SEQ ID NO: 14797 - DNA, 14 bp, Artificial sequence
  Synthetic
ccccgctgcccggc

SEQ ID NO: 14798 - DNA, 11 bp, Artificial sequence
  Synthetic
accatggacag

SEQ ID NO: 14799 - DNA, 20 bp, Artificial sequence
  Synthetic
tcacaccttagaaggtgtga

SEQ ID NO: 14800 - DNA, 10 bp, Artificial sequence
  Synthetic
cgcgcgcgcg

SEQ ID NO: 14801 - DNA, 17 bp, Artificial sequence
  Synthetic
gtccattaattaatgga

SEQ ID NO: 14802 - DNA, 10 bp, Artificial sequence
  Synthetic
ggtaattaaa

SEQ ID NO: 14803 - DNA, 9 bp, Artificial sequence
  Synthetic
aattttggg

SEQ ID NO: 14804 - DNA, 10 bp, Artificial sequence
  Synthetic
ggtaattaac

SEQ ID NO: 14805 - DNA, 15 bp, Artificial sequence
  Synthetic
aacaaacaacaagag

SEQ ID NO: 14806 - DNA, 10 bp, Artificial sequence
  Synthetic
attgcgcaat

SEQ ID NO: 14807 - DNA, 10 bp, Artificial sequence
  Synthetic
caagatggcg

SEQ ID NO: 14808 - DNA, 11 bp, Artificial sequence
  Synthetic
ggtcgtaaaaa

SEQ ID NO: 14809 - DNA, 24 bp, Artificial sequence
  Synthetic
ctctaggaaacgcaattctgggaa

SEQ ID NO: 14810 - DNA, 17 bp, Artificial sequence
  Synthetic
atccacaggtgcgaaaa

SEQ ID NO: 14811 - DNA, 12 bp, Artificial sequence
  Synthetic
tctaaaaataga

SEQ ID NO: 14812 - DNA, 10 bp, Artificial sequence
  Synthetic
atgagtcata

SEQ ID NO: 14813 - DNA, 6 bp, Artificial sequence
  Synthetic
ggatta

SEQ ID NO: 14814 - DNA, 8 bp, Artificial sequence
  Synthetic
cacgtggc

SEQ ID NO: 14815 - DNA, 11 bp, Artificial sequence
  Synthetic
aaaataaacat

SEQ ID NO: 14816 - DNA, 10 bp, Artificial sequence
  Synthetic
ccgcccacgc

SEQ ID NO: 14817 - DNA, 11 bp, Artificial sequence
  Synthetic
ctgggtggtcc

SEQ ID NO: 14818 - DNA, 15 bp, Artificial sequence
  Synthetic
aaagaggaagtgaaa

SEQ ID NO: 14819 - DNA, 12 bp, Artificial sequence
  Synthetic
ctacatgacaaa

SEQ ID NO: 14820 - DNA, 9 bp, Artificial sequence
  Synthetic
cccatcaaa

SEQ ID NO: 14821 - DNA, 16 bp, Artificial sequence
  Synthetic
aatgccagacgccatt

SEQ ID NO: 14822 - DNA, 12 bp, Artificial sequence
  Synthetic
gtttggcgcgaa

SEQ ID NO: 14823 - DNA, 16 bp, Artificial sequence
  Synthetic
ccgtcgccatggcaac

SEQ ID NO: 14824 - DNA, 19 bp, Artificial sequence
  Synthetic
cgttgacctttgaccttta

SEQ ID NO: 14825 - DNA, 10 bp, Artificial sequence
  Synthetic
cgtctagaca

SEQ ID NO: 14826 - DNA, 17 bp, Artificial sequence
  Synthetic
aaagggggcgtggctta

SEQ ID NO: 14827 - DNA, 16 bp, Artificial sequence
  Synthetic
ccgaccatctgttcag

SEQ ID NO: 14828 - DNA, 13 bp, Artificial sequence
  Synthetic
aaccaattaatat

SEQ ID NO: 14829 - DNA, 7 bp, Artificial sequence
  Synthetic
taattaa

SEQ ID NO: 14830 - DNA, 11 bp, Artificial sequence
  Synthetic
taatttatgca

SEQ ID NO: 14831 - DNA, 10 bp, Artificial sequence
  Synthetic
cctcctcccc

SEQ ID NO: 14832 - DNA, 9 bp, Artificial sequence
  Synthetic
gtcgtaaaa

SEQ ID NO: 14833 - DNA, 12 bp, Artificial sequence
  Synthetic
cagcacctggcg

SEQ ID NO: 14834 - DNA, 14 bp, Artificial sequence
  Synthetic
accatgactcagca

SEQ ID NO: 14835 - DNA, 10 bp, Artificial sequence
  Synthetic
cacgtggccc

SEQ ID NO: 14836 - DNA, 15 bp, Artificial sequence
  Synthetic
agggggcggggccaa

SEQ ID NO: 14837 - DNA, 8 bp, Artificial sequence
  Synthetic
aggattaa

SEQ ID NO: 14838 - DNA, 8 bp, Artificial sequence
  Synthetic
aggattag

SEQ ID NO: 14839 - DNA, 20 bp, Artificial sequence
  Synthetic
caagtaacacgtgacacttg

SEQ ID NO: 14840 - DNA, 15 bp, Artificial sequence
  Synthetic
agggggcggggccag

SEQ ID NO: 14841 - DNA, 9 bp, Artificial sequence
  Synthetic
gtgacgcca

SEQ ID NO: 14842 - DNA, 12 bp, Artificial sequence
  Synthetic
cggcacgtgcca

SEQ ID NO: 14843 - DNA, 12 bp, Artificial sequence
  Synthetic
cggcacgtgccg

SEQ ID NO: 14844 - DNA, 12 bp, Artificial sequence
  Synthetic
taccacgtgtca

SEQ ID NO: 14845 - DNA, 16 bp, Artificial sequence
  Synthetic
aaaaaccaattaagaa

SEQ ID NO: 14846 - DNA, 6 bp, Artificial sequence
  Synthetic
aacaat

SEQ ID NO: 14847 - DNA, 12 bp, Artificial sequence
  Synthetic
gctaaaaatagc

SEQ ID NO: 14848 - DNA, 11 bp, Artificial sequence
  Synthetic
aaccgaaacca

SEQ ID NO: 14849 - DNA, 10 bp, Artificial sequence
  Synthetic
agccaatcag

SEQ ID NO: 14850 - DNA, 14 bp, Artificial sequence
  Synthetic
atattgcacaactc

SEQ ID NO: 14851 - DNA, 20 bp, Artificial sequence
  Synthetic
acatgcccgggcatgtccgg

SEQ ID NO: 14852 - DNA, 15 bp, Artificial sequence
  Synthetic
agcaccatggacagc

SEQ ID NO: 14853 - DNA, 18 bp, Artificial sequence
  Synthetic
ccgaagcaggtggcgaag

SEQ ID NO: 14854 - DNA, 10 bp, Artificial sequence
  Synthetic
ccccccccac

SEQ ID NO: 14855 - DNA, 17 bp, Artificial sequence
  Synthetic
cgcgctaattaggtatc

SEQ ID NO: 14856 - DNA, 12 bp, Artificial sequence
  Synthetic
ggcgaccaccga

SEQ ID NO: 14857 - DNA, 10 bp, Artificial sequence
  Synthetic
ccaactgcca

SEQ ID NO: 14858 - DNA, 24 bp, Artificial sequence
  Synthetic
aaaaaataaatcacagcatatgcc

SEQ ID NO: 14859 - DNA, 16 bp, Artificial sequence
  Synthetic
ataggggcggggtcga

SEQ ID NO: 14860 - DNA, 10 bp, Artificial sequence
  Synthetic
gatttgcata

SEQ ID NO: 14861 - DNA, 12 bp, Artificial sequence
  Synthetic
caacaggtggtg

SEQ ID NO: 14862 - DNA, 7 bp, Artificial sequence
  Synthetic
cagatta

SEQ ID NO: 14863 - DNA, 17 bp, Artificial sequence
  Synthetic
ccaccagggggcgccag

SEQ ID NO: 14864 - DNA, 10 bp, Artificial sequence
  Synthetic
agatcaaagg

SEQ ID NO: 14865 - DNA, 15 bp, Artificial sequence
  Synthetic
ccgagacccctgccc

SEQ ID NO: 14866 - DNA, 10 bp, Artificial sequence
  Synthetic
aaggtgtgag

SEQ ID NO: 14867 - DNA, 16 bp, Artificial sequence
  Synthetic
tatttatatataaaga

SEQ ID NO: 14868 - DNA, 10 bp, Artificial sequence
  Synthetic
aaggtgtgaa

SEQ ID NO: 14869 - DNA, 12 bp, Artificial sequence
  Synthetic
aaacatatgttt

SEQ ID NO: 14870 - DNA, 16 bp, Artificial sequence
  Synthetic
atgttttacgacttta

SEQ ID NO: 14871 - DNA, 14 bp, Artificial sequence
  Synthetic
accggaaatccggt

SEQ ID NO: 14872 - DNA, 17 bp, Artificial sequence
  Synthetic
taggtcagtcaaggtca

SEQ ID NO: 14873 - DNA, 11 bp, Artificial sequence
  Synthetic
acggacacaat

SEQ ID NO: 14874 - DNA, 21 bp, Artificial sequence
  Synthetic
aaagtgaaagtgaaagtaaaa

SEQ ID NO: 14875 - DNA, 16 bp, Artificial sequence
  Synthetic
aatcaattcaataatt

SEQ ID NO: 14876 - DNA, 15 bp, Artificial sequence
  Synthetic
attatgttaaatcac

SEQ ID NO: 14877 - DNA, 10 bp, Artificial sequence
  Synthetic
gggaattgta

SEQ ID NO: 14878 - DNA, 7 bp, Artificial sequence
  Synthetic
agataag

SEQ ID NO: 14879 - DNA, 15 bp, Artificial sequence
  Synthetic
ctggactttggactc

SEQ ID NO: 14880 - DNA, 9 bp, Artificial sequence
  Synthetic
ggtcataaa

SEQ ID NO: 14881 - DNA, 8 bp, Artificial sequence
  Synthetic
aaatgtaa

SEQ ID NO: 14882 - DNA, 8 bp, Artificial sequence
  Synthetic
gtaaacaa

SEQ ID NO: 14883 - DNA, 17 bp, Artificial sequence
  Synthetic
tcgcattaattaatgca

SEQ ID NO: 14884 - DNA, 15 bp, Artificial sequence
  Synthetic
caagatggcggccgc

SEQ ID NO: 14885 - DNA, 10 bp, Artificial sequence
  Synthetic
atagataaga

SEQ ID NO: 14886 - DNA, 16 bp, Artificial sequence
  Synthetic
cccgaccacgtggtca

SEQ ID NO: 14887 - DNA, 21 bp, Artificial sequence
  Synthetic
ggcgctgtccgtggtgctgaa

SEQ ID NO: 14888 - DNA, 11 bp, Artificial sequence
  Synthetic
gccacgcccac

SEQ ID NO: 14889 - DNA, 15 bp, Artificial sequence
  Synthetic
aaccaagatggcggc

SEQ ID NO: 14890 - DNA, 23 bp, Artificial sequence
  Synthetic
cagatgccgcccacgcattattc

SEQ ID NO: 14891 - DNA, 12 bp, Artificial sequence
  Synthetic
cagtgacaggtc

SEQ ID NO: 14892 - DNA, 14 bp, Artificial sequence
  Synthetic
ctcgaacccgtgcc

SEQ ID NO: 14893 - DNA, 12 bp, Artificial sequence
  Synthetic
attgcccgccgc

SEQ ID NO: 14894 - DNA, 15 bp, Artificial sequence
  Synthetic
ctcccgcccccactc

SEQ ID NO: 14895 - DNA, 12 bp, Artificial sequence
  Synthetic
aattagcataca

SEQ ID NO: 14896 - DNA, 15 bp, Artificial sequence
  Synthetic
cgtatcgaaaccaaa

SEQ ID NO: 14897 - DNA, 8 bp, Artificial sequence
  Synthetic
accgcgtg

SEQ ID NO: 14898 - DNA, 18 bp, Artificial sequence
  Synthetic
atcgataacctgatcgat

SEQ ID NO: 14899 - DNA, 6 bp, Artificial sequence
  Synthetic
cggaag

SEQ ID NO: 14900 - DNA, 8 bp, Artificial sequence
  Synthetic
agaacaat

SEQ ID NO: 14901 - DNA, 11 bp, Artificial sequence
  Synthetic
tatgtgggtca

SEQ ID NO: 14902 - DNA, 12 bp, Artificial sequence
  Synthetic
aatgggcgtggc

SEQ ID NO: 14903 - DNA, 17 bp, Artificial sequence
  Synthetic
cagccgacacgtgcccc

SEQ ID NO: 14904 - DNA, 9 bp, Artificial sequence
  Synthetic
agctgtcaa

SEQ ID NO: 14905 - DNA, 18 bp, Artificial sequence
  Synthetic
ccaccagagggcgctata

SEQ ID NO: 14906 - DNA, 10 bp, Artificial sequence
  Synthetic
taatacatta

SEQ ID NO: 14907 - DNA, 16 bp, Artificial sequence
  Synthetic
aaagacctgtcaatac

SEQ ID NO: 14908 - DNA, 17 bp, Artificial sequence
  Synthetic
acgcagctgtcaatatc

SEQ ID NO: 14909 - DNA, 10 bp, Artificial sequence
  Synthetic
agaatattcg

SEQ ID NO: 14910 - DNA, 15 bp, Artificial sequence
  Synthetic
agagtccaaagtcca

SEQ ID NO: 14911 - DNA, 17 bp, Artificial sequence
  Synthetic
aaaaagtaaacaaagac

SEQ ID NO: 14912 - DNA, 15 bp, Artificial sequence
  Synthetic
aggggtcagaggtca

SEQ ID NO: 14913 - DNA, 13 bp, Artificial sequence
  Synthetic
agaacagtctgta

SEQ ID NO: 14914 - DNA, 18 bp, Artificial sequence
  Synthetic
attggttatattggttaa

SEQ ID NO: 14915 - DNA, 14 bp, Artificial sequence
  Synthetic
attaattacctcag

SEQ ID NO: 14916 - DNA, 20 bp, Artificial sequence
  Synthetic
agagcactgaagcgtaaccg

SEQ ID NO: 14917 - DNA, 17 bp, Artificial sequence
  Synthetic
cgaattaattaagaaac

SEQ ID NO: 14918 - DNA, 16 bp, Artificial sequence
  Synthetic
gataattataattagc

SEQ ID NO: 14919 - DNA, 10 bp, Artificial sequence
  Synthetic
aaccggaagt

SEQ ID NO: 14920 - DNA, 15 bp, Artificial sequence
  Synthetic
gcaacaatgtatcaa

SEQ ID NO: 14921 - DNA, 11 bp, Artificial sequence
  Synthetic
aaatcgtgact

SEQ ID NO: 14922 - DNA, 13 bp, Artificial sequence
  Synthetic
cagccaatcagag

SEQ ID NO: 14923 - DNA, 15 bp, Artificial sequence
  Synthetic
gacactgtaacaaaa

SEQ ID NO: 14924 - DNA, 10 bp, Artificial sequence
  Synthetic
taagtaaaca

SEQ ID NO: 14925 - DNA, 15 bp, Artificial sequence
  Synthetic
cacttcattgaatta

SEQ ID NO: 14926 - DNA, 17 bp, Artificial sequence
  Synthetic
caaattaattaataaaa

SEQ ID NO: 14927 - DNA, 10 bp, Artificial sequence
  Synthetic
aaccggaagc

SEQ ID NO: 14928 - DNA, 8 bp, Artificial sequence
  Synthetic
ccaattaa

SEQ ID NO: 14929 - DNA, 8 bp, Artificial sequence
  Synthetic
tatttcca

SEQ ID NO: 14930 - DNA, 9 bp, Artificial sequence
  Synthetic
caactgcca

SEQ ID NO: 14931 - DNA, 10 bp, Artificial sequence
  Synthetic
ccgtgacccc

SEQ ID NO: 14932 - DNA, 17 bp, Artificial sequence
  Synthetic
gccaccctctggtggcc

SEQ ID NO: 14933 - DNA, 7 bp, Artificial sequence
  Synthetic
aaatcaa

SEQ ID NO: 14934 - DNA, 10 bp, Artificial sequence
  Synthetic
acacttgagt

SEQ ID NO: 14935 - DNA, 16 bp, Artificial sequence
  Synthetic
atgtattaattaagta

SEQ ID NO: 14936 - DNA, 15 bp, Artificial sequence
  Synthetic
aaccacctgttgacc

SEQ ID NO: 14937 - DNA, 11 bp, Artificial sequence
  Synthetic
agctgtcagaa

SEQ ID NO: 14938 - DNA, 10 bp, Artificial sequence
  Synthetic
ccacatgacc

SEQ ID NO: 14939 - DNA, 21 bp, Artificial sequence
  Synthetic
agggaacagaatgttctgggc

SEQ ID NO: 14940 - DNA, 12 bp, Artificial sequence
  Synthetic
atgttaacataa

SEQ ID NO: 14941 - DNA, 9 bp, Artificial sequence
  Synthetic
atgcccacc

SEQ ID NO: 14942 - DNA, 17 bp, Artificial sequence
  Synthetic
aattttacatgtatata

SEQ ID NO: 14943 - DNA, 9 bp, Artificial sequence
  Synthetic
accggaagt

SEQ ID NO: 14944 - DNA, 10 bp, Artificial sequence
  Synthetic
gcaataaaaa

SEQ ID NO: 14945 - DNA, 9 bp, Artificial sequence
  Synthetic
atgataccc

SEQ ID NO: 14946 - DNA, 18 bp, Artificial sequence
  Synthetic
gtaattaacggtaattaa

SEQ ID NO: 14947 - DNA, 10 bp, Artificial sequence
  Synthetic
cgcccacgtc

SEQ ID NO: 14948 - DNA, 11 bp, Artificial sequence
  Synthetic
gaacagctgtc

SEQ ID NO: 14949 - DNA, 7 bp, Artificial sequence
  Synthetic
ggattaa

SEQ ID NO: 14950 - DNA, 10 bp, Artificial sequence
  Synthetic
tatgtaaaca

SEQ ID NO: 14951 - DNA, 12 bp, Artificial sequence
  Synthetic
tatagacgcgca

SEQ ID NO: 14952 - DNA, 13 bp, Artificial sequence
  Synthetic
ccttagccaatca

SEQ ID NO: 14953 - DNA, 16 bp, Artificial sequence
  Synthetic
tcaggcgcgcgcgcca

SEQ ID NO: 14954 - DNA, 14 bp, Artificial sequence
  Synthetic
tcataaaactgtca

SEQ ID NO: 14955 - DNA, 12 bp, Artificial sequence
  Synthetic
agaacaaagcgc

SEQ ID NO: 14956 - DNA, 14 bp, Artificial sequence
  Synthetic
cggtgacgtcatca

SEQ ID NO: 14957 - DNA, 8 bp, Artificial sequence
  Synthetic
tgtatcaa

SEQ ID NO: 14958 - DNA, 8 bp, Artificial sequence
  Synthetic
gttaacta

SEQ ID NO: 14959 - DNA, 13 bp, Artificial sequence
  Synthetic
ctcatttgcatac

SEQ ID NO: 14960 - DNA, 14 bp, Artificial sequence
  Synthetic
ttatgtactaataa

SEQ ID NO: 14961 - DNA, 9 bp, Artificial sequence
  Synthetic
cgtgcgcaa

SEQ ID NO: 14962 - DNA, 12 bp, Artificial sequence
  Synthetic
atgcataaatta

SEQ ID NO: 14963 - DNA, 10 bp, Artificial sequence
  Synthetic
ggagggggaa

SEQ ID NO: 14964 - DNA, 11 bp, Artificial sequence
  Synthetic
ctcacgtgcac

SEQ ID NO: 14965 - DNA, 20 bp, Artificial sequence
  Synthetic
agggacgcagctgctcccca

SEQ ID NO: 14966 - DNA, 8 bp, Artificial sequence
  Synthetic
ctaatcaa

SEQ ID NO: 14967 - DNA, 22 bp, Artificial sequence
  Synthetic
aattaatcgaaatcaaattaaa

SEQ ID NO: 14968 - DNA, 16 bp, Artificial sequence
  Synthetic
acgatgacgtcatcgg

SEQ ID NO: 14969 - DNA, 11 bp, Artificial sequence
  Synthetic
agcacgtggcc

SEQ ID NO: 14970 - DNA, 7 bp, Artificial sequence
  Synthetic
ccgccgc

SEQ ID NO: 14971 - DNA, 11 bp, Artificial sequence
  Synthetic
aaaatggcggt

SEQ ID NO: 14972 - DNA, 8 bp, Artificial sequence
  Synthetic
gtcacgca

SEQ ID NO: 14973 - DNA, 12 bp, Artificial sequence
  Synthetic
tgattgcaatca

SEQ ID NO: 14974 - DNA, 7 bp, Artificial sequence
  Synthetic
tcattaa

SEQ ID NO: 14975 - DNA, 9 bp, Artificial sequence
  Synthetic
attccaggc

SEQ ID NO: 14976 - DNA, 15 bp, Artificial sequence
  Synthetic
gggtcaagggggtga

SEQ ID NO: 14977 - DNA, 13 bp, Artificial sequence
  Synthetic
cgctgccctctgc

SEQ ID NO: 14978 - DNA, 15 bp, Artificial sequence
  Synthetic
acatgcccagacatg

SEQ ID NO: 14979 - DNA, 11 bp, Artificial sequence
  Synthetic
aaaatggcggc

SEQ ID NO: 14980 - DNA, 15 bp, Artificial sequence
  Synthetic
ttggcaccgtgccaa

SEQ ID NO: 14981 - DNA, 16 bp, Artificial sequence
  Synthetic
aagctataaatagaat

SEQ ID NO: 14982 - DNA, 10 bp, Artificial sequence
  Synthetic
tgcatatcaa

SEQ ID NO: 14983 - DNA, 12 bp, Artificial sequence
  Synthetic
aaataattaacg

SEQ ID NO: 14984 - DNA, 17 bp, Artificial sequence
  Synthetic
taattaattaatggcta

SEQ ID NO: 14985 - DNA, 12 bp, Artificial sequence
  Synthetic
ggtccttttata

SEQ ID NO: 14986 - DNA, 15 bp, Artificial sequence
  Synthetic
aaagatgatgtcatc

SEQ ID NO: 14987 - DNA, 11 bp, Artificial sequence
  Synthetic
aaccggaagtg

SEQ ID NO: 14988 - DNA, 8 bp, Artificial sequence
  Synthetic
tcttatca

SEQ ID NO: 14989 - DNA, 11 bp, Artificial sequence
  Synthetic
cattgcgtgac

SEQ ID NO: 14990 - DNA, 22 bp, Artificial sequence
  Synthetic
cataattgctgagtcattttag

SEQ ID NO: 14991 - DNA, 18 bp, Artificial sequence
  Synthetic
cggtttaaaaataaccca

SEQ ID NO: 14992 - DNA, 17 bp, Artificial sequence
  Synthetic
cctcacttccgggttcg

SEQ ID NO: 14993 - DNA, 8 bp, Artificial sequence
  Synthetic
ccacttaa

SEQ ID NO: 14994 - DNA, 10 bp, Artificial sequence
  Synthetic
acccaaggga

SEQ ID NO: 14995 - DNA, 19 bp, Artificial sequence
  Synthetic
ccgaaatttgcatattgaa

SEQ ID NO: 14996 - DNA, 11 bp, Artificial sequence
  Synthetic
gaggtcagggc

SEQ ID NO: 14997 - DNA, 17 bp, Artificial sequence
  Synthetic
gagaagggggcgggacc

SEQ ID NO: 14998 - DNA, 19 bp, Artificial sequence
  Synthetic
cctgaccccaatgacccga

SEQ ID NO: 14999 - DNA, 17 bp, Artificial sequence
  Synthetic
cgcgttaattaattacc

SEQ ID NO: 15000 - DNA, 10 bp, Artificial sequence
  Synthetic
cacacctgca

SEQ ID NO: 15001 - DNA, 10 bp, Artificial sequence
  Synthetic
agcacctgtc

SEQ ID NO: 15002 - DNA, 17 bp, Artificial sequence
  Synthetic
cctattaattaattccg

SEQ ID NO: 15003 - DNA, 16 bp, Artificial sequence
  Synthetic
aaggagctgtcaatac

SEQ ID NO: 15004 - DNA, 11 bp, Artificial sequence
  Synthetic
aaccggaaata

SEQ ID NO: 15005 - DNA, 13 bp, Artificial sequence
  Synthetic
aaaaacaaacaac

SEQ ID NO: 15006 - DNA, 6 bp, Artificial sequence
  Synthetic
agtcca

SEQ ID NO: 15007 - DNA, 8 bp, Artificial sequence
  Synthetic
acatatgg

SEQ ID NO: 15008 - DNA, 22 bp, Artificial sequence
  Synthetic
acaacctccctggggagttgtg

SEQ ID NO: 15009 - DNA, 10 bp, Artificial sequence
  Synthetic
gcggattaac

SEQ ID NO: 15010 - DNA, 10 bp, Artificial sequence
  Synthetic
gccaattagc

SEQ ID NO: 15011 - DNA, 14 bp, Artificial sequence
  Synthetic
gcacctcgcacagc

SEQ ID NO: 15012 - DNA, 11 bp, Artificial sequence
  Synthetic
ataatggcggc

SEQ ID NO: 15013 - DNA, 7 bp, Artificial sequence
  Synthetic
cccggag

SEQ ID NO: 15014 - DNA, 10 bp, Artificial sequence
  Synthetic
attttgctga

SEQ ID NO: 15015 - DNA, 9 bp, Artificial sequence
  Synthetic
agataagag

SEQ ID NO: 15016 - DNA, 10 bp, Artificial sequence
  Synthetic
acccaggtgg

SEQ ID NO: 15017 - DNA, 17 bp, Artificial sequence
  Synthetic
gaacaccatttttgaac

SEQ ID NO: 15018 - DNA, 7 bp, Artificial sequence
  Synthetic
aagcttg

SEQ ID NO: 15019 - DNA, 11 bp, Artificial sequence
  Synthetic
aaggtgtgaaa

SEQ ID NO: 15020 - DNA, 17 bp, Artificial sequence
  Synthetic
aaccgctaattagtgga

SEQ ID NO: 15021 - DNA, 10 bp, Artificial sequence
  Synthetic
agcagctgct

SEQ ID NO: 15022 - DNA, 11 bp, Artificial sequence
  Synthetic
agggccagttg

SEQ ID NO: 15023 - DNA, 9 bp, Artificial sequence
  Synthetic
agagataag

SEQ ID NO: 15024 - DNA, 8 bp, Artificial sequence
  Synthetic
atgactca

SEQ ID NO: 15025 - DNA, 19 bp, Artificial sequence
  Synthetic
ccggccccgccccctcccc

SEQ ID NO: 15026 - DNA, 15 bp, Artificial sequence
  Synthetic
agggtcaaaaggtca

SEQ ID NO: 15027 - DNA, 10 bp, Artificial sequence
  Synthetic
gttaattaac

SEQ ID NO: 15028 - DNA, 21 bp, Artificial sequence
  Synthetic
ccggttcaaaccggttctggc

SEQ ID NO: 15029 - DNA, 18 bp, Artificial sequence
  Synthetic
aaggtcatttcaaggtca

SEQ ID NO: 15030 - DNA, 9 bp, Artificial sequence
  Synthetic
ggtaataaa

SEQ ID NO: 15031 - DNA, 14 bp, Artificial sequence
  Synthetic
aacgtaaacaacac

SEQ ID NO: 15032 - DNA, 7 bp, Artificial sequence
  Synthetic
agtcatg

SEQ ID NO: 15033 - DNA, 17 bp, Artificial sequence
  Synthetic
ccctccctccccccccc

SEQ ID NO: 15034 - DNA, 16 bp, Artificial sequence
  Synthetic
aataacaggtgttcac

SEQ ID NO: 15035 - DNA, 14 bp, Artificial sequence
  Synthetic
gtcgtgtggggaaa

SEQ ID NO: 15036 - DNA, 17 bp, Artificial sequence
  Synthetic
aaggtcagtcaaggtca

SEQ ID NO: 15037 - DNA, 10 bp, Artificial sequence
  Synthetic
ggccacgtga

SEQ ID NO: 15038 - DNA, 17 bp, Artificial sequence
  Synthetic
catgactgaaattcatc

SEQ ID NO: 15039 - DNA, 21 bp, Artificial sequence
  Synthetic
atcgaatatatatatctagtc

SEQ ID NO: 15040 - DNA, 30 bp, Artificial sequence
  Synthetic
tgccaacttccccattagtggtcgcctcca

SEQ ID NO: 15041 - DNA, 17 bp, Artificial sequence
  Synthetic
accactaattagtggac

SEQ ID NO: 15042 - DNA, 10 bp, Artificial sequence
  Synthetic
atgagtcatc

SEQ ID NO: 15043 - DNA, 12 bp, Artificial sequence
  Synthetic
agggttaataaa

SEQ ID NO: 15044 - DNA, 10 bp, Artificial sequence
  Synthetic
acctggtggc

SEQ ID NO: 15045 - DNA, 11 bp, Artificial sequence
  Synthetic
caaaccacaga

SEQ ID NO: 15046 - DNA, 9 bp, Artificial sequence
  Synthetic
aaattcctg

SEQ ID NO: 15047 - DNA, 15 bp, Artificial sequence
  Synthetic
ggggtcaaaggtcac

SEQ ID NO: 15048 - DNA, 11 bp, Artificial sequence
  Synthetic
agccactcaag

SEQ ID NO: 15049 - DNA, 11 bp, Artificial sequence
  Synthetic
ctgggtagagc

SEQ ID NO: 15050 - DNA, 10 bp, Artificial sequence
  Synthetic
aaaccggttt

SEQ ID NO: 15051 - DNA, 8 bp, Artificial sequence
  Synthetic
ccattaaa

SEQ ID NO: 15052 - DNA, 10 bp, Artificial sequence
  Synthetic
gccacttaaa

SEQ ID NO: 15053 - DNA, 11 bp, Artificial sequence
  Synthetic
agttaagtgga

SEQ ID NO: 15054 - DNA, 30 bp, Artificial sequence
  Synthetic
gaaaaatttccaatactccactcccccccc

SEQ ID NO: 15055 - DNA, 13 bp, Artificial sequence
  Synthetic
caaaggtcaaggg

SEQ ID NO: 15056 - DNA, 15 bp, Artificial sequence
  Synthetic
ggttaataattacca

SEQ ID NO: 15057 - DNA, 10 bp, Artificial sequence
  Synthetic
ggtcaggtca

SEQ ID NO: 15058 - DNA, 14 bp, Artificial sequence
  Synthetic
acgaaaccgaaact

SEQ ID NO: 15059 - DNA, 14 bp, Artificial sequence
  Synthetic
aaaaaatcaataat

SEQ ID NO: 15060 - DNA, 14 bp, Artificial sequence
  Synthetic
acgaccccccacag

SEQ ID NO: 15061 - DNA, 9 bp, Artificial sequence
  Synthetic
cgtgacgtc

SEQ ID NO: 15062 - DNA, 7 bp, Artificial sequence
  Synthetic
ctttgtc

SEQ ID NO: 15063 - DNA, 11 bp, Artificial sequence
  Synthetic
ccacttcccgc

SEQ ID NO: 15064 - DNA, 8 bp, Artificial sequence
  Synthetic
aaaggcgc

SEQ ID NO: 15065 - DNA, 17 bp, Artificial sequence
  Synthetic
agtatttaattaattcg

SEQ ID NO: 15066 - DNA, 13 bp, Artificial sequence
  Synthetic
aggtcattaaccc

SEQ ID NO: 15067 - DNA, 9 bp, Artificial sequence
  Synthetic
agatggccg

SEQ ID NO: 15068 - DNA, 13 bp, Artificial sequence
  Synthetic
cacttccggttcc

SEQ ID NO: 15069 - DNA, 12 bp, Artificial sequence
  Synthetic
atcgattattgg

SEQ ID NO: 15070 - DNA, 10 bp, Artificial sequence
  Synthetic
ggggcccccc

SEQ ID NO: 15071 - DNA, 12 bp, Artificial sequence
  Synthetic
aattttacgacc

SEQ ID NO: 15072 - DNA, 10 bp, Artificial sequence
  Synthetic
cggccgacgc

SEQ ID NO: 15073 - DNA, 14 bp, Artificial sequence
  Synthetic
cgccccctggtggc

SEQ ID NO: 15074 - DNA, 8 bp, Artificial sequence
  Synthetic
aaataaca

SEQ ID NO: 15075 - DNA, 10 bp, Artificial sequence
  Synthetic
tcgtaaacaa

SEQ ID NO: 15076 - DNA, 10 bp, Artificial sequence
  Synthetic
aaatcacagc

SEQ ID NO: 15077 - DNA, 14 bp, Artificial sequence
  Synthetic
ttgacagctgtcaa

SEQ ID NO: 15078 - DNA, 15 bp, Artificial sequence
  Synthetic
ctccctggcaacagc

SEQ ID NO: 15079 - DNA, 12 bp, Artificial sequence
  Synthetic
tgcgcatgcgca

SEQ ID NO: 15080 - DNA, 10 bp, Artificial sequence
  Synthetic
cggggggccc

SEQ ID NO: 15081 - DNA, 21 bp, Artificial sequence
  Synthetic
cagtttcggtttccgtttccc

SEQ ID NO: 15082 - DNA, 12 bp, Artificial sequence
  Synthetic
ccatcaatcaaa

SEQ ID NO: 15083 - DNA, 12 bp, Artificial sequence
  Synthetic
gaaagcgaaacc

SEQ ID NO: 15084 - DNA, 25 bp, Artificial sequence
  Synthetic
cggggcattctgggaattgtagtcc

SEQ ID NO: 15085 - DNA, 15 bp, Artificial sequence
  Synthetic
cagaccccccacaga

SEQ ID NO: 15086 - DNA, 9 bp, Artificial sequence
  Synthetic
aaagtgata

SEQ ID NO: 15087 - DNA, 13 bp, Artificial sequence
  Synthetic
taattgccaatta

SEQ ID NO: 15088 - DNA, 13 bp, Artificial sequence
  Synthetic
aggccaaagtcca

SEQ ID NO: 15089 - DNA, 10 bp, Artificial sequence
  Synthetic
agacatgcct

SEQ ID NO: 15090 - DNA, 11 bp, Artificial sequence
  Synthetic
ataaattatgc

SEQ ID NO: 15091 - DNA, 9 bp, Artificial sequence
  Synthetic
ccctatctc

SEQ ID NO: 15092 - DNA, 11 bp, Artificial sequence
  Synthetic
ccaaggtcaca

SEQ ID NO: 15093 - DNA, 10 bp, Artificial sequence
  Synthetic
cgctgactca

SEQ ID NO: 15094 - DNA, 17 bp, Artificial sequence
  Synthetic
attaaggggtcacgaca

SEQ ID NO: 15095 - DNA, 8 bp, Artificial sequence
  Synthetic
actcatgc

SEQ ID NO: 15096 - DNA, 14 bp, Artificial sequence
  Synthetic
atgcattacataac

SEQ ID NO: 15097 - DNA, 18 bp, Artificial sequence
  Synthetic
caacaatcttcattgtcc

SEQ ID NO: 15098 - DNA, 12 bp, Artificial sequence
  Synthetic
accatatatggc

SEQ ID NO: 15099 - DNA, 12 bp, Artificial sequence
  Synthetic
accgttaacggt

SEQ ID NO: 15100 - DNA, 8 bp, Artificial sequence
  Synthetic
tcacatga

SEQ ID NO: 15101 - DNA, 9 bp, Artificial sequence
  Synthetic
atcacgcga

SEQ ID NO: 15102 - DNA, 13 bp, Artificial sequence
  Synthetic
tcgtcacgcttca

SEQ ID NO: 15103 - DNA, 14 bp, Artificial sequence
  Synthetic
aagataagataaca

SEQ ID NO: 15104 - DNA, 10 bp, Artificial sequence
  Synthetic
atgactcagc

SEQ ID NO: 15105 - DNA, 9 bp, Artificial sequence
  Synthetic
catataagg

SEQ ID NO: 15106 - DNA, 9 bp, Artificial sequence
  Synthetic
cgtgggaaa

SEQ ID NO: 15107 - DNA, 7 bp, Artificial sequence
  Synthetic
acaatta

SEQ ID NO: 15108 - DNA, 21 bp, Artificial sequence
  Synthetic
aaattgctgagtcagcatatt

SEQ ID NO: 15109 - DNA, 14 bp, Artificial sequence
  Synthetic
aaaaatattattat

SEQ ID NO: 15110 - DNA, 10 bp, Artificial sequence
  Synthetic
taaccacaaa

SEQ ID NO: 15111 - DNA, 13 bp, Artificial sequence
  Synthetic
ccaccggaaatta

SEQ ID NO: 15112 - DNA, 14 bp, Artificial sequence
  Synthetic
agttactaggcaaa

SEQ ID NO: 15113 - DNA, 7 bp, Artificial sequence
  Synthetic
ctaatga

SEQ ID NO: 15114 - DNA, 19 bp, Artificial sequence
  Synthetic
caaggtcatttcaaggtca

SEQ ID NO: 15115 - DNA, 12 bp, Artificial sequence
  Synthetic
tgccccagggca

SEQ ID NO: 15116 - DNA, 15 bp, Artificial sequence
  Synthetic
atgaataacattcat

SEQ ID NO: 15117 - DNA, 10 bp, Artificial sequence
  Synthetic
aatttgcata

SEQ ID NO: 15118 - DNA, 8 bp, Artificial sequence
  Synthetic
atcacgtg

SEQ ID NO: 15119 - DNA, 8 bp, Artificial sequence
  Synthetic
taataaaa

SEQ ID NO: 15120 - DNA, 12 bp, Artificial sequence
  Synthetic
cgccccctgaca

SEQ ID NO: 15121 - DNA, 10 bp, Artificial sequence
  Synthetic
taacggtcaa

SEQ ID NO: 15122 - DNA, 12 bp, Artificial sequence
  Synthetic
gcctcccacgcc

SEQ ID NO: 15123 - DNA, 10 bp, Artificial sequence
  Synthetic
aaagatctta

SEQ ID NO: 15124 - DNA, 11 bp, Artificial sequence
  Synthetic
attgtgcaatc

SEQ ID NO: 15125 - DNA, 12 bp, Artificial sequence
  Synthetic
caagatggcggc

SEQ ID NO: 15126 - DNA, 11 bp, Artificial sequence
  Synthetic
attgtgcaata

SEQ ID NO: 15127 - DNA, 15 bp, Artificial sequence
  Synthetic
aagccccccaaaaat

SEQ ID NO: 15128 - DNA, 22 bp, Artificial sequence
  Synthetic
tgtggttctaaaaatagaacaa

SEQ ID NO: 15129 - DNA, 14 bp, Artificial sequence
  Synthetic
cccgcccccgcccc

SEQ ID NO: 15130 - DNA, 7 bp, Artificial sequence
  Synthetic
cttatca

SEQ ID NO: 15131 - DNA, 18 bp, Artificial sequence
  Synthetic
gttcagtcatgcgtgaca

SEQ ID NO: 15132 - DNA, 17 bp, Artificial sequence
  Synthetic
gtgggctaattagttca

SEQ ID NO: 15133 - DNA, 9 bp, Artificial sequence
  Synthetic
gtcacgtga

SEQ ID NO: 15134 - DNA, 14 bp, Artificial sequence
  Synthetic
taattgaccaatta

SEQ ID NO: 15135 - DNA, 12 bp, Artificial sequence
  Synthetic
ctgaccttgaac

SEQ ID NO: 15136 - DNA, 12 bp, Artificial sequence
  Synthetic
atggcggcatgg

SEQ ID NO: 15137 - DNA, 12 bp, Artificial sequence
  Synthetic
aaaattgctgac

SEQ ID NO: 15138 - DNA, 13 bp, Artificial sequence
  Synthetic
aatccagatgttg

SEQ ID NO: 15139 - DNA, 12 bp, Artificial sequence
  Synthetic
gaacagatggtc

SEQ ID NO: 15140 - DNA, 8 bp, Artificial sequence
  Synthetic
aataaaaa

SEQ ID NO: 15141 - DNA, 8 bp, Artificial sequence
  Synthetic
ctttgatc

SEQ ID NO: 15142 - DNA, 12 bp, Artificial sequence
  Synthetic
accggaagtgca

SEQ ID NO: 15143 - DNA, 14 bp, Artificial sequence
  Synthetic
aaagatcaaaggaa

SEQ ID NO: 15144 - DNA, 13 bp, Artificial sequence
  Synthetic
gacaggaagtaac

SEQ ID NO: 15145 - DNA, 11 bp, Artificial sequence
  Synthetic
accggaaatcc

SEQ ID NO: 15146 - DNA, 9 bp, Artificial sequence
  Synthetic
ggtggggaa

SEQ ID NO: 15147 - DNA, 15 bp, Artificial sequence
  Synthetic
acgtttgtggttagc

SEQ ID NO: 15148 - DNA, 17 bp, Artificial sequence
  Synthetic
tcacccatcaataatca

SEQ ID NO: 15149 - DNA, 11 bp, Artificial sequence
  Synthetic
gccctgccgcc

SEQ ID NO: 15150 - DNA, 13 bp, Artificial sequence
  Synthetic
taatttatgcata

SEQ ID NO: 15151 - DNA, 17 bp, Artificial sequence
  Synthetic
gttcactaattagttta

SEQ ID NO: 15152 - DNA, 12 bp, Artificial sequence
  Synthetic
caacacctgtcc

SEQ ID NO: 15153 - DNA, 20 bp, Artificial sequence
  Synthetic
ctggtgggggcagataagga

SEQ ID NO: 15154 - DNA, 11 bp, Artificial sequence
  Synthetic
acagctgctgc

SEQ ID NO: 15155 - DNA, 10 bp, Artificial sequence
  Synthetic
catcaaaggg

SEQ ID NO: 15156 - DNA, 9 bp, Artificial sequence
  Synthetic
aaagtccaa

SEQ ID NO: 15157 - DNA, 14 bp, Artificial sequence
  Synthetic
gtgttgtttacaac

SEQ ID NO: 15158 - DNA, 17 bp, Artificial sequence
  Synthetic
gaaaactagttaacatc

SEQ ID NO: 15159 - DNA, 14 bp, Artificial sequence
  Synthetic
ccaccagggggcgc

SEQ ID NO: 15160 - DNA, 17 bp, Artificial sequence
  Synthetic
cgaattaattaatcacc

SEQ ID NO: 15161 - DNA, 13 bp, Artificial sequence
  Synthetic
cacttcctggttc

SEQ ID NO: 15162 - DNA, 16 bp, Artificial sequence
  Synthetic
ggtgtgaattcacacc

SEQ ID NO: 15163 - DNA, 8 bp, Artificial sequence
  Synthetic
ccacgtca

SEQ ID NO: 15164 - DNA, 9 bp, Artificial sequence
  Synthetic
acgtcatca

SEQ ID NO: 15165 - DNA, 8 bp, Artificial sequence
  Synthetic
gcgccaaa

SEQ ID NO: 15166 - DNA, 15 bp, Artificial sequence
  Synthetic
attgtcatgctaatg

SEQ ID NO: 15167 - DNA, 15 bp, Artificial sequence
  Synthetic
ccacttccgggttcg

SEQ ID NO: 15168 - DNA, 17 bp, Artificial sequence
  Synthetic
aaatttgctgacttagc

SEQ ID NO: 15169 - DNA, 16 bp, Artificial sequence
  Synthetic
gccccgctgccgccgc

SEQ ID NO: 15170 - DNA, 15 bp, Artificial sequence
  Synthetic
ctctgtttactttgc

SEQ ID NO: 15171 - DNA, 14 bp, Artificial sequence
  Synthetic
ggtaattattaacc

SEQ ID NO: 15172 - DNA, 7 bp, Artificial sequence
  Synthetic
aaaatac

SEQ ID NO: 15173 - DNA, 19 bp, Artificial sequence
  Synthetic
gaacccattgttcttttcc

SEQ ID NO: 15174 - DNA, 19 bp, Artificial sequence
  Synthetic
atggccatataaggagatg

SEQ ID NO: 15175 - DNA, 12 bp, Artificial sequence
  Synthetic
tgacagctgtca

SEQ ID NO: 15176 - DNA, 10 bp, Artificial sequence
  Synthetic
aaatcacggc

SEQ ID NO: 15177 - DNA, 8 bp, Artificial sequence
  Synthetic
acaactcc

SEQ ID NO: 15178 - DNA, 19 bp, Artificial sequence
  Synthetic
tcacctgttgctaggcaga

SEQ ID NO: 15179 - DNA, 10 bp, Artificial sequence
  Synthetic
actaattagc

SEQ ID NO: 15180 - DNA, 12 bp, Artificial sequence
  Synthetic
acgcccacgcaa

SEQ ID NO: 15181 - DNA, 15 bp, Artificial sequence
  Synthetic
caatagcggtggtgg

SEQ ID NO: 15182 - DNA, 10 bp, Artificial sequence
  Synthetic
ccccgccccc

SEQ ID NO: 15183 - DNA, 12 bp, Artificial sequence
  Synthetic
acgcccacgcat

SEQ ID NO: 15184 - DNA, 10 bp, Artificial sequence
  Synthetic
acacgcccct

SEQ ID NO: 15185 - DNA, 10 bp, Artificial sequence
  Synthetic
ggtcataaaa

SEQ ID NO: 15186 - DNA, 20 bp, Artificial sequence
  Synthetic
ggccaccagatggcactata

SEQ ID NO: 15187 - DNA, 10 bp, Artificial sequence
  Synthetic
gggcaataga

SEQ ID NO: 15188 - DNA, 20 bp, Artificial sequence
  Synthetic
caaaactaggtcaaaggtca

SEQ ID NO: 15189 - DNA, 11 bp, Artificial sequence
  Synthetic
agaccacccag

SEQ ID NO: 15190 - DNA, 10 bp, Artificial sequence
  Synthetic
ggccagacac

SEQ ID NO: 15191 - DNA, 11 bp, Artificial sequence
  Synthetic
agaccacccac

SEQ ID NO: 15192 - DNA, 15 bp, Artificial sequence
  Synthetic
aaaaagaggaagtga

SEQ ID NO: 15193 - DNA, 11 bp, Artificial sequence
  Synthetic
aataaacaata

SEQ ID NO: 15194 - DNA, 9 bp, Artificial sequence
  Synthetic
gacacgtgc

SEQ ID NO: 15195 - DNA, 11 bp, Artificial sequence
  Synthetic
cccacgtgata

SEQ ID NO: 15196 - DNA, 12 bp, Artificial sequence
  Synthetic
aatattcaacag

SEQ ID NO: 15197 - DNA, 12 bp, Artificial sequence
  Synthetic
tgccctagggca

SEQ ID NO: 15198 - DNA, 14 bp, Artificial sequence
  Synthetic
cagccaatcagcgc

SEQ ID NO: 15199 - DNA, 8 bp, Artificial sequence
  Synthetic
tatacata

SEQ ID NO: 15200 - DNA, 11 bp, Artificial sequence
  Synthetic
cacttccggcg

SEQ ID NO: 15201 - DNA, 18 bp, Artificial sequence
  Synthetic
aaggtcaagcaaaggtca

SEQ ID NO: 15202 - DNA, 8 bp, Artificial sequence
  Synthetic
tcaattaa

SEQ ID NO: 15203 - DNA, 12 bp, Artificial sequence
  Synthetic
aaccaatcagag

SEQ ID NO: 15204 - DNA, 17 bp, Artificial sequence
  Synthetic
cacttccgccggaagtg

SEQ ID NO: 15205 - DNA, 12 bp, Artificial sequence
  Synthetic
aaaaagaggaag

SEQ ID NO: 15206 - DNA, 16 bp, Artificial sequence
  Synthetic
atgcataattaatgag

SEQ ID NO: 15207 - DNA, 7 bp, Artificial sequence
  Synthetic
gaaatca

SEQ ID NO: 15208 - DNA, 10 bp, Artificial sequence
  Synthetic
tacccgcata

SEQ ID NO: 15209 - DNA, 17 bp, Artificial sequence
  Synthetic
agcgctaattggtcttc

SEQ ID NO: 15210 - DNA, 12 bp, Artificial sequence
  Synthetic
aattcctggaaa

SEQ ID NO: 15211 - DNA, 8 bp, Artificial sequence
  Synthetic
gctgtcaa

SEQ ID NO: 15212 - DNA, 15 bp, Artificial sequence
  Synthetic
aatttgattgatgtg

SEQ ID NO: 15213 - DNA, 18 bp, Artificial sequence
  Synthetic
ctaattagcgctaattaa

SEQ ID NO: 15214 - DNA, 10 bp, Artificial sequence
  Synthetic
gtagcaacca

SEQ ID NO: 15215 - DNA, 17 bp, Artificial sequence
  Synthetic
tgaattcctagaaagca

SEQ ID NO: 15216 - DNA, 15 bp, Artificial sequence
  Synthetic
gaggatgacgtcatc

SEQ ID NO: 15217 - DNA, 8 bp, Artificial sequence
  Synthetic
cagatggc

SEQ ID NO: 15218 - DNA, 12 bp, Artificial sequence
  Synthetic
accgttaaacgg

SEQ ID NO: 15219 - DNA, 11 bp, Artificial sequence
  Synthetic
cgccaaggagc

SEQ ID NO: 15220 - DNA, 14 bp, Artificial sequence
  Synthetic
aattacttcctgtc

SEQ ID NO: 15221 - DNA, 9 bp, Artificial sequence
  Synthetic
attgcacaa

SEQ ID NO: 15222 - DNA, 17 bp, Artificial sequence
  Synthetic
aggtcactcaaaggtca

SEQ ID NO: 15223 - DNA, 12 bp, Artificial sequence
  Synthetic
gacgtgtcatta

SEQ ID NO: 15224 - DNA, 12 bp, Artificial sequence
  Synthetic
agctcaaggtca

SEQ ID NO: 15225 - DNA, 13 bp, Artificial sequence
  Synthetic
agggacagctgca

SEQ ID NO: 15226 - DNA, 14 bp, Artificial sequence
  Synthetic
gattgtgcaatacc

SEQ ID NO: 15227 - DNA, 18 bp, Artificial sequence
  Synthetic
aatgcttacgtcagcact

SEQ ID NO: 15228 - DNA, 8 bp, Artificial sequence
  Synthetic
cacgtgtc

SEQ ID NO: 15229 - DNA, 11 bp, Artificial sequence
  Synthetic
ggtaataaaaa

SEQ ID NO: 15230 - DNA, 14 bp, Artificial sequence
  Synthetic
aaaaaatcgataat

SEQ ID NO: 15231 - DNA, 11 bp, Artificial sequence
  Synthetic
gtcccttggga

SEQ ID NO: 15232 - DNA, 9 bp, Artificial sequence
  Synthetic
ctagggtta

SEQ ID NO: 15233 - DNA, 11 bp, Artificial sequence
  Synthetic
ctggaactcac

SEQ ID NO: 15234 - DNA, 12 bp, Artificial sequence
  Synthetic
acaataacattg

SEQ ID NO: 15235 - DNA, 18 bp, Artificial sequence
  Synthetic
cccatataaggagatggc

SEQ ID NO: 15236 - DNA, 13 bp, Artificial sequence
  Synthetic
ccaccagagggcg

SEQ ID NO: 15237 - DNA, 15 bp, Artificial sequence
  Synthetic
agcgccccctggtgg

SEQ ID NO: 15238 - DNA, 17 bp, Artificial sequence
  Synthetic
cgaactaattagtacta

SEQ ID NO: 15239 - DNA, 13 bp, Artificial sequence
  Synthetic
aaaaatcaaaggt

SEQ ID NO: 15240 - DNA, 14 bp, Artificial sequence
  Synthetic
ggggtcatgacccc

SEQ ID NO: 15241 - DNA, 13 bp, Artificial sequence
  Synthetic
ctaatttaatcaa

SEQ ID NO: 15242 - DNA, 20 bp, Artificial sequence
  Synthetic
aggtcagggtgacctgggcc

SEQ ID NO: 15243 - DNA, 16 bp, Artificial sequence
  Synthetic
gcagtaagaagtatac

SEQ ID NO: 15244 - DNA, 15 bp, Artificial sequence
  Synthetic
caagatggcggcggc

SEQ ID NO: 15245 - DNA, 14 bp, Artificial sequence
  Synthetic
cacccccggggggg

SEQ ID NO: 15246 - DNA, 10 bp, Artificial sequence
  Synthetic
atgaccttga

SEQ ID NO: 15247 - DNA, 8 bp, Artificial sequence
  Synthetic
gagcggga

SEQ ID NO: 15248 - DNA, 9 bp, Artificial sequence
  Synthetic
ctgagtcac

SEQ ID NO: 15249 - DNA, 9 bp, Artificial sequence
  Synthetic
cttaattga

SEQ ID NO: 15250 - DNA, 10 bp, Artificial sequence
  Synthetic
cctgaggcga

SEQ ID NO: 15251 - DNA, 10 bp, Artificial sequence
  Synthetic
cgcgcgaaac

SEQ ID NO: 15252 - DNA, 12 bp, Artificial sequence
  Synthetic
cacattcctccg

SEQ ID NO: 15253 - DNA, 11 bp, Artificial sequence
  Synthetic
accgtgacctg

SEQ ID NO: 15254 - DNA, 11 bp, Artificial sequence
  Synthetic
ggccacgccca

SEQ ID NO: 15255 - DNA, 16 bp, Artificial sequence
  Synthetic
aaaggtcaaaaggtca

SEQ ID NO: 15256 - DNA, 10 bp, Artificial sequence
  Synthetic
agaggtcacc

SEQ ID NO: 15257 - DNA, 6 bp, Artificial sequence
  Synthetic
cacctg

SEQ ID NO: 15258 - DNA, 10 bp, Artificial sequence
  Synthetic
agaggtcacg

SEQ ID NO: 15259 - DNA, 14 bp, Artificial sequence
  Synthetic
aattggcgggaaaa

SEQ ID NO: 15260 - DNA, 21 bp, Artificial sequence
  Synthetic
aaaatgctgactcagcatttt

SEQ ID NO: 15261 - DNA, 15 bp, Artificial sequence
  Synthetic
caaaccacaaacccc

SEQ ID NO: 15262 - DNA, 10 bp, Artificial sequence
  Synthetic
cggcgcccgc

SEQ ID NO: 15263 - DNA, 11 bp, Artificial sequence
  Synthetic
accggaagtac

SEQ ID NO: 15264 - DNA, 9 bp, Artificial sequence
  Synthetic
aactgatga

SEQ ID NO: 15265 - DNA, 13 bp, Artificial sequence
  Synthetic
tatttacgtaaca

SEQ ID NO: 15266 - DNA, 8 bp, Artificial sequence
  Synthetic
tataaaca

SEQ ID NO: 15267 - DNA, 15 bp, Artificial sequence
  Synthetic
ccgcatagcaacgga

SEQ ID NO: 15268 - DNA, 19 bp, Artificial sequence
  Synthetic
aacacggatatctgtggtc

SEQ ID NO: 15269 - DNA, 15 bp, Artificial sequence
  Synthetic
ctggcaaattgccaa

SEQ ID NO: 15270 - DNA, 16 bp, Artificial sequence
  Synthetic
tctaatttgcatacaa

SEQ ID NO: 15271 - DNA, 15 bp, Artificial sequence
  Synthetic
cagcaccatggacag

SEQ ID NO: 15272 - DNA, 12 bp, Artificial sequence
  Synthetic
aaaaccggtttt

SEQ ID NO: 15273 - DNA, 8 bp, Artificial sequence
  Synthetic
atgacctc

SEQ ID NO: 15274 - DNA, 7 bp, Artificial sequence
  Synthetic
cacccca

SEQ ID NO: 15275 - DNA, 20 bp, Artificial sequence
  Synthetic
ttcacacctagaggtgtgaa

SEQ ID NO: 15276 - DNA, 9 bp, Artificial sequence
  Synthetic
aaggtgctg

SEQ ID NO: 15277 - DNA, 14 bp, Artificial sequence
  Synthetic
aaaaagcggaagta

SEQ ID NO: 15278 - DNA, 13 bp, Artificial sequence
  Synthetic
cagtcacgtggtc

SEQ ID NO: 15279 - DNA, 9 bp, Artificial sequence
  Synthetic
cgaccgtta

SEQ ID NO: 15280 - DNA, 11 bp, Artificial sequence
  Synthetic
agcctgaggca

SEQ ID NO: 15281 - DNA, 17 bp, Artificial sequence
  Synthetic
atagtgagcactgttcg

SEQ ID NO: 15282 - DNA, 14 bp, Artificial sequence
  Synthetic
aacgtaaccacgta

SEQ ID NO: 15283 - DNA, 15 bp, Artificial sequence
  Synthetic
catttcccggaaatg

SEQ ID NO: 15284 - DNA, 7 bp, Artificial sequence
  Synthetic
aaagtca

SEQ ID NO: 15285 - DNA, 14 bp, Artificial sequence
  Synthetic
aaggggatttccaa

SEQ ID NO: 15286 - DNA, 13 bp, Artificial sequence
  Synthetic
acgacagctgacg

SEQ ID NO: 15287 - DNA, 9 bp, Artificial sequence
  Synthetic
caattacgg

SEQ ID NO: 15288 - DNA, 15 bp, Artificial sequence
  Synthetic
actgcctcagggcat

SEQ ID NO: 15289 - DNA, 14 bp, Artificial sequence
  Synthetic
aggaagattaccgc

SEQ ID NO: 15290 - DNA, 13 bp, Artificial sequence
  Synthetic
aaacccggaagta

SEQ ID NO: 15291 - DNA, 17 bp, Artificial sequence
  Synthetic
ctttcccacaacacgac

SEQ ID NO: 15292 - DNA, 19 bp, Artificial sequence
  Synthetic
atgttaaatgtagattaag

SEQ ID NO: 15293 - DNA, 17 bp, Artificial sequence
  Synthetic
ctcagctaattagttta

SEQ ID NO: 15294 - DNA, 10 bp, Artificial sequence
  Synthetic
atgctaatta

SEQ ID NO: 15295 - DNA, 11 bp, Artificial sequence
  Synthetic
agataagataa

SEQ ID NO: 15296 - DNA, 10 bp, Artificial sequence
  Synthetic
gctcataaaa

SEQ ID NO: 15297 - DNA, 15 bp, Artificial sequence
  Synthetic
aaggtcaaaggtcaa

SEQ ID NO: 15298 - DNA, 12 bp, Artificial sequence
  Synthetic
agtttcgctttc

SEQ ID NO: 15299 - DNA, 15 bp, Artificial sequence
  Synthetic
aaatgcgtgggcgta

SEQ ID NO: 15300 - DNA, 10 bp, Artificial sequence
  Synthetic
ccccgcggcc

SEQ ID NO: 15301 - DNA, 7 bp, Artificial sequence
  Synthetic
ataaaca

SEQ ID NO: 15302 - DNA, 9 bp, Artificial sequence
  Synthetic
acccgcatc

SEQ ID NO: 15303 - DNA, 18 bp, Artificial sequence
  Synthetic
atgcccatatatggtaat

SEQ ID NO: 15304 - DNA, 10 bp, Artificial sequence
  Synthetic
catgaccacc

SEQ ID NO: 15305 - DNA, 17 bp, Artificial sequence
  Synthetic
aagttattaattaatta

SEQ ID NO: 15306 - DNA, 8 bp, Artificial sequence
  Synthetic
aggagcac

SEQ ID NO: 15307 - DNA, 8 bp, Artificial sequence
  Synthetic
atttccgg

SEQ ID NO: 15308 - DNA, 15 bp, Artificial sequence
  Synthetic
atgaatgaaattcat

SEQ ID NO: 15309 - DNA, 13 bp, Artificial sequence
  Synthetic
ggatgatgcaata

SEQ ID NO: 15310 - DNA, 24 bp, Artificial sequence
  Synthetic
attaaatgacacgtcatctttctg

SEQ ID NO: 15311 - DNA, 10 bp, Artificial sequence
  Synthetic
taggggataa

SEQ ID NO: 15312 - DNA, 18 bp, Artificial sequence
  Synthetic
aacatgttgggacatgtc

SEQ ID NO: 15313 - DNA, 8 bp, Artificial sequence
  Synthetic
aacctcgc

SEQ ID NO: 15314 - DNA, 20 bp, Artificial sequence
  Synthetic
aggtgtgaaatttcacacct

SEQ ID NO: 15315 - DNA, 10 bp, Artificial sequence
  Synthetic
gtgtgagtca

SEQ ID NO: 15316 - DNA, 23 bp, Artificial sequence
  Synthetic
tgtgacccttagcaaccgattaa

SEQ ID NO: 15317 - DNA, 15 bp, Artificial sequence
  Synthetic
aaaacccggagcgga

SEQ ID NO: 15318 - DNA, 11 bp, Artificial sequence
  Synthetic
attaataatta

SEQ ID NO: 15319 - DNA, 10 bp, Artificial sequence
  Synthetic
ggtaataaaa

SEQ ID NO: 15320 - DNA, 9 bp, Artificial sequence
  Synthetic
cactaatta

SEQ ID NO: 15321 - DNA, 16 bp, Artificial sequence
  Synthetic
aatgttaagtggctta

SEQ ID NO: 15322 - DNA, 11 bp, Artificial sequence
  Synthetic
gccccgccccc

SEQ ID NO: 15323 - DNA, 10 bp, Artificial sequence
  Synthetic
accaattaaa

SEQ ID NO: 15324 - DNA, 13 bp, Artificial sequence
  Synthetic
aatttatgtaata

SEQ ID NO: 15325 - DNA, 11 bp, Artificial sequence
  Synthetic
gaggggccggc

SEQ ID NO: 15326 - DNA, 15 bp, Artificial sequence
  Synthetic
gaaagtgaaactgaa

SEQ ID NO: 15327 - DNA, 15 bp, Artificial sequence
  Synthetic
agataagataagata

SEQ ID NO: 15328 - DNA, 15 bp, Artificial sequence
  Synthetic
aaattccaggaaatc

SEQ ID NO: 15329 - DNA, 20 bp, Artificial sequence
  Synthetic
agacatgcccgggcatgtcc

SEQ ID NO: 15330 - DNA, 20 bp, Artificial sequence
  Synthetic
ccccccccccgcccccgcac

SEQ ID NO: 15331 - DNA, 17 bp, Artificial sequence
  Synthetic
ggaaagcgaaactgaaa

SEQ ID NO: 15332 - DNA, 11 bp, Artificial sequence
  Synthetic
atgttacataa

SEQ ID NO: 15333 - DNA, 10 bp, Artificial sequence
  Synthetic
aatcgatcgc

SEQ ID NO: 15334 - DNA, 8 bp, Artificial sequence
  Synthetic
agtaacgg

SEQ ID NO: 15335 - DNA, 17 bp, Artificial sequence
  Synthetic
aactagggcaaaggtca

SEQ ID NO: 15336 - DNA, 12 bp, Artificial sequence
  Synthetic
attcacctgtac

SEQ ID NO: 15337 - DNA, 7 bp, Artificial sequence
  Synthetic
atgaacc

SEQ ID NO: 15338 - DNA, 19 bp, Artificial sequence
  Synthetic
acagggtcaaaggtcacga

SEQ ID NO: 15339 - DNA, 18 bp, Artificial sequence
  Synthetic
aaaggtcatgtgaggtca

SEQ ID NO: 15340 - DNA, 12 bp, Artificial sequence
  Synthetic
ctaagtaaacaa

SEQ ID NO: 15341 - DNA, 11 bp, Artificial sequence
  Synthetic
ctctgacgtca

SEQ ID NO: 15342 - DNA, 10 bp, Artificial sequence
  Synthetic
tggcgcaaaa

SEQ ID NO: 15343 - DNA, 12 bp, Artificial sequence
  Synthetic
caacatatgcga

SEQ ID NO: 15344 - DNA, 7 bp, Artificial sequence
  Synthetic
gtaatta

SEQ ID NO: 15345 - DNA, 8 bp, Artificial sequence
  Synthetic
attacatg

SEQ ID NO: 15346 - DNA, 23 bp, Artificial sequence
  Synthetic
aagtaggtcaccgtgacctactt

SEQ ID NO: 15347 - DNA, 9 bp, Artificial sequence
  Synthetic
aaaagtcaa

SEQ ID NO: 15348 - DNA, 9 bp, Artificial sequence
  Synthetic
ggtcattaa

SEQ ID NO: 15349 - DNA, 15 bp, Artificial sequence
  Synthetic
taaataaacatttca

SEQ ID NO: 15350 - DNA, 11 bp, Artificial sequence
  Synthetic
ggtgactcaga

SEQ ID NO: 15351 - DNA, 15 bp, Artificial sequence
  Synthetic
caaaaagagcaacca

SEQ ID NO: 15352 - DNA, 12 bp, Artificial sequence
  Synthetic
aagcacgtgatt

SEQ ID NO: 15353 - DNA, 11 bp, Artificial sequence
  Synthetic
ataaccgttaa

SEQ ID NO: 15354 - DNA, 9 bp, Artificial sequence
  Synthetic
agtccaaag

SEQ ID NO: 15355 - DNA, 7 bp, Artificial sequence
  Synthetic
gccatta

SEQ ID NO: 15356 - DNA, 11 bp, Artificial sequence
  Synthetic
caaagtaaaca

SEQ ID NO: 15357 - DNA, 12 bp, Artificial sequence
  Synthetic
tgccacgtggca

SEQ ID NO: 15358 - DNA, 10 bp, Artificial sequence
  Synthetic
gcgcatgcgc

SEQ ID NO: 15359 - DNA, 15 bp, Artificial sequence
  Synthetic
ccctaagtaaacaaa

SEQ ID NO: 15360 - DNA, 20 bp, Artificial sequence
  Synthetic
ggacatgcccgggcatgtcc

SEQ ID NO: 15361 - DNA, 15 bp, Artificial sequence
  Synthetic
cgttgtttacttaag

SEQ ID NO: 15362 - DNA, 9 bp, Artificial sequence
  Synthetic
acctgtcaa

SEQ ID NO: 15363 - DNA, 13 bp, Artificial sequence
  Synthetic
accacctgttgca

SEQ ID NO: 15364 - DNA, 7 bp, Artificial sequence
  Synthetic
cagttgg

SEQ ID NO: 15365 - DNA, 9 bp, Artificial sequence
  Synthetic
acctgtcat

SEQ ID NO: 15366 - DNA, 12 bp, Artificial sequence
  Synthetic
cagacctgcccc

SEQ ID NO: 15367 - DNA, 13 bp, Artificial sequence
  Synthetic
gaggatgagtcac

SEQ ID NO: 15368 - DNA, 14 bp, Artificial sequence
  Synthetic
taaagcataggggc

SEQ ID NO: 15369 - DNA, 15 bp, Artificial sequence
  Synthetic
attaatgcgattaat

SEQ ID NO: 15370 - DNA, 9 bp, Artificial sequence
  Synthetic
gggattact

SEQ ID NO: 15371 - DNA, 7 bp, Artificial sequence
  Synthetic
gttaatt

SEQ ID NO: 15372 - DNA, 9 bp, Artificial sequence
  Synthetic
caggaactt

SEQ ID NO: 15373 - DNA, 7 bp, Artificial sequence
  Synthetic
gttaatg

SEQ ID NO: 15374 - DNA, 18 bp, Artificial sequence
  Synthetic
gacttgaaaggactgggg

SEQ ID NO: 15375 - DNA, 7 bp, Artificial sequence
  Synthetic
gttaatc

SEQ ID NO: 15376 - DNA, 11 bp, Artificial sequence
  Synthetic
ttgatagctat

SEQ ID NO: 15377 - DNA, 16 bp, Artificial sequence
  Synthetic
gacttcattaataagg

SEQ ID NO: 15378 - DNA, 11 bp, Artificial sequence
  Synthetic
cgattaatcgg

SEQ ID NO: 15379 - DNA, 8 bp, Artificial sequence
  Synthetic
tactatgg

SEQ ID NO: 15380 - DNA, 9 bp, Artificial sequence
  Synthetic
taaactatg

SEQ ID NO: 15381 - DNA, 7 bp, Artificial sequence
  Synthetic
gggggcg

SEQ ID NO: 15382 - DNA, 12 bp, Artificial sequence
  Synthetic
tattctccttta

SEQ ID NO: 15383 - DNA, 14 bp, Artificial sequence
  Synthetic
ccaattactaattg

SEQ ID NO: 15384 - DNA, 15 bp, Artificial sequence
  Synthetic
catcccgtttccagt

SEQ ID NO: 15385 - DNA, 12 bp, Artificial sequence
  Synthetic
cccctgaaaggt

SEQ ID NO: 15386 - DNA, 18 bp, Artificial sequence
  Synthetic
gtcaggcttccagtggcg

SEQ ID NO: 15387 - DNA, 11 bp, Artificial sequence
  Synthetic
ccggggtgggt

SEQ ID NO: 15388 - DNA, 7 bp, Artificial sequence
  Synthetic
tgtttct

SEQ ID NO: 15389 - DNA, 13 bp, Artificial sequence
  Synthetic
gattagattaatt

SEQ ID NO: 15390 - DNA, 8 bp, Artificial sequence
  Synthetic
gattaggg

SEQ ID NO: 15391 - DNA, 14 bp, Artificial sequence
  Synthetic
tgattggttagtct

SEQ ID NO: 15392 - DNA, 15 bp, Artificial sequence
  Synthetic
actggggcggttgtt

SEQ ID NO: 15393 - DNA, 13 bp, Artificial sequence
  Synthetic
gtattaaatacgt

SEQ ID NO: 15394 - DNA, 15 bp, Artificial sequence
  Synthetic
tttcattatttagta

SEQ ID NO: 15395 - DNA, 9 bp, Artificial sequence
  Synthetic
gattaattg

SEQ ID NO: 15396 - DNA, 13 bp, Artificial sequence
  Synthetic
ttgtacatatttt

SEQ ID NO: 15397 - DNA, 10 bp, Artificial sequence
  Synthetic
tagtgcacta

SEQ ID NO: 15398 - DNA, 8 bp, Artificial sequence
  Synthetic
ggtggacg

SEQ ID NO: 15399 - DNA, 15 bp, Artificial sequence
  Synthetic
ggtaacaatacgttt

SEQ ID NO: 15400 - DNA, 6 bp, Artificial sequence
  Synthetic
gacagt

SEQ ID NO: 15401 - DNA, 14 bp, Artificial sequence
  Synthetic
tacttaattacgta

SEQ ID NO: 15402 - DNA, 7 bp, Artificial sequence
  Synthetic
gattaat

SEQ ID NO: 15403 - DNA, 16 bp, Artificial sequence
  Synthetic
taaaataacaagattt

SEQ ID NO: 15404 - DNA, 10 bp, Artificial sequence
  Synthetic
tagtgcactg

SEQ ID NO: 15405 - DNA, 8 bp, Artificial sequence
  Synthetic
taatcatg

SEQ ID NO: 15406 - DNA, 6 bp, Artificial sequence
  Synthetic
catagt

SEQ ID NO: 15407 - DNA, 14 bp, Artificial sequence
  Synthetic
gaagcaccccccag

SEQ ID NO: 15408 - DNA, 11 bp, Artificial sequence
  Synthetic
tttggtgtctg

SEQ ID NO: 15409 - DNA, 17 bp, Artificial sequence
  Synthetic
cttgttatggtaacaag

SEQ ID NO: 15410 - DNA, 17 bp, Artificial sequence
  Synthetic
gcttaattaatttttgg

SEQ ID NO: 15411 - DNA, 13 bp, Artificial sequence
  Synthetic
tattcatccagtt

SEQ ID NO: 15412 - DNA, 15 bp, Artificial sequence
  Synthetic
tcttggaagatcttc

SEQ ID NO: 15413 - DNA, 13 bp, Artificial sequence
  Synthetic
ttggttaattttt

SEQ ID NO: 15414 - DNA, 11 bp, Artificial sequence
  Synthetic
tgtttggtgtc

SEQ ID NO: 15415 - DNA, 16 bp, Artificial sequence
  Synthetic
ggtaacaaatgaattc

SEQ ID NO: 15416 - DNA, 13 bp, Artificial sequence
  Synthetic
tctacgttagggg

SEQ ID NO: 15417 - DNA, 9 bp, Artificial sequence
  Synthetic
ttaattaat

SEQ ID NO: 15418 - DNA, 12 bp, Artificial sequence
  Synthetic
tttctagtttcc

SEQ ID NO: 15419 - DNA, 16 bp, Artificial sequence
  Synthetic
ttcgatatttatctga

SEQ ID NO: 15420 - DNA, 8 bp, Artificial sequence
  Synthetic
ggagtcgg

SEQ ID NO: 15421 - DNA, 15 bp, Artificial sequence
  Synthetic
cggatctcgccgggg

SEQ ID NO: 15422 - DNA, 8 bp, Artificial sequence
  Synthetic
cccatagt

SEQ ID NO: 15423 - DNA, 16 bp, Artificial sequence
  Synthetic
gggtgccaatgacggc

SEQ ID NO: 15424 - DNA, 14 bp, Artificial sequence
  Synthetic
cctgatgtcgaggg

SEQ ID NO: 15425 - DNA, 9 bp, Artificial sequence
  Synthetic
ttaagttta

SEQ ID NO: 15426 - DNA, 15 bp, Artificial sequence
  Synthetic
ctcagattactgggt

SEQ ID NO: 15427 - DNA, 18 bp, Artificial sequence
  Synthetic
gttccagtgccactggac

SEQ ID NO: 15428 - DNA, 16 bp, Artificial sequence
  Synthetic
gaattaatattaattt

SEQ ID NO: 15429 - DNA, 8 bp, Artificial sequence
  Synthetic
cctaaggg

SEQ ID NO: 15430 - DNA, 12 bp, Artificial sequence
  Synthetic
tagagcaaacct

SEQ ID NO: 15431 - DNA, 11 bp, Artificial sequence
  Synthetic
gccgtggacgg

SEQ ID NO: 15432 - DNA, 9 bp, Artificial sequence
  Synthetic
tagcgcaat

SEQ ID NO: 15433 - DNA, 15 bp, Artificial sequence
  Synthetic
tactaggccctggtg

SEQ ID NO: 15434 - DNA, 11 bp, Artificial sequence
  Synthetic
caggggtccct

SEQ ID NO: 15435 - DNA, 14 bp, Artificial sequence
  Synthetic
gattataacgattt

SEQ ID NO: 15436 - DNA, 12 bp, Artificial sequence
  Synthetic
caggggtccctg

SEQ ID NO: 15437 - DNA, 16 bp, Artificial sequence
  Synthetic
cttaattaattaattt

SEQ ID NO: 15438 - DNA, 13 bp, Artificial sequence
  Synthetic
cttttcactttgg

SEQ ID NO: 15439 - DNA, 12 bp, Artificial sequence
  Synthetic
gggttaatcctt

SEQ ID NO: 15440 - DNA, 15 bp, Artificial sequence
  Synthetic
tcagtgaaggacgat

SEQ ID NO: 15441 - DNA, 9 bp, Artificial sequence
  Synthetic
ttgtcgact

SEQ ID NO: 15442 - DNA, 11 bp, Artificial sequence
  Synthetic
ggtgaaggccg

SEQ ID NO: 15443 - DNA, 14 bp, Artificial sequence
  Synthetic
ttacgcacccgcat

SEQ ID NO: 15444 - DNA, 10 bp, Artificial sequence
  Synthetic
tggtacctgt

SEQ ID NO: 15445 - DNA, 10 bp, Artificial sequence
  Synthetic
cggttaattg

SEQ ID NO: 15446 - DNA, 14 bp, Artificial sequence
  Synthetic
tttttctccttcat

SEQ ID NO: 15447 - DNA, 9 bp, Artificial sequence
  Synthetic
ccactggat

SEQ ID NO: 15448 - DNA, 8 bp, Artificial sequence
  Synthetic
acagtatt

SEQ ID NO: 15449 - DNA, 8 bp, Artificial sequence
  Synthetic
tttccccg

SEQ ID NO: 15450 - DNA, 13 bp, Artificial sequence
  Synthetic
tttccgcgctttt

SEQ ID NO: 15451 - DNA, 8 bp, Artificial sequence
  Synthetic
ccattcat

SEQ ID NO: 15452 - DNA, 8 bp, Artificial sequence
  Synthetic
cgtggacg

SEQ ID NO: 15453 - DNA, 16 bp, Artificial sequence
  Synthetic
cgcgatcgcctgcaat

SEQ ID NO: 15454 - DNA, 16 bp, Artificial sequence
  Synthetic
ttaactcacccgcatc

SEQ ID NO: 15455 - DNA, 18 bp, Artificial sequence
  Synthetic
ttaagtattaatatgtgt

SEQ ID NO: 15456 - DNA, 14 bp, Artificial sequence
  Synthetic
attgaaggagaatt

SEQ ID NO: 15457 - DNA, 10 bp, Artificial sequence
  Synthetic
caattaatct

SEQ ID NO: 15458 - DNA, 14 bp, Artificial sequence
  Synthetic
ttatgggcgtacac

SEQ ID NO: 15459 - DNA, 12 bp, Artificial sequence
  Synthetic
atcccgacgttt

SEQ ID NO: 15460 - DNA, 17 bp, Artificial sequence
  Synthetic
gtttaggtctgtagtct

SEQ ID NO: 15461 - DNA, 17 bp, Artificial sequence
  Synthetic
tttttctccttcacttt

SEQ ID NO: 15462 - DNA, 17 bp, Artificial sequence
  Synthetic
ctgctattactccaacg

SEQ ID NO: 15463 - DNA, 15 bp, Artificial sequence
  Synthetic
ttggcgaaggcccag

SEQ ID NO: 15464 - DNA, 13 bp, Artificial sequence
  Synthetic
cccccggaacttt

SEQ ID NO: 15465 - DNA, 10 bp, Artificial sequence
  Synthetic
tggtataccg

SEQ ID NO: 15466 - DNA, 9 bp, Artificial sequence
  Synthetic
ccattaatt

SEQ ID NO: 15467 - DNA, 12 bp, Artificial sequence
  Synthetic
ttggtgcacgag

SEQ ID NO: 15468 - DNA, 16 bp, Artificial sequence
  Synthetic
taaacgtattgtttcc

SEQ ID NO: 15469 - DNA, 18 bp, Artificial sequence
  Synthetic
gggttgccgccaaccccc

SEQ ID NO: 15470 - DNA, 16 bp, Artificial sequence
  Synthetic
tgcaaaatgctgaaat

SEQ ID NO: 15471 - DNA, 10 bp, Artificial sequence
  Synthetic
ttaatttcgt

SEQ ID NO: 15472 - DNA, 8 bp, Artificial sequence
  Synthetic
caattaat

SEQ ID NO: 15473 - DNA, 10 bp, Artificial sequence
  Synthetic
tggtatacca

SEQ ID NO: 15474 - DNA, 18 bp, Artificial sequence
  Synthetic
gtacgggtttattccgtt

SEQ ID NO: 15475 - DNA, 16 bp, Artificial sequence
  Synthetic
tggccaaatttggcca

SEQ ID NO: 15476 - DNA, 17 bp, Artificial sequence
  Synthetic
ttatatgtacattttgt

SEQ ID NO: 15477 - DNA, 15 bp, Artificial sequence
  Synthetic
ttcagacaccaatcg

SEQ ID NO: 15478 - DNA, 14 bp, Artificial sequence
  Synthetic
gctactgcagtagt

SEQ ID NO: 15479 - DNA, 12 bp, Artificial sequence
  Synthetic
ttaaacaaatgt

SEQ ID NO: 15480 - DNA, 11 bp, Artificial sequence
  Synthetic
tactcagtggg

SEQ ID NO: 15481 - DNA, 9 bp, Artificial sequence
  Synthetic
ttatttgag

SEQ ID NO: 15482 - DNA, 10 bp, Artificial sequence
  Synthetic
gtcggttagt

SEQ ID NO: 15483 - DNA, 14 bp, Artificial sequence
  Synthetic
tccttccctttcct

SEQ ID NO: 15484 - DNA, 14 bp, Artificial sequence
  Synthetic
gggggcgggggcgg

SEQ ID NO: 15485 - DNA, 15 bp, Artificial sequence
  Synthetic
tacggtttttatctt

SEQ ID NO: 15486 - DNA, 16 bp, Artificial sequence
  Synthetic
tatttagtgtcgtgag

SEQ ID NO: 15487 - DNA, 24 bp, Artificial sequence
  Synthetic
tgttttatttagtgtcgtatacgg

SEQ ID NO: 15488 - DNA, 10 bp, Artificial sequence
  Synthetic
ccactcagtg

SEQ ID NO: 15489 - DNA, 20 bp, Artificial sequence
  Synthetic
tctgtacgggtctgtacggg

SEQ ID NO: 15490 - DNA, 11 bp, Artificial sequence
  Synthetic
tttagtgacgt

SEQ ID NO: 15491 - DNA, 8 bp, Artificial sequence
  Synthetic
gactgggg

SEQ ID NO: 15492 - DNA, 13 bp, Artificial sequence
  Synthetic
ggtgaaggccaag

SEQ ID NO: 15493 - DNA, 14 bp, Artificial sequence
  Synthetic
tactagcttagttt

SEQ ID NO: 15494 - DNA, 11 bp, Artificial sequence
  Synthetic
ggaggccgggc

SEQ ID NO: 15495 - DNA, 10 bp, Artificial sequence
  Synthetic
gtttataaac

SEQ ID NO: 15496 - DNA, 17 bp, Artificial sequence
  Synthetic
tttagataacaagtgat

SEQ ID NO: 15497 - DNA, 15 bp, Artificial sequence
  Synthetic
gcgggggaccaccgg

SEQ ID NO: 15498 - DNA, 11 bp, Artificial sequence
  Synthetic
gaagtgtggat

SEQ ID NO: 15499 - DNA, 11 bp, Artificial sequence
  Synthetic
ttcatcacggg

SEQ ID NO: 15500 - DNA, 10 bp, Artificial sequence
  Synthetic
ggcgggggcg

SEQ ID NO: 15501 - DNA, 11 bp, Artificial sequence
  Synthetic
tctggggggtg

SEQ ID NO: 15502 - DNA, 21 bp, Artificial sequence
  Synthetic
ccgcgagaggcaccacgactt

SEQ ID NO: 15503 - DNA, 11 bp, Artificial sequence
  Synthetic
tatatattatt

SEQ ID NO: 15504 - DNA, 17 bp, Artificial sequence
  Synthetic
tattcttgtttcctgat

SEQ ID NO: 15505 - DNA, 19 bp, Artificial sequence
  Synthetic
tttacgactgagtcgtgtt

SEQ ID NO: 15506 - DNA, 12 bp, Artificial sequence
  Synthetic
ttacggtctggg

SEQ ID NO: 15507 - DNA, 22 bp, Artificial sequence
  Synthetic
tggggtttggtggggggggggg

SEQ ID NO: 15508 - DNA, 11 bp, Artificial sequence
  Synthetic
cttattaatgg

SEQ ID NO: 15509 - DNA, 13 bp, Artificial sequence
  Synthetic
ggtggacaacgtg

SEQ ID NO: 15510 - DNA, 10 bp, Artificial sequence
  Synthetic
cgggtatttt

SEQ ID NO: 15511 - DNA, 16 bp, Artificial sequence
  Synthetic
ttgttataagtaacaa

SEQ ID NO: 15512 - DNA, 11 bp, Artificial sequence
  Synthetic
atttatccagt

SEQ ID NO: 15513 - DNA, 15 bp, Artificial sequence
  Synthetic
aacgactgagtcgtt

SEQ ID NO: 15514 - DNA, 20 bp, Artificial sequence
  Synthetic
cccccagtgggtctccagtg

SEQ ID NO: 15515 - DNA, 9 bp, Artificial sequence
  Synthetic
tgggcctag

SEQ ID NO: 15516 - DNA, 10 bp, Artificial sequence
  Synthetic
ggcgcggcgg

SEQ ID NO: 15517 - DNA, 27 bp, Artificial sequence
  Synthetic
caacgcccatgtctcacaagatccctt

SEQ ID NO: 15518 - DNA, 8 bp, Artificial sequence
  Synthetic
tccacgcc

SEQ ID NO: 15519 - DNA, 10 bp, Artificial sequence
  Synthetic
ggaatagacg

SEQ ID NO: 15520 - DNA, 10 bp, Artificial sequence
  Synthetic
gactggactt

SEQ ID NO: 15521 - DNA, 17 bp, Artificial sequence
  Synthetic
ttagcaattagggaaat

SEQ ID NO: 15522 - DNA, 10 bp, Artificial sequence
  Synthetic
cgcgcgcgcg

SEQ ID NO: 15523 - DNA, 7 bp, Artificial sequence
  Synthetic
gtgaatt

SEQ ID NO: 15524 - DNA, 16 bp, Artificial sequence
  Synthetic
actggaaatttccagt

SEQ ID NO: 15525 - DNA, 14 bp, Artificial sequence
  Synthetic
gtacatttattacg

SEQ ID NO: 15526 - DNA, 12 bp, Artificial sequence
  Synthetic
attcatttgttt

SEQ ID NO: 15527 - DNA, 17 bp, Artificial sequence
  Synthetic
ttttatgtacattatga

SEQ ID NO: 15528 - DNA, 9 bp, Artificial sequence
  Synthetic
tggttaatc

SEQ ID NO: 15529 - DNA, 15 bp, Artificial sequence
  Synthetic
ttgttacgttaacaa

SEQ ID NO: 15530 - DNA, 8 bp, Artificial sequence
  Synthetic
tggacagt

SEQ ID NO: 15531 - DNA, 12 bp, Artificial sequence
  Synthetic
aaaccgcggttt

SEQ ID NO: 15532 - DNA, 8 bp, Artificial sequence
  Synthetic
ggtggacc

SEQ ID NO: 15533 - DNA, 10 bp, Artificial sequence
  Synthetic
tagtggggtg

SEQ ID NO: 15534 - DNA, 14 bp, Artificial sequence
  Synthetic
ttcagttattcagt

SEQ ID NO: 15535 - DNA, 8 bp, Artificial sequence
  Synthetic
taaatacc

SEQ ID NO: 15536 - DNA, 9 bp, Artificial sequence
  Synthetic
gattaattt

SEQ ID NO: 15537 - DNA, 15 bp, Artificial sequence
  Synthetic
ttctccttcactttg

SEQ ID NO: 15538 - DNA, 16 bp, Artificial sequence
  Synthetic
ttgatcgacagttatg

SEQ ID NO: 15539 - DNA, 10 bp, Artificial sequence
  Synthetic
tagtggggta

SEQ ID NO: 15540 - DNA, 11 bp, Artificial sequence
  Synthetic
tataattaatt

SEQ ID NO: 15541 - DNA, 10 bp, Artificial sequence
  Synthetic
gtgcgtgcgt

SEQ ID NO: 15542 - DNA, 9 bp, Artificial sequence
  Synthetic
gattaattc

SEQ ID NO: 15543 - DNA, 8 bp, Artificial sequence
  Synthetic
ttaatgtt

SEQ ID NO: 15544 - DNA, 8 bp, Artificial sequence
  Synthetic
gttaattc

SEQ ID NO: 15545 - DNA, 11 bp, Artificial sequence
  Synthetic
tctcgtgcacc

SEQ ID NO: 15546 - DNA, 8 bp, Artificial sequence
  Synthetic
gttaattt

SEQ ID NO: 15547 - DNA, 13 bp, Artificial sequence
  Synthetic
caccctaatcact

SEQ ID NO: 15548 - DNA, 10 bp, Artificial sequence
  Synthetic
cgattagggg

SEQ ID NO: 15549 - DNA, 24 bp, Artificial sequence
  Synthetic
ccggaaaacaacagttagttttgt

SEQ ID NO: 15550 - DNA, 9 bp, Artificial sequence
  Synthetic
tgtccttca

SEQ ID NO: 15551 - DNA, 9 bp, Artificial sequence
  Synthetic
gacaacggt

SEQ ID NO: 15552 - DNA, 10 bp, Artificial sequence
  Synthetic
tcattaatcg

SEQ ID NO: 15553 - DNA, 20 bp, Artificial sequence
  Synthetic
agtagaaacaaatgaaaatt

SEQ ID NO: 15554 - DNA, 12 bp, Artificial sequence
  Synthetic
gagcgtccttct

SEQ ID NO: 15555 - DNA, 20 bp, Artificial sequence
  Synthetic
aaagtgtggatccacacttt

SEQ ID NO: 15556 - DNA, 12 bp, Artificial sequence
  Synthetic
gccgtctaccgg

SEQ ID NO: 15557 - DNA, 8 bp, Artificial sequence
  Synthetic
tggcgaag

SEQ ID NO: 15558 - DNA, 11 bp, Artificial sequence
  Synthetic
gacgtcgacag

SEQ ID NO: 15559 - DNA, 13 bp, Artificial sequence
  Synthetic
tatagttccagta

SEQ ID NO: 15560 - DNA, 15 bp, Artificial sequence
  Synthetic
cggtcgtcgaccgcg

SEQ ID NO: 15561 - DNA, 16 bp, Artificial sequence
  Synthetic
cgagtaatgcttactg

SEQ ID NO: 15562 - DNA, 13 bp, Artificial sequence
  Synthetic
tacttgaaactgg

SEQ ID NO: 15563 - DNA, 8 bp, Artificial sequence
  Synthetic
tgaaagtg

SEQ ID NO: 15564 - DNA, 17 bp, Artificial sequence
  Synthetic
tcgcggtggatcaccat

SEQ ID NO: 15565 - DNA, 14 bp, Artificial sequence
  Synthetic
tgggtgttgtgtat

SEQ ID NO: 15566 - DNA, 11 bp, Artificial sequence
  Synthetic
gtactgagtag

SEQ ID NO: 15567 - DNA, 15 bp, Artificial sequence
  Synthetic
cccccgtttccagtg

SEQ ID NO: 15568 - DNA, 14 bp, Artificial sequence
  Synthetic
cgcatgcacgccgt

SEQ ID NO: 15569 - DNA, 23 bp, Artificial sequence
  Synthetic
gggcctcccgaaggacctcctcc

SEQ ID NO: 15570 - DNA, 14 bp, Artificial sequence
  Synthetic
ttgagtacgcactt

SEQ ID NO: 15571 - DNA, 17 bp, Artificial sequence
  Synthetic
tttttcatttgtttggg

SEQ ID NO: 15572 - DNA, 10 bp, Artificial sequence
  Synthetic
tactgcagtg

SEQ ID NO: 15573 - DNA, 12 bp, Artificial sequence
  Synthetic
ggcgtgcatgcg

SEQ ID NO: 15574 - DNA, 21 bp, Artificial sequence
  Synthetic
atcacgggggatcaccggttt

SEQ ID NO: 15575 - DNA, 14 bp, Artificial sequence
  Synthetic
cgcgactgcattgg

SEQ ID NO: 15576 - DNA, 22 bp, Artificial sequence
  Synthetic
tgacaatgatttttatctttga

SEQ ID NO: 15577 - DNA, 17 bp, Artificial sequence
  Synthetic
tttgttacgttaacaaa

SEQ ID NO: 15578 - DNA, 10 bp, Artificial sequence
  Synthetic
tgaaccgtgg

SEQ ID NO: 15579 - DNA, 10 bp, Artificial sequence
  Synthetic
tactgcagta

SEQ ID NO: 15580 - DNA, 11 bp, Artificial sequence
  Synthetic
tcatggcaata

SEQ ID NO: 15581 - DNA, 13 bp, Artificial sequence
  Synthetic
tagggggggtggc

SEQ ID NO: 15582 - DNA, 9 bp, Artificial sequence
  Synthetic
tttggcgtt

SEQ ID NO: 15583 - DNA, 15 bp, Artificial sequence
  Synthetic
attactactagtgat

SEQ ID NO: 15584 - DNA, 12 bp, Artificial sequence
  Synthetic
gaggggacggcg

SEQ ID NO: 15585 - DNA, 14 bp, Artificial sequence
  Synthetic
actactgcagtagt

SEQ ID NO: 15586 - DNA, 13 bp, Artificial sequence
  Synthetic
gtcgaggggtccc

SEQ ID NO: 15587 - DNA, 12 bp, Artificial sequence
  Synthetic
cgaaaagggtgt

SEQ ID NO: 15588 - DNA, 11 bp, Artificial sequence
  Synthetic
gaggagcgggg

SEQ ID NO: 15589 - DNA, 13 bp, Artificial sequence
  Synthetic
ctttgtgtcatcg

SEQ ID NO: 15590 - DNA, 10 bp, Artificial sequence
  Synthetic
ttacctttta

SEQ ID NO: 15591 - DNA, 17 bp, Artificial sequence
  Synthetic
ttatcccatagttataa

SEQ ID NO: 15592 - DNA, 17 bp, Artificial sequence
  Synthetic
gtaaattcatgaatcat

SEQ ID NO: 15593 - DNA, 10 bp, Artificial sequence
  Synthetic
ttgtcgacaa

SEQ ID NO: 15594 - DNA, 9 bp, Artificial sequence
  Synthetic
tttgtttaa

SEQ ID NO: 15595 - DNA, 15 bp, Artificial sequence
  Synthetic
gtaaagggcctttgg

SEQ ID NO: 15596 - DNA, 16 bp, Artificial sequence
  Synthetic
ttcttgtaggacaagg

SEQ ID NO: 15597 - DNA, 18 bp, Artificial sequence
  Synthetic
tttttaccgcggttttac

SEQ ID NO: 15598 - DNA, 14 bp, Artificial sequence
  Synthetic
tttagtgcactata

SEQ ID NO: 15599 - DNA, 17 bp, Artificial sequence
  Synthetic
taacaattagggagatt

SEQ ID NO: 15600 - DNA, 10 bp, Artificial sequence
  Synthetic
cggtgcgggt

SEQ ID NO: 15601 - DNA, 9 bp, Artificial sequence
  Synthetic
gcgacaatt

SEQ ID NO: 15602 - DNA, 7 bp, Artificial sequence
  Synthetic
gttattt

SEQ ID NO: 15603 - DNA, 21 bp, Artificial sequence
  Synthetic
gtcctttgacttgtcgacagg

SEQ ID NO: 15604 - DNA, 14 bp, Artificial sequence
  Synthetic
ttatatttgtatgt

SEQ ID NO: 15605 - DNA, 12 bp, Artificial sequence
  Synthetic
cctttacccggg

SEQ ID NO: 15606 - DNA, 17 bp, Artificial sequence
  Synthetic
tttgttaacgtcacaaa

SEQ ID NO: 15607 - DNA, 17 bp, Artificial sequence
  Synthetic
tggccaactagtggact

SEQ ID NO: 15608 - DNA, 9 bp, Artificial sequence
  Synthetic
gttctaccg

SEQ ID NO: 15609 - DNA, 10 bp, Artificial sequence
  Synthetic
atactgcatt

SEQ ID NO: 15610 - DNA, 14 bp, Artificial sequence
  Synthetic
ggtcaagtttggtc

SEQ ID NO: 15611 - DNA, 12 bp, Artificial sequence
  Synthetic
ccgataaaaatt

SEQ ID NO: 15612 - DNA, 12 bp, Artificial sequence
  Synthetic
cataagggtttg

SEQ ID NO: 15613 - DNA, 15 bp, Artificial sequence
  Synthetic
cggaaacaaaacgtt

SEQ ID NO: 15614 - DNA, 15 bp, Artificial sequence
  Synthetic
tgctactcagtacga

SEQ ID NO: 15615 - DNA, 10 bp, Artificial sequence
  Synthetic
gcgataggcg

SEQ ID NO: 15616 - DNA, 13 bp, Artificial sequence
  Synthetic
cccactccccctt

SEQ ID NO: 15617 - DNA, 9 bp, Artificial sequence
  Synthetic
tgccatcgt

SEQ ID NO: 15618 - DNA, 9 bp, Artificial sequence
  Synthetic
gtatcgttg

SEQ ID NO: 15619 - DNA, 14 bp, Artificial sequence
  Synthetic
ttggtgtttggggt

SEQ ID NO: 15620 - DNA, 8 bp, Artificial sequence
  Synthetic
gatccagt

SEQ ID NO: 15621 - DNA, 23 bp, Artificial sequence
  Synthetic
tatattaatacgtttaattttct

SEQ ID NO: 15622 - DNA, 12 bp, Artificial sequence
  Synthetic
ggaagaaggaat

SEQ ID NO: 15623 - DNA, 12 bp, Artificial sequence
  Synthetic
gggtccttcacg

SEQ ID NO: 15624 - DNA, 10 bp, Artificial sequence
  Synthetic
gcgtgcaccg

SEQ ID NO: 15625 - DNA, 15 bp, Artificial sequence
  Synthetic
ctggggggcgacacg

SEQ ID NO: 15626 - DNA, 20 bp, Artificial sequence
  Synthetic
tatcgcgggggaccaccggt

SEQ ID NO: 15627 - DNA, 14 bp, Artificial sequence
  Synthetic
gccggtgcactggg

SEQ ID NO: 15628 - DNA, 16 bp, Artificial sequence
  Synthetic
tccccctaatcgacgg

SEQ ID NO: 15629 - DNA, 8 bp, Artificial sequence
  Synthetic
gattaatt

SEQ ID NO: 15630 - DNA, 8 bp, Artificial sequence
  Synthetic
gattaatg

SEQ ID NO: 15631 - DNA, 8 bp, Artificial sequence
  Synthetic
gattaatc

SEQ ID NO: 15632 - DNA, 17 bp, Artificial sequence
  Synthetic
ctcgtaattaattccgt

SEQ ID NO: 15633 - DNA, 12 bp, Artificial sequence
  Synthetic
ctggtgcactgt

SEQ ID NO: 15634 - DNA, 10 bp, Artificial sequence
  Synthetic
gtgtcgcccc

SEQ ID NO: 15635 - DNA, 21 bp, Artificial sequence
  Synthetic
ggacgaccctcaacatcaggg

SEQ ID NO: 15636 - DNA, 11 bp, Artificial sequence
  Synthetic
gcctgtgttag

SEQ ID NO: 15637 - DNA, 8 bp, Artificial sequence
  Synthetic
tatagttt

SEQ ID NO: 15638 - DNA, 9 bp, Artificial sequence
  Synthetic
tgtgcaccg

SEQ ID NO: 15639 - DNA, 18 bp, Artificial sequence
  Synthetic
tgggggaatagtctgata

SEQ ID NO: 15640 - DNA, 11 bp, Artificial sequence
  Synthetic
caatacattgt

SEQ ID NO: 15641 - DNA, 10 bp, Artificial sequence
  Synthetic
tggacagtta

SEQ ID NO: 15642 - DNA, 10 bp, Artificial sequence
  Synthetic
tagatcttgt

SEQ ID NO: 15643 - DNA, 16 bp, Artificial sequence
  Synthetic
cttataatattaatat

SEQ ID NO: 15644 - DNA, 10 bp, Artificial sequence
  Synthetic
agattaattt

SEQ ID NO: 15645 - DNA, 8 bp, Artificial sequence
  Synthetic
cgttaatt

SEQ ID NO: 15646 - DNA, 12 bp, Artificial sequence
  Synthetic
gttttaccgccg

SEQ ID NO: 15647 - DNA, 10 bp, Artificial sequence
  Synthetic
gggactccgt

SEQ ID NO: 15648 - DNA, 10 bp, Artificial sequence
  Synthetic
actccagtgt

SEQ ID NO: 15649 - DNA, 16 bp, Artificial sequence
  Synthetic
tagagcaaagggtgtc

SEQ ID NO: 15650 - DNA, 15 bp, Artificial sequence
  Synthetic
ggtgaaggccaaggc

SEQ ID NO: 15651 - DNA, 10 bp, Artificial sequence
  Synthetic
ggtgaattct

SEQ ID NO: 15652 - DNA, 17 bp, Artificial sequence
  Synthetic
tagctattgactagcta

SEQ ID NO: 15653 - DNA, 13 bp, Artificial sequence
  Synthetic
gattaatttaatt

SEQ ID NO: 15654 - DNA, 15 bp, Artificial sequence
  Synthetic
tcccctaaaggttcc

SEQ ID NO: 15655 - DNA, 19 bp, Artificial sequence
  Synthetic
tgtcccagtttccagttct

SEQ ID NO: 15656 - DNA, 13 bp, Artificial sequence
  Synthetic
gattaatttaatc

SEQ ID NO: 15657 - DNA, 8 bp, Artificial sequence
  Synthetic
gtgaattc

SEQ ID NO: 15658 - DNA, 9 bp, Artificial sequence
  Synthetic
tagtatttt

SEQ ID NO: 15659 - DNA, 10 bp, Artificial sequence
  Synthetic
ggaggcggcg

SEQ ID NO: 15660 - DNA, 17 bp, Artificial sequence
  Synthetic
ttatcccatagtatata

SEQ ID NO: 15661 - DNA, 17 bp, Artificial sequence
  Synthetic
tcattaattaattaagc

SEQ ID NO: 15662 - DNA, 15 bp, Artificial sequence
  Synthetic
cgtgggaacccacgg

SEQ ID NO: 15663 - DNA, 10 bp, Artificial sequence
  Synthetic
cctgtcgcgg

SEQ ID NO: 15664 - DNA, 17 bp, Artificial sequence
  Synthetic
ttttgcttttagctaaa

SEQ ID NO: 15665 - DNA, 16 bp, Artificial sequence
  Synthetic
ctaactccagtgcggt

SEQ ID NO: 15666 - DNA, 9 bp, Artificial sequence
  Synthetic
gattaatag

SEQ ID NO: 15667 - DNA, 11 bp, Artificial sequence
  Synthetic
ctagtggggtg

SEQ ID NO: 15668 - DNA, 9 bp, Artificial sequence
  Synthetic
gtgcactag

SEQ ID NO: 15669 - DNA, 9 bp, Artificial sequence
  Synthetic
tatatatat

SEQ ID NO: 15670 - DNA, 15 bp, Artificial sequence
  Synthetic
taaccacgcactgcc

SEQ ID NO: 15671 - DNA, 10 bp, Artificial sequence
  Synthetic
cctttagggg

SEQ ID NO: 15672 - DNA, 21 bp, Artificial sequence
  Synthetic
tgtcgcgggggaccaccggtg

SEQ ID NO: 15673 - DNA, 11 bp, Artificial sequence
  Synthetic
gtttccagtct

SEQ ID NO: 15674 - DNA, 25 bp, Artificial sequence
  Synthetic
ggcggtagaaccaattcccgtctcc

SEQ ID NO: 15675 - DNA, 14 bp, Artificial sequence
  Synthetic
tgctttcgctttca

SEQ ID NO: 15676 - DNA, 10 bp, Artificial sequence
  Synthetic
tcccccgccc

SEQ ID NO: 15677 - DNA, 17 bp, Artificial sequence
  Synthetic
taaacgtattgtttcct

SEQ ID NO: 15678 - DNA, 10 bp, Artificial sequence
  Synthetic
gggtattttt

SEQ ID NO: 15679 - DNA, 8 bp, Artificial sequence
  Synthetic
cacttact

SEQ ID NO: 15680 - DNA, 8 bp, Artificial sequence
  Synthetic
tactgcat

SEQ ID NO: 15681 - DNA, 10 bp, Artificial sequence
  Synthetic
gtatcgttgg

SEQ ID NO: 15682 - DNA, 30 bp, Artificial sequence
  Synthetic
tttttaattgggttttaggttggagtgggg

SEQ ID NO: 15683 - DNA, 10 bp, Artificial sequence
  Synthetic
gtatcgttgc

SEQ ID NO: 15684 - DNA, 10 bp, Artificial sequence
  Synthetic
caccccccat

SEQ ID NO: 15685 - DNA, 10 bp, Artificial sequence
  Synthetic
tctccttcac

SEQ ID NO: 15686 - DNA, 17 bp, Artificial sequence
  Synthetic
tgtaaggactgtaaggt

SEQ ID NO: 15687 - DNA, 11 bp, Artificial sequence
  Synthetic
caaaccgcgct

SEQ ID NO: 15688 - DNA, 15 bp, Artificial sequence
  Synthetic
agtatgacctctctt

SEQ ID NO: 15689 - DNA, 11 bp, Artificial sequence
  Synthetic
gcggagtccgt

SEQ ID NO: 15690 - DNA, 9 bp, Artificial sequence
  Synthetic
tgtcaatgt

SEQ ID NO: 15691 - DNA, 9 bp, Artificial sequence
  Synthetic
tactggaac

SEQ ID NO: 15692 - DNA, 12 bp, Artificial sequence
  Synthetic
ttaggggtgggg

SEQ ID NO: 15693 - DNA, 12 bp, Artificial sequence
  Synthetic
tgaaagtgaaag

SEQ ID NO: 15694 - DNA, 19 bp, Artificial sequence
  Synthetic
tagttatacgtttaaagcc

SEQ ID NO: 15695 - DNA, 12 bp, Artificial sequence
  Synthetic
ttaggggtgggc

SEQ ID NO: 15696 - DNA, 15 bp, Artificial sequence
  Synthetic
tacttatacgtatat

SEQ ID NO: 15697 - DNA, 16 bp, Artificial sequence
  Synthetic
taaatgctgtttatcg

SEQ ID NO: 15698 - DNA, 19 bp, Artificial sequence
  Synthetic
agtgtggaatttccacact

SEQ ID NO: 15699 - DNA, 17 bp, Artificial sequence
  Synthetic
gtgcacgattggtgcac

SEQ ID NO: 15700 - DNA, 15 bp, Artificial sequence
  Synthetic
aagcttggcaagctt

SEQ ID NO: 15701 - DNA, 14 bp, Artificial sequence
  Synthetic
tcctaacacgttat

SEQ ID NO: 15702 - DNA, 8 bp, Artificial sequence
  Synthetic
tatcgttg

SEQ ID NO: 15703 - DNA, 10 bp, Artificial sequence
  Synthetic
taatgcgtta

SEQ ID NO: 15704 - DNA, 8 bp, Artificial sequence
  Synthetic
tttttgtt

SEQ ID NO: 15705 - DNA, 12 bp, Artificial sequence
  Synthetic
cttaattactgg

SEQ ID NO: 15706 - DNA, 11 bp, Artificial sequence
  Synthetic
ggagggcgggc

SEQ ID NO: 15707 - DNA, 13 bp, Artificial sequence
  Synthetic
aattagattaatt

SEQ ID NO: 15708 - DNA, 10 bp, Artificial sequence
  Synthetic
ttgtatacca

SEQ ID NO: 15709 - DNA, 15 bp, Artificial sequence
  Synthetic
tttatttagtgtcgt

SEQ ID NO: 15710 - DNA, 11 bp, Artificial sequence
  Synthetic
tttcgcagcaa

SEQ ID NO: 15711 - DNA, 11 bp, Artificial sequence
  Synthetic
attaatttaat

SEQ ID NO: 15712 - DNA, 11 bp, Artificial sequence
  Synthetic
atacgtttagt

SEQ ID NO: 15713 - DNA, 10 bp, Artificial sequence
  Synthetic
ttgtataccg

SEQ ID NO: 15714 - DNA, 10 bp, Artificial sequence
  Synthetic
tttcatttgt

SEQ ID NO: 15715 - DNA, 10 bp, Artificial sequence
  Synthetic
tctccagtta

SEQ ID NO: 15716 - DNA, 9 bp, Artificial sequence
  Synthetic
cgtgcgttg

SEQ ID NO: 15717 - DNA, 14 bp, Artificial sequence
  Synthetic
catttctatcccct

SEQ ID NO: 15718 - DNA, 11 bp, Artificial sequence
  Synthetic
tgactcagtag

SEQ ID NO: 15719 - DNA, 8 bp, Artificial sequence
  Synthetic
gcctttag

SEQ ID NO: 15720 - DNA, 15 bp, Artificial sequence
  Synthetic
ttcttttcttttttt

SEQ ID NO: 15721 - DNA, 14 bp, Artificial sequence
  Synthetic
ggggcctgtcgcgg

SEQ ID NO: 15722 - DNA, 10 bp, Artificial sequence
  Synthetic
taatgcattg

SEQ ID NO: 15723 - DNA, 8 bp, Artificial sequence
  Synthetic
gtccactc

SEQ ID NO: 15724 - DNA, 15 bp, Artificial sequence
  Synthetic
tcggtgtgggtccgt

SEQ ID NO: 15725 - DNA, 10 bp, Artificial sequence
  Synthetic
ttactcagta

SEQ ID NO: 15726 - DNA, 13 bp, Artificial sequence
  Synthetic
caattagtaattg

SEQ ID NO: 15727 - DNA, 9 bp, Artificial sequence
  Synthetic
taattaatc

SEQ ID NO: 15728 - DNA, 8 bp, Artificial sequence
  Synthetic
gcaccctt

SEQ ID NO: 15729 - DNA, 9 bp, Artificial sequence
  Synthetic
taattaatg

SEQ ID NO: 15730 - DNA, 14 bp, Artificial sequence
  Synthetic
tttttgtcatcggc

SEQ ID NO: 15731 - DNA, 15 bp, Artificial sequence
  Synthetic
tttttttttttttgg

SEQ ID NO: 15732 - DNA, 11 bp, Artificial sequence
  Synthetic
ggtcgacgggg

SEQ ID NO: 15733 - DNA, 8 bp, Artificial sequence
  Synthetic
ggtgcacg

SEQ ID NO: 15734 - DNA, 14 bp, Artificial sequence
  Synthetic
gggtgtcggagcag

SEQ ID NO: 15735 - DNA, 17 bp, Artificial sequence
  Synthetic
gactggacttcactggg

SEQ ID NO: 15736 - DNA, 19 bp, Artificial sequence
  Synthetic
gatcttgtgtcacatgggt

SEQ ID NO: 15737 - DNA, 8 bp, Artificial sequence
  Synthetic
tgtaaggt

SEQ ID NO: 15738 - DNA, 8 bp, Artificial sequence
  Synthetic
agtgcgct

SEQ ID NO: 15739 - DNA, 15 bp, Artificial sequence
  Synthetic
tacgactcagtcgct

SEQ ID NO: 15740 - DNA, 11 bp, Artificial sequence
  Synthetic
ccagtgcactg

SEQ ID NO: 15741 - DNA, 11 bp, Artificial sequence
  Synthetic
ctcgtgcaccg

SEQ ID NO: 15742 - DNA, 10 bp, Artificial sequence
  Synthetic
tgcctaatcg

SEQ ID NO: 15743 - DNA, 16 bp, Artificial sequence
  Synthetic
gcggtgattaatcatg

SEQ ID NO: 15744 - DNA, 10 bp, Artificial sequence
  Synthetic
ggcgttattt

SEQ ID NO: 15745 - DNA, 15 bp, Artificial sequence
  Synthetic
gtgacgcgtacgcgt

SEQ ID NO: 15746 - DNA, 10 bp, Artificial sequence
  Synthetic
tcggttactc

SEQ ID NO: 15747 - DNA, 12 bp, Artificial sequence
  Synthetic
ataatgtattgt

SEQ ID NO: 15748 - DNA, 13 bp, Artificial sequence
  Synthetic
tcccccgccccgg

SEQ ID NO: 15749 - DNA, 16 bp, Artificial sequence
  Synthetic
tcattaattaatgaag

SEQ ID NO: 15750 - DNA, 10 bp, Artificial sequence
  Synthetic
cggggcgggg

SEQ ID NO: 15751 - DNA, 16 bp, Artificial sequence
  Synthetic
tttaagttcaccgaat

SEQ ID NO: 15752 - DNA, 14 bp, Artificial sequence
  Synthetic
tttacccgcaccgg

SEQ ID NO: 15753 - DNA, 18 bp, Artificial sequence
  Synthetic
gcagtgcgtactcacgag

SEQ ID NO: 15754 - DNA, 9 bp, Artificial sequence
  Synthetic
tattaacgg

SEQ ID NO: 15755 - DNA, 9 bp, Artificial sequence
  Synthetic
gaatgcgtt

SEQ ID NO: 15756 - DNA, 27 bp, Artificial sequence
  Synthetic
tcccctccatgtgccacaagaaaaccc

SEQ ID NO: 15757 - DNA, 17 bp, Artificial sequence
  Synthetic
atttatctatggggtat

SEQ ID NO: 15758 - DNA, 17 bp, Artificial sequence
  Synthetic
gcgtaattaattaatgg

SEQ ID NO: 15759 - DNA, 14 bp, Artificial sequence
  Synthetic
cccggcacacgtct

SEQ ID NO: 15760 - DNA, 10 bp, Artificial sequence
  Synthetic
actcatttgt

SEQ ID NO: 15761 - DNA, 15 bp, Artificial sequence
  Synthetic
gtaacggagtcccgt

SEQ ID NO: 15762 - DNA, 9 bp, Artificial sequence
  Synthetic
acatttgtt

SEQ ID NO: 15763 - DNA, 10 bp, Artificial sequence
  Synthetic
ggggcgcggg

SEQ ID NO: 15764 - DNA, 16 bp, Artificial sequence
  Synthetic
tttttaggcctacatg

SEQ ID NO: 15765 - DNA, 18 bp, Artificial sequence
  Synthetic
atcatcggtaccgttgtt

SEQ ID NO: 15766 - DNA, 21 bp, Artificial sequence
  Synthetic
gcttccgacgccccagtcgtg

SEQ ID NO: 15767 - DNA, 10 bp, Artificial sequence
  Synthetic
tactgagtat

SEQ ID NO: 15768 - DNA, 15 bp, Artificial sequence
  Synthetic
tcgacagtgagtgga

SEQ ID NO: 15769 - DNA, 10 bp, Artificial sequence
  Synthetic
tactgagtag

SEQ ID NO: 15770 - DNA, 9 bp, Artificial sequence
  Synthetic
gcgcgcgtg

SEQ ID NO: 15771 - DNA, 8 bp, Artificial sequence
  Synthetic
tagactat

SEQ ID NO: 15772 - DNA, 15 bp, Artificial sequence
  Synthetic
ccttttgctttgact

SEQ ID NO: 15773 - DNA, 11 bp, Artificial sequence
  Synthetic
atatccctatt

SEQ ID NO: 15774 - DNA, 9 bp, Artificial sequence
  Synthetic
tggtgcacc

SEQ ID NO: 15775 - DNA, 16 bp, Artificial sequence
  Synthetic
taacctgaaacctggg

SEQ ID NO: 15776 - DNA, 10 bp, Artificial sequence
  Synthetic
ttcgtgtacc

SEQ ID NO: 15777 - DNA, 15 bp, Artificial sequence
  Synthetic
gacaacgatccgtct

SEQ ID NO: 15778 - DNA, 12 bp, Artificial sequence
  Synthetic
gacgtggacacg

SEQ ID NO: 15779 - DNA, 13 bp, Artificial sequence
  Synthetic
tttgggcgtataa

SEQ ID NO: 15780 - DNA, 8 bp, Artificial sequence
  Synthetic
tggatcac

SEQ ID NO: 15781 - DNA, 19 bp, Artificial sequence
  Synthetic
gttccagtcccactggacc

SEQ ID NO: 15782 - DNA, 10 bp, Artificial sequence
  Synthetic
ttaattaatc

SEQ ID NO: 15783 - DNA, 10 bp, Artificial sequence
  Synthetic
ttaattaatt

SEQ ID NO: 15784 - DNA, 15 bp, Artificial sequence
  Synthetic
gtcaaagtgaaaggg

SEQ ID NO: 15785 - DNA, 14 bp, Artificial sequence
  Synthetic
gaagcgccccccag

SEQ ID NO: 15786 - DNA, 19 bp, Artificial sequence
  Synthetic
cactggaattattccagtg

SEQ ID NO: 15787 - DNA, 9 bp, Artificial sequence
  Synthetic
ggattactc

SEQ ID NO: 15788 - DNA, 13 bp, Artificial sequence
  Synthetic
gttctaccgccgg

SEQ ID NO: 15789 - DNA, 11 bp, Artificial sequence
  Synthetic
ggcgtcgaccg

SEQ ID NO: 15790 - DNA, 15 bp, Artificial sequence
  Synthetic
gagactaaccggccg

SEQ ID NO: 15791 - DNA, 10 bp, Artificial sequence
  Synthetic
ggcgccgccg

SEQ ID NO: 15792 - DNA, 8 bp, Artificial sequence
  Synthetic
ttcactat

SEQ ID NO: 15793 - DNA, 8 bp, Artificial sequence
  Synthetic
gaccaatt

SEQ ID NO: 15794 - DNA, 11 bp, Artificial sequence
  Synthetic
tgtccttcacc

SEQ ID NO: 15795 - DNA, 13 bp, Artificial sequence
  Synthetic
cggaatggtttat

SEQ ID NO: 15796 - DNA, 15 bp, Artificial sequence
  Synthetic
tagttattgtaacta

SEQ ID NO: 15797 - DNA, 12 bp, Artificial sequence
  Synthetic
tcaaagtaaaag

SEQ ID NO: 15798 - DNA, 9 bp, Artificial sequence
  Synthetic
ggcagtcgt

SEQ ID NO: 15799 - DNA, 18 bp, Artificial sequence
  Synthetic
tcttggtcgacgccagtc

SEQ ID NO: 15800 - DNA, 10 bp, Artificial sequence
  Synthetic
ttactgcagt

SEQ ID NO: 15801 - DNA, 14 bp, Artificial sequence
  Synthetic
acttacaagtcagt

SEQ ID NO: 15802 - DNA, 12 bp, Artificial sequence
  Synthetic
gacgcgtacgcg

SEQ ID NO: 15803 - DNA, 16 bp, Artificial sequence
  Synthetic
gtttaaggagctttct

SEQ ID NO: 15804 - DNA, 15 bp, Artificial sequence
  Synthetic
tatttccgcgcgcta

SEQ ID NO: 15805 - DNA, 15 bp, Artificial sequence
  Synthetic
tggtgaaggcccagt

SEQ ID NO: 15806 - DNA, 17 bp, Artificial sequence
  Synthetic
ttaataattaattgagc

SEQ ID NO: 15807 - DNA, 12 bp, Artificial sequence
  Synthetic
agggtgcacagt

SEQ ID NO: 15808 - DNA, 14 bp, Artificial sequence
  Synthetic
tagtttcctcggct

SEQ ID NO: 15809 - DNA, 10 bp, Artificial sequence
  Synthetic
cgactacgtt

SEQ ID NO: 15810 - DNA, 15 bp, Artificial sequence
  Synthetic
tacttaccttaagta

SEQ ID NO: 15811 - DNA, 10 bp, Artificial sequence
  Synthetic
ggattaatag

SEQ ID NO: 15812 - DNA, 11 bp, Artificial sequence
  Synthetic
gtctgcctgtg

SEQ ID NO: 15813 - DNA, 16 bp, Artificial sequence
  Synthetic
attccattattttaat

SEQ ID NO: 15814 - DNA, 8 bp, Artificial sequence
  Synthetic
ttccagtt

SEQ ID NO: 15815 - DNA, 8 bp, Artificial sequence
  Synthetic
ttccagtg

SEQ ID NO: 15816 - DNA, 11 bp, Artificial sequence
  Synthetic
tggcacccttt

SEQ ID NO: 15817 - DNA, 17 bp, Artificial sequence
  Synthetic
cattaatggcattaatt

SEQ ID NO: 15818 - DNA, 8 bp, Artificial sequence
  Synthetic
ttgtgcac

SEQ ID NO: 15819 - DNA, 14 bp, Artificial sequence
  Synthetic
ggtcgtcccccgcc

SEQ ID NO: 15820 - DNA, 7 bp, Artificial sequence
  Synthetic
gtcaccc

SEQ ID NO: 15821 - DNA, 8 bp, Artificial sequence
  Synthetic
ttccagta

SEQ ID NO: 15822 - DNA, 19 bp, Artificial sequence
  Synthetic
ggtgccgccacagtgtacg

SEQ ID NO: 15823 - DNA, 8 bp, Artificial sequence
  Synthetic
ttcaaagt

SEQ ID NO: 15824 - DNA, 18 bp, Artificial sequence
  Synthetic
tatcgcgggggaccaccg

SEQ ID NO: 15825 - DNA, 11 bp, Artificial sequence
  Synthetic
cactgagtcgt

SEQ ID NO: 15826 - DNA, 10 bp, Artificial sequence
  Synthetic
tctctattct

SEQ ID NO: 15827 - DNA, 15 bp, Artificial sequence
  Synthetic
tcacggtagatcacc

SEQ ID NO: 15828 - DNA, 12 bp, Artificial sequence
  Synthetic
gcatgcacgccg

SEQ ID NO: 15829 - DNA, 20 bp, Artificial sequence
  Synthetic
cactggaatgtattccagtg

SEQ ID NO: 15830 - DNA, 17 bp, Artificial sequence
  Synthetic
tcaacggaatataccag

SEQ ID NO: 15831 - DNA, 11 bp, Artificial sequence
  Synthetic
ctattataact

SEQ ID NO: 15832 - DNA, 10 bp, Artificial sequence
  Synthetic
ttattgcctt

SEQ ID NO: 15833 - DNA, 9 bp, Artificial sequence
  Synthetic
ttgtggacc

SEQ ID NO: 15834 - DNA, 10 bp, Artificial sequence
  Synthetic
ggttagtctt

SEQ ID NO: 15835 - DNA, 10 bp, Artificial sequence
  Synthetic
tacttattta

SEQ ID NO: 15836 - DNA, 17 bp, Artificial sequence
  Synthetic
ttttatgtacattttta

SEQ ID NO: 15837 - DNA, 13 bp, Artificial sequence
  Synthetic
ggactcttattag

SEQ ID NO: 15838 - DNA, 18 bp, Artificial sequence
  Synthetic
tttttaccgcggtaaaaa

SEQ ID NO: 15839 - DNA, 8 bp, Artificial sequence
  Synthetic
ttcaagta

SEQ ID NO: 15840 - DNA, 17 bp, Artificial sequence
  Synthetic
tttgtattactccaacg

SEQ ID NO: 15841 - DNA, 8 bp, Artificial sequence
  Synthetic
ttcaagtg

SEQ ID NO: 15842 - DNA, 11 bp, Artificial sequence
  Synthetic
tcttgttaccc

SEQ ID NO: 15843 - DNA, 16 bp, Artificial sequence
  Synthetic
gatccccgcgggggtt

SEQ ID NO: 15844 - DNA, 14 bp, Artificial sequence
  Synthetic
tgtccctcactcac

SEQ ID NO: 15845 - DNA, 15 bp, Artificial sequence
  Synthetic
ggctttggctttgat

SEQ ID NO: 15846 - DNA, 16 bp, Artificial sequence
  Synthetic
aatggactaatccttt

SEQ ID NO: 15847 - DNA, 9 bp, Artificial sequence
  Synthetic
tgggtaatt

SEQ ID NO: 15848 - DNA, 8 bp, Artificial sequence
  Synthetic
ccgaaggg

SEQ ID NO: 15849 - DNA, 13 bp, Artificial sequence
  Synthetic
cctacaaacaaat

SEQ ID NO: 15850 - DNA, 9 bp, Artificial sequence
  Synthetic
ggcgtgcgt

SEQ ID NO: 15851 - DNA, 17 bp, Artificial sequence
  Synthetic
ttaaattcatgaatttt

SEQ ID NO: 15852 - DNA, 10 bp, Artificial sequence
  Synthetic
gatatttatc

SEQ ID NO: 15853 - DNA, 9 bp, Artificial sequence
  Synthetic
gattaatgg

SEQ ID NO: 15854 - DNA, 9 bp, Artificial sequence
  Synthetic
cgtgaattt

SEQ ID NO: 15855 - DNA, 20 bp, Artificial sequence
  Synthetic
gtccactaaaggccctttac

SEQ ID NO: 15856 - DNA, 16 bp, Artificial sequence
  Synthetic
gcctgtggacaagaag

SEQ ID NO: 15857 - DNA, 14 bp, Artificial sequence
  Synthetic
ccgattaatcgctt

SEQ ID NO: 15858 - DNA, 13 bp, Artificial sequence
  Synthetic
ttgaatggtttgt

SEQ ID NO: 15859 - DNA, 12 bp, Artificial sequence
  Synthetic
tattaacctaat

SEQ ID NO: 15860 - DNA, 12 bp, Artificial sequence
  Synthetic
ttgtctaccagc

SEQ ID NO: 15861 - DNA, 11 bp, Artificial sequence
  Synthetic
ttcatttgttt

SEQ ID NO: 15862 - DNA, 12 bp, Artificial sequence
  Synthetic
tttgtttgtaag

SEQ ID NO: 15863 - DNA, 15 bp, Artificial sequence
  Synthetic
tttctagtttcccaa

SEQ ID NO: 15864 - DNA, 7 bp, Artificial sequence
  Synthetic
tcttgtc

SEQ ID NO: 15865 - DNA, 16 bp, Artificial sequence
  Synthetic
cagtggtagacaagct

SEQ ID NO: 15866 - DNA, 16 bp, Artificial sequence
  Synthetic
gagtcggttagtcgcg

SEQ ID NO: 15867 - DNA, 8 bp, Artificial sequence
  Synthetic
tgtggacg

SEQ ID NO: 15868 - DNA, 7 bp, Artificial sequence
  Synthetic
attattt

SEQ ID NO: 15869 - DNA, 8 bp, Artificial sequence
  Synthetic
tgtggacc

SEQ ID NO: 15870 - DNA, 10 bp, Artificial sequence
  Synthetic
tcgacagtta

SEQ ID NO: 15871 - DNA, 14 bp, Artificial sequence
  Synthetic
gagggacaggggag

SEQ ID NO: 15872 - DNA, 8 bp, Artificial sequence
  Synthetic
ctaaaggt

SEQ ID NO: 15873 - DNA, 15 bp, Artificial sequence
  Synthetic
tttaacgactgagtc

SEQ ID NO: 15874 - DNA, 19 bp, Artificial sequence
  Synthetic
tttttctccttcactttga

SEQ ID NO: 15875 - DNA, 13 bp, Artificial sequence
  Synthetic
ggcggtgctcggg

SEQ ID NO: 15876 - DNA, 10 bp, Artificial sequence
  Synthetic
tcgacagttt

SEQ ID NO: 15877 - DNA, 12 bp, Artificial sequence
  Synthetic
ggtgcagtggtg

SEQ ID NO: 15878 - DNA, 15 bp, Artificial sequence
  Synthetic
tggcaacgataccat

SEQ ID NO: 15879 - DNA, 17 bp, Artificial sequence
  Synthetic
ttccagtaagttccagt

SEQ ID NO: 15880 - DNA, 10 bp, Artificial sequence
  Synthetic
agttggacgt

SEQ ID NO: 15881 - DNA, 9 bp, Artificial sequence
  Synthetic
aatgcgttt

SEQ ID NO: 15882 - DNA, 10 bp, Artificial sequence
  Synthetic
gactgagtag

SEQ ID NO: 15883 - DNA, 7 bp, Artificial sequence
  Synthetic
tctcctt

SEQ ID NO: 15884 - DNA, 10 bp, Artificial sequence
  Synthetic
aaggtccttt

SEQ ID NO: 15885 - DNA, 9 bp, Artificial sequence
  Synthetic
taaattaat

SEQ ID NO: 15886 - DNA, 17 bp, Artificial sequence
  Synthetic
tcgtcacccagggggtc

SEQ ID NO: 15887 - DNA, 17 bp, Artificial sequence
  Synthetic
tgtacagtatctgtaca

SEQ ID NO: 15888 - DNA, 10 bp, Artificial sequence
  Synthetic
caatacgttg

SEQ ID NO: 15889 - DNA, 17 bp, Artificial sequence
  Synthetic
agaaaccgcatgggatt

SEQ ID NO: 15890 - DNA, 8 bp, Artificial sequence
  Synthetic
tgtattta

SEQ ID NO: 15891 - DNA, 16 bp, Artificial sequence
  Synthetic
ttgggttattttaagc

SEQ ID NO: 15892 - DNA, 11 bp, Artificial sequence
  Synthetic
acattagggtt

SEQ ID NO: 15893 - DNA, 12 bp, Artificial sequence
  Synthetic
gttctgcggaat

SEQ ID NO: 15894 - DNA, 9 bp, Artificial sequence
  Synthetic
tctacctga

SEQ ID NO: 15895 - DNA, 8 bp, Artificial sequence
  Synthetic
tggccttc

SEQ ID NO: 15896 - DNA, 12 bp, Artificial sequence
  Synthetic
cttgtgttgttt

SEQ ID NO: 15897 - DNA, 8 bp, Artificial sequence
  Synthetic
attagttt

SEQ ID NO: 15898 - DNA, 15 bp, Artificial sequence
  Synthetic
ttgctttggctttga

SEQ ID NO: 15899 - DNA, 17 bp, Artificial sequence
  Synthetic
gttaatttatggctaat

SEQ ID NO: 15900 - DNA, 10 bp, Artificial sequence
  Synthetic
atttgtttct

SEQ ID NO: 15901 - DNA, 15 bp, Artificial sequence
  Synthetic
ggtattaattaatgt

SEQ ID NO: 15902 - DNA, 11 bp, Artificial sequence
  Synthetic
gaagacccttt

SEQ ID NO: 15903 - DNA, 13 bp, Artificial sequence
  Synthetic
cttgcaagatctt

SEQ ID NO: 15904 - DNA, 11 bp, Artificial sequence
  Synthetic
aaagggccttt

SEQ ID NO: 15905 - DNA, 25 bp, Artificial sequence
  Synthetic
ttgatgttaagggtcttacggggcg

SEQ ID NO: 15906 - DNA, 10 bp, Artificial sequence
  Synthetic
tggttaatcg

SEQ ID NO: 15907 - DNA, 16 bp, Artificial sequence
  Synthetic
tttaattaactaaaac

SEQ ID NO: 15908 - DNA, 10 bp, Artificial sequence
  Synthetic
ttgtcgacta

SEQ ID NO: 15909 - DNA, 18 bp, Artificial sequence
  Synthetic
ccggtggtcccccgcgat

SEQ ID NO: 15910 - DNA, 16 bp, Artificial sequence
  Synthetic
ttgttggttaattaag

SEQ ID NO: 15911 - DNA, 10 bp, Artificial sequence
  Synthetic
ctccacactt

SEQ ID NO: 15912 - DNA, 13 bp, Artificial sequence
  Synthetic
gatagcgctgtat

SEQ ID NO: 15913 - DNA, 20 bp, Artificial sequence
  Synthetic
aggagaaacaaatgttaagt

SEQ ID NO: 15914 - DNA, 10 bp, Artificial sequence
  Synthetic
tgttctcccg

SEQ ID NO: 15915 - DNA, 14 bp, Artificial sequence
  Synthetic
caacggtaccgttg

SEQ ID NO: 15916 - DNA, 8 bp, Artificial sequence
  Synthetic
gtgtagtt

SEQ ID NO: 15917 - DNA, 10 bp, Artificial sequence
  Synthetic
tccttcactt

SEQ ID NO: 15918 - DNA, 10 bp, Artificial sequence
  Synthetic
ggaatattcc

SEQ ID NO: 15919 - DNA, 8 bp, Artificial sequence
  Synthetic
cgcccttt

SEQ ID NO: 15920 - DNA, 14 bp, Artificial sequence
  Synthetic
aggtaccacgactt

SEQ ID NO: 15921 - DNA, 9 bp, Artificial sequence
  Synthetic
cactgcagt

SEQ ID NO: 15922 - DNA, 15 bp, Artificial sequence
  Synthetic
ctctttaattatatt

SEQ ID NO: 15923 - DNA, 20 bp, Artificial sequence
  Synthetic
gtttccagtgcactggaaac

SEQ ID NO: 15924 - DNA, 15 bp, Artificial sequence
  Synthetic
ctataaagacgagat

SEQ ID NO: 15925 - DNA, 16 bp, Artificial sequence
  Synthetic
ttttcgaaagatcctt

SEQ ID NO: 15926 - DNA, 13 bp, Artificial sequence
  Synthetic
gaaagggcggggg

SEQ ID NO: 15927 - DNA, 10 bp, Artificial sequence
  Synthetic
ggtgcactgg

SEQ ID NO: 15928 - DNA, 13 bp, Artificial sequence
  Synthetic
gattaaattaatt

SEQ ID NO: 15929 - DNA, 14 bp, Artificial sequence
  Synthetic
gggggaacccgggg

SEQ ID NO: 15930 - DNA, 14 bp, Artificial sequence
  Synthetic
tcctcccccgtcac

SEQ ID NO: 15931 - DNA, 7 bp, Artificial sequence
  Synthetic
agtattt

SEQ ID NO: 15932 - DNA, 22 bp, Artificial sequence
  Synthetic
cccgcgacaggtaccacgactt

SEQ ID NO: 15933 - DNA, 11 bp, Artificial sequence
  Synthetic
cggtatttagt

SEQ ID NO: 15934 - DNA, 7 bp, Artificial sequence
  Synthetic
ttatata

SEQ ID NO: 15935 - DNA, 10 bp, Artificial sequence
  Synthetic
tgattaattg

SEQ ID NO: 15936 - DNA, 11 bp, Artificial sequence
  Synthetic
ttaaacgactg

SEQ ID NO: 15937 - DNA, 13 bp, Artificial sequence
  Synthetic
tccagtttcaggt

SEQ ID NO: 15938 - DNA, 10 bp, Artificial sequence
  Synthetic
cctaagcttg

SEQ ID NO: 15939 - DNA, 11 bp, Artificial sequence
  Synthetic
ttctaccgccg

SEQ ID NO: 15940 - DNA, 14 bp, Artificial sequence
  Synthetic
gtttagagcgctct

SEQ ID NO: 15941 - DNA, 12 bp, Artificial sequence
  Synthetic
gcaactgcagtg

SEQ ID NO: 15942 - DNA, 10 bp, Artificial sequence
  Synthetic
ttgtccacca

SEQ ID NO: 15943 - DNA, 14 bp, Artificial sequence
  Synthetic
gtgtcgccccccag

SEQ ID NO: 15944 - DNA, 12 bp, Artificial sequence
  Synthetic
ttaccgcggttt

SEQ ID NO: 15945 - DNA, 8 bp, Artificial sequence
  Synthetic
cgattact

SEQ ID NO: 15946 - DNA, 17 bp, Artificial sequence
  Synthetic
ttagcgtgacgtaaggc

SEQ ID NO: 15947 - DNA, 10 bp, Artificial sequence
  Synthetic
ggtgcactag

SEQ ID NO: 15948 - DNA, 8 bp, Artificial sequence
  Synthetic
acagtttt

SEQ ID NO: 15949 - DNA, 17 bp, Artificial sequence
  Synthetic
gttatggccttcacatt

SEQ ID NO: 15950 - DNA, 7 bp, Artificial sequence
  Synthetic
cgtctct

SEQ ID NO: 15951 - DNA, 10 bp, Artificial sequence
  Synthetic
gcgggggcgt

SEQ ID NO: 15952 - DNA, 17 bp, Artificial sequence
  Synthetic
tgccggtattttaatta

SEQ ID NO: 15953 - DNA, 10 bp, Artificial sequence
  Synthetic
gattaatatg

SEQ ID NO: 15954 - DNA, 16 bp, Artificial sequence
  Synthetic
gggtcccattgtcggc

SEQ ID NO: 15955 - DNA, 9 bp, Artificial sequence
  Synthetic
tgtgcacgg

SEQ ID NO: 15956 - DNA, 17 bp, Artificial sequence
  Synthetic
ttatcccatagttaata

SEQ ID NO: 15957 - DNA, 15 bp, Artificial sequence
  Synthetic
ttcagtcgtaaaaat

SEQ ID NO: 15958 - DNA, 9 bp, Artificial sequence
  Synthetic
ccggtaatt

SEQ ID NO: 15959 - DNA, 17 bp, Artificial sequence
  Synthetic
gctcaattaattattcg

SEQ ID NO: 15960 - DNA, 14 bp, Artificial sequence
  Synthetic
ttggtgttatggtt

SEQ ID NO: 15961 - DNA, 10 bp, Artificial sequence
  Synthetic
tgtagtttcc

SEQ ID NO: 15962 - DNA, 18 bp, Artificial sequence
  Synthetic
ggttgaaagctaaaggat

SEQ ID NO: 15963 - DNA, 16 bp, Artificial sequence
  Synthetic
ttaaggtaacaagtta

SEQ ID NO: 15964 - DNA, 9 bp, Artificial sequence
  Synthetic
gaattaggg

SEQ ID NO: 15965 - DNA, 10 bp, Artificial sequence
  Synthetic
tactgagtgg

SEQ ID NO: 15966 - DNA, 9 bp, Artificial sequence
  Synthetic
tctgtctgt

SEQ ID NO: 15967 - DNA, 7 bp, Artificial sequence
  Synthetic
ggccttc

SEQ ID NO: 15968 - DNA, 14 bp, Artificial sequence
  Synthetic
acttatcagtaagt

SEQ ID NO: 15969 - DNA, 15 bp, Artificial sequence
  Synthetic
atttatttataaagt

SEQ ID NO: 15970 - DNA, 8 bp, Artificial sequence
  Synthetic
taaaaccc

SEQ ID NO: 15971 - DNA, 13 bp, Artificial sequence
  Synthetic
tattaatttaatt

SEQ ID NO: 15972 - DNA, 13 bp, Artificial sequence
  Synthetic
actactgcaccgt

SEQ ID NO: 15973 - DNA, 14 bp, Artificial sequence
  Synthetic
cccgtagttagttt

SEQ ID NO: 15974 - DNA, 11 bp, Artificial sequence
  Synthetic
ctttactcagt

SEQ ID NO: 15975 - DNA, 13 bp, Artificial sequence
  Synthetic
tttacgttagggg

SEQ ID NO: 15976 - DNA, 10 bp, Artificial sequence
  Synthetic
attagctatt

SEQ ID NO: 15977 - DNA, 17 bp, Artificial sequence
  Synthetic
gattccaagatctagtg

SEQ ID NO: 15978 - DNA, 11 bp, Artificial sequence
  Synthetic
ttaattaatca

SEQ ID NO: 15979 - DNA, 14 bp, Artificial sequence
  Synthetic
taccttttaatgtc

SEQ ID NO: 15980 - DNA, 23 bp, Artificial sequence
  Synthetic
gggggactggaaacgggagacgg

SEQ ID NO: 15981 - DNA, 10 bp, Artificial sequence
  Synthetic
gaaaatatct

SEQ ID NO: 15982 - DNA, 9 bp, Artificial sequence
  Synthetic
attaattct

SEQ ID NO: 15983 - DNA, 8 bp, Artificial sequence
  Synthetic
tcgactga

SEQ ID NO: 15984 - DNA, 9 bp, Artificial sequence
  Synthetic
taacaaatg

SEQ ID NO: 15985 - DNA, 10 bp, Artificial sequence
  Synthetic
gtcctttatt

SEQ ID NO: 15986 - DNA, 10 bp, Artificial sequence
  Synthetic
cagcattttt

SEQ ID NO: 15987 - DNA, 10 bp, Artificial sequence
  Synthetic
tcggggggtt

SEQ ID NO: 15988 - DNA, 14 bp, Artificial sequence
  Synthetic
gtccggagccgggg

SEQ ID NO: 15989 - DNA, 17 bp, Artificial sequence
  Synthetic
tccagtttgacactgga

SEQ ID NO: 15990 - DNA, 10 bp, Artificial sequence
  Synthetic
gtttagtgac

SEQ ID NO: 15991 - DNA, 15 bp, Artificial sequence
  Synthetic
cccccaactgcgtct

SEQ ID NO: 15992 - DNA, 11 bp, Artificial sequence
  Synthetic
cgagcattttg

SEQ ID NO: 15993 - DNA, 11 bp, Artificial sequence
  Synthetic
cgagcattttt

SEQ ID NO: 15994 - DNA, 9 bp, Artificial sequence
  Synthetic
ctgtcgacg

SEQ ID NO: 15995 - DNA, 15 bp, Artificial sequence
  Synthetic
gggcggtgcactggg

SEQ ID NO: 15996 - DNA, 16 bp, Artificial sequence
  Synthetic
ttcgtggacagttata

SEQ ID NO: 15997 - DNA, 16 bp, Artificial sequence
  Synthetic
gtccactgtggactgt

SEQ ID NO: 15998 - DNA, 11 bp, Artificial sequence
  Synthetic
ggcgggggcgt

SEQ ID NO: 15999 - DNA, 8 bp, Artificial sequence
  Synthetic
agagggtt

SEQ ID NO: 16000 - DNA, 10 bp, Artificial sequence
  Synthetic
cggtcaactg

SEQ ID NO: 16001 - DNA, 10 bp, Artificial sequence
  Synthetic
ttccacagtt

SEQ ID NO: 16002 - DNA, 9 bp, Artificial sequence
  Synthetic
tgacaatga

SEQ ID NO: 16003 - DNA, 15 bp, Artificial sequence
  Synthetic
cgtcctcccataccg

SEQ ID NO: 16004 - DNA, 21 bp, Artificial sequence
  Synthetic
gcctactggaaactggggact

SEQ ID NO: 16005 - DNA, 21 bp, Artificial sequence
  Synthetic
gaggaggggagggaggagggg

SEQ ID NO: 16006 - DNA, 10 bp, Artificial sequence
  Synthetic
tacatttgtt

SEQ ID NO: 16007 - DNA, 10 bp, Artificial sequence
  Synthetic
ggtaccgttg

SEQ ID NO: 16008 - DNA, 17 bp, Artificial sequence
  Synthetic
ctgttaattagggatgt

SEQ ID NO: 16009 - DNA, 12 bp, Artificial sequence
  Synthetic
tttaaacgactg

SEQ ID NO: 16010 - DNA, 10 bp, Artificial sequence
  Synthetic
cggtgcactg

SEQ ID NO: 16011 - DNA, 9 bp, Artificial sequence
  Synthetic
ttccttcat

SEQ ID NO: 16012 - DNA, 9 bp, Artificial sequence
  Synthetic
gttgtccac

SEQ ID NO: 16013 - DNA, 9 bp, Artificial sequence
  Synthetic
tgtcgaggg

SEQ ID NO: 16014 - DNA, 15 bp, Artificial sequence
  Synthetic
ttacgttaaaaaact

SEQ ID NO: 16015 - DNA, 15 bp, Artificial sequence
  Synthetic
tttagagcgctcttg

SEQ ID NO: 16016 - DNA, 14 bp, Artificial sequence
  Synthetic
ggtggacggcgtcc

SEQ ID NO: 16017 - DNA, 16 bp, Artificial sequence
  Synthetic
ctccagttttccagtg

SEQ ID NO: 16018 - DNA, 16 bp, Artificial sequence
  Synthetic
ctccagttttccagtt

SEQ ID NO: 16019 - DNA, 6 bp, Artificial sequence
  Synthetic
tattgt

SEQ ID NO: 16020 - DNA, 8 bp, Artificial sequence
  Synthetic
cgtgcact

SEQ ID NO: 16021 - DNA, 9 bp, Artificial sequence
  Synthetic
tgtcgagga

SEQ ID NO: 16022 - DNA, 12 bp, Artificial sequence
  Synthetic
gcggcgggggcg

SEQ ID NO: 16023 - DNA, 17 bp, Artificial sequence
  Synthetic
cttgttattgtaacaag

SEQ ID NO: 16024 - DNA, 10 bp, Artificial sequence
  Synthetic
ccgcgctttg

SEQ ID NO: 16025 - DNA, 10 bp, Artificial sequence
  Synthetic
ctagctaggg

SEQ ID NO: 16026 - DNA, 12 bp, Artificial sequence
  Synthetic
taaaaatgctgg

SEQ ID NO: 16027 - DNA, 17 bp, Artificial sequence
  Synthetic
gtggcaactaacccagc

SEQ ID NO: 16028 - DNA, 16 bp, Artificial sequence
  Synthetic
cccaatgaccgccagt

SEQ ID NO: 16029 - DNA, 10 bp, Artificial sequence
  Synthetic
tgtaggccca

SEQ ID NO: 16030 - DNA, 16 bp, Artificial sequence
  Synthetic
tgctactgcagtagct

SEQ ID NO: 16031 - DNA, 10 bp, Artificial sequence
  Synthetic
taataattat

SEQ ID NO: 16032 - DNA, 9 bp, Artificial sequence
  Synthetic
tcccatagt

SEQ ID NO: 16033 - DNA, 9 bp, Artificial sequence
  Synthetic
gggcggggg

SEQ ID NO: 16034 - DNA, 12 bp, Artificial sequence
  Synthetic
ccggtgaactct

SEQ ID NO: 16035 - DNA, 11 bp, Artificial sequence
  Synthetic
cgtccgcggcg

SEQ ID NO: 16036 - DNA, 11 bp, Artificial sequence
  Synthetic
gtgtcgacgtc

SEQ ID NO: 16037 - DNA, 16 bp, Artificial sequence
  Synthetic
ttccattaatggttat

SEQ ID NO: 16038 - DNA, 11 bp, Artificial sequence
  Synthetic
tgtctattctt

SEQ ID NO: 16039 - DNA, 11 bp, Artificial sequence
  Synthetic
tactcagtagg

SEQ ID NO: 16040 - DNA, 17 bp, Artificial sequence
  Synthetic
acttggcctaattactt

SEQ ID NO: 16041 - DNA, 10 bp, Artificial sequence
  Synthetic
tcattaattg

SEQ ID NO: 16042 - DNA, 18 bp, Artificial sequence
  Synthetic
ttgtacgggcccgtacag

SEQ ID NO: 16043 - DNA, 10 bp, Artificial sequence
  Synthetic
ctgtgcacgg

SEQ ID NO: 16044 - DNA, 10 bp, Artificial sequence
  Synthetic
ggaatcgttg

SEQ ID NO: 16045 - DNA, 10 bp, Artificial sequence
  Synthetic
gaaggccgag

SEQ ID NO: 16046 - DNA, 10 bp, Artificial sequence
  Synthetic
tacgcccatg

SEQ ID NO: 16047 - DNA, 21 bp, Artificial sequence
  Synthetic
cctcctcctccccctcctcct

SEQ ID NO: 16048 - DNA, 15 bp, Artificial sequence
  Synthetic
aaacgtattgttttt

SEQ ID NO: 16049 - DNA, 18 bp, Artificial sequence
  Synthetic
gtacgggtatattccgtt

SEQ ID NO: 16050 - DNA, 7 bp, Artificial sequence
  Synthetic
acagttt

SEQ ID NO: 16051 - DNA, 15 bp, Artificial sequence
  Synthetic
taaacgtattgtttc

SEQ ID NO: 16052 - DNA, 12 bp, Artificial sequence
  Synthetic
ggtatatacccg

SEQ ID NO: 16053 - DNA, 15 bp, Artificial sequence
  Synthetic
cttccttcgccttct

SEQ ID NO: 16054 - DNA, 7 bp, Artificial sequence
  Synthetic
ggttaat

SEQ ID NO: 16055 - DNA, 8 bp, Artificial sequence
  Synthetic
tccagtgc

SEQ ID NO: 16056 - DNA, 15 bp, Artificial sequence
  Synthetic
gaaattagggaattg

SEQ ID NO: 16057 - DNA, 11 bp, Artificial sequence
  Synthetic
tccacacttct

SEQ ID NO: 16058 - DNA, 20 bp, Artificial sequence
  Synthetic
ccacgacaggcaccacgact

SEQ ID NO: 16059 - DNA, 13 bp, Artificial sequence
  Synthetic
ggagtggggtggg

SEQ ID NO: 16060 - DNA, 12 bp, Artificial sequence
  Synthetic
cgctagtggggt

SEQ ID NO: 16061 - DNA, 9 bp, Artificial sequence
  Synthetic
ttagctatt

SEQ ID NO: 16062 - DNA, 13 bp, Artificial sequence
  Synthetic
gtaggtctacaag

SEQ ID NO: 16063 - DNA, 10 bp, Artificial sequence
  Synthetic
gcgcggtttg

SEQ ID NO: 16064 - DNA, 17 bp, Artificial sequence
  Synthetic
agggtttcatcgaccct

SEQ ID NO: 16065 - DNA, 9 bp, Artificial sequence
  Synthetic
catttgttg

SEQ ID NO: 16066 - DNA, 9 bp, Artificial sequence
  Synthetic
catttgttt

SEQ ID NO: 16067 - DNA, 15 bp, Artificial sequence
  Synthetic
gcaacgatccgttgg

SEQ ID NO: 16068 - DNA, 9 bp, Artificial sequence
  Synthetic
ggttaatcg

SEQ ID NO: 16069 - DNA, 9 bp, Artificial sequence
  Synthetic
ggttaatcc

SEQ ID NO: 16070 - DNA, 12 bp, Artificial sequence
  Synthetic
tttaactggagt

SEQ ID NO: 16071 - DNA, 11 bp, Artificial sequence
  Synthetic
gtactcagtgg

SEQ ID NO: 16072 - DNA, 6 bp, Artificial sequence
  Synthetic
attgat

SEQ ID NO: 16073 - DNA, 18 bp, Artificial sequence
  Synthetic
ggggcccgaacgcactct

SEQ ID NO: 16074 - DNA, 8 bp, Artificial sequence
  Synthetic
aatgcatt

SEQ ID NO: 16075 - DNA, 15 bp, Artificial sequence
  Synthetic
ccaaagagaggtcat

SEQ ID NO: 16076 - DNA, 9 bp, Artificial sequence
  Synthetic
ttaaaaggt

SEQ ID NO: 16077 - DNA, 11 bp, Artificial sequence
  Synthetic
tggtctaccag

SEQ ID NO: 16078 - DNA, 15 bp, Artificial sequence
  Synthetic
gtgaaggcgaaggcc

SEQ ID NO: 16079 - DNA, 8 bp, Artificial sequence
  Synthetic
cggtaatt

SEQ ID NO: 16080 - DNA, 14 bp, Artificial sequence
  Synthetic
cttgtcttacaagg

SEQ ID NO: 16081 - DNA, 10 bp, Artificial sequence
  Synthetic
aggggcccct

SEQ ID NO: 16082 - DNA, 9 bp, Artificial sequence
  Synthetic
ccggtctgt

SEQ ID NO: 16083 - DNA, 10 bp, Artificial sequence
  Synthetic
cgtgcactgg

SEQ ID NO: 16084 - DNA, 8 bp, Artificial sequence
  Synthetic
gcgggtgc

SEQ ID NO: 16085 - DNA, 17 bp, Artificial sequence
  Synthetic
atcatcggaccgttgtt

SEQ ID NO: 16086 - DNA, 10 bp, Artificial sequence
  Synthetic
tctataatag

SEQ ID NO: 16087 - DNA, 15 bp, Artificial sequence
  Synthetic
cccagttgctcaagt

SEQ ID NO: 16088 - DNA, 8 bp, Artificial sequence
  Synthetic
tttccagt

SEQ ID NO: 16089 - DNA, 10 bp, Artificial sequence
  Synthetic
tgtgcagtag

SEQ ID NO: 16090 - DNA, 13 bp, Artificial sequence
  Synthetic
acttattgtaagt

SEQ ID NO: 16091 - DNA, 10 bp, Artificial sequence
  Synthetic
tttcgtttgt

SEQ ID NO: 16092 - DNA, 8 bp, Artificial sequence
  Synthetic
caattact

SEQ ID NO: 16093 - DNA, 17 bp, Artificial sequence
  Synthetic
tagattcaatagagaat

SEQ ID NO: 16094 - DNA, 10 bp, Artificial sequence
  Synthetic
cgatgcagtg

SEQ ID NO: 16095 - DNA, 12 bp, Artificial sequence
  Synthetic
gattaaacgtat

SEQ ID NO: 16096 - DNA, 17 bp, Artificial sequence
  Synthetic
ctagaggtaaaaacctg

SEQ ID NO: 16097 - DNA, 8 bp, Artificial sequence
  Synthetic
ggacgact

SEQ ID NO: 16098 - DNA, 28 bp, Artificial sequence
  Synthetic
tttgtctatggacttcgcactggtatgt

SEQ ID NO: 16099 - DNA, 13 bp, Artificial sequence
  Synthetic
tgtgtccattcat

SEQ ID NO: 16100 - DNA, 11 bp, Artificial sequence
  Synthetic
tatttgttcgg

SEQ ID NO: 16101 - DNA, 15 bp, Artificial sequence
  Synthetic
tacttaacgtcagta

SEQ ID NO: 16102 - DNA, 15 bp, Artificial sequence
  Synthetic
tctttcactttcact

SEQ ID NO: 16103 - DNA, 14 bp, Artificial sequence
  Synthetic
gattagtagtaatt

SEQ ID NO: 16104 - DNA, 8 bp, Artificial sequence
  Synthetic
gttgccgg

SEQ ID NO: 16105 - DNA, 14 bp, Artificial sequence
  Synthetic
gtgatctaccgtcg

SEQ ID NO: 16106 - DNA, 18 bp, Artificial sequence
  Synthetic
cactggaatattccagtg

SEQ ID NO: 16107 - DNA, 18 bp, Artificial sequence
  Synthetic
tctcacgactaaccaggt

SEQ ID NO: 16108 - DNA, 19 bp, Artificial sequence
  Synthetic
ctcccgtcacttcgcactg

SEQ ID NO: 16109 - DNA, 17 bp, Artificial sequence
  Synthetic
taaaggaaactagatat

SEQ ID NO: 16110 - DNA, 10 bp, Artificial sequence
  Synthetic
tggccttctc

SEQ ID NO: 16111 - DNA, 16 bp, Artificial sequence
  Synthetic
taattgtccacaagtg

SEQ ID NO: 16112 - DNA, 16 bp, Artificial sequence
  Synthetic
ctcaagtaactcaagt

SEQ ID NO: 16113 - DNA, 15 bp, Artificial sequence
  Synthetic
ttggcaatttgccag

SEQ ID NO: 16114 - DNA, 9 bp, Artificial sequence
  Synthetic
tactcagtc

SEQ ID NO: 16115 - DNA, 17 bp, Artificial sequence
  Synthetic
tttaattgccaaaagtt

SEQ ID NO: 16116 - DNA, 10 bp, Artificial sequence
  Synthetic
tgactggagc

SEQ ID NO: 16117 - DNA, 14 bp, Artificial sequence
  Synthetic
gtacttataagtat

SEQ ID NO: 16118 - DNA, 13 bp, Artificial sequence
  Synthetic
acatttatttgtt

SEQ ID NO: 16119 - DNA, 9 bp, Artificial sequence
  Synthetic
tttcaggtc

SEQ ID NO: 16120 - DNA, 20 bp, Artificial sequence
  Synthetic
ctaaagggtattacggaacg

SEQ ID NO: 16121 - DNA, 10 bp, Artificial sequence
  Synthetic
tcttacaagc

SEQ ID NO: 16122 - DNA, 9 bp, Artificial sequence
  Synthetic
gtctatccc

SEQ ID NO: 16123 - DNA, 20 bp, Artificial sequence
  Synthetic
ggggtttggtgggggggggg

SEQ ID NO: 16124 - DNA, 20 bp, Artificial sequence
  Synthetic
ggggtttggtgggggggggt

SEQ ID NO: 16125 - DNA, 10 bp, Artificial sequence
  Synthetic
gcgggtgcgt

SEQ ID NO: 16126 - DNA, 16 bp, Artificial sequence
  Synthetic
ttgttacaagtcacaa

SEQ ID NO: 16127 - DNA, 13 bp, Artificial sequence
  Synthetic
gtatatttgttac

SEQ ID NO: 16128 - DNA, 9 bp, Artificial sequence
  Synthetic
ggccttttt

SEQ ID NO: 16129 - DNA, 13 bp, Artificial sequence
  Synthetic
tccatttgtttgt

SEQ ID NO: 16130 - DNA, 17 bp, Artificial sequence
  Synthetic
cacgtgattaatcacgt

SEQ ID NO: 16131 - DNA, 11 bp, Artificial sequence
  Synthetic
gacagaccgat

SEQ ID NO: 16132 - DNA, 9 bp, Artificial sequence
  Synthetic
ttgtagttt

SEQ ID NO: 16133 - DNA, 18 bp, Artificial sequence
  Synthetic
ctgattcgtttgttactt

SEQ ID NO: 16134 - DNA, 12 bp, Artificial sequence
  Synthetic
ttgtcgactgcg

SEQ ID NO: 16135 - DNA, 12 bp, Artificial sequence
  Synthetic
gtacagtacatt

SEQ ID NO: 16136 - DNA, 15 bp, Artificial sequence
  Synthetic
tgccgtccacagggg

SEQ ID NO: 16137 - DNA, 10 bp, Artificial sequence
  Synthetic
tttgtaccgc

SEQ ID NO: 16138 - DNA, 13 bp, Artificial sequence
  Synthetic
tacctttaaaggt

SEQ ID NO: 16139 - DNA, 6 bp, Artificial sequence
  Synthetic
gtgcac

SEQ ID NO: 16140 - DNA, 12 bp, Artificial sequence
  Synthetic
ttttacgactga

SEQ ID NO: 16141 - DNA, 7 bp, Artificial sequence
  Synthetic
tatattt

SEQ ID NO: 16142 - DNA, 15 bp, Artificial sequence
  Synthetic
tattcccgcgcgcta

SEQ ID NO: 16143 - DNA, 9 bp, Artificial sequence
  Synthetic
gtctattcc

SEQ ID NO: 16144 - DNA, 8 bp, Artificial sequence
  Synthetic
agttactt

SEQ ID NO: 16145 - DNA, 15 bp, Artificial sequence
  Synthetic
tacgggtatatacct

SEQ ID NO: 16146 - DNA, 18 bp, Artificial sequence
  Synthetic
tgtcagtacgcactcaat

SEQ ID NO: 16147 - DNA, 16 bp, Artificial sequence
  Synthetic
gttggggacccacacc

SEQ ID NO: 16148 - DNA, 13 bp, Artificial sequence
  Synthetic
atgttccttcatt

SEQ ID NO: 16149 - DNA, 17 bp, Artificial sequence
  Synthetic
gtaataattaattaagc

SEQ ID NO: 16150 - DNA, 16 bp, Artificial sequence
  Synthetic
actggtatataccagt

SEQ ID NO: 16151 - DNA, 16 bp, Artificial sequence
  Synthetic
tctcaataaaaatctc

SEQ ID NO: 16152 - DNA, 22 bp, Artificial sequence
  Synthetic
ccgcgttacgtaacacccattt

SEQ ID NO: 16153 - DNA, 9 bp, Artificial sequence
  Synthetic
tctctttgg

SEQ ID NO: 16154 - DNA, 8 bp, Artificial sequence
  Synthetic
cctaattg

SEQ ID NO: 16155 - DNA, 10 bp, Artificial sequence
  Synthetic
ttccccccgt

SEQ ID NO: 16156 - DNA, 17 bp, Artificial sequence
  Synthetic
tcctgcgacatttccct

SEQ ID NO: 16157 - DNA, 9 bp, Artificial sequence
  Synthetic
gggggcccg

SEQ ID NO: 16158 - DNA, 11 bp, Artificial sequence
  Synthetic
tggtgaacttt

SEQ ID NO: 16159 - DNA, 15 bp, Artificial sequence
  Synthetic
ggggcgggggcgtgg

SEQ ID NO: 16160 - DNA, 10 bp, Artificial sequence
  Synthetic
tggcaaattg

SEQ ID NO: 16161 - DNA, 17 bp, Artificial sequence
  Synthetic
ctttacaacaaagtctg

SEQ ID NO: 16162 - DNA, 11 bp, Artificial sequence
  Synthetic
tccctctaagg

SEQ ID NO: 16163 - DNA, 14 bp, Artificial sequence
  Synthetic
ggtgaaggcccaag

SEQ ID NO: 16164 - DNA, 10 bp, Artificial sequence
  Synthetic
ttggttaatt

SEQ ID NO: 16165 - DNA, 16 bp, Artificial sequence
  Synthetic
catcattaattacctt

SEQ ID NO: 16166 - DNA, 10 bp, Artificial sequence
  Synthetic
tccatccatg

SEQ ID NO: 16167 - DNA, 10 bp, Artificial sequence
  Synthetic
ttgtggacga

SEQ ID NO: 16168 - DNA, 15 bp, Artificial sequence
  Synthetic
cggggcgggggaggg

SEQ ID NO: 16169 - DNA, 13 bp, Artificial sequence
  Synthetic
cgtgcacagcaat

SEQ ID NO: 16170 - DNA, 10 bp, Artificial sequence
  Synthetic
tttccagttc

SEQ ID NO: 16171 - DNA, 12 bp, Artificial sequence
  Synthetic
ctccccccgcct

SEQ ID NO: 16172 - DNA, 12 bp, Artificial sequence
  Synthetic
gcacaccccttt

SEQ ID NO: 16173 - DNA, 14 bp, Artificial sequence
  Synthetic
ccccagtttccagt

SEQ ID NO: 16174 - DNA, 15 bp, Artificial sequence
  Synthetic
gttttcatttgtttc

SEQ ID NO: 16175 - DNA, 9 bp, Artificial sequence
  Synthetic
gacgggcgt

SEQ ID NO: 16176 - DNA, 13 bp, Artificial sequence
  Synthetic
ggcgggggtccgg

SEQ ID NO: 16177 - DNA, 15 bp, Artificial sequence
  Synthetic
tttctactacgttat

SEQ ID NO: 16178 - DNA, 9 bp, Artificial sequence
  Synthetic
ttcagtgca

SEQ ID NO: 16179 - DNA, 8 bp, Artificial sequence
  Synthetic
ttcgcctt

SEQ ID NO: 16180 - DNA, 9 bp, Artificial sequence
  Synthetic
ttatttgtt

SEQ ID NO: 16181 - DNA, 16 bp, Artificial sequence
  Synthetic
aattactcgattaatt

SEQ ID NO: 16182 - DNA, 8 bp, Artificial sequence
  Synthetic
attaattt

SEQ ID NO: 16183 - DNA, 10 bp, Artificial sequence
  Synthetic
tcgtcgacct

SEQ ID NO: 16184 - DNA, 10 bp, Artificial sequence
  Synthetic
gacaagaaag

SEQ ID NO: 16185 - DNA, 17 bp, Artificial sequence
  Synthetic
gccatgtggcacatggg

SEQ ID NO: 16186 - DNA, 10 bp, Artificial sequence
  Synthetic
ttcgttaatc

SEQ ID NO: 16187 - DNA, 8 bp, Artificial sequence
  Synthetic
agtgcact

SEQ ID NO: 16188 - DNA, 15 bp, Artificial sequence
  Synthetic
ctccagttttccagt

SEQ ID NO: 16189 - DNA, 13 bp, Artificial sequence
  Synthetic
gagagggaaaggg

SEQ ID NO: 16190 - DNA, 10 bp, Artificial sequence
  Synthetic
tggtgaactt

SEQ ID NO: 16191 - DNA, 15 bp, Artificial sequence
  Synthetic
ctccagtttccagtt

SEQ ID NO: 16192 - DNA, 10 bp, Artificial sequence
  Synthetic
tgatgttgag

SEQ ID NO: 16193 - DNA, 9 bp, Artificial sequence
  Synthetic
gttaatttt

SEQ ID NO: 16194 - DNA, 17 bp, Artificial sequence
  Synthetic
gaagtccccagttaact

SEQ ID NO: 16195 - DNA, 9 bp, Artificial sequence
  Synthetic
gtgaacttt

SEQ ID NO: 16196 - DNA, 10 bp, Artificial sequence
  Synthetic
ggccccccag

SEQ ID NO: 16197 - DNA, 17 bp, Artificial sequence
  Synthetic
tcttgattaatcacctg

SEQ ID NO: 16198 - DNA, 8 bp, Artificial sequence
  Synthetic
ttagctat

SEQ ID NO: 16199 - DNA, 16 bp, Artificial sequence
  Synthetic
tacttacacgtcagta

SEQ ID NO: 16200 - DNA, 16 bp, Artificial sequence
  Synthetic
cccagttgctcaagtg

SEQ ID NO: 16201 - DNA, 14 bp, Artificial sequence
  Synthetic
ttgcactgagtcgt

SEQ ID NO: 16202 - DNA, 17 bp, Artificial sequence
  Synthetic
tgcatacacgtgtagac

SEQ ID NO: 16203 - DNA, 11 bp, Artificial sequence
  Synthetic
tttagtgtcgt

SEQ ID NO: 16204 - DNA, 10 bp, Artificial sequence
  Synthetic
ttcttgttac

SEQ ID NO: 16205 - DNA, 13 bp, Artificial sequence
  Synthetic
ttcgcgcgggggc

SEQ ID NO: 16206 - DNA, 11 bp, Artificial sequence
  Synthetic
tctgttctatt

SEQ ID NO: 16207 - DNA, 14 bp, Artificial sequence
  Synthetic
aaaaggtacctttt

SEQ ID NO: 16208 - DNA, 13 bp, Artificial sequence
  Synthetic
catttgtatttgt

SEQ ID NO: 16209 - DNA, 8 bp, Artificial sequence
  Synthetic
ggtagggt

SEQ ID NO: 16210 - DNA, 10 bp, Artificial sequence
  Synthetic
ttccccttca

SEQ ID NO: 16211 - DNA, 17 bp, Artificial sequence
  Synthetic
attaattaattattaat

SEQ ID NO: 16212 - DNA, 11 bp, Artificial sequence
  Synthetic
cggtgcactgg

SEQ ID NO: 16213 - DNA, 7 bp, Artificial sequence
  Synthetic
tatgaat

SEQ ID NO: 16214 - DNA, 10 bp, Artificial sequence
  Synthetic
agtctccagt

SEQ ID NO: 16215 - DNA, 8 bp, Artificial sequence
  Synthetic
gttattgt

SEQ ID NO: 16216 - DNA, 10 bp, Artificial sequence
  Synthetic
ttaaatttaa

SEQ ID NO: 16217 - DNA, 14 bp, Artificial sequence
  Synthetic
accgtggtacggtt

SEQ ID NO: 16218 - DNA, 8 bp, Artificial sequence
  Synthetic
tacaaatg

SEQ ID NO: 16219 - DNA, 17 bp, Artificial sequence
  Synthetic
tcatcaattaatcaatg

SEQ ID NO: 16220 - DNA, 14 bp, Artificial sequence
  Synthetic
atacatttgttgtt

SEQ ID NO: 16221 - DNA, 15 bp, Artificial sequence
  Synthetic
gtacagccctgtacg

SEQ ID NO: 16222 - DNA, 17 bp, Artificial sequence
  Synthetic
tcaattaataattggtt

SEQ ID NO: 16223 - DNA, 15 bp, Artificial sequence
  Synthetic
tagttaacgtcacta

SEQ ID NO: 16224 - DNA, 11 bp, Artificial sequence
  Synthetic
gattcatttgt

SEQ ID NO: 16225 - DNA, 11 bp, Artificial sequence
  Synthetic
cgtaattagtt

SEQ ID NO: 16226 - DNA, 13 bp, Artificial sequence
  Synthetic
gtcgagtaattat

SEQ ID NO: 16227 - DNA, 9 bp, Artificial sequence
  Synthetic
ttgggccgg

SEQ ID NO: 16228 - DNA, 17 bp, Artificial sequence
  Synthetic
taataaattaattaatg

SEQ ID NO: 16229 - DNA, 17 bp, Artificial sequence
  Synthetic
aagtatgacctctcttt

SEQ ID NO: 16230 - DNA, 15 bp, Artificial sequence
  Synthetic
gtccgcggcggcggc

SEQ ID NO: 16231 - DNA, 14 bp, Artificial sequence
  Synthetic
tgtaacgtattaat

SEQ ID NO: 16232 - DNA, 11 bp, Artificial sequence
  Synthetic
tttgttacctt

SEQ ID NO: 16233 - DNA, 15 bp, Artificial sequence
  Synthetic
tttacctggttagtc

SEQ ID NO: 16234 - DNA, 17 bp, Artificial sequence
  Synthetic
gcttcattaattaaaag

SEQ ID NO: 16235 - DNA, 10 bp, Artificial sequence
  Synthetic
taaggtctgt

SEQ ID NO: 16236 - DNA, 10 bp, Artificial sequence
  Synthetic
tgggcgtact

SEQ ID NO: 16237 - DNA, 12 bp, Artificial sequence
  Synthetic
tttaaaccgttt

SEQ ID NO: 16238 - DNA, 9 bp, Artificial sequence
  Synthetic
taacgcttt

SEQ ID NO: 16239 - DNA, 13 bp, Artificial sequence
  Synthetic
ctaacaaataaat

SEQ ID NO: 16240 - DNA, 10 bp, Artificial sequence
  Synthetic
gcttatccct

SEQ ID NO: 16241 - DNA, 8 bp, Artificial sequence
  Synthetic
ttcacgct

SEQ ID NO: 16242 - DNA, 9 bp, Artificial sequence
  Synthetic
tggacgtcc

SEQ ID NO: 16243 - DNA, 15 bp, Artificial sequence
  Synthetic
tggcggactccccta

SEQ ID NO: 16244 - DNA, 16 bp, Artificial sequence
  Synthetic
gataaaatgctgaaat

SEQ ID NO: 16245 - DNA, 12 bp, Artificial sequence
  Synthetic
tgggagcttggg

SEQ ID NO: 16246 - DNA, 10 bp, Artificial sequence
  Synthetic
ttcgtgaatt

SEQ ID NO: 16247 - DNA, 10 bp, Artificial sequence
  Synthetic
gtgaaggccg

SEQ ID NO: 16248 - DNA, 12 bp, Artificial sequence
  Synthetic
attaacgttagt

SEQ ID NO: 16249 - DNA, 18 bp, Artificial sequence
  Synthetic
gcagtgcgaactgacgag

SEQ ID NO: 16250 - DNA, 6 bp, Artificial sequence
  Synthetic
attatt

SEQ ID NO: 16251 - DNA, 15 bp, Artificial sequence
  Synthetic
ttattcccgcaccag

SEQ ID NO: 16252 - DNA, 16 bp, Artificial sequence
  Synthetic
attaatcgcgattaat

SEQ ID NO: 16253 - DNA, 11 bp, Artificial sequence
  Synthetic
ggggggcggag

SEQ ID NO: 16254 - DNA, 19 bp, Artificial sequence
  Synthetic
attgatccaatcatccagt

SEQ ID NO: 16255 - DNA, 17 bp, Artificial sequence
  Synthetic
ttccgctttagtagcgt

SEQ ID NO: 16256 - DNA, 7 bp, Artificial sequence
  Synthetic
tagtttc

SEQ ID NO: 16257 - DNA, 8 bp, Artificial sequence
  Synthetic
agtatttt

SEQ ID NO: 16258 - DNA, 5 bp, Artificial sequence
  Synthetic
actgt

SEQ ID NO: 16259 - DNA, 9 bp, Artificial sequence
  Synthetic
taaacgtat

SEQ ID NO: 16260 - DNA, 16 bp, Artificial sequence
  Synthetic
ctcaagtagcccaagt

SEQ ID NO: 16261 - DNA, 10 bp, Artificial sequence
  Synthetic
ggagtccgct

SEQ ID NO: 16262 - DNA, 13 bp, Artificial sequence
  Synthetic
taaaacgttagac

SEQ ID NO: 16263 - DNA, 8 bp, Artificial sequence
  Synthetic
tggtgcac

SEQ ID NO: 16264 - DNA, 9 bp, Artificial sequence
  Synthetic
tactgagtt

SEQ ID NO: 16265 - DNA, 6 bp, Artificial sequence
  Synthetic
taggtg

SEQ ID NO: 16266 - DNA, 12 bp, Artificial sequence
  Synthetic
tttcgttaattc

SEQ ID NO: 16267 - DNA, 8 bp, Artificial sequence
  Synthetic
cgattaat

SEQ ID NO: 16268 - DNA, 9 bp, Artificial sequence
  Synthetic
tactgagta

SEQ ID NO: 16269 - DNA, 12 bp, Artificial sequence
  Synthetic
ttacgcccacac

SEQ ID NO: 16270 - DNA, 18 bp, Artificial sequence
  Synthetic
aatatttatttgtaagtt

SEQ ID NO: 16271 - DNA, 9 bp, Artificial sequence
  Synthetic
ttcgccttc

SEQ ID NO: 16272 - DNA, 11 bp, Artificial sequence
  Synthetic
cttaaatatgg

SEQ ID NO: 16273 - DNA, 9 bp, Artificial sequence
  Synthetic
tggtggacc

SEQ ID NO: 16274 - DNA, 17 bp, Artificial sequence
  Synthetic
atgtacacgtgtatttt

SEQ ID NO: 16275 - DNA, 20 bp, Artificial sequence
  Synthetic
ctaaagggtagtacggaacg

SEQ ID NO: 16276 - DNA, 9 bp, Artificial sequence
  Synthetic
gctattact

SEQ ID NO: 16277 - DNA, 16 bp, Artificial sequence
  Synthetic
tccaattaactcattt

SEQ ID NO: 16278 - DNA, 9 bp, Artificial sequence
  Synthetic
ggtgcgggt

SEQ ID NO: 16279 - DNA, 9 bp, Artificial sequence
  Synthetic
atccggtgt

SEQ ID NO: 16280 - DNA, 9 bp, Artificial sequence
  Synthetic
cctattagg

SEQ ID NO: 16281 - DNA, 11 bp, Artificial sequence
  Synthetic
ccctattaggg

SEQ ID NO: 16282 - DNA, 8 bp, Artificial sequence
  Synthetic
tttgcatc

SEQ ID NO: 16283 - DNA, 9 bp, Artificial sequence
  Synthetic
taacaaaac

SEQ ID NO: 16284 - DNA, 9 bp, Artificial sequence
  Synthetic
taacaaaat

SEQ ID NO: 16285 - DNA, 21 bp, Artificial sequence
  Synthetic
gcggtagaacctactcccgtc

SEQ ID NO: 16286 - DNA, 14 bp, Artificial sequence
  Synthetic
tctttcaagatctt

SEQ ID NO: 16287 - DNA, 13 bp, Artificial sequence
  Synthetic
gtgaaaattaatc

SEQ ID NO: 16288 - DNA, 15 bp, Artificial sequence
  Synthetic
tacgatttttatctt

SEQ ID NO: 16289 - DNA, 11 bp, Artificial sequence
  Synthetic
gctactgcagt

SEQ ID NO: 16290 - DNA, 11 bp, Artificial sequence
  Synthetic
tgggccttcat

SEQ ID NO: 16291 - DNA, 13 bp, Artificial sequence
  Synthetic
ccggtatttagtg

SEQ ID NO: 16292 - DNA, 11 bp, Artificial sequence
  Synthetic
tgggccttcac

SEQ ID NO: 16293 - DNA, 14 bp, Artificial sequence
  Synthetic
attaaccggttaat

SEQ ID NO: 16294 - DNA, 8 bp, Artificial sequence
  Synthetic
ggtgcacc

SEQ ID NO: 16295 - DNA, 13 bp, Artificial sequence
  Synthetic
ctttggagacctt

SEQ ID NO: 16296 - DNA, 10 bp, Artificial sequence
  Synthetic
taacaagacg

SEQ ID NO: 16297 - DNA, 20 bp, Artificial sequence
  Synthetic
gtaaaggcttaaccctttgt

SEQ ID NO: 16298 - DNA, 10 bp, Artificial sequence
  Synthetic
agttcaccct

SEQ ID NO: 16299 - DNA, 9 bp, Artificial sequence
  Synthetic
ttgtccaca

SEQ ID NO: 16300 - DNA, 14 bp, Artificial sequence
  Synthetic
tccccttaaagggg

SEQ ID NO: 16301 - DNA, 8 bp, Artificial sequence
  Synthetic
gcctaatt

SEQ ID NO: 16302 - DNA, 15 bp, Artificial sequence
  Synthetic
caaacaaaacggtct

SEQ ID NO: 16303 - DNA, 10 bp, Artificial sequence
  Synthetic
tggccttcat

SEQ ID NO: 16304 - DNA, 17 bp, Artificial sequence
  Synthetic
gtttcgattaatcaaat

SEQ ID NO: 16305 - DNA, 16 bp, Artificial sequence
  Synthetic
tcaataattactccag

SEQ ID NO: 16306 - DNA, 10 bp, Artificial sequence
  Synthetic
tggccttcac

SEQ ID NO: 16307 - DNA, 7 bp, Artificial sequence
  Synthetic
actgagt

SEQ ID NO: 16308 - DNA, 16 bp, Artificial sequence
  Synthetic
cggacttgaccggtct

SEQ ID NO: 16309 - DNA, 7 bp, Artificial sequence
  Synthetic
cgttaat

SEQ ID NO: 16310 - DNA, 20 bp, Artificial sequence
  Synthetic
tggcccagtgcacgtcttcg

SEQ ID NO: 16311 - DNA, 15 bp, Artificial sequence
  Synthetic
tcctgggccttcatt

SEQ ID NO: 16312 - DNA, 15 bp, Artificial sequence
  Synthetic
ccgtggtcgacgcgg

SEQ ID NO: 16313 - DNA, 10 bp, Artificial sequence
  Synthetic
gtaggtagtt

SEQ ID NO: 16314 - DNA, 12 bp, Artificial sequence
  Synthetic
tacttatacgtt

SEQ ID NO: 16315 - DNA, 6 bp, Artificial sequence
  Synthetic
gcgcgg

SEQ ID NO: 16316 - DNA, 10 bp, Artificial sequence
  Synthetic
aagggccttt

SEQ ID NO: 16317 - DNA, 7 bp, Artificial sequence
  Synthetic
tgttgtg

SEQ ID NO: 16318 - DNA, 12 bp, Artificial sequence
  Synthetic
ttggtgaaggac

SEQ ID NO: 16319 - DNA, 14 bp, Artificial sequence
  Synthetic
tcaaagccaaagcc

SEQ ID NO: 16320 - DNA, 14 bp, Artificial sequence
  Synthetic
tcaaagccaaagct

SEQ ID NO: 16321 - DNA, 7 bp, Artificial sequence
  Synthetic
taattat

SEQ ID NO: 16322 - DNA, 25 bp, Artificial sequence
  Synthetic
ttgtctaccagcgggttggtgacct

SEQ ID NO: 16323 - DNA, 10 bp, Artificial sequence
  Synthetic
ttataactgt

SEQ ID NO: 16324 - DNA, 10 bp, Artificial sequence
  Synthetic
ttccccgccc

SEQ ID NO: 16325 - DNA, 11 bp, Artificial sequence
  Synthetic
ggtgcactagg

SEQ ID NO: 16326 - DNA, 12 bp, Artificial sequence
  Synthetic
gtaacgcagtcc

SEQ ID NO: 16327 - DNA, 13 bp, Artificial sequence
  Synthetic
ccggggcgggggg

SEQ ID NO: 16328 - DNA, 11 bp, Artificial sequence
  Synthetic
agagcattttt

SEQ ID NO: 16329 - DNA, 8 bp, Artificial sequence
  Synthetic
ggaatagt

SEQ ID NO: 16330 - DNA, 10 bp, Artificial sequence
  Synthetic
ggtctacagt

SEQ ID NO: 16331 - DNA, 14 bp, Artificial sequence
  Synthetic
ttgcatttgttgta

SEQ ID NO: 16332 - DNA, 17 bp, Artificial sequence
  Synthetic
tagaagaatagtcaaat

SEQ ID NO: 16333 - DNA, 16 bp, Artificial sequence
  Synthetic
tggcaattttggcaat

SEQ ID NO: 16334 - DNA, 13 bp, Artificial sequence
  Synthetic
gggggcgggggcg

SEQ ID NO: 16335 - DNA, 16 bp, Artificial sequence
  Synthetic
tttaataacaagaatt

SEQ ID NO: 16336 - DNA, 7 bp, Artificial sequence
  Synthetic
gtggacc

SEQ ID NO: 16337 - DNA, 18 bp, Artificial sequence
  Synthetic
ccacactttaaagtgtgg

SEQ ID NO: 16338 - DNA, 12 bp, Artificial sequence
  Synthetic
aaagggcggttt

SEQ ID NO: 16339 - DNA, 8 bp, Artificial sequence
  Synthetic
gtggacag

SEQ ID NO: 16340 - DNA, 11 bp, Artificial sequence
  Synthetic
tcggttagtcg

SEQ ID NO: 16341 - DNA, 9 bp, Artificial sequence
  Synthetic
cactgcatt

SEQ ID NO: 16342 - DNA, 12 bp, Artificial sequence
  Synthetic
ccactgcattgg

SEQ ID NO: 16343 - DNA, 14 bp, Artificial sequence
  Synthetic
gtggtcccccgtcg

SEQ ID NO: 16344 - DNA, 17 bp, Artificial sequence
  Synthetic
tatcaattagggggagt

SEQ ID NO: 16345 - DNA, 12 bp, Artificial sequence
  Synthetic
catttgttatct

SEQ ID NO: 16346 - DNA, 10 bp, Artificial sequence
  Synthetic
ttgagagcgc

SEQ ID NO: 16347 - DNA, 11 bp, Artificial sequence
  Synthetic
tcagcattttt

SEQ ID NO: 16348 - DNA, 9 bp, Artificial sequence
  Synthetic
tttacgact

SEQ ID NO: 16349 - DNA, 17 bp, Artificial sequence
  Synthetic
acgtgattaatcacctt

SEQ ID NO: 16350 - DNA, 17 bp, Artificial sequence
  Synthetic
ttagttattgtaactag

SEQ ID NO: 16351 - DNA, 9 bp, Artificial sequence
  Synthetic
ttttgtttt

SEQ ID NO: 16352 - DNA, 15 bp, Artificial sequence
  Synthetic
cccccccccccccct

SEQ ID NO: 16353 - DNA, 24 bp, Artificial sequence
  Synthetic
taaccggtcgcaccgacagtcagt

SEQ ID NO: 16354 - DNA, 12 bp, Artificial sequence
  Synthetic
tcacccgcaccg

SEQ ID NO: 16355 - DNA, 10 bp, Artificial sequence
  Synthetic
tttggcctat

SEQ ID NO: 16356 - DNA, 10 bp, Artificial sequence
  Synthetic
ttccactgga

SEQ ID NO: 16357 - DNA, 11 bp, Artificial sequence
  Synthetic
ccggtattttt

SEQ ID NO: 16358 - DNA, 15 bp, Artificial sequence
  Synthetic
ttggtggacaacgag

SEQ ID NO: 16359 - DNA, 9 bp, Artificial sequence
  Synthetic
tcgctaatt

SEQ ID NO: 16360 - DNA, 10 bp, Artificial sequence
  Synthetic
tcccaagttt

SEQ ID NO: 16361 - DNA, 11 bp, Artificial sequence
  Synthetic
atactggaact

SEQ ID NO: 16362 - DNA, 14 bp, Artificial sequence
  Synthetic
gactggaccttgag

SEQ ID NO: 16363 - DNA, 18 bp, Artificial sequence
  Synthetic
tccagtcccactggacct

SEQ ID NO: 16364 - DNA, 10 bp, Artificial sequence
  Synthetic
ggtttagccc

SEQ ID NO: 16365 - DNA, 20 bp, Artificial sequence
  Synthetic
ggggccggggcggggggggg

SEQ ID NO: 16366 - DNA, 12 bp, Artificial sequence
  Synthetic
acgggggcccgt

SEQ ID NO: 16367 - DNA, 8 bp, Artificial sequence
  Synthetic
tgaaggac

SEQ ID NO: 16368 - DNA, 15 bp, Artificial sequence
  Synthetic
tggcggagtccgcca

SEQ ID NO: 16369 - DNA, 8 bp, Artificial sequence
  Synthetic
tgaaggag

SEQ ID NO: 16370 - DNA, 14 bp, Artificial sequence
  Synthetic
tttcagttttcagt

SEQ ID NO: 16371 - DNA, 11 bp, Artificial sequence
  Synthetic
agttcgcactt

SEQ ID NO: 16372 - DNA, 17 bp, Artificial sequence
  Synthetic
atatctagtttcctttt

SEQ ID NO: 16373 - DNA, 20 bp, Artificial sequence
  Synthetic
gtaaggactccctactgaat

SEQ ID NO: 16374 - DNA, 10 bp, Artificial sequence
  Synthetic
tgacatagtt

SEQ ID NO: 16375 - DNA, 13 bp, Artificial sequence
  Synthetic
gactggagaccgg

SEQ ID NO: 16376 - DNA, 13 bp, Artificial sequence
  Synthetic
ttttcatccagtc

SEQ ID NO: 16377 - DNA, 11 bp, Artificial sequence
  Synthetic
aagttccagtt

SEQ ID NO: 16378 - DNA, 9 bp, Artificial sequence
  Synthetic
tagtcgacc

SEQ ID NO: 16379 - DNA, 7 bp, Artificial sequence
  Synthetic
atgcagt

SEQ ID NO: 16380 - DNA, 13 bp, Artificial sequence
  Synthetic
gaaggttttactg

SEQ ID NO: 16381 - DNA, 10 bp, Artificial sequence
  Synthetic
cctttaaggg

SEQ ID NO: 16382 - DNA, 11 bp, Artificial sequence
  Synthetic
tattccttcat

SEQ ID NO: 16383 - DNA, 9 bp, Artificial sequence
  Synthetic
tagtcgact

SEQ ID NO: 16384 - DNA, 14 bp, Artificial sequence
  Synthetic
tacttattaattac

SEQ ID NO: 16385 - DNA, 8 bp, Artificial sequence
  Synthetic
taaaggac

SEQ ID NO: 16386 - DNA, 14 bp, Artificial sequence
  Synthetic
ttacggtgcagtag

SEQ ID NO: 16387 - DNA, 10 bp, Artificial sequence
  Synthetic
taataaatac

SEQ ID NO: 16388 - DNA, 8 bp, Artificial sequence
  Synthetic
ttaattag

SEQ ID NO: 16389 - DNA, 9 bp, Artificial sequence
  Synthetic
ggtaacaag

SEQ ID NO: 16390 - DNA, 17 bp, Artificial sequence
  Synthetic
gtacttatggtaagtag

SEQ ID NO: 16391 - DNA, 17 bp, Artificial sequence
  Synthetic
agggtgattaatcgcgt

SEQ ID NO: 16392 - DNA, 12 bp, Artificial sequence
  Synthetic
ctttattaatgg

SEQ ID NO: 16393 - DNA, 9 bp, Artificial sequence
  Synthetic
gtgggggac

SEQ ID NO: 16394 - DNA, 15 bp, Artificial sequence
  Synthetic
cgtggggacccacgg

SEQ ID NO: 16395 - DNA, 11 bp, Artificial sequence
  Synthetic
tctacgaatag

SEQ ID NO: 16396 - DNA, 10 bp, Artificial sequence
  Synthetic
cccttagggg

SEQ ID NO: 16397 - DNA, 18 bp, Artificial sequence
  Synthetic
ccgcgggggaccaccggt

SEQ ID NO: 16398 - DNA, 11 bp, Artificial sequence
  Synthetic
attaatcgatt

SEQ ID NO: 16399 - DNA, 16 bp, Artificial sequence
  Synthetic
tgcaattaattgggtc

SEQ ID NO: 16400 - DNA, 10 bp, Artificial sequence
  Synthetic
tgaaggccag

SEQ ID NO: 16401 - DNA, 10 bp, Artificial sequence
  Synthetic
tactcagtgg

SEQ ID NO: 16402 - DNA, 10 bp, Artificial sequence
  Synthetic
gaattaatgg

SEQ ID NO: 16403 - DNA, 15 bp, Artificial sequence
  Synthetic
gggggcgggtgcgtg

SEQ ID NO: 16404 - DNA, 17 bp, Artificial sequence
  Synthetic
ttaaaagttcaccaatt

SEQ ID NO: 16405 - DNA, 9 bp, Artificial sequence
  Synthetic
tgtggacga

SEQ ID NO: 16406 - DNA, 15 bp, Artificial sequence
  Synthetic
tattaggccctggtg

SEQ ID NO: 16407 - DNA, 17 bp, Artificial sequence
  Synthetic
cagccattaatatcgct

SEQ ID NO: 16408 - DNA, 26 bp, Artificial sequence
  Synthetic
taaattggtaatattggttaattatt

SEQ ID NO: 16409 - DNA, 15 bp, Artificial sequence
  Synthetic
gtacctcaaaaggtg

SEQ ID NO: 16410 - DNA, 17 bp, Artificial sequence
  Synthetic
ttttatacgtattattt

SEQ ID NO: 16411 - DNA, 10 bp, Artificial sequence
  Synthetic
ttgtggacac

SEQ ID NO: 16412 - DNA, 12 bp, Artificial sequence
  Synthetic
ggcgagtcggcg

SEQ ID NO: 16413 - DNA, 9 bp, Artificial sequence
  Synthetic
ggtgaactc

SEQ ID NO: 16414 - DNA, 14 bp, Artificial sequence
  Synthetic
gtcccagtctcgcc

SEQ ID NO: 16415 - DNA, 18 bp, Artificial sequence
  Synthetic
tttccagtggtctccagt

SEQ ID NO: 16416 - DNA, 13 bp, Artificial sequence
  Synthetic
tatatcttgtaag

SEQ ID NO: 16417 - DNA, 18 bp, Artificial sequence
  Synthetic
ggaatagacggggggggt

SEQ ID NO: 16418 - DNA, 15 bp, Artificial sequence
  Synthetic
ggggagggggtgggg

SEQ ID NO: 16419 - DNA, 11 bp, Artificial sequence
  Synthetic
ttaacacgtta

SEQ ID NO: 16420 - DNA, 12 bp, Artificial sequence
  Synthetic
ttttgctaatat

SEQ ID NO: 16421 - DNA, 7 bp, Artificial sequence
  Synthetic
gtaattg

SEQ ID NO: 16422 - DNA, 14 bp, Artificial sequence
  Synthetic
gctactgcagtagc

SEQ ID NO: 16423 - DNA, 10 bp, Artificial sequence
  Synthetic
ggattaatgg

SEQ ID NO: 16424 - DNA, 12 bp, Artificial sequence
  Synthetic
cccagtactggg

SEQ ID NO: 16425 - DNA, 13 bp, Artificial sequence
  Synthetic
ctgaaaagaccct

SEQ ID NO: 16426 - DNA, 18 bp, Artificial sequence
  Synthetic
gaccccccccgtctattc

SEQ ID NO: 16427 - DNA, 18 bp, Artificial sequence
  Synthetic
gaccacccccgtctattc

SEQ ID NO: 16428 - DNA, 10 bp, Artificial sequence
  Synthetic
actcagtagt

SEQ ID NO: 16429 - DNA, 18 bp, Artificial sequence
  Synthetic
ggaaggaaggaaggaagg

SEQ ID NO: 16430 - DNA, 14 bp, Artificial sequence
  Synthetic
cccagtgcacaggt

SEQ ID NO: 16431 - DNA, 11 bp, Artificial sequence
  Synthetic
tggggcggggg

SEQ ID NO: 16432 - DNA, 10 bp, Artificial sequence
  Synthetic
tcgcactggc

SEQ ID NO: 16433 - DNA, 13 bp, Artificial sequence
  Synthetic
gaaaagacccttt

SEQ ID NO: 16434 - DNA, 12 bp, Artificial sequence
  Synthetic
tttaacacgtta

SEQ ID NO: 16435 - DNA, 9 bp, Artificial sequence
  Synthetic
catgcactg

SEQ ID NO: 16436 - DNA, 16 bp, Artificial sequence
  Synthetic
attggcgtttggcgtt

SEQ ID NO: 16437 - DNA, 17 bp, Artificial sequence
  Synthetic
ttaattaattaattaag

SEQ ID NO: 16438 - DNA, 17 bp, Artificial sequence
  Synthetic
ggcgagggtcgccgacg

SEQ ID NO: 16439 - DNA, 8 bp, Artificial sequence
  Synthetic
gtagttag

SEQ ID NO: 16440 - DNA, 11 bp, Artificial sequence
  Synthetic
tagtcgaccag

SEQ ID NO: 16441 - DNA, 15 bp, Artificial sequence
  Synthetic
gggactggaaacggg

SEQ ID NO: 16442 - DNA, 13 bp, Artificial sequence
  Synthetic
tctcccccgggat

SEQ ID NO: 16443 - DNA, 15 bp, Artificial sequence
  Synthetic
tcatgaaggcccagt

SEQ ID NO: 16444 - DNA, 10 bp, Artificial sequence
  Synthetic
tgcgcactgc

SEQ ID NO: 16445 - DNA, 10 bp, Artificial sequence
  Synthetic
tctaaactta

SEQ ID NO: 16446 - DNA, 6 bp, Artificial sequence
  Synthetic
tggtgt

SEQ ID NO: 16447 - DNA, 17 bp, Artificial sequence
  Synthetic
atttcttgttatctatt

SEQ ID NO: 16448 - DNA, 12 bp, Artificial sequence
  Synthetic
gtactgagtctg

SEQ ID NO: 16449 - DNA, 8 bp, Artificial sequence
  Synthetic
ttgtttcc

SEQ ID NO: 16450 - DNA, 11 bp, Artificial sequence
  Synthetic
ctactgagtag

SEQ ID NO: 16451 - DNA, 21 bp, Artificial sequence
  Synthetic
tttaaagcagtgccaattcca

SEQ ID NO: 16452 - DNA, 16 bp, Artificial sequence
  Synthetic
gcaatggtaccgttgc

SEQ ID NO: 16453 - DNA, 15 bp, Artificial sequence
  Synthetic
agagctatactgagt

SEQ ID NO: 16454 - DNA, 18 bp, Artificial sequence
  Synthetic
actggcggtcactggggt

SEQ ID NO: 16455 - DNA, 8 bp, Artificial sequence
  Synthetic
ccaacggt

SEQ ID NO: 16456 - DNA, 14 bp, Artificial sequence
  Synthetic
cgacaccaaaaggg

SEQ ID NO: 16457 - DNA, 14 bp, Artificial sequence
  Synthetic
cgtgggttcccacg

SEQ ID NO: 16458 - DNA, 13 bp, Artificial sequence
  Synthetic
acgggggccccgt

SEQ ID NO: 16459 - DNA, 15 bp, Artificial sequence
  Synthetic
tcggagtcccgtacc

SEQ ID NO: 16460 - DNA, 12 bp, Artificial sequence
  Synthetic
ccagtttccagt

SEQ ID NO: 16461 - DNA, 18 bp, Artificial sequence
  Synthetic
gggggccgatcgcactct

SEQ ID NO: 16462 - DNA, 8 bp, Artificial sequence
  Synthetic
gttatagc

SEQ ID NO: 16463 - DNA, 10 bp, Artificial sequence
  Synthetic
ggtatcgttg

SEQ ID NO: 16464 - DNA, 14 bp, Artificial sequence
  Synthetic
actcatttgttttt

SEQ ID NO: 16465 - DNA, 11 bp, Artificial sequence
  Synthetic
cgtcctttact

SEQ ID NO: 16466 - DNA, 8 bp, Artificial sequence
  Synthetic
tctcaagt

SEQ ID NO: 16467 - DNA, 9 bp, Artificial sequence
  Synthetic
atcctatct

SEQ ID NO: 16468 - DNA, 10 bp, Artificial sequence
  Synthetic
gccttcagcg

SEQ ID NO: 16469 - DNA, 17 bp, Artificial sequence
  Synthetic
gtgttaattaattgcgc

SEQ ID NO: 16470 - DNA, 15 bp, Artificial sequence
  Synthetic
caattaggctaattg

SEQ ID NO: 16471 - DNA, 14 bp, Artificial sequence
  Synthetic
tcggaacccctccc

SEQ ID NO: 16472 - DNA, 8 bp, Artificial sequence
  Synthetic
tattaacg

SEQ ID NO: 16473 - DNA, 8 bp, Artificial sequence
  Synthetic
tattaacc

SEQ ID NO: 16474 - DNA, 16 bp, Artificial sequence
  Synthetic
cggtaggttttacttg

SEQ ID NO: 16475 - DNA, 11 bp, Artificial sequence
  Synthetic
taacgtgttat

SEQ ID NO: 16476 - DNA, 14 bp, Artificial sequence
  Synthetic
agcattttgacagt

SEQ ID NO: 16477 - DNA, 17 bp, Artificial sequence
  Synthetic
ccggcaatattggcaat

SEQ ID NO: 16478 - DNA, 16 bp, Artificial sequence
  Synthetic
tttaattaaccaaaac

SEQ ID NO: 16479 - DNA, 17 bp, Artificial sequence
  Synthetic
tcttcttgtttcctgat

SEQ ID NO: 16480 - DNA, 10 bp, Artificial sequence
  Synthetic
ggtgcacgag

SEQ ID NO: 16481 - DNA, 8 bp, Artificial sequence
  Synthetic
cctcaagt

SEQ ID NO: 16482 - DNA, 12 bp, Artificial sequence
  Synthetic
gcgggggggggg

SEQ ID NO: 16483 - DNA, 12 bp, Artificial sequence
  Synthetic
tgtagttagttt

SEQ ID NO: 16484 - DNA, 12 bp, Artificial sequence
  Synthetic
cagaaagatctt

SEQ ID NO: 16485 - DNA, 10 bp, Artificial sequence
  Synthetic
gtctattctt

SEQ ID NO: 16486 - DNA, 11 bp, Artificial sequence
  Synthetic
tggttaatttt

SEQ ID NO: 16487 - DNA, 17 bp, Artificial sequence
  Synthetic
gttcaattaattattag

SEQ ID NO: 16488 - DNA, 9 bp, Artificial sequence
  Synthetic
ggaccaatt

SEQ ID NO: 16489 - DNA, 8 bp, Artificial sequence
  Synthetic
ggcgcgcg

SEQ ID NO: 16490 - DNA, 15 bp, Artificial sequence
  Synthetic
tttttgcctaataac

SEQ ID NO: 16491 - DNA, 9 bp, Artificial sequence
  Synthetic
tgatctccc

SEQ ID NO: 16492 - DNA, 7 bp, Artificial sequence
  Synthetic
gacagtg

SEQ ID NO: 16493 - DNA, 17 bp, Artificial sequence
  Synthetic
ttagttaaagtcactaa

SEQ ID NO: 16494 - DNA, 7 bp, Artificial sequence
  Synthetic
gacagtt

SEQ ID NO: 16495 - DNA, 13 bp, Artificial sequence
  Synthetic
acgggagtcccgt

SEQ ID NO: 16496 - DNA, 7 bp, Artificial sequence
  Synthetic
ccatagt

SEQ ID NO: 16497 - DNA, 9 bp, Artificial sequence
  Synthetic
gcgattaat

SEQ ID NO: 16498 - DNA, 11 bp, Artificial sequence
  Synthetic
aggacaaatgt

SEQ ID NO: 16499 - DNA, 7 bp, Artificial sequence
  Synthetic
acctttt

SEQ ID NO: 16500 - DNA, 20 bp, Artificial sequence
  Synthetic
tattttttgttgtgtttatt

SEQ ID NO: 16501 - DNA, 10 bp, Artificial sequence
  Synthetic
gattaattct

SEQ ID NO: 16502 - DNA, 18 bp, Artificial sequence
  Synthetic
ttaaaaccgcggttttac

SEQ ID NO: 16503 - DNA, 12 bp, Artificial sequence
  Synthetic
gttgcaggcgcc

SEQ ID NO: 16504 - DNA, 15 bp, Artificial sequence
  Synthetic
ggcccggtgcactgg

SEQ ID NO: 16505 - DNA, 8 bp, Artificial sequence
  Synthetic
tgaaggcc

SEQ ID NO: 16506 - DNA, 10 bp, Artificial sequence
  Synthetic
ggggtggggg

SEQ ID NO: 16507 - DNA, 16 bp, Artificial sequence
  Synthetic
ttccattaatggatta

SEQ ID NO: 16508 - DNA, 15 bp, Artificial sequence
  Synthetic
ctactcagtgggggg

SEQ ID NO: 16509 - DNA, 16 bp, Artificial sequence
  Synthetic
tgctgattaatcctca

SEQ ID NO: 16510 - DNA, 19 bp, Artificial sequence
  Synthetic
cgcctgcaagttgcaggcg

SEQ ID NO: 16511 - DNA, 12 bp, Artificial sequence
  Synthetic
gcccactgcagg

SEQ ID NO: 16512 - DNA, 12 bp, Artificial sequence
  Synthetic
ggctaaaaaagg

SEQ ID NO: 16513 - DNA, 12 bp, Artificial sequence
  Synthetic
ttacatttgtat

SEQ ID NO: 16514 - DNA, 8 bp, Artificial sequence
  Synthetic
cgcgcttt

SEQ ID NO: 16515 - DNA, 17 bp, Artificial sequence
  Synthetic
cgggggtggaggggcgg

SEQ ID NO: 16516 - DNA, 16 bp, Artificial sequence
  Synthetic
tcgtggtacctgtcgc

SEQ ID NO: 16517 - DNA, 12 bp, Artificial sequence
  Synthetic
tctacgttaggg

SEQ ID NO: 16518 - DNA, 16 bp, Artificial sequence
  Synthetic
gacaggtaccacgact

SEQ ID NO: 16519 - DNA, 11 bp, Artificial sequence
  Synthetic
taaaatgctgg

SEQ ID NO: 16520 - DNA, 23 bp, Artificial sequence
  Synthetic
agaaaattaaacgtattagtatt

SEQ ID NO: 16521 - DNA, 16 bp, Artificial sequence
  Synthetic
cgggtgatctcccgtg

SEQ ID NO: 16522 - DNA, 18 bp, Artificial sequence
  Synthetic
ccataaaccgttacgtgt

SEQ ID NO: 16523 - DNA, 6 bp, Artificial sequence
  Synthetic
ccccgt

SEQ ID NO: 16524 - DNA, 7 bp, Artificial sequence
  Synthetic
catttgt

SEQ ID NO: 16525 - DNA, 9 bp, Artificial sequence
  Synthetic
ctggtgggt

SEQ ID NO: 16526 - DNA, 17 bp, Artificial sequence
  Synthetic
tatttactgtggatagt

SEQ ID NO: 16527 - DNA, 9 bp, Artificial sequence
  Synthetic
ctggtgggg

SEQ ID NO: 16528 - DNA, 12 bp, Artificial sequence
  Synthetic
gcgggcggccgc

SEQ ID NO: 16529 - DNA, 14 bp, Artificial sequence
  Synthetic
gtaaatgtatttgt

SEQ ID NO: 16530 - DNA, 11 bp, Artificial sequence
  Synthetic
ttcattaatga

SEQ ID NO: 16531 - DNA, 17 bp, Artificial sequence
  Synthetic
cttaaaattaatttggg

SEQ ID NO: 16532 - DNA, 15 bp, Artificial sequence
  Synthetic
taaagagtcctttac

SEQ ID NO: 16533 - DNA, 18 bp, Artificial sequence
  Synthetic
ctccccacgggcgtccgg

SEQ ID NO: 16534 - DNA, 7 bp, Artificial sequence
  Synthetic
ttcactt

SEQ ID NO: 16535 - DNA, 16 bp, Artificial sequence
  Synthetic
tggttcattaaggatc

SEQ ID NO: 16536 - DNA, 9 bp, Artificial sequence
  Synthetic
gtgtggacc

SEQ ID NO: 16537 - DNA, 17 bp, Artificial sequence
  Synthetic
ctccccccgccccgatt

SEQ ID NO: 16538 - DNA, 18 bp, Artificial sequence
  Synthetic
cactggagtattccagtg

SEQ ID NO: 16539 - DNA, 17 bp, Artificial sequence
  Synthetic
atgtgattaatcaccgt

SEQ ID NO: 16540 - DNA, 14 bp, Artificial sequence
  Synthetic
ttggtgttgtgtat

SEQ ID NO: 16541 - DNA, 7 bp, Artificial sequence
  Synthetic
ttactat

SEQ ID NO: 16542 - DNA, 8 bp, Artificial sequence
  Synthetic
tccttcag

SEQ ID NO: 16543 - DNA, 8 bp, Artificial sequence
  Synthetic
gtccttcc

SEQ ID NO: 16544 - DNA, 14 bp, Artificial sequence
  Synthetic
ctttcactttcact

SEQ ID NO: 16545 - DNA, 7 bp, Artificial sequence
  Synthetic
tcgtttg

SEQ ID NO: 16546 - DNA, 8 bp, Artificial sequence
  Synthetic
tttaagga

SEQ ID NO: 16547 - DNA, 11 bp, Artificial sequence
  Synthetic
agagtggactt

SEQ ID NO: 16548 - DNA, 21 bp, Artificial sequence
  Synthetic
gggccgcgggggaccaccggc

SEQ ID NO: 16549 - DNA, 17 bp, Artificial sequence
  Synthetic
cccttgtgccacatggg

SEQ ID NO: 16550 - DNA, 9 bp, Artificial sequence
  Synthetic
cttttttag

SEQ ID NO: 16551 - DNA, 18 bp, Artificial sequence
  Synthetic
cgttaatttttggttaat

SEQ ID NO: 16552 - DNA, 6 bp, Artificial sequence
  Synthetic
acggtt

SEQ ID NO: 16553 - DNA, 11 bp, Artificial sequence
  Synthetic
gtgactgcagt

SEQ ID NO: 16554 - DNA, 15 bp, Artificial sequence
  Synthetic
ggggcccgtgggccc

SEQ ID NO: 16555 - DNA, 10 bp, Artificial sequence
  Synthetic
taattaatta

SEQ ID NO: 16556 - DNA, 13 bp, Artificial sequence
  Synthetic
tggagtaatgctc

SEQ ID NO: 16557 - DNA, 19 bp, Artificial sequence
  Synthetic
gttttcgttagttggcact

SEQ ID NO: 16558 - DNA, 10 bp, Artificial sequence
  Synthetic
gcaacgattc

SEQ ID NO: 16559 - DNA, 18 bp, Artificial sequence
  Synthetic
cactggatgaaggaccgt

SEQ ID NO: 16560 - DNA, 11 bp, Artificial sequence
  Synthetic
ggccttcaccg

SEQ ID NO: 16561 - DNA, 14 bp, Artificial sequence
  Synthetic
gtacgtatacgttt

SEQ ID NO: 16562 - DNA, 16 bp, Artificial sequence
  Synthetic
ccacactatagtgtgg

SEQ ID NO: 16563 - DNA, 22 bp, Artificial sequence
  Synthetic
ctccccgcgtcgacgcggggtt

SEQ ID NO: 16564 - DNA, 18 bp, Artificial sequence
  Synthetic
tcctgtttcaagtgaact

SEQ ID NO: 16565 - DNA, 14 bp, Artificial sequence
  Synthetic
tttaccgcggtaaa

SEQ ID NO: 16566 - DNA, 15 bp, Artificial sequence
  Synthetic
acgactgagtcgttt

SEQ ID NO: 16567 - DNA, 9 bp, Artificial sequence
  Synthetic
gtttccagt

SEQ ID NO: 16568 - DNA, 8 bp, Artificial sequence
  Synthetic
taatgttc

SEQ ID NO: 16569 - DNA, 9 bp, Artificial sequence
  Synthetic
ttgtatacc

SEQ ID NO: 16570 - DNA, 12 bp, Artificial sequence
  Synthetic
ttaacgcagtga

SEQ ID NO: 16571 - DNA, 11 bp, Artificial sequence
  Synthetic
ccctttaaggg

SEQ ID NO: 16572 - DNA, 10 bp, Artificial sequence
  Synthetic
gggaccgttg

SEQ ID NO: 16573 - DNA, 10 bp, Artificial sequence
  Synthetic
ttactgagta

SEQ ID NO: 16574 - DNA, 15 bp, Artificial sequence
  Synthetic
gcagcggtaccgttg

SEQ ID NO: 16575 - DNA, 7 bp, Artificial sequence
  Synthetic
tgaagga

SEQ ID NO: 16576 - DNA, 16 bp, Artificial sequence
  Synthetic
tctggggggtgcttcg

SEQ ID NO: 16577 - DNA, 12 bp, Artificial sequence
  Synthetic
taaaaaggagac

SEQ ID NO: 16578 - DNA, 11 bp, Artificial sequence
  Synthetic
tcgttaatttt

SEQ ID NO: 16579 - DNA, 16 bp, Artificial sequence
  Synthetic
tgccattaatcgagta

SEQ ID NO: 16580 - DNA, 12 bp, Artificial sequence
  Synthetic
ctaaattgtatt

SEQ ID NO: 16581 - DNA, 8 bp, Artificial sequence
  Synthetic
ttttatcg

SEQ ID NO: 16582 - DNA, 15 bp, Artificial sequence
  Synthetic
gggccagtgcactgg

SEQ ID NO: 16583 - DNA, 11 bp, Artificial sequence
  Synthetic
ttaaacgtata

SEQ ID NO: 16584 - DNA, 10 bp, Artificial sequence
  Synthetic
ttactgtgat

SEQ ID NO: 16585 - DNA, 9 bp, Artificial sequence
  Synthetic
ggttagtcg

SEQ ID NO: 16586 - DNA, 16 bp, Artificial sequence
  Synthetic
tgccattaatcgagtc

SEQ ID NO: 16587 - DNA, 6 bp, Artificial sequence
  Synthetic
gttaat

SEQ ID NO: 16588 - DNA, 10 bp, Artificial sequence
  Synthetic
cgtctattgt

SEQ ID NO: 16589 - DNA, 10 bp, Artificial sequence
  Synthetic
ctaacgcatt

SEQ ID NO: 16590 - DNA, 10 bp, Artificial sequence
  Synthetic
gactcagtgg

SEQ ID NO: 16591 - DNA, 24 bp, Artificial sequence
  Synthetic
taatttactgtgcagtagaaagtc

SEQ ID NO: 16592 - DNA, 16 bp, Artificial sequence
  Synthetic
cagaattaatcacgtg

SEQ ID NO: 16593 - DNA, 12 bp, Artificial sequence
  Synthetic
gcaatgtattgc

SEQ ID NO: 16594 - DNA, 16 bp, Artificial sequence
  Synthetic
gtttgcatttgttagg

SEQ ID NO: 16595 - DNA, 13 bp, Artificial sequence
  Synthetic
gtggtgcacccgt

SEQ ID NO: 16596 - DNA, 12 bp, Artificial sequence
  Synthetic
ctttgtagacct

SEQ ID NO: 16597 - DNA, 13 bp, Artificial sequence
  Synthetic
ccataagggtcat

SEQ ID NO: 16598 - DNA, 10 bp, Artificial sequence
  Synthetic
ttgtaccgcc

SEQ ID NO: 16599 - DNA, 10 bp, Artificial sequence
  Synthetic
ggtttaaacc

SEQ ID NO: 16600 - DNA, 9 bp, Artificial sequence
  Synthetic
tttccagtt

SEQ ID NO: 16601 - DNA, 9 bp, Artificial sequence
  Synthetic
tttccagtg

SEQ ID NO: 16602 - DNA, 15 bp, Artificial sequence
  Synthetic
ttcggagcaccggtc

SEQ ID NO: 16603 - DNA, 11 bp, Artificial sequence
  Synthetic
gtcgtggggcc

SEQ ID NO: 16604 - DNA, 8 bp, Artificial sequence
  Synthetic
gtcgaccg

SEQ ID NO: 16605 - DNA, 15 bp, Artificial sequence
  Synthetic
ggcggtcccccgcgg

SEQ ID NO: 16606 - DNA, 17 bp, Artificial sequence
  Synthetic
ggtggtcccccgcggcc

SEQ ID NO: 16607 - DNA, 11 bp, Artificial sequence
  Synthetic
tttgtacatga

SEQ ID NO: 16608 - DNA, 11 bp, Artificial sequence
  Synthetic
taaaataccgg

SEQ ID NO: 16609 - DNA, 10 bp, Artificial sequence
  Synthetic
aacatttgtt

SEQ ID NO: 16610 - DNA, 17 bp, Artificial sequence
  Synthetic
gcgtaattaattaaccg

SEQ ID NO: 16611 - DNA, 15 bp, Artificial sequence
  Synthetic
ggtcatacttaagag

SEQ ID NO: 16612 - DNA, 10 bp, Artificial sequence
  Synthetic
actgagtcgt

SEQ ID NO: 16613 - DNA, 15 bp, Artificial sequence
  Synthetic
ttagttatctaacct

SEQ ID NO: 16614 - DNA, 9 bp, Artificial sequence
  Synthetic
tgattaatc

SEQ ID NO: 16615 - DNA, 9 bp, Artificial sequence
  Synthetic
tctccagtg

SEQ ID NO: 16616 - DNA, 9 bp, Artificial sequence
  Synthetic
tctccagtt

SEQ ID NO: 16617 - DNA, 9 bp, Artificial sequence
  Synthetic
aagggcctt

SEQ ID NO: 16618 - DNA, 9 bp, Artificial sequence
  Synthetic
taatgtact

SEQ ID NO: 16619 - DNA, 20 bp, Artificial sequence
  Synthetic
gggggggggggcgggtgcgt

SEQ ID NO: 16620 - DNA, 12 bp, Artificial sequence
  Synthetic
cgatatttatcg

SEQ ID NO: 16621 - DNA, 9 bp, Artificial sequence
  Synthetic
gtgtaccgg

SEQ ID NO: 16622 - DNA, 10 bp, Artificial sequence
  Synthetic
tcaaaataac

SEQ ID NO: 16623 - DNA, 11 bp, Artificial sequence
  Synthetic
gtggccttcat

SEQ ID NO: 16624 - DNA, 14 bp, Artificial sequence
  Synthetic
ctactgcagtgggg

SEQ ID NO: 16625 - DNA, 14 bp, Artificial sequence
  Synthetic
cacggcacacgttt

SEQ ID NO: 16626 - DNA, 10 bp, Artificial sequence
  Synthetic
tcgcggggga

SEQ ID NO: 16627 - DNA, 12 bp, Artificial sequence
  Synthetic
ttatttgtttgt

SEQ ID NO: 16628 - DNA, 13 bp, Artificial sequence
  Synthetic
cccagtgcactgg

SEQ ID NO: 16629 - DNA, 6 bp, Artificial sequence
  Synthetic
acagtt

SEQ ID NO: 16630 - DNA, 15 bp, Artificial sequence
  Synthetic
ggtcggtgtgggtgg

SEQ ID NO: 16631 - DNA, 10 bp, Artificial sequence
  Synthetic
tctgttcagg

SEQ ID NO: 16632 - DNA, 10 bp, Artificial sequence
  Synthetic
gggatagtgc

SEQ ID NO: 16633 - DNA, 12 bp, Artificial sequence
  Synthetic
cccctaaagggt

SEQ ID NO: 16634 - DNA, 18 bp, Artificial sequence
  Synthetic
atgtttgtttcattattt

SEQ ID NO: 16635 - DNA, 29 bp, Artificial sequence
  Synthetic
gtggacaagttaaaccgtgcctcggttgt

SEQ ID NO: 16636 - DNA, 10 bp, Artificial sequence
  Synthetic
tattacgtat

SEQ ID NO: 16637 - DNA, 10 bp, Artificial sequence
  Synthetic
aaccgcggtt

SEQ ID NO: 16638 - DNA, 17 bp, Artificial sequence
  Synthetic
tttcgattaatcgcttt

SEQ ID NO: 16639 - DNA, 13 bp, Artificial sequence
  Synthetic
tttaaggaccctt

SEQ ID NO: 16640 - DNA, 11 bp, Artificial sequence
  Synthetic
ggcgggtgcgg

SEQ ID NO: 16641 - DNA, 13 bp, Artificial sequence
  Synthetic
ttcaagttccagt

SEQ ID NO: 16642 - DNA, 19 bp, Artificial sequence
  Synthetic
ggaatagacgggggtggtc

SEQ ID NO: 16643 - DNA, 13 bp, Artificial sequence
  Synthetic
gtgttatgattgg

SEQ ID NO: 16644 - DNA, 10 bp, Artificial sequence
  Synthetic
ttacatttgt

SEQ ID NO: 16645 - DNA, 11 bp, Artificial sequence
  Synthetic
catttatttgt

SEQ ID NO: 16646 - DNA, 9 bp, Artificial sequence
  Synthetic
ttcctgtcc

SEQ ID NO: 16647 - DNA, 8 bp, Artificial sequence
  Synthetic
ttctttag

SEQ ID NO: 16648 - DNA, 10 bp, Artificial sequence
  Synthetic
tcactttcac

SEQ ID NO: 16649 - DNA, 8 bp, Artificial sequence
  Synthetic
ttctttac

SEQ ID NO: 16650 - DNA, 6 bp, Artificial sequence
  Synthetic
gtaagg

SEQ ID NO: 16651 - DNA, 22 bp, Artificial sequence
  Synthetic
tattcttgtgggacatgggcgg

SEQ ID NO: 16652 - DNA, 17 bp, Artificial sequence
  Synthetic
atctttttacggtgctt

SEQ ID NO: 16653 - DNA, 16 bp, Artificial sequence
  Synthetic
tttacgcacccgcatt

SEQ ID NO: 16654 - DNA, 15 bp, Artificial sequence
  Synthetic
ccaattattaattgg

SEQ ID NO: 16655 - DNA, 17 bp, Artificial sequence
  Synthetic
agaaccgttcataggtt

SEQ ID NO: 16656 - DNA, 22 bp, Artificial sequence
  Synthetic
tgggggggaagactaaccgact

SEQ ID NO: 16657 - DNA, 16 bp, Artificial sequence
  Synthetic
tttacgcacccgcata

SEQ ID NO: 16658 - DNA, 13 bp, Artificial sequence
  Synthetic
agataaatatctt

SEQ ID NO: 16659 - DNA, 8 bp, Artificial sequence
  Synthetic
ggtgtggg

SEQ ID NO: 16660 - DNA, 13 bp, Artificial sequence
  Synthetic
ggggccggaggcg

SEQ ID NO: 16661 - DNA, 8 bp, Artificial sequence
  Synthetic
tcttgtct

SEQ ID NO: 16662 - DNA, 10 bp, Artificial sequence
  Synthetic
gtcgacaatg

SEQ ID NO: 16663 - DNA, 10 bp, Artificial sequence
  Synthetic
tcagtgcact

SEQ ID NO: 16664 - DNA, 18 bp, Artificial sequence
  Synthetic
gtcaacgatccgttgccc

SEQ ID NO: 16665 - DNA, 16 bp, Artificial sequence
  Synthetic
tgatacttacttacta

SEQ ID NO: 16666 - DNA, 14 bp, Artificial sequence
  Synthetic
ggagcctgtcgacg

SEQ ID NO: 16667 - DNA, 9 bp, Artificial sequence
  Synthetic
taacaagag

SEQ ID NO: 16668 - DNA, 11 bp, Artificial sequence
  Synthetic
tactgagtggg

SEQ ID NO: 16669 - DNA, 10 bp, Artificial sequence
  Synthetic
tggtgcacgg

SEQ ID NO: 16670 - DNA, 10 bp, Artificial sequence
  Synthetic
tggtcgacac

SEQ ID NO: 16671 - DNA, 8 bp, Artificial sequence
  Synthetic
ggtcatcg

SEQ ID NO: 16672 - DNA, 11 bp, Artificial sequence
  Synthetic
agggattattt

SEQ ID NO: 16673 - DNA, 19 bp, Artificial sequence
  Synthetic
tttctccttcactttgatc

SEQ ID NO: 16674 - DNA, 11 bp, Artificial sequence
  Synthetic
cccctaaaggt

SEQ ID NO: 16675 - DNA, 9 bp, Artificial sequence
  Synthetic
ggtgaactt

SEQ ID NO: 16676 - DNA, 11 bp, Artificial sequence
  Synthetic
ttttgtggaca

SEQ ID NO: 16677 - DNA, 12 bp, Artificial sequence
  Synthetic
tcaatgcagtgg

SEQ ID NO: 16678 - DNA, 18 bp, Artificial sequence
  Synthetic
ggccctgtcagacaagag

SEQ ID NO: 16679 - DNA, 15 bp, Artificial sequence
  Synthetic
cactgacaatgatat

SEQ ID NO: 16680 - DNA, 15 bp, Artificial sequence
  Synthetic
ggtggtcccccgcgg

SEQ ID NO: 16681 - DNA, 11 bp, Artificial sequence
  Synthetic
ggtataccatg

SEQ ID NO: 16682 - DNA, 8 bp, Artificial sequence
  Synthetic
ggcggggg

SEQ ID NO: 16683 - DNA, 10 bp, Artificial sequence
  Synthetic
tgactggaga

SEQ ID NO: 16684 - DNA, 13 bp, Artificial sequence
  Synthetic
ttccacactttta

SEQ ID NO: 16685 - DNA, 17 bp, Artificial sequence
  Synthetic
cttgttaacgtcacaag

SEQ ID NO: 16686 - DNA, 11 bp, Artificial sequence
  Synthetic
tactggaactt

SEQ ID NO: 16687 - DNA, 17 bp, Artificial sequence
  Synthetic
ttacttaacgtcagtaa

SEQ ID NO: 16688 - DNA, 21 bp, Artificial sequence
  Synthetic
tttgccaagtccttcaagtag

SEQ ID NO: 16689 - DNA, 10 bp, Artificial sequence
  Synthetic
tcgagtaata

SEQ ID NO: 16690 - DNA, 11 bp, Artificial sequence
  Synthetic
ggtcccccgtc

SEQ ID NO: 16691 - DNA, 10 bp, Artificial sequence
  Synthetic
ctttcacttt

SEQ ID NO: 16692 - DNA, 10 bp, Artificial sequence
  Synthetic
ttaaaattac

SEQ ID NO: 16693 - DNA, 13 bp, Artificial sequence
  Synthetic
ccccccccccggt

SEQ ID NO: 16694 - DNA, 8 bp, Artificial sequence
  Synthetic
acatttgt

SEQ ID NO: 16695 - DNA, 12 bp, Artificial sequence
  Synthetic
ctactaaatact

SEQ ID NO: 16696 - DNA, 15 bp, Artificial sequence
  Synthetic
cgtcggccgcggcgg

SEQ ID NO: 16697 - DNA, 16 bp, Artificial sequence
  Synthetic
ttgttacttgtaacaa

SEQ ID NO: 16698 - DNA, 8 bp, Artificial sequence
  Synthetic
gtgcactg

SEQ ID NO: 16699 - DNA, 16 bp, Artificial sequence
  Synthetic
ttacctgaaactgggg

SEQ ID NO: 16700 - DNA, 16 bp, Artificial sequence
  Synthetic
attcattaatcaatat

SEQ ID NO: 16701 - DNA, 10 bp, Artificial sequence
  Synthetic
attagctaat

SEQ ID NO: 16702 - DNA, 10 bp, Artificial sequence
  Synthetic
gattaatcat

SEQ ID NO: 16703 - DNA, 14 bp, Artificial sequence
  Synthetic
ttggcaattggcaa

SEQ ID NO: 16704 - DNA, 12 bp, Artificial sequence
  Synthetic
ctggttagtctt

SEQ ID NO: 16705 - DNA, 9 bp, Artificial sequence
  Synthetic
gattaatcg

SEQ ID NO: 16706 - DNA, 10 bp, Artificial sequence
  Synthetic
ggtggtcccc

SEQ ID NO: 16707 - DNA, 5 bp, Artificial sequence
  Synthetic
atagt

SEQ ID NO: 16708 - DNA, 12 bp, Artificial sequence
  Synthetic
tttttatcggga

SEQ ID NO: 16709 - DNA, 13 bp, Artificial sequence
  Synthetic
gagaaacaatgct

SEQ ID NO: 16710 - DNA, 10 bp, Artificial sequence
  Synthetic
ggcatggtgg

SEQ ID NO: 16711 - DNA, 10 bp, Artificial sequence
  Synthetic
attgtggagt

SEQ ID NO: 16712 - DNA, 10 bp, Artificial sequence
  Synthetic
tggggcgggg

SEQ ID NO: 16713 - DNA, 16 bp, Artificial sequence
  Synthetic
aaaatgtcatcgtttt

SEQ ID NO: 16714 - DNA, 9 bp, Artificial sequence
  Synthetic
tggccttta

SEQ ID NO: 16715 - DNA, 8 bp, Artificial sequence
  Synthetic
ttaaatct

SEQ ID NO: 16716 - DNA, 8 bp, Artificial sequence
  Synthetic
tatactat

SEQ ID NO: 16717 - DNA, 14 bp, Artificial sequence
  Synthetic
tcatttataattga

SEQ ID NO: 16718 - DNA, 10 bp, Artificial sequence
  Synthetic
gttcgcactg

SEQ ID NO: 16719 - DNA, 14 bp, Artificial sequence
  Synthetic
tccaagtttccagt

SEQ ID NO: 16720 - DNA, 18 bp, Artificial sequence
  Synthetic
agaaccgttcttcggttt

SEQ ID NO: 16721 - DNA, 8 bp, Artificial sequence
  Synthetic
tgtgcacc

SEQ ID NO: 16722 - DNA, 8 bp, Artificial sequence
  Synthetic
tgtgcact

SEQ ID NO: 16723 - DNA, 10 bp, Artificial sequence
  Synthetic
ccctttcggg

SEQ ID NO: 16724 - DNA, 8 bp, Artificial sequence
  Synthetic
tgtgcacg

SEQ ID NO: 16725 - DNA, 11 bp, Artificial sequence
  Synthetic
tggtgcaccag

SEQ ID NO: 16726 - DNA, 15 bp, Artificial sequence
  Synthetic
gtttcatttgtacct

SEQ ID NO: 16727 - DNA, 10 bp, Artificial sequence
  Synthetic
caattaacct

SEQ ID NO: 16728 - DNA, 12 bp, Artificial sequence
  Synthetic
ggattcatttgt

SEQ ID NO: 16729 - DNA, 15 bp, Artificial sequence
  Synthetic
tcgatttttatcgta

SEQ ID NO: 16730 - DNA, 13 bp, Artificial sequence
  Synthetic
tgacaccctttgc

SEQ ID NO: 16731 - DNA, 15 bp, Artificial sequence
  Synthetic
tgagtgcgttatgac

SEQ ID NO: 16732 - DNA, 13 bp, Artificial sequence
  Synthetic
gagtaaagttttt

SEQ ID NO: 16733 - DNA, 16 bp, Artificial sequence
  Synthetic
ttaatggacagttatg

SEQ ID NO: 16734 - DNA, 9 bp, Artificial sequence
  Synthetic
tacaagggt

SEQ ID NO: 16735 - DNA, 17 bp, Artificial sequence
  Synthetic
gtttcattaattaatag

SEQ ID NO: 16736 - DNA, 11 bp, Artificial sequence
  Synthetic
tttactcgttg

SEQ ID NO: 16737 - DNA, 10 bp, Artificial sequence
  Synthetic
ttgtagacca

SEQ ID NO: 16738 - DNA, 11 bp, Artificial sequence
  Synthetic
ttttggcaatt

SEQ ID NO: 16739 - DNA, 10 bp, Artificial sequence
  Synthetic
gagttgaccg

SEQ ID NO: 16740 - DNA, 18 bp, Artificial sequence
  Synthetic
ctgtacaggtctgtacag

SEQ ID NO: 16741 - DNA, 19 bp, Artificial sequence
  Synthetic
tcaaagctatactcagtag

SEQ ID NO: 16742 - DNA, 10 bp, Artificial sequence
  Synthetic
ggttattttg

SEQ ID NO: 16743 - DNA, 10 bp, Artificial sequence
  Synthetic
ggttattttt

SEQ ID NO: 16744 - DNA, 9 bp, Artificial sequence
  Synthetic
ttaatgtac

SEQ ID NO: 16745 - DNA, 9 bp, Artificial sequence
  Synthetic
tttcagggg

SEQ ID NO: 16746 - DNA, 15 bp, Artificial sequence
  Synthetic
gactaaacgtataag

SEQ ID NO: 16747 - DNA, 10 bp, Artificial sequence
  Synthetic
taccttacac

SEQ ID NO: 16748 - DNA, 15 bp, Artificial sequence
  Synthetic
ggtcccatagtcggc

SEQ ID NO: 16749 - DNA, 10 bp, Artificial sequence
  Synthetic
ggtgtcgtcc

SEQ ID NO: 16750 - DNA, 9 bp, Artificial sequence
  Synthetic
tttgtttgt

SEQ ID NO: 16751 - DNA, 15 bp, Artificial sequence
  Synthetic
cggtggtctcccgcg

SEQ ID NO: 16752 - DNA, 9 bp, Artificial sequence
  Synthetic
tcggttagt

SEQ ID NO: 16753 - DNA, 15 bp, Artificial sequence
  Synthetic
ttttattagctatat

SEQ ID NO: 16754 - DNA, 12 bp, Artificial sequence
  Synthetic
tttactgtcgag

SEQ ID NO: 16755 - DNA, 16 bp, Artificial sequence
  Synthetic
gtaaatcgtcgttaat

SEQ ID NO: 16756 - DNA, 16 bp, Artificial sequence
  Synthetic
tattaattactggagg

SEQ ID NO: 16757 - DNA, 14 bp, Artificial sequence
  Synthetic
ggcagtgcactggt

SEQ ID NO: 16758 - DNA, 14 bp, Artificial sequence
  Synthetic
ggtcggttagtctc

SEQ ID NO: 16759 - DNA, 15 bp, Artificial sequence
  Synthetic
ggatcgttgtccact

SEQ ID NO: 16760 - DNA, 15 bp, Artificial sequence
  Synthetic
tttttgtggacgcgg

SEQ ID NO: 16761 - DNA, 13 bp, Artificial sequence
  Synthetic
ccggtgcactggg

SEQ ID NO: 16762 - DNA, 15 bp, Artificial sequence
  Synthetic
ttcaagttccagtcg

SEQ ID NO: 16763 - DNA, 8 bp, Artificial sequence
  Synthetic
catgggat

SEQ ID NO: 16764 - DNA, 9 bp, Artificial sequence
  Synthetic
ggtggacgg

SEQ ID NO: 16765 - DNA, 16 bp, Artificial sequence
  Synthetic
cgtaattaatcaagcg

SEQ ID NO: 16766 - DNA, 10 bp, Artificial sequence
  Synthetic
tcagtcgttt

SEQ ID NO: 16767 - DNA, 8 bp, Artificial sequence
  Synthetic
ggttaatc

SEQ ID NO: 16768 - DNA, 15 bp, Artificial sequence
  Synthetic
gccggtggtcccccg

SEQ ID NO: 16769 - DNA, 22 bp, Artificial sequence
  Synthetic
tcccctgcgtcgacgcggggga

SEQ ID NO: 16770 - DNA, 10 bp, Artificial sequence
  Synthetic
cataacaatt

SEQ ID NO: 16771 - DNA, 14 bp, Artificial sequence
  Synthetic
tctagtgcactaga

SEQ ID NO: 16772 - DNA, 7 bp, Artificial sequence
  Synthetic
ttgttac

SEQ ID NO: 16773 - DNA, 18 bp, Artificial sequence
  Synthetic
ttacacctttactcagtc

SEQ ID NO: 16774 - DNA, 7 bp, Artificial sequence
  Synthetic
gtgaact

SEQ ID NO: 16775 - DNA, 8 bp, Artificial sequence
  Synthetic
cttgttat

SEQ ID NO: 16776 - DNA, 10 bp, Artificial sequence
  Synthetic
tacacgtgta

SEQ ID NO: 16777 - DNA, 9 bp, Artificial sequence
  Synthetic
tggctaatc

SEQ ID NO: 16778 - DNA, 11 bp, Artificial sequence
  Synthetic
cggtgcaccgg

SEQ ID NO: 16779 - DNA, 17 bp, Artificial sequence
  Synthetic
gtattaattaattgcgc

SEQ ID NO: 16780 - DNA, 11 bp, Artificial sequence
  Synthetic
gagtggggtgg

SEQ ID NO: 16781 - DNA, 10 bp, Artificial sequence
  Synthetic
ttttcagttt

SEQ ID NO: 16782 - DNA, 8 bp, Artificial sequence
  Synthetic
gatcaatt

SEQ ID NO: 16783 - DNA, 7 bp, Artificial sequence
  Synthetic
gcaaccg

SEQ ID NO: 16784 - DNA, 21 bp, Artificial sequence
  Synthetic
ttaaaagtgcgtactcaagtg

SEQ ID NO: 16785 - DNA, 8 bp, Artificial sequence
  Synthetic
tccccagt

SEQ ID NO: 16786 - DNA, 13 bp, Artificial sequence
  Synthetic
gtaaagggccttc

SEQ ID NO: 16787 - DNA, 14 bp, Artificial sequence
  Synthetic
gagactgcagtggg

SEQ ID NO: 16788 - DNA, 6 bp, Artificial sequence
  Synthetic
gaaact

SEQ ID NO: 16789 - DNA, 11 bp, Artificial sequence
  Synthetic
gatccacactt

SEQ ID NO: 16790 - DNA, 10 bp, Artificial sequence
  Synthetic
atttatttgt

SEQ ID NO: 16791 - DNA, 13 bp, Artificial sequence
  Synthetic
ctactgagtgtgt

SEQ ID NO: 16792 - DNA, 10 bp, Artificial sequence
  Synthetic
tttaaaagga

SEQ ID NO: 16793 - DNA, 10 bp, Artificial sequence
  Synthetic
gcgggctccg

SEQ ID NO: 16794 - DNA, 15 bp, Artificial sequence
  Synthetic
ggaaacaatacgttt

SEQ ID NO: 16795 - DNA, 20 bp, Artificial sequence
  Synthetic
tccacacttttttccacact

SEQ ID NO: 16796 - DNA, 22 bp, Artificial sequence
  Synthetic
ccttctcagtgcactggttatg

SEQ ID NO: 16797 - DNA, 12 bp, Artificial sequence
  Synthetic
tacgcacccgcc

SEQ ID NO: 16798 - DNA, 9 bp, Artificial sequence
  Synthetic
tgtagacag

SEQ ID NO: 16799 - DNA, 15 bp, Artificial sequence
  Synthetic
tggtacctgtcgcgg

SEQ ID NO: 16800 - DNA, 17 bp, Artificial sequence
  Synthetic
tttccagtttccagttg

SEQ ID NO: 16801 - DNA, 17 bp, Artificial sequence
  Synthetic
cggtgtccttcattgtg

SEQ ID NO: 16802 - DNA, 11 bp, Artificial sequence
  Synthetic
gtggtataccg

SEQ ID NO: 16803 - DNA, 8 bp, Artificial sequence
  Synthetic
tggtgttt

SEQ ID NO: 16804 - DNA, 9 bp, Artificial sequence
  Synthetic
tccgtcctt

SEQ ID NO: 16805 - DNA, 10 bp, Artificial sequence
  Synthetic
accggaactt

SEQ ID NO: 16806 - DNA, 10 bp, Artificial sequence
  Synthetic
ggtgaacttt

SEQ ID NO: 16807 - DNA, 19 bp, Artificial sequence
  Synthetic
cggctccggaccccggggg

SEQ ID NO: 16808 - DNA, 13 bp, Artificial sequence
  Synthetic
ggtggtcccccgc

SEQ ID NO: 16809 - DNA, 22 bp, Artificial sequence
  Synthetic
taccccgcgtcgacgcggggag

SEQ ID NO: 16810 - DNA, 11 bp, Artificial sequence
  Synthetic
gaagggcgggg

SEQ ID NO: 16811 - DNA, 15 bp, Artificial sequence
  Synthetic
cggtggtcccccgcg

SEQ ID NO: 16812 - DNA, 14 bp, Artificial sequence
  Synthetic
ttatacgtttaata

SEQ ID NO: 16813 - DNA, 7 bp, Artificial sequence
  Synthetic
atgcatt

SEQ ID NO: 16814 - DNA, 14 bp, Artificial sequence
  Synthetic
ccgggttccagtgt

SEQ ID NO: 16815 - DNA, 10 bp, Artificial sequence
  Synthetic
ctattaatgt

SEQ ID NO: 16816 - DNA, 8 bp, Artificial sequence
  Synthetic
tgtcgcag

SEQ ID NO: 16817 - DNA, 14 bp, Artificial sequence
  Synthetic
ttatacgtttaatc

SEQ ID NO: 16818 - DNA, 18 bp, Artificial sequence
  Synthetic
gagttcaagttcaagtgg

SEQ ID NO: 16819 - DNA, 14 bp, Artificial sequence
  Synthetic
acatttataactgt

SEQ ID NO: 16820 - DNA, 13 bp, Artificial sequence
  Synthetic
ttctactacagta

SEQ ID NO: 16821 - DNA, 15 bp, Artificial sequence
  Synthetic
tgggggggccccccc

SEQ ID NO: 16822 - DNA, 7 bp, Artificial sequence
  Synthetic
gtctatt

SEQ ID NO: 16823 - DNA, 15 bp, Artificial sequence
  Synthetic
acgatttttatcgtt

SEQ ID NO: 16824 - DNA, 15 bp, Artificial sequence
  Synthetic
tacggtttttatcgt

SEQ ID NO: 16825 - DNA, 16 bp, Artificial sequence
  Synthetic
gtaaattgtggttaat

SEQ ID NO: 16826 - DNA, 16 bp, Artificial sequence
  Synthetic
gcaacggtaccgttgc

SEQ ID NO: 16827 - DNA, 16 bp, Artificial sequence
  Synthetic
gcaacggtaccgttgg

SEQ ID NO: 16828 - DNA, 9 bp, Artificial sequence
  Synthetic
gactttgtc

SEQ ID NO: 16829 - DNA, 16 bp, Artificial sequence
  Synthetic
tccaattaatcgacta

SEQ ID NO: 16830 - DNA, 13 bp, Artificial sequence
  Synthetic
ttaagggtctttt

SEQ ID NO: 16831 - DNA, 8 bp, Artificial sequence
  Synthetic
tctattcc

SEQ ID NO: 16832 - DNA, 8 bp, Artificial sequence
  Synthetic
tctattct

SEQ ID NO: 16833 - DNA, 18 bp, Artificial sequence
  Synthetic
tcgcgggggaccaccggt

SEQ ID NO: 16834 - DNA, 12 bp, Artificial sequence
  Synthetic
ttttgatccagt

SEQ ID NO: 16835 - DNA, 9 bp, Artificial sequence
  Synthetic
tcggtttgg

SEQ ID NO: 16836 - DNA, 9 bp, Artificial sequence
  Synthetic
gggtgggag

SEQ ID NO: 16837 - DNA, 10 bp, Artificial sequence
  Synthetic
gaaggacctt

SEQ ID NO: 16838 - DNA, 15 bp, Artificial sequence
  Synthetic
gtcaaagtcaaagag

SEQ ID NO: 16839 - DNA, 9 bp, Artificial sequence
  Synthetic
cattatttt

SEQ ID NO: 16840 - DNA, 9 bp, Artificial sequence
  Synthetic
gagtatttt

SEQ ID NO: 16841 - DNA, 25 bp, Artificial sequence
  Synthetic
ccaataattaaccaatataaccaat

SEQ ID NO: 16842 - DNA, 8 bp, Artificial sequence
  Synthetic
gaccaccg

SEQ ID NO: 16843 - DNA, 14 bp, Artificial sequence
  Synthetic
gctggtgcaccagt

SEQ ID NO: 16844 - DNA, 10 bp, Artificial sequence
  Synthetic
ccgtgcactg

SEQ ID NO: 16845 - DNA, 16 bp, Artificial sequence
  Synthetic
tttttatttatattcc

SEQ ID NO: 16846 - DNA, 10 bp, Artificial sequence
  Synthetic
ctccacagtt

SEQ ID NO: 16847 - DNA, 14 bp, Artificial sequence
  Synthetic
tgtaacgtgttaga

SEQ ID NO: 16848 - DNA, 10 bp, Artificial sequence
  Synthetic
tggtgcacag

SEQ ID NO: 16849 - DNA, 11 bp, Artificial sequence
  Synthetic
tactgagtgag

SEQ ID NO: 16850 - DNA, 9 bp, Artificial sequence
  Synthetic
tcttgttac

SEQ ID NO: 16851 - DNA, 12 bp, Artificial sequence
  Synthetic
ggacccaccagg

SEQ ID NO: 16852 - DNA, 21 bp, Artificial sequence
  Synthetic
ggggtaaagggcctttagtgg

SEQ ID NO: 16853 - DNA, 8 bp, Artificial sequence
  Synthetic
cggtattt

SEQ ID NO: 16854 - DNA, 8 bp, Artificial sequence
  Synthetic
catgcatt

SEQ ID NO: 16855 - DNA, 18 bp, Artificial sequence
  Synthetic
tccagtgccactggaccc

SEQ ID NO: 16856 - DNA, 10 bp, Artificial sequence
  Synthetic
ggattaattt

SEQ ID NO: 16857 - DNA, 9 bp, Artificial sequence
  Synthetic
cccctaatt

SEQ ID NO: 16858 - DNA, 8 bp, Artificial sequence
  Synthetic
ctccagtg

SEQ ID NO: 16859 - DNA, 8 bp, Artificial sequence
  Synthetic
ctccagtt

SEQ ID NO: 16860 - DNA, 10 bp, Artificial sequence
  Synthetic
ggtgaaggcc

SEQ ID NO: 16861 - DNA, 14 bp, Artificial sequence
  Synthetic
tacggtgcagtagt

SEQ ID NO: 16862 - DNA, 14 bp, Artificial sequence
  Synthetic
tcctactacgttag

SEQ ID NO: 16863 - DNA, 16 bp, Artificial sequence
  Synthetic
tttttcatttgtttgg

SEQ ID NO: 16864 - DNA, 14 bp, Artificial sequence
  Synthetic
ttttttagttattt

SEQ ID NO: 16865 - DNA, 11 bp, Artificial sequence
  Synthetic
gcactcagtag

SEQ ID NO: 16866 - DNA, 16 bp, Artificial sequence
  Synthetic
atccattattttaagt

SEQ ID NO: 16867 - DNA, 9 bp, Artificial sequence
  Synthetic
cggggtccg

SEQ ID NO: 16868 - DNA, 16 bp, Artificial sequence
  Synthetic
tccgattaggggttgc

SEQ ID NO: 16869 - DNA, 16 bp, Artificial sequence
  Synthetic
tcttaaaataaccatc

SEQ ID NO: 16870 - DNA, 8 bp, Artificial sequence
  Synthetic
cgtgcagg

SEQ ID NO: 16871 - DNA, 15 bp, Artificial sequence
  Synthetic
ttgttaccatcacaa

SEQ ID NO: 16872 - DNA, 24 bp, Artificial sequence
  Synthetic
tgccccgcgtccctaaacaacggg

SEQ ID NO: 16873 - DNA, 8 bp, Artificial sequence
  Synthetic
ccgttaat

SEQ ID NO: 16874 - DNA, 10 bp, Artificial sequence
  Synthetic
gcggcggcgg

SEQ ID NO: 16875 - DNA, 10 bp, Artificial sequence
  Synthetic
tggtcgactc

SEQ ID NO: 16876 - DNA, 10 bp, Artificial sequence
  Synthetic
cgggggcccg

SEQ ID NO: 16877 - DNA, 15 bp, Artificial sequence
  Synthetic
tttcccgacgccggg

SEQ ID NO: 16878 - DNA, 10 bp, Artificial sequence
  Synthetic
ttaaaaccgt

SEQ ID NO: 16879 - DNA, 11 bp, Artificial sequence
  Synthetic
ccggttagggg

SEQ ID NO: 16880 - DNA, 15 bp, Artificial sequence
  Synthetic
ttcctactcagtggc

SEQ ID NO: 16881 - DNA, 16 bp, Artificial sequence
  Synthetic
gcgccagtgcactggg

SEQ ID NO: 16882 - DNA, 13 bp, Artificial sequence
  Synthetic
tttaacaatgtaa

SEQ ID NO: 16883 - DNA, 10 bp, Artificial sequence
  Synthetic
ttaaaaccga

SEQ ID NO: 16884 - DNA, 9 bp, Artificial sequence
  Synthetic
agagggttt

SEQ ID NO: 16885 - DNA, 15 bp, Artificial sequence
  Synthetic
tttttctccttcacc

SEQ ID NO: 16886 - DNA, 19 bp, Artificial sequence
  Synthetic
atcgcgggggaccaccggt

SEQ ID NO: 16887 - DNA, 13 bp, Artificial sequence
  Synthetic
tctactatctcgg

SEQ ID NO: 16888 - DNA, 8 bp, Artificial sequence
  Synthetic
tatacgta

SEQ ID NO: 16889 - DNA, 14 bp, Artificial sequence
  Synthetic
tgtctattcttaga

SEQ ID NO: 16890 - DNA, 10 bp, Artificial sequence
  Synthetic
ggttccagtg

SEQ ID NO: 16891 - DNA, 8 bp, Artificial sequence
  Synthetic
tgcattat

SEQ ID NO: 16892 - DNA, 17 bp, Artificial sequence
  Synthetic
gtcctcgtcgacgactc

SEQ ID NO: 16893 - DNA, 10 bp, Artificial sequence
  Synthetic
gggatcgttg

SEQ ID NO: 16894 - DNA, 14 bp, Artificial sequence
  Synthetic
ccaacggtaccatt

SEQ ID NO: 16895 - DNA, 8 bp, Artificial sequence
  Synthetic
gaattaat

SEQ ID NO: 16896 - DNA, 17 bp, Artificial sequence
  Synthetic
ggaaccgttgaacggtc

SEQ ID NO: 16897 - DNA, 14 bp, Artificial sequence
  Synthetic
tccccctagctacc

SEQ ID NO: 16898 - DNA, 10 bp, Artificial sequence
  Synthetic
gaatagagat

SEQ ID NO: 16899 - DNA, 11 bp, Artificial sequence
  Synthetic
ccggtgtgggt

SEQ ID NO: 16900 - DNA, 10 bp, Artificial sequence
  Synthetic
cgattaatgg

SEQ ID NO: 16901 - DNA, 16 bp, Artificial sequence
  Synthetic
tacatgtcatcgtttc

SEQ ID NO: 16902 - DNA, 13 bp, Artificial sequence
  Synthetic
gattcatttgttc

SEQ ID NO: 16903 - DNA, 11 bp, Artificial sequence
  Synthetic
ttggtgaattc

SEQ ID NO: 16904 - DNA, 17 bp, Artificial sequence
  Synthetic
ctcgcaattaattacat

SEQ ID NO: 16905 - DNA, 11 bp, Artificial sequence
  Synthetic
ccccttagggg

SEQ ID NO: 16906 - DNA, 15 bp, Artificial sequence
  Synthetic
ccaacggtaccgctg

SEQ ID NO: 16907 - DNA, 17 bp, Artificial sequence
  Synthetic
ttccagtgctttccagt

SEQ ID NO: 16908 - DNA, 14 bp, Artificial sequence
  Synthetic
caattaatggaggt

SEQ ID NO: 16909 - DNA, 9 bp, Artificial sequence
  Synthetic
tgtggacag

SEQ ID NO: 16910 - DNA, 15 bp, Artificial sequence
  Synthetic
cccaggtttccagtt

SEQ ID NO: 16911 - DNA, 14 bp, Artificial sequence
  Synthetic
tcccctaaagggtc

SEQ ID NO: 16912 - DNA, 7 bp, Artificial sequence
  Synthetic
catattt

SEQ ID NO: 16913 - DNA, 10 bp, Artificial sequence
  Synthetic
taacacaggc

SEQ ID NO: 16914 - DNA, 13 bp, Artificial sequence
  Synthetic
tcaatgcattaac

SEQ ID NO: 16915 - DNA, 12 bp, Artificial sequence
  Synthetic
cgctggtggctt

SEQ ID NO: 16916 - DNA, 16 bp, Artificial sequence
  Synthetic
ttccagttttccagtt

SEQ ID NO: 16917 - DNA, 6 bp, Artificial sequence
  Synthetic
tgtttc

SEQ ID NO: 16918 - DNA, 14 bp, Artificial sequence
  Synthetic
catttgtacaaatg

SEQ ID NO: 16919 - DNA, 14 bp, Artificial sequence
  Synthetic
gacgtgggcgacgg

SEQ ID NO: 16920 - DNA, 10 bp, Artificial sequence
  Synthetic
gtctattccg

SEQ ID NO: 16921 - DNA, 11 bp, Artificial sequence
  Synthetic
ccagtgtactg

SEQ ID NO: 16922 - DNA, 8 bp, Artificial sequence
  Synthetic
tgcagtag

SEQ ID NO: 16923 - DNA, 8 bp, Artificial sequence
  Synthetic
gttccagt

SEQ ID NO: 16924 - DNA, 11 bp, Artificial sequence
  Synthetic
gaacgcactct

SEQ ID NO: 16925 - DNA, 10 bp, Artificial sequence
  Synthetic
tgcgcggttt

SEQ ID NO: 16926 - DNA, 16 bp, Artificial sequence
  Synthetic
cagttaattaattagt

SEQ ID NO: 16927 - DNA, 10 bp, Artificial sequence
  Synthetic
ctgcgcacgg

SEQ ID NO: 16928 - DNA, 8 bp, Artificial sequence
  Synthetic
gattaacg

SEQ ID NO: 16929 - DNA, 16 bp, Artificial sequence
  Synthetic
tccggtgcacggccta

SEQ ID NO: 16930 - DNA, 14 bp, Artificial sequence
  Synthetic
ccggtatattcctg

SEQ ID NO: 16931 - DNA, 17 bp, Artificial sequence
  Synthetic
ctcataataccctacct

SEQ ID NO: 16932 - DNA, 17 bp, Artificial sequence
  Synthetic
taggaattcaccaattc

SEQ ID NO: 16933 - DNA, 15 bp, Artificial sequence
  Synthetic
tgtccttcactaacg

SEQ ID NO: 16934 - DNA, 11 bp, Artificial sequence
  Synthetic
actggaaattt

SEQ ID NO: 16935 - DNA, 11 bp, Artificial sequence
  Synthetic
tcgttattttt

SEQ ID NO: 16936 - DNA, 19 bp, Artificial sequence
  Synthetic
tccacactttaagtgtgga

SEQ ID NO: 16937 - DNA, 8 bp, Artificial sequence
  Synthetic
gactattc

SEQ ID NO: 16938 - DNA, 13 bp, Artificial sequence
  Synthetic
tatacgtttactt

SEQ ID NO: 16939 - DNA, 10 bp, Artificial sequence
  Synthetic
tagtacatta

SEQ ID NO: 16940 - DNA, 17 bp, Artificial sequence
  Synthetic
ttttattgccaaaggta

SEQ ID NO: 16941 - DNA, 13 bp, Artificial sequence
  Synthetic
tatacgtttactc

SEQ ID NO: 16942 - DNA, 10 bp, Artificial sequence
  Synthetic
ggattaggcg

SEQ ID NO: 16943 - DNA, 15 bp, Artificial sequence
  Synthetic
gtagaggaatatacc

SEQ ID NO: 16944 - DNA, 10 bp, Artificial sequence
  Synthetic
gattaatgcg

SEQ ID NO: 16945 - DNA, 17 bp, Artificial sequence
  Synthetic
cccttgtgttacaaggg

SEQ ID NO: 16946 - DNA, 10 bp, Artificial sequence
  Synthetic
cggggtgggt

SEQ ID NO: 16947 - DNA, 8 bp, Artificial sequence
  Synthetic
taagttta

SEQ ID NO: 16948 - DNA, 30 bp, Artificial sequence
  Synthetic
tcctctcttccccttcccttctttccctct

SEQ ID NO: 16949 - DNA, 14 bp, Artificial sequence
  Synthetic
ggggtttggtgggg

SEQ ID NO: 16950 - DNA, 22 bp, Artificial sequence
  Synthetic
ttatttcttgttatcttaaagt

SEQ ID NO: 16951 - DNA, 9 bp, Artificial sequence
  Synthetic
tacggttgg

SEQ ID NO: 16952 - DNA, 16 bp, Artificial sequence
  Synthetic
gtccattaatggagtc

SEQ ID NO: 16953 - DNA, 10 bp, Artificial sequence
  Synthetic
ttcctttact

SEQ ID NO: 16954 - DNA, 13 bp, Artificial sequence
  Synthetic
tttaatcgtatta

SEQ ID NO: 16955 - DNA, 14 bp, Artificial sequence
  Synthetic
aaggtatatacctt

SEQ ID NO: 16956 - DNA, 17 bp, Artificial sequence
  Synthetic
gggacggggggggaagg

SEQ ID NO: 16957 - DNA, 17 bp, Artificial sequence
  Synthetic
tgttcgttaatttctta

SEQ ID NO: 16958 - DNA, 13 bp, Artificial sequence
  Synthetic
tacgttgtccacc

SEQ ID NO: 16959 - DNA, 8 bp, Artificial sequence
  Synthetic
accatggt

SEQ ID NO: 16960 - DNA, 13 bp, Artificial sequence
  Synthetic
tacttaacgtcag

SEQ ID NO: 16961 - DNA, 10 bp, Artificial sequence
  Synthetic
cgcgtgcgcg

SEQ ID NO: 16962 - DNA, 21 bp, Artificial sequence
  Synthetic
tcactgtccgggcggccggtt

SEQ ID NO: 16963 - DNA, 11 bp, Artificial sequence
  Synthetic
ggaagggcggg

SEQ ID NO: 16964 - DNA, 12 bp, Artificial sequence
  Synthetic
ctactgcagtag

SEQ ID NO: 16965 - DNA, 13 bp, Artificial sequence
  Synthetic
ttactaactacgt

SEQ ID NO: 16966 - DNA, 14 bp, Artificial sequence
  Synthetic
ttcccccgcaccgg

SEQ ID NO: 16967 - DNA, 17 bp, Artificial sequence
  Synthetic
ttttacatttgtttgtc

SEQ ID NO: 16968 - DNA, 10 bp, Artificial sequence
  Synthetic
cagtattttt

SEQ ID NO: 16969 - DNA, 15 bp, Artificial sequence
  Synthetic
ttgttttaccgccgg

SEQ ID NO: 16970 - DNA, 19 bp, Artificial sequence
  Synthetic
tgtccagtgacactggact

SEQ ID NO: 16971 - DNA, 18 bp, Artificial sequence
  Synthetic
tttccagttctctccagt

SEQ ID NO: 16972 - DNA, 11 bp, Artificial sequence
  Synthetic
ggcgggtgcgt

SEQ ID NO: 16973 - DNA, 15 bp, Artificial sequence
  Synthetic
gggcgtatgttgctt

SEQ ID NO: 16974 - DNA, 9 bp, Artificial sequence
  Synthetic
ttcaaagtg

SEQ ID NO: 16975 - DNA, 11 bp, Artificial sequence
  Synthetic
ttgtggacagt

SEQ ID NO: 16976 - DNA, 15 bp, Artificial sequence
  Synthetic
ttcactttcactttc

SEQ ID NO: 16977 - DNA, 9 bp, Artificial sequence
  Synthetic
cgtgcacgt

SEQ ID NO: 16978 - DNA, 8 bp, Artificial sequence
  Synthetic
tctcccgc

SEQ ID NO: 16979 - DNA, 12 bp, Artificial sequence
  Synthetic
ttatacgtttaa

SEQ ID NO: 16980 - DNA, 10 bp, Artificial sequence
  Synthetic
gacagtgagt

SEQ ID NO: 16981 - DNA, 15 bp, Artificial sequence
  Synthetic
gaccctttaggggat

SEQ ID NO: 16982 - DNA, 10 bp, Artificial sequence
  Synthetic
actgggcctt

SEQ ID NO: 16983 - DNA, 18 bp, Artificial sequence
  Synthetic
tagctattttaatagcta

SEQ ID NO: 16984 - DNA, 22 bp, Artificial sequence
  Synthetic
cgttccgtaagacccttcacat

SEQ ID NO: 16985 - DNA, 9 bp, Artificial sequence
  Synthetic
ctggttaat

SEQ ID NO: 16986 - DNA, 10 bp, Artificial sequence
  Synthetic
ccactgcact

SEQ ID NO: 16987 - DNA, 7 bp, Artificial sequence
  Synthetic
gtgcacg

SEQ ID NO: 16988 - DNA, 11 bp, Artificial sequence
  Synthetic
tcggttaccct

SEQ ID NO: 16989 - DNA, 14 bp, Artificial sequence
  Synthetic
cttggccttcaccg

SEQ ID NO: 16990 - DNA, 15 bp, Artificial sequence
  Synthetic
tggtcggttagtctc

SEQ ID NO: 16991 - DNA, 9 bp, Artificial sequence
  Synthetic
tggtcgacg

SEQ ID NO: 16992 - DNA, 15 bp, Artificial sequence
  Synthetic
gtcggttcgcactgg

SEQ ID NO: 16993 - DNA, 10 bp, Artificial sequence
  Synthetic
gtatttgttt

SEQ ID NO: 16994 - DNA, 8 bp, Artificial sequence
  Synthetic
tctccttc

SEQ ID NO: 16995 - DNA, 10 bp, Artificial sequence
  Synthetic
gttaattact

SEQ ID NO: 16996 - DNA, 10 bp, Artificial sequence
  Synthetic
tggtgcacga

SEQ ID NO: 16997 - DNA, 18 bp, Artificial sequence
  Synthetic
ccctaagcttgggccctg

SEQ ID NO: 16998 - DNA, 15 bp, Artificial sequence
  Synthetic
ttcccctaaaggttt

SEQ ID NO: 16999 - DNA, 8 bp, Artificial sequence
  Synthetic
gtaaagat

SEQ ID NO: 17000 - DNA, 7 bp, Artificial sequence
  Synthetic
ctccagt

SEQ ID NO: 17001 - DNA, 15 bp, Artificial sequence
  Synthetic
ttcccctaaaggttc

SEQ ID NO: 17002 - DNA, 9 bp, Artificial sequence
  Synthetic
tcatttgtt

SEQ ID NO: 17003 - DNA, 13 bp, Artificial sequence
  Synthetic
cggtgatctcccg

SEQ ID NO: 17004 - DNA, 9 bp, Artificial sequence
  Synthetic
tcaaaaggt

SEQ ID NO: 17005 - DNA, 10 bp, Artificial sequence
  Synthetic
tgattaattt

SEQ ID NO: 17006 - DNA, 10 bp, Artificial sequence
  Synthetic
tgattaattc

SEQ ID NO: 17007 - DNA, 19 bp, Artificial sequence
  Synthetic
cctgtacgggtccgtacgg

SEQ ID NO: 17008 - DNA, 16 bp, Artificial sequence
  Synthetic
tttcatttgtttttaa

SEQ ID NO: 17009 - DNA, 10 bp, Artificial sequence
  Synthetic
gggggggtgc

SEQ ID NO: 17010 - DNA, 10 bp, Artificial sequence
  Synthetic
gggggggtgt

SEQ ID NO: 17011 - DNA, 14 bp, Artificial sequence
  Synthetic
cttcggtattgccg

SEQ ID NO: 17012 - DNA, 18 bp, Artificial sequence
  Synthetic
atacatttataactgtat

SEQ ID NO: 17013 - DNA, 9 bp, Artificial sequence
  Synthetic
gcgcggttt

SEQ ID NO: 17014 - DNA, 10 bp, Artificial sequence
  Synthetic
tttggcgttt

SEQ ID NO: 17015 - DNA, 19 bp, Artificial sequence
  Synthetic
ggcgccaacggtaccgttg

SEQ ID NO: 17016 - DNA, 11 bp, Artificial sequence
  Synthetic
cggtgtgggtg

SEQ ID NO: 17017 - DNA, 9 bp, Artificial sequence
  Synthetic
tgtgcagtg

SEQ ID NO: 17018 - DNA, 11 bp, Artificial sequence
  Synthetic
tcgttaattgt

SEQ ID NO: 17019 - DNA, 10 bp, Artificial sequence
  Synthetic
gcgtacgcgt

SEQ ID NO: 17020 - DNA, 10 bp, Artificial sequence
  Synthetic
gggcgggggg

SEQ ID NO: 17021 - DNA, 11 bp, Artificial sequence
  Synthetic
cgggtgcactg

SEQ ID NO: 17022 - DNA, 12 bp, Artificial sequence
  Synthetic
gtactgagtcgt

SEQ ID NO: 17023 - DNA, 7 bp, Artificial sequence
  Synthetic
tgtagga

SEQ ID NO: 17024 - DNA, 13 bp, Artificial sequence
  Synthetic
ccagtttccagtg

SEQ ID NO: 17025 - DNA, 15 bp, Artificial sequence
  Synthetic
caggtaccacgactt

SEQ ID NO: 17026 - DNA, 10 bp, Artificial sequence
  Synthetic
cagggcgttg

SEQ ID NO: 17027 - DNA, 14 bp, Artificial sequence
  Synthetic
tcatggcaataaac

SEQ ID NO: 17028 - DNA, 17 bp, Artificial sequence
  Synthetic
gcagtgcgtactgacgt

SEQ ID NO: 17029 - DNA, 15 bp, Artificial sequence
  Synthetic
cttttactttgactt

SEQ ID NO: 17030 - DNA, 13 bp, Artificial sequence
  Synthetic
ggggttcacttcc

SEQ ID NO: 17031 - DNA, 17 bp, Artificial sequence
  Synthetic
ttccagtggtctccagt

SEQ ID NO: 17032 - DNA, 11 bp, Artificial sequence
  Synthetic
tcggagtccgt

SEQ ID NO: 17033 - DNA, 13 bp, Artificial sequence
  Synthetic
gagctggattaat

SEQ ID NO: 17034 - DNA, 10 bp, Artificial sequence
  Synthetic
gtcagttcgc

SEQ ID NO: 17035 - DNA, 27 bp, Artificial sequence
  Synthetic
gggggttcttgtggtacaggggggggg

SEQ ID NO: 17036 - DNA, 12 bp, Artificial sequence
  Synthetic
atttagtgacgt

SEQ ID NO: 17037 - DNA, 12 bp, Artificial sequence
  Synthetic
ggcctgtgttag

SEQ ID NO: 17038 - DNA, 13 bp, Artificial sequence
  Synthetic
aattaatttaatt

SEQ ID NO: 17039 - DNA, 21 bp, Artificial sequence
  Synthetic
ccgcgacaggtaccacgactt

SEQ ID NO: 17040 - DNA, 15 bp, Artificial sequence
  Synthetic
ggatcgttgtctact

SEQ ID NO: 17041 - DNA, 8 bp, Artificial sequence
  Synthetic
ttaactat

SEQ ID NO: 17042 - DNA, 11 bp, Artificial sequence
  Synthetic
ctctgtacagg

SEQ ID NO: 17043 - DNA, 10 bp, Artificial sequence
  Synthetic
cgcctgcaat

SEQ ID NO: 17044 - DNA, 10 bp, Artificial sequence
  Synthetic
tagtgtactg

SEQ ID NO: 17045 - DNA, 28 bp, Artificial sequence
  Synthetic
ccccgccgatgcgtagtaacgcggagct

SEQ ID NO: 17046 - DNA, 9 bp, Artificial sequence
  Synthetic
agcacgagt

SEQ ID NO: 17047 - DNA, 10 bp, Artificial sequence
  Synthetic
tcgtgcactg

SEQ ID NO: 17048 - DNA, 11 bp, Artificial sequence
  Synthetic
gactcatttgt

SEQ ID NO: 17049 - DNA, 12 bp, Artificial sequence
  Synthetic
gcggtccacgtc

SEQ ID NO: 17050 - DNA, 10 bp, Artificial sequence
  Synthetic
ttcgttaatt

SEQ ID NO: 17051 - DNA, 17 bp, Artificial sequence
  Synthetic
gtcgtcggcggccgcgc

SEQ ID NO: 17052 - DNA, 17 bp, Artificial sequence
  Synthetic
ttaaaatgtacataaat

SEQ ID NO: 17053 - DNA, 8 bp, Artificial sequence
  Synthetic
gtccagtt

SEQ ID NO: 17054 - DNA, 10 bp, Artificial sequence
  Synthetic
cttgtggacg

SEQ ID NO: 17055 - DNA, 19 bp, Artificial sequence
  Synthetic
tgcttcggtaattcgggag

SEQ ID NO: 17056 - DNA, 8 bp, Artificial sequence
  Synthetic
ctaaaggg

SEQ ID NO: 17057 - DNA, 15 bp, Artificial sequence
  Synthetic
tcacgcacccgcatc

SEQ ID NO: 17058 - DNA, 18 bp, Artificial sequence
  Synthetic
ttaaaaccgcggttttga

SEQ ID NO: 17059 - DNA, 17 bp, Artificial sequence
  Synthetic
tgaaaccaaagctagtc

SEQ ID NO: 17060 - DNA, 20 bp, Artificial sequence
  Synthetic
ttaccttttaataaaaggga

SEQ ID NO: 17061 - DNA, 10 bp, Artificial sequence
  Synthetic
cgcaccctct

SEQ ID NO: 17062 - DNA, 9 bp, Artificial sequence
  Synthetic
cccgttggg

SEQ ID NO: 17063 - DNA, 9 bp, Artificial sequence
  Synthetic
tgtccacca

SEQ ID NO: 17064 - DNA, 14 bp, Artificial sequence
  Synthetic
cacggtgcagtagt

SEQ ID NO: 17065 - DNA, 9 bp, Artificial sequence
  Synthetic
taacgcatt

SEQ ID NO: 17066 - DNA, 25 bp, Artificial sequence
  Synthetic
cagcgaagagtgtggagactaccgt

SEQ ID NO: 17067 - DNA, 18 bp, Artificial sequence
  Synthetic
cccttgtaatacaggatt

SEQ ID NO: 17068 - DNA, 17 bp, Artificial sequence
  Synthetic
tatcctgtgcagtagta

SEQ ID NO: 17069 - DNA, 10 bp, Artificial sequence
  Synthetic
ctccagtacg

SEQ ID NO: 17070 - DNA, 14 bp, Artificial sequence
  Synthetic
gtgtaaggacgcgg

SEQ ID NO: 17071 - DNA, 14 bp, Artificial sequence
  Synthetic
attaatcgattaat

SEQ ID NO: 17072 - DNA, 11 bp, Artificial sequence
  Synthetic
caggcggtaat

SEQ ID NO: 17073 - DNA, 10 bp, Artificial sequence
  Synthetic
cgtgaactcg

SEQ ID NO: 17074 - DNA, 15 bp, Artificial sequence
  Synthetic
tccagtgggactgga

SEQ ID NO: 17075 - DNA, 9 bp, Artificial sequence
  Synthetic
tacgcaccc

SEQ ID NO: 17076 - DNA, 8 bp, Artificial sequence
  Synthetic
gtctattc

SEQ ID NO: 17077 - DNA, 17 bp, Artificial sequence
  Synthetic
gtaattaatacgtactc

SEQ ID NO: 17078 - DNA, 15 bp, Artificial sequence
  Synthetic
gttctaccgccgggg

SEQ ID NO: 17079 - DNA, 15 bp, Artificial sequence
  Synthetic
tcaattagtaattga

SEQ ID NO: 17080 - DNA, 14 bp, Artificial sequence
  Synthetic
gtcctactcagtgg

SEQ ID NO: 17081 - DNA, 10 bp, Artificial sequence
  Synthetic
ctggctttgg

SEQ ID NO: 17082 - DNA, 8 bp, Artificial sequence
  Synthetic
tggttaat

SEQ ID NO: 17083 - DNA, 8 bp, Artificial sequence
  Synthetic
cgtgaatt

SEQ ID NO: 17084 - DNA, 12 bp, Artificial sequence
  Synthetic
tttgtttgtagg

SEQ ID NO: 17085 - DNA, 15 bp, Artificial sequence
  Synthetic
tagcggagtccgtta

SEQ ID NO: 17086 - DNA, 7 bp, Artificial sequence
  Synthetic
ttaattt

SEQ ID NO: 17087 - DNA, 15 bp, Artificial sequence
  Synthetic
gtggttatacatacc

SEQ ID NO: 17088 - DNA, 12 bp, Artificial sequence
  Synthetic
ctggtgcaccag

SEQ ID NO: 17089 - DNA, 21 bp, Artificial sequence
  Synthetic
tttgatgttaagggtcttacg

SEQ ID NO: 17090 - DNA, 17 bp, Artificial sequence
  Synthetic
gtttgattaattaatag

SEQ ID NO: 17091 - DNA, 10 bp, Artificial sequence
  Synthetic
tggtgcacta

SEQ ID NO: 17092 - DNA, 11 bp, Artificial sequence
  Synthetic
ccgtgcacggt

SEQ ID NO: 17093 - DNA, 9 bp, Artificial sequence
  Synthetic
attgccagt

SEQ ID NO: 17094 - DNA, 12 bp, Artificial sequence
  Synthetic
taacatttgttt

SEQ ID NO: 17095 - DNA, 11 bp, Artificial sequence
  Synthetic
ttgtcgacgtc

SEQ ID NO: 17096 - DNA, 11 bp, Artificial sequence
  Synthetic
gtgaaggccgg

SEQ ID NO: 17097 - DNA, 8 bp, Artificial sequence
  Synthetic
gtgaactc

SEQ ID NO: 17098 - DNA, 15 bp, Artificial sequence
  Synthetic
ttgttactttaacaa

SEQ ID NO: 17099 - DNA, 17 bp, Artificial sequence
  Synthetic
ttagggaaactagatag

SEQ ID NO: 17100 - DNA, 16 bp, Artificial sequence
  Synthetic
ctcaggtttcaggtag

SEQ ID NO: 17101 - DNA, 15 bp, Artificial sequence
  Synthetic
atgcattgactgcat

SEQ ID NO: 17102 - DNA, 8 bp, Artificial sequence
  Synthetic
cagtaatt

SEQ ID NO: 17103 - DNA, 12 bp, Artificial sequence
  Synthetic
ttactgcagtgg

SEQ ID NO: 17104 - DNA, 9 bp, Artificial sequence
  Synthetic
gcactgggg

SEQ ID NO: 17105 - DNA, 12 bp, Artificial sequence
  Synthetic
gggccacttggg

SEQ ID NO: 17106 - DNA, 8 bp, Artificial sequence
  Synthetic
gaatagag

SEQ ID NO: 17107 - DNA, 13 bp, Artificial sequence
  Synthetic
tttaattaattag

SEQ ID NO: 17108 - DNA, 9 bp, Artificial sequence
  Synthetic
gcatgcagt

SEQ ID NO: 17109 - DNA, 15 bp, Artificial sequence
  Synthetic
tccaccgacggggtg

SEQ ID NO: 17110 - DNA, 8 bp, Artificial sequence
  Synthetic
ttgccttc

SEQ ID NO: 17111 - DNA, 12 bp, Artificial sequence
  Synthetic
tttttttgtgtt

SEQ ID NO: 17112 - DNA, 15 bp, Artificial sequence
  Synthetic
gacccttaacatcag

SEQ ID NO: 17113 - DNA, 12 bp, Artificial sequence
  Synthetic
tttattcatata

SEQ ID NO: 17114 - DNA, 10 bp, Artificial sequence
  Synthetic
tttcagttaa

SEQ ID NO: 17115 - DNA, 9 bp, Artificial sequence
  Synthetic
tcccggggg

SEQ ID NO: 17116 - DNA, 16 bp, Artificial sequence
  Synthetic
cttaattaatcaacgt

SEQ ID NO: 17117 - DNA, 17 bp, Artificial sequence
  Synthetic
ttacgttattttaaata

SEQ ID NO: 17118 - DNA, 10 bp, Artificial sequence
  Synthetic
tttagagcgc

SEQ ID NO: 17119 - DNA, 16 bp, Artificial sequence
  Synthetic
gggaggcggacccccg

SEQ ID NO: 17120 - DNA, 8 bp, Artificial sequence
  Synthetic
tccacagt

SEQ ID NO: 17121 - DNA, 12 bp, Artificial sequence
  Synthetic
tacatttgttcg

SEQ ID NO: 17122 - DNA, 17 bp, Artificial sequence
  Synthetic
gtagttattgtaactag

SEQ ID NO: 17123 - DNA, 17 bp, Artificial sequence
  Synthetic
cggtggtcccccgcggt

SEQ ID NO: 17124 - DNA, 10 bp, Artificial sequence
  Synthetic
tgtctattcc

SEQ ID NO: 17125 - DNA, 8 bp, Artificial sequence
  Synthetic
ggtgatct

SEQ ID NO: 17126 - DNA, 10 bp, Artificial sequence
  Synthetic
tgtctattct

SEQ ID NO: 17127 - DNA, 12 bp, Artificial sequence
  Synthetic
gggagttctcgg

SEQ ID NO: 17128 - DNA, 7 bp, Artificial sequence
  Synthetic
gtggacg

SEQ ID NO: 17129 - DNA, 16 bp, Artificial sequence
  Synthetic
catcattaattacgtt

SEQ ID NO: 17130 - DNA, 10 bp, Artificial sequence
  Synthetic
tacttatacg

SEQ ID NO: 17131 - DNA, 17 bp, Artificial sequence
  Synthetic
tatttgttaacatttgt

SEQ ID NO: 17132 - DNA, 10 bp, Artificial sequence
  Synthetic
tacggtctgg

SEQ ID NO: 17133 - DNA, 10 bp, Artificial sequence
  Synthetic
atccttgtat

SEQ ID NO: 17134 - DNA, 9 bp, Artificial sequence
  Synthetic
ctatttgtt

SEQ ID NO: 17135 - DNA, 18 bp, Artificial sequence
  Synthetic
tgacaattaataattggt

SEQ ID NO: 17136 - DNA, 10 bp, Artificial sequence
  Synthetic
tagtgcgcta

SEQ ID NO: 17137 - DNA, 15 bp, Artificial sequence
  Synthetic
gttttagctttgatt

SEQ ID NO: 17138 - DNA, 9 bp, Artificial sequence
  Synthetic
ggtccacgt

SEQ ID NO: 17139 - DNA, 10 bp, Artificial sequence
  Synthetic
tttaggggag

SEQ ID NO: 17140 - DNA, 10 bp, Artificial sequence
  Synthetic
ttgccatcgt

SEQ ID NO: 17141 - DNA, 14 bp, Artificial sequence
  Synthetic
tcccagttactgga

SEQ ID NO: 17142 - DNA, 12 bp, Artificial sequence
  Synthetic
ttttactttgac

SEQ ID NO: 17143 - DNA, 8 bp, Artificial sequence
  Synthetic
tcttttta

SEQ ID NO: 17144 - DNA, 11 bp, Artificial sequence
  Synthetic
tgcgggtgcgt

SEQ ID NO: 17145 - DNA, 9 bp, Artificial sequence
  Synthetic
ttaactgta

SEQ ID NO: 17146 - DNA, 17 bp, Artificial sequence
  Synthetic
ctactaattagggaagt

SEQ ID NO: 17147 - DNA, 8 bp, Artificial sequence
  Synthetic
tattactt

SEQ ID NO: 17148 - DNA, 11 bp, Artificial sequence
  Synthetic
ttgtggacaac

SEQ ID NO: 17149 - DNA, 9 bp, Artificial sequence
  Synthetic
tgagtaact

SEQ ID NO: 17150 - DNA, 8 bp, Artificial sequence
  Synthetic
ccccagtt

SEQ ID NO: 17151 - DNA, 14 bp, Artificial sequence
  Synthetic
tacgggatcccgtt

SEQ ID NO: 17152 - DNA, 8 bp, Artificial sequence
  Synthetic
ccccagtg

SEQ ID NO: 17153 - DNA, 11 bp, Artificial sequence
  Synthetic
taattgatgtg

SEQ ID NO: 17154 - DNA, 15 bp, Artificial sequence
  Synthetic
tggcgtggtagacag

SEQ ID NO: 17155 - DNA, 12 bp, Artificial sequence
  Synthetic
ttaaaaggtaac

SEQ ID NO: 17156 - DNA, 14 bp, Artificial sequence
  Synthetic
ggttggccttcagg

SEQ ID NO: 17157 - DNA, 11 bp, Artificial sequence
  Synthetic
ggtatacagtg

SEQ ID NO: 17158 - DNA, 13 bp, Artificial sequence
  Synthetic
gctttagtgccgg

SEQ ID NO: 17159 - DNA, 9 bp, Artificial sequence
  Synthetic
aggtgaatt

SEQ ID NO: 17160 - DNA, 11 bp, Artificial sequence
  Synthetic
gtgcaccaagg

SEQ ID NO: 17161 - DNA, 17 bp, Artificial sequence
  Synthetic
ttgcgattaatcgccac

SEQ ID NO: 17162 - DNA, 15 bp, Artificial sequence
  Synthetic
gggtgaaggacagag

SEQ ID NO: 17163 - DNA, 21 bp, Artificial sequence
  Synthetic
gccggtggtcccccgcggcct

SEQ ID NO: 17164 - DNA, 14 bp, Artificial sequence
  Synthetic
ggtattttgacagt

SEQ ID NO: 17165 - DNA, 7 bp, Artificial sequence
  Synthetic
taatgtt

SEQ ID NO: 17166 - DNA, 10 bp, Artificial sequence
  Synthetic
ttttgttacc

SEQ ID NO: 17167 - DNA, 17 bp, Artificial sequence
  Synthetic
ctttaaattagggagat

SEQ ID NO: 17168 - DNA, 17 bp, Artificial sequence
  Synthetic
ataataccctacctatt

SEQ ID NO: 17169 - DNA, 17 bp, Artificial sequence
  Synthetic
gttaagaatagagatat

SEQ ID NO: 17170 - DNA, 7 bp, Artificial sequence
  Synthetic
gtgcact

SEQ ID NO: 17171 - DNA, 21 bp, Artificial sequence
  Synthetic
ggtctaccgtgcctgtgttgt

SEQ ID NO: 17172 - DNA, 11 bp, Artificial sequence
  Synthetic
ggtcccccgcg

SEQ ID NO: 17173 - DNA, 11 bp, Artificial sequence
  Synthetic
attagattaat

SEQ ID NO: 17174 - DNA, 14 bp, Artificial sequence
  Synthetic
cgctttgtagacct

SEQ ID NO: 17175 - DNA, 7 bp, Artificial sequence
  Synthetic
gtgcacc

SEQ ID NO: 17176 - DNA, 17 bp, Artificial sequence
  Synthetic
tcacggcacacgttttg

SEQ ID NO: 17177 - DNA, 7 bp, Artificial sequence
  Synthetic
cgtactg

SEQ ID NO: 17178 - DNA, 17 bp, Artificial sequence
  Synthetic
tattcactatgggatag

SEQ ID NO: 17179 - DNA, 10 bp, Artificial sequence
  Synthetic
tggttaattc

SEQ ID NO: 17180 - DNA, 10 bp, Artificial sequence
  Synthetic
tggttaattg

SEQ ID NO: 17181 - DNA, 11 bp, Artificial sequence
  Synthetic
tggtagacggc

SEQ ID NO: 17182 - DNA, 24 bp, Artificial sequence
  Synthetic
gccggggcgggggggggaccgggg

SEQ ID NO: 17183 - DNA, 13 bp, Artificial sequence
  Synthetic
gggtgcatgcgtg

SEQ ID NO: 17184 - DNA, 9 bp, Artificial sequence
  Synthetic
agttccagt

SEQ ID NO: 17185 - DNA, 17 bp, Artificial sequence
  Synthetic
ctattaattagggaagg

SEQ ID NO: 17186 - DNA, 9 bp, Artificial sequence
  Synthetic
ccgttaatt

SEQ ID NO: 17187 - DNA, 14 bp, Artificial sequence
  Synthetic
tcgtactgagtcgt

SEQ ID NO: 17188 - DNA, 10 bp, Artificial sequence
  Synthetic
ttggtgcact

SEQ ID NO: 17189 - DNA, 10 bp, Artificial sequence
  Synthetic
ttggtgcacc

SEQ ID NO: 17190 - DNA, 10 bp, Artificial sequence
  Synthetic
tgggccttta

SEQ ID NO: 17191 - DNA, 14 bp, Artificial sequence
  Synthetic
atattcatccagtt

SEQ ID NO: 17192 - DNA, 10 bp, Artificial sequence
  Synthetic
taagtacacg

SEQ ID NO: 17193 - DNA, 11 bp, Artificial sequence
  Synthetic
gtcccacaccg

SEQ ID NO: 17194 - DNA, 10 bp, Artificial sequence
  Synthetic
cagtaattct

SEQ ID NO: 17195 - DNA, 16 bp, Artificial sequence
  Synthetic
gtccactggaaactct

SEQ ID NO: 17196 - DNA, 10 bp, Artificial sequence
  Synthetic
ggggcgggcg

SEQ ID NO: 17197 - DNA, 17 bp, Artificial sequence
  Synthetic
tatttgttcacatttgt

SEQ ID NO: 17198 - DNA, 8 bp, Artificial sequence
  Synthetic
tgggcgta

SEQ ID NO: 17199 - DNA, 14 bp, Artificial sequence
  Synthetic
ttcacccgcaccgg

SEQ ID NO: 17200 - DNA, 10 bp, Artificial sequence
  Synthetic
gtcgtggtcc

SEQ ID NO: 17201 - DNA, 10 bp, Artificial sequence
  Synthetic
tatacgttta

SEQ ID NO: 17202 - DNA, 12 bp, Artificial sequence
  Synthetic
ggaagggcgggt

SEQ ID NO: 17203 - DNA, 10 bp, Artificial sequence
  Synthetic
gtttccagtt

SEQ ID NO: 17204 - DNA, 10 bp, Artificial sequence
  Synthetic
gtttccagtc

SEQ ID NO: 17205 - DNA, 14 bp, Artificial sequence
  Synthetic
tcctctactgagta

SEQ ID NO: 17206 - DNA, 8 bp, Artificial sequence
  Synthetic
gattaccg

SEQ ID NO: 17207 - DNA, 18 bp, Artificial sequence
  Synthetic
attggcgtttttggcgtt

SEQ ID NO: 17208 - DNA, 15 bp, Artificial sequence
  Synthetic
ttcatactcagtagt

SEQ ID NO: 17209 - DNA, 9 bp, Artificial sequence
  Synthetic
gggaggggg

SEQ ID NO: 17210 - DNA, 17 bp, Artificial sequence
  Synthetic
taaaatcaattgattcc

SEQ ID NO: 17211 - DNA, 11 bp, Artificial sequence
  Synthetic
ttctcctaatc

SEQ ID NO: 17212 - DNA, 15 bp, Artificial sequence
  Synthetic
ctcctactcagtggt

SEQ ID NO: 17213 - DNA, 9 bp, Artificial sequence
  Synthetic
cggcaatct

SEQ ID NO: 17214 - DNA, 17 bp, Artificial sequence
  Synthetic
cccttgtaatacatggg

SEQ ID NO: 17215 - DNA, 30 bp, Artificial sequence
  Synthetic
acggttgagggggtaatcacgagctgaggt

SEQ ID NO: 17216 - DNA, 17 bp, Artificial sequence
  Synthetic
ttctccctaattaatag

SEQ ID NO: 17217 - DNA, 16 bp, Artificial sequence
  Synthetic
gtcgtaattaatcatc

SEQ ID NO: 17218 - DNA, 9 bp, Artificial sequence
  Synthetic
tcctactta

SEQ ID NO: 17219 - DNA, 10 bp, Artificial sequence
  Synthetic
gaattaatcg

SEQ ID NO: 17220 - DNA, 8 bp, Artificial sequence
  Synthetic
gacaaatg

SEQ ID NO: 17221 - DNA, 22 bp, Artificial sequence
  Synthetic
gaaataaagaatagagattttt

SEQ ID NO: 17222 - DNA, 11 bp, Artificial sequence
  Synthetic
tactgagtagg

SEQ ID NO: 17223 - DNA, 11 bp, Artificial sequence
  Synthetic
tctattccgga

SEQ ID NO: 17224 - DNA, 17 bp, Artificial sequence
  Synthetic
ttttaacgactcagtac

SEQ ID NO: 17225 - DNA, 12 bp, Artificial sequence
  Synthetic
gtcgtcgacgac

SEQ ID NO: 17226 - DNA, 10 bp, Artificial sequence
  Synthetic
gtgtgtggac

SEQ ID NO: 17227 - DNA, 10 bp, Artificial sequence
  Synthetic
tagttccagt

SEQ ID NO: 17228 - DNA, 15 bp, Artificial sequence
  Synthetic
gtctagagcgctctc

SEQ ID NO: 17229 - DNA, 7 bp, Artificial sequence
  Synthetic
tgtccac

SEQ ID NO: 17230 - DNA, 15 bp, Artificial sequence
  Synthetic
cggtggtcccccgtg

SEQ ID NO: 17231 - DNA, 15 bp, Artificial sequence
  Synthetic
ttaaactaactaccc

SEQ ID NO: 17232 - DNA, 8 bp, Artificial sequence
  Synthetic
gttgtctt

SEQ ID NO: 17233 - DNA, 10 bp, Artificial sequence
  Synthetic
tcgtgaattc

SEQ ID NO: 17234 - DNA, 16 bp, Artificial sequence
  Synthetic
tccaattaattgagtt

SEQ ID NO: 17235 - DNA, 11 bp, Artificial sequence
  Synthetic
ttacatagtta

SEQ ID NO: 17236 - DNA, 18 bp, Artificial sequence
  Synthetic
tgtacaggtacctgtaca

SEQ ID NO: 17237 - DNA, 9 bp, Artificial sequence
  Synthetic
gtgcactgg

SEQ ID NO: 17238 - DNA, 10 bp, Artificial sequence
  Synthetic
tattaagtat

SEQ ID NO: 17239 - DNA, 14 bp, Artificial sequence
  Synthetic
agctccgatctggt

SEQ ID NO: 17240 - DNA, 15 bp, Artificial sequence
  Synthetic
agtcgtggtacctgt

SEQ ID NO: 17241 - DNA, 10 bp, Artificial sequence
  Synthetic
tttctactta

SEQ ID NO: 17242 - DNA, 10 bp, Artificial sequence
  Synthetic
cggtgcaccg

SEQ ID NO: 17243 - DNA, 17 bp, Artificial sequence
  Synthetic
ttagttaacgtcactaa

SEQ ID NO: 17244 - DNA, 11 bp, Artificial sequence
  Synthetic
gtacgcccatg

SEQ ID NO: 17245 - DNA, 14 bp, Artificial sequence
  Synthetic
taccgcgcacggcg

SEQ ID NO: 17246 - DNA, 10 bp, Artificial sequence
  Synthetic
gggttaatcg

SEQ ID NO: 17247 - DNA, 13 bp, Artificial sequence
  Synthetic
gttccaaccaacg

SEQ ID NO: 17248 - DNA, 16 bp, Artificial sequence
  Synthetic
ggtggtcccccgcggc

SEQ ID NO: 17249 - DNA, 10 bp, Artificial sequence
  Synthetic
ttttgatgtt

SEQ ID NO: 17250 - DNA, 11 bp, Artificial sequence
  Synthetic
acaaacgaatt

SEQ ID NO: 17251 - DNA, 15 bp, Artificial sequence
  Synthetic
ttttacatagtttaa

SEQ ID NO: 17252 - DNA, 11 bp, Artificial sequence
  Synthetic
cgcggacgcgt

SEQ ID NO: 17253 - DNA, 11 bp, Artificial sequence
  Synthetic
tggtggacaac

SEQ ID NO: 17254 - DNA, 9 bp, Artificial sequence
  Synthetic
ttggccaat

SEQ ID NO: 17255 - DNA, 10 bp, Artificial sequence
  Synthetic
tcgccttcac

SEQ ID NO: 17256 - DNA, 13 bp, Artificial sequence
  Synthetic
tatttgtttgtct

SEQ ID NO: 17257 - DNA, 13 bp, Artificial sequence
  Synthetic
ttttttatttgtt

SEQ ID NO: 17258 - DNA, 10 bp, Artificial sequence
  Synthetic
tgatcaattg

SEQ ID NO: 17259 - DNA, 11 bp, Artificial sequence
  Synthetic
ttacatttgtt

SEQ ID NO: 17260 - DNA, 14 bp, Artificial sequence
  Synthetic
acttacacgtcagt

SEQ ID NO: 17261 - DNA, 11 bp, Artificial sequence
  Synthetic
cactaaccaat

SEQ ID NO: 17262 - DNA, 15 bp, Artificial sequence
  Synthetic
ttccactgcagtagt

SEQ ID NO: 17263 - DNA, 10 bp, Artificial sequence
  Synthetic
ccgtgcgcgg

SEQ ID NO: 17264 - DNA, 16 bp, Artificial sequence
  Synthetic
ggctactgcagtaggg

SEQ ID NO: 17265 - DNA, 16 bp, Artificial sequence
  Synthetic
cccgtgcgttgggaat

SEQ ID NO: 17266 - DNA, 11 bp, Artificial sequence
  Synthetic
gtcggttactc

SEQ ID NO: 17267 - DNA, 15 bp, Artificial sequence
  Synthetic
ggccgtccacaggcg

SEQ ID NO: 17268 - DNA, 12 bp, Artificial sequence
  Synthetic
ggggaactcagt

SEQ ID NO: 17269 - DNA, 18 bp, Artificial sequence
  Synthetic
tttttaacgactgagtcg

SEQ ID NO: 17270 - DNA, 10 bp, Artificial sequence
  Synthetic
ccgttgcggg

SEQ ID NO: 17271 - DNA, 13 bp, Artificial sequence
  Synthetic
tttaacgactgca

SEQ ID NO: 17272 - DNA, 16 bp, Artificial sequence
  Synthetic
ttttttcttttacttt

SEQ ID NO: 17273 - DNA, 10 bp, Artificial sequence
  Synthetic
ttggaatata

SEQ ID NO: 17274 - DNA, 12 bp, Artificial sequence
  Synthetic
tgcgtcgacgcg

SEQ ID NO: 17275 - DNA, 10 bp, Artificial sequence
  Synthetic
ataattagct

SEQ ID NO: 17276 - DNA, 10 bp, Artificial sequence
  Synthetic
ccgtgcacgg

SEQ ID NO: 17277 - DNA, 15 bp, Artificial sequence
  Synthetic
tttatacgtttagtg

SEQ ID NO: 17278 - DNA, 16 bp, Artificial sequence
  Synthetic
gtcttgtctaacatgg

SEQ ID NO: 17279 - DNA, 6 bp, Artificial sequence
  Synthetic
attaat

SEQ ID NO: 17280 - DNA, 13 bp, Artificial sequence
  Synthetic
atttgtttttgtt

SEQ ID NO: 17281 - DNA, 6 bp, Artificial sequence
  Synthetic
ctaccg

SEQ ID NO: 17282 - DNA, 14 bp, Artificial sequence
  Synthetic
ccccaaagggatgg

SEQ ID NO: 17283 - DNA, 8 bp, Artificial sequence
  Synthetic
actgcagt

SEQ ID NO: 17284 - DNA, 9 bp, Artificial sequence
  Synthetic
ttcaggtca

SEQ ID NO: 17285 - DNA, 8 bp, Artificial sequence
  Synthetic
aattattt

SEQ ID NO: 17286 - DNA, 14 bp, Artificial sequence
  Synthetic
ctccagtactgggg

SEQ ID NO: 17287 - DNA, 17 bp, Artificial sequence
  Synthetic
ggggaggactacggggg

SEQ ID NO: 17288 - DNA, 8 bp, Artificial sequence
  Synthetic
atatttat

SEQ ID NO: 17289 - DNA, 11 bp, Artificial sequence
  Synthetic
ctagtgcactg

SEQ ID NO: 17290 - DNA, 12 bp, Artificial sequence
  Synthetic
tgcctgtgttac

SEQ ID NO: 17291 - DNA, 8 bp, Artificial sequence
  Synthetic
catgcagt

SEQ ID NO: 17292 - DNA, 16 bp, Artificial sequence
  Synthetic
gagcactggaaactct

SEQ ID NO: 17293 - DNA, 10 bp, Artificial sequence
  Synthetic
tttactgacc

SEQ ID NO: 17294 - DNA, 13 bp, Artificial sequence
  Synthetic
tagtctattcccc

SEQ ID NO: 17295 - DNA, 11 bp, Artificial sequence
  Synthetic
actactgcgtt

SEQ ID NO: 17296 - DNA, 6 bp, Artificial sequence
  Synthetic
tctatc

SEQ ID NO: 17297 - DNA, 13 bp, Artificial sequence
  Synthetic
tcccctaaaggtt

SEQ ID NO: 17298 - DNA, 11 bp, Artificial sequence
  Synthetic
ggcgactgagg

SEQ ID NO: 17299 - DNA, 8 bp, Artificial sequence
  Synthetic
cagtcgtt

SEQ ID NO: 17300 - DNA, 8 bp, Artificial sequence
  Synthetic
gttaatcg

SEQ ID NO: 17301 - DNA, 12 bp, Artificial sequence
  Synthetic
aaagcgcggttt

SEQ ID NO: 17302 - DNA, 12 bp, Artificial sequence
  Synthetic
ggaatgcagtgg

SEQ ID NO: 17303 - DNA, 10 bp, Artificial sequence
  Synthetic
ttcatccagt

SEQ ID NO: 17304 - DNA, 13 bp, Artificial sequence
  Synthetic
ttcatttatttgt

SEQ ID NO: 17305 - DNA, 13 bp, Artificial sequence
  Synthetic
tacacaaacaaat

SEQ ID NO: 17306 - DNA, 16 bp, Artificial sequence
  Synthetic
tagttacacgtcacta

SEQ ID NO: 17307 - DNA, 16 bp, Artificial sequence
  Synthetic
gcttaaaataccgagg

SEQ ID NO: 17308 - DNA, 8 bp, Artificial sequence
  Synthetic
tccacact

SEQ ID NO: 17309 - DNA, 16 bp, Artificial sequence
  Synthetic
tttaaaataatggcaa

SEQ ID NO: 17310 - DNA, 15 bp, Artificial sequence
  Synthetic
ccaattactaatggt

SEQ ID NO: 17311 - DNA, 12 bp, Artificial sequence
  Synthetic
ttctaacgcgtt

SEQ ID NO: 17312 - DNA, 17 bp, Artificial sequence
  Synthetic
ggttaattaattaatgc

SEQ ID NO: 17313 - DNA, 6 bp, Artificial sequence
  Synthetic
ttaata

SEQ ID NO: 17314 - DNA, 15 bp, Artificial sequence
  Synthetic
ggagagggaggaggg

SEQ ID NO: 17315 - DNA, 12 bp, Artificial sequence
  Synthetic
ccctttaggggt

SEQ ID NO: 17316 - DNA, 12 bp, Artificial sequence
  Synthetic
ccctttaggggg

SEQ ID NO: 17317 - DNA, 6 bp, Artificial sequence
  Synthetic
ttaatt

SEQ ID NO: 17318 - DNA, 14 bp, Artificial sequence
  Synthetic
acgaaagatccttt

SEQ ID NO: 17319 - DNA, 6 bp, Artificial sequence
  Synthetic
ttaatc

SEQ ID NO: 17320 - DNA, 9 bp, Artificial sequence
  Synthetic
tcgcactgc

SEQ ID NO: 17321 - DNA, 16 bp, Artificial sequence
  Synthetic
aagttaacaagatttt

SEQ ID NO: 17322 - DNA, 13 bp, Artificial sequence
  Synthetic
tcgggttccagtg

SEQ ID NO: 17323 - DNA, 23 bp, Artificial sequence
  Synthetic
cggcggtagaacccacgcccgtt

SEQ ID NO: 17324 - DNA, 16 bp, Artificial sequence
  Synthetic
tttggagcattttaaa

SEQ ID NO: 17325 - DNA, 9 bp, Artificial sequence
  Synthetic
gggtatttt

SEQ ID NO: 17326 - DNA, 10 bp, Artificial sequence
  Synthetic
tcgttaattg

SEQ ID NO: 17327 - DNA, 10 bp, Artificial sequence
  Synthetic
tggaaactgg

SEQ ID NO: 17328 - DNA, 10 bp, Artificial sequence
  Synthetic
ttaactatgt

SEQ ID NO: 17329 - DNA, 10 bp, Artificial sequence
  Synthetic
gactgcagtg

SEQ ID NO: 17330 - DNA, 10 bp, Artificial sequence
  Synthetic
ttacatagtt

SEQ ID NO: 17331 - DNA, 21 bp, Artificial sequence
  Synthetic
tcgtcaattattaattggtat

SEQ ID NO: 17332 - DNA, 10 bp, Artificial sequence
  Synthetic
cgattaattg

SEQ ID NO: 17333 - DNA, 16 bp, Artificial sequence
  Synthetic
ttaaagttcaccgaat

SEQ ID NO: 17334 - DNA, 16 bp, Artificial sequence
  Synthetic
tgcaattaatggggtt

SEQ ID NO: 17335 - DNA, 11 bp, Artificial sequence
  Synthetic
tggtcccccgc

SEQ ID NO: 17336 - DNA, 11 bp, Artificial sequence
  Synthetic
cgtctattcct

SEQ ID NO: 17337 - DNA, 17 bp, Artificial sequence
  Synthetic
ttttgtagcaaaaattc

SEQ ID NO: 17338 - DNA, 19 bp, Artificial sequence
  Synthetic
cccctagcgcactgttggg

SEQ ID NO: 17339 - DNA, 17 bp, Artificial sequence
  Synthetic
gcttaattaattgttat

SEQ ID NO: 17340 - DNA, 9 bp, Artificial sequence
  Synthetic
actgcatgt

SEQ ID NO: 17341 - DNA, 21 bp, Artificial sequence
  Synthetic
cttgatgttaagggtcttccg

SEQ ID NO: 17342 - DNA, 14 bp, Artificial sequence
  Synthetic
gtaacattacgttt

SEQ ID NO: 17343 - DNA, 13 bp, Artificial sequence
  Synthetic
ttttaattaatta

SEQ ID NO: 17344 - DNA, 17 bp, Artificial sequence
  Synthetic
tccagtgcctctccagt

SEQ ID NO: 17345 - DNA, 17 bp, Artificial sequence
  Synthetic
catcaattaggggaatt

SEQ ID NO: 17346 - DNA, 27 bp, Artificial sequence
  Synthetic
ggtgcttcttgtggtacaggggtgggg

SEQ ID NO: 17347 - DNA, 18 bp, Artificial sequence
  Synthetic
tacggtgcggggaaaaac

SEQ ID NO: 17348 - DNA, 12 bp, Artificial sequence
  Synthetic
ggtggactcggg

SEQ ID NO: 17349 - DNA, 15 bp, Artificial sequence
  Synthetic
tcttgtgggacatgg

SEQ ID NO: 17350 - DNA, 8 bp, Artificial sequence
  Synthetic
ggacagtt

SEQ ID NO: 17351 - DNA, 16 bp, Artificial sequence
  Synthetic
tctattctattctatt

SEQ ID NO: 17352 - DNA, 14 bp, Artificial sequence
  Synthetic
cttactgtgtcgct

SEQ ID NO: 17353 - DNA, 6 bp, Artificial sequence
  Synthetic
atacgt

SEQ ID NO: 17354 - DNA, 11 bp, Artificial sequence
  Synthetic
ttactcagtgt

SEQ ID NO: 17355 - DNA, 14 bp, Artificial sequence
  Synthetic
aaaaccgcggtttt

SEQ ID NO: 17356 - DNA, 9 bp, Artificial sequence
  Synthetic
ggttaattt

SEQ ID NO: 17357 - DNA, 8 bp, Artificial sequence
  Synthetic
tgattaat

SEQ ID NO: 17358 - DNA, 11 bp, Artificial sequence
  Synthetic
aggttaggtgt

SEQ ID NO: 17359 - DNA, 10 bp, Artificial sequence
  Synthetic
tttctattcg

SEQ ID NO: 17360 - DNA, 16 bp, Artificial sequence
  Synthetic
tgttacatagttaaac

SEQ ID NO: 17361 - DNA, 8 bp, Artificial sequence
  Synthetic
ttacatag

SEQ ID NO: 17362 - DNA, 20 bp, Artificial sequence
  Synthetic
tcgtcggttctaccggcgcc

SEQ ID NO: 17363 - DNA, 8 bp, Artificial sequence
  Synthetic
gaacagtt

SEQ ID NO: 17364 - DNA, 10 bp, Artificial sequence
  Synthetic
atacgtttat

SEQ ID NO: 17365 - DNA, 10 bp, Artificial sequence
  Synthetic
gcgtcgacgc

SEQ ID NO: 17366 - DNA, 19 bp, Artificial sequence
  Synthetic
ctcccgtcggttcgcactg

SEQ ID NO: 17367 - DNA, 10 bp, Artificial sequence
  Synthetic
ccagtgcatg

SEQ ID NO: 17368 - DNA, 16 bp, Artificial sequence
  Synthetic
ttttgtccttcatgca

SEQ ID NO: 17369 - DNA, 8 bp, Artificial sequence
  Synthetic
ctctagtt

SEQ ID NO: 17370 - DNA, 13 bp, Artificial sequence
  Synthetic
cccagtttccagt

SEQ ID NO: 17371 - DNA, 17 bp, Artificial sequence
  Synthetic
tggaaacaaatgtaaat

SEQ ID NO: 17372 - DNA, 20 bp, Artificial sequence
  Synthetic
cgcctgcaacgttgcaggcg

SEQ ID NO: 17373 - DNA, 21 bp, Artificial sequence
  Synthetic
gaccccccccgtctattccgt

SEQ ID NO: 17374 - DNA, 15 bp, Artificial sequence
  Synthetic
tcacccgccccggtt

SEQ ID NO: 17375 - DNA, 5 bp, Artificial sequence
  Synthetic
tggtt

SEQ ID NO: 17376 - DNA, 12 bp, Artificial sequence
  Synthetic
gtaatgcattgg

SEQ ID NO: 17377 - DNA, 7 bp, Artificial sequence
  Synthetic
catagtg

SEQ ID NO: 17378 - DNA, 12 bp, Artificial sequence
  Synthetic
gtaatgcattgt

SEQ ID NO: 17379 - DNA, 10 bp, Artificial sequence
  Synthetic
ccttcacttt

SEQ ID NO: 17380 - DNA, 11 bp, Artificial sequence
  Synthetic
tggcactggtg

SEQ ID NO: 17381 - DNA, 16 bp, Artificial sequence
  Synthetic
cgggcaaagcgcggtt

SEQ ID NO: 17382 - DNA, 10 bp, Artificial sequence
  Synthetic
gtcccccgcg

SEQ ID NO: 17383 - DNA, 14 bp, Artificial sequence
  Synthetic
cgatatttatcttg

SEQ ID NO: 17384 - DNA, 22 bp, Artificial sequence
  Synthetic
atgactaatacgtataaaaatt

SEQ ID NO: 17385 - DNA, 10 bp, Artificial sequence
  Synthetic
gttatttgtt

SEQ ID NO: 17386 - DNA, 15 bp, Artificial sequence
  Synthetic
ctccttaattttatg

SEQ ID NO: 17387 - DNA, 10 bp, Artificial sequence
  Synthetic
cgttatagct

SEQ ID NO: 17388 - DNA, 10 bp, Artificial sequence
  Synthetic
ttaacgactg

SEQ ID NO: 17389 - DNA, 13 bp, Artificial sequence
  Synthetic
tccccttagggga

SEQ ID NO: 17390 - DNA, 8 bp, Artificial sequence
  Synthetic
taattaat

SEQ ID NO: 17391 - DNA, 10 bp, Artificial sequence
  Synthetic
ttgtgcacaa

SEQ ID NO: 17392 - DNA, 15 bp, Artificial sequence
  Synthetic
tactgcgtatggggg

SEQ ID NO: 17393 - DNA, 11 bp, Artificial sequence
  Synthetic
ctactcagtgg

SEQ ID NO: 17394 - DNA, 15 bp, Artificial sequence
  Synthetic
ccgccctttaacctt

SEQ ID NO: 17395 - DNA, 10 bp, Artificial sequence
  Synthetic
tggcaaatcg

SEQ ID NO: 17396 - DNA, 14 bp, Artificial sequence
  Synthetic
gttgttacattgtt

SEQ ID NO: 17397 - DNA, 17 bp, Artificial sequence
  Synthetic
tccagtacgtttccagt

SEQ ID NO: 17398 - DNA, 11 bp, Artificial sequence
  Synthetic
tttttgtttgt

SEQ ID NO: 17399 - DNA, 11 bp, Artificial sequence
  Synthetic
tgcaatgtatt

SEQ ID NO: 17400 - DNA, 14 bp, Artificial sequence
  Synthetic
gttttactgtacgt

SEQ ID NO: 17401 - DNA, 15 bp, Artificial sequence
  Synthetic
ggtcgagtttggtcg

SEQ ID NO: 17402 - DNA, 16 bp, Artificial sequence
  Synthetic
ttactacgcccatgct

SEQ ID NO: 17403 - DNA, 9 bp, Artificial sequence
  Synthetic
tcgtttgtc

SEQ ID NO: 17404 - DNA, 9 bp, Artificial sequence
  Synthetic
cgtgcactg

SEQ ID NO: 17405 - DNA, 15 bp, Artificial sequence
  Synthetic
gtgaaggccctttac

SEQ ID NO: 17406 - DNA, 24 bp, Artificial sequence
  Synthetic
tccatctcttaatccactattttt

SEQ ID NO: 17407 - DNA, 11 bp, Artificial sequence
  Synthetic
caccccactat

SEQ ID NO: 17408 - DNA, 8 bp, Artificial sequence
  Synthetic
cagtattt

SEQ ID NO: 17409 - DNA, 10 bp, Artificial sequence
  Synthetic
tccccagtgc

SEQ ID NO: 17410 - DNA, 10 bp, Artificial sequence
  Synthetic
tccacacttt

SEQ ID NO: 17411 - DNA, 14 bp, Artificial sequence
  Synthetic
gggcgaagtcactg

SEQ ID NO: 17412 - DNA, 14 bp, Artificial sequence
  Synthetic
ggtgtccgtccacg

SEQ ID NO: 17413 - DNA, 7 bp, Artificial sequence
  Synthetic
tccagtg

SEQ ID NO: 17414 - DNA, 12 bp, Artificial sequence
  Synthetic
attaaacgtatt

SEQ ID NO: 17415 - DNA, 8 bp, Artificial sequence
  Synthetic
aacgcttt

SEQ ID NO: 17416 - DNA, 17 bp, Artificial sequence
  Synthetic
tgtaaggagcgtaaggt

SEQ ID NO: 17417 - DNA, 8 bp, Artificial sequence
  Synthetic
agtaattt

SEQ ID NO: 17418 - DNA, 9 bp, Artificial sequence
  Synthetic
tggtcgtcc

SEQ ID NO: 17419 - DNA, 12 bp, Artificial sequence
  Synthetic
gcgaaacaagag

SEQ ID NO: 17420 - DNA, 18 bp, Artificial sequence
  Synthetic
tttccagtaaactccagt

SEQ ID NO: 17421 - DNA, 11 bp, Artificial sequence
  Synthetic
ccctctattct

SEQ ID NO: 17422 - DNA, 13 bp, Artificial sequence
  Synthetic
cgtcgtcgacagt

SEQ ID NO: 17423 - DNA, 14 bp, Artificial sequence
  Synthetic
ttacatttgttgtg

SEQ ID NO: 17424 - DNA, 10 bp, Artificial sequence
  Synthetic
ttaaaaggtg

SEQ ID NO: 17425 - DNA, 19 bp, Artificial sequence
  Synthetic
tgatgttgagggtcgtccg

SEQ ID NO: 17426 - DNA, 17 bp, Artificial sequence
  Synthetic
ttcttgtccaacaacat

SEQ ID NO: 17427 - DNA, 12 bp, Artificial sequence
  Synthetic
ctaatgcattgg

SEQ ID NO: 17428 - DNA, 10 bp, Artificial sequence
  Synthetic
tgattaatgg

SEQ ID NO: 17429 - DNA, 6 bp, Artificial sequence
  Synthetic
aggggt

SEQ ID NO: 17430 - DNA, 12 bp, Artificial sequence
  Synthetic
caacggtccctt

SEQ ID NO: 17431 - DNA, 16 bp, Artificial sequence
  Synthetic
gttacgtaacacccat

SEQ ID NO: 17432 - DNA, 10 bp, Artificial sequence
  Synthetic
cggttagtct

SEQ ID NO: 17433 - DNA, 11 bp, Artificial sequence
  Synthetic
tggtataccgc

SEQ ID NO: 17434 - DNA, 15 bp, Artificial sequence
  Synthetic
tcttgtagtacatga

SEQ ID NO: 17435 - DNA, 5 bp, Artificial sequence
  Synthetic
cctat

SEQ ID NO: 17436 - DNA, 12 bp, Artificial sequence
  Synthetic
tttgtttgttag

SEQ ID NO: 17437 - DNA, 14 bp, Artificial sequence
  Synthetic
ttacgcccccgcct

SEQ ID NO: 17438 - DNA, 13 bp, Artificial sequence
  Synthetic
tccagtttccagt

SEQ ID NO: 17439 - DNA, 11 bp, Artificial sequence
  Synthetic
cacaccccttt

SEQ ID NO: 17440 - DNA, 14 bp, Artificial sequence
  Synthetic
tgttgtcgacaacg

SEQ ID NO: 17441 - DNA, 19 bp, Artificial sequence
  Synthetic
cgcgacaggcaccacgact

SEQ ID NO: 17442 - DNA, 15 bp, Artificial sequence
  Synthetic
ttccagttttccagt

SEQ ID NO: 17443 - DNA, 10 bp, Artificial sequence
  Synthetic
cagtgcactg

SEQ ID NO: 17444 - DNA, 14 bp, Artificial sequence
  Synthetic
tgattaatggagtt

SEQ ID NO: 17445 - DNA, 8 bp, Artificial sequence
  Synthetic
aattaatt

SEQ ID NO: 17446 - DNA, 16 bp, Artificial sequence
  Synthetic
taaacgtattgttacc

SEQ ID NO: 17447 - DNA, 20 bp, Artificial sequence
  Synthetic
atttcctttcggttttcact

SEQ ID NO: 17448 - DNA, 15 bp, Artificial sequence
  Synthetic
tatttggctttggtt

SEQ ID NO: 17449 - DNA, 14 bp, Artificial sequence
  Synthetic
ggtatattccgttt

SEQ ID NO: 17450 - DNA, 6 bp, Artificial sequence
  Synthetic
tactgc

SEQ ID NO: 17451 - DNA, 8 bp, Artificial sequence
  Synthetic
gtcgacgg

SEQ ID NO: 17452 - DNA, 8 bp, Artificial sequence
  Synthetic
cattagtt

SEQ ID NO: 17453 - DNA, 9 bp, Artificial sequence
  Synthetic
agcatttgt

SEQ ID NO: 17454 - DNA, 16 bp, Artificial sequence
  Synthetic
tccaattaaccaattt

SEQ ID NO: 17455 - DNA, 17 bp, Artificial sequence
  Synthetic
tttgttactgtaacaaa

SEQ ID NO: 17456 - DNA, 15 bp, Artificial sequence
  Synthetic
cgggggaccaccggt

SEQ ID NO: 17457 - DNA, 17 bp, Artificial sequence
  Synthetic
ttatatgtacattataa

SEQ ID NO: 17458 - DNA, 15 bp, Artificial sequence
  Synthetic
tttgatgtaaagggt

SEQ ID NO: 17459 - DNA, 15 bp, Artificial sequence
  Synthetic
gaccgtgacacggtt

SEQ ID NO: 17460 - DNA, 14 bp, Artificial sequence
  Synthetic
cgcaaataccgctg

SEQ ID NO: 17461 - DNA, 15 bp, Artificial sequence
  Synthetic
gtacgggaccccggt

SEQ ID NO: 17462 - DNA, 14 bp, Artificial sequence
  Synthetic
cctttcactttcgt

SEQ ID NO: 17463 - DNA, 14 bp, Artificial sequence
  Synthetic
ggtaaaggaccttt

SEQ ID NO: 17464 - DNA, 10 bp, Artificial sequence
  Synthetic
taaaatgctg

SEQ ID NO: 17465 - DNA, 12 bp, Artificial sequence
  Synthetic
gatggtagttag

SEQ ID NO: 17466 - DNA, 13 bp, Artificial sequence
  Synthetic
gggggagtggacg

SEQ ID NO: 17467 - DNA, 11 bp, Artificial sequence
  Synthetic
ggtggtctccc

SEQ ID NO: 17468 - DNA, 21 bp, Artificial sequence
  Synthetic
taaagggtagtacggaacgct

SEQ ID NO: 17469 - DNA, 8 bp, Artificial sequence
  Synthetic
gtggacgg

SEQ ID NO: 17470 - DNA, 18 bp, Artificial sequence
  Synthetic
gtaactggaaaactggag

SEQ ID NO: 17471 - DNA, 9 bp, Artificial sequence
  Synthetic
tcacggtta

SEQ ID NO: 17472 - DNA, 9 bp, Artificial sequence
  Synthetic
gcacggttc

SEQ ID NO: 17473 - DNA, 15 bp, Artificial sequence
  Synthetic
agtcgtggtgcctgt

SEQ ID NO: 17474 - DNA, 18 bp, Artificial sequence
  Synthetic
tccacaagacaattgtga

SEQ ID NO: 17475 - DNA, 8 bp, Artificial sequence
  Synthetic
tactgtgt

SEQ ID NO: 17476 - DNA, 13 bp, Artificial sequence
  Synthetic
tctttcccaatta

SEQ ID NO: 17477 - DNA, 8 bp, Artificial sequence
  Synthetic
ttagtttt

SEQ ID NO: 17478 - DNA, 17 bp, Artificial sequence
  Synthetic
tcctaaaatgctggaat

SEQ ID NO: 17479 - DNA, 15 bp, Artificial sequence
  Synthetic
ttcttgtcttacaag

SEQ ID NO: 17480 - DNA, 22 bp, Artificial sequence
  Synthetic
gcctctccccctcccccccccg

SEQ ID NO: 17481 - DNA, 11 bp, Artificial sequence
  Synthetic
ttgtagtttcc

SEQ ID NO: 17482 - DNA, 17 bp, Artificial sequence
  Synthetic
aggttgattaatcgagt

SEQ ID NO: 17483 - DNA, 13 bp, Artificial sequence
  Synthetic
tatataagtactc

SEQ ID NO: 17484 - DNA, 19 bp, Artificial sequence
  Synthetic
acacgtcagtacgcacttt

SEQ ID NO: 17485 - DNA, 14 bp, Artificial sequence
  Synthetic
tttaccgccctttg

SEQ ID NO: 17486 - DNA, 10 bp, Artificial sequence
  Synthetic
ttggtgaatt

SEQ ID NO: 17487 - DNA, 17 bp, Artificial sequence
  Synthetic
cccccgtgcaccgtaat

SEQ ID NO: 17488 - DNA, 14 bp, Artificial sequence
  Synthetic
aaaagggcggtttt

SEQ ID NO: 17489 - DNA, 11 bp, Artificial sequence
  Synthetic
tattccttttt

SEQ ID NO: 17490 - DNA, 12 bp, Artificial sequence
  Synthetic
ttctagtttccc

SEQ ID NO: 17491 - DNA, 10 bp, Artificial sequence
  Synthetic
tttgctttga

SEQ ID NO: 17492 - DNA, 10 bp, Artificial sequence
  Synthetic
gtacgcccat

SEQ ID NO: 17493 - DNA, 15 bp, Artificial sequence
  Synthetic
tatttgttaattagt

SEQ ID NO: 17494 - DNA, 21 bp, Artificial sequence
  Synthetic
ttttttttagttattgttctg

SEQ ID NO: 17495 - DNA, 8 bp, Artificial sequence
  Synthetic
tctccagt

SEQ ID NO: 17496 - DNA, 14 bp, Artificial sequence
  Synthetic
ccaattattaattg

SEQ ID NO: 17497 - DNA, 15 bp, Artificial sequence
  Synthetic
gtcgtactgagtcgt

SEQ ID NO: 17498 - DNA, 7 bp, Artificial sequence
  Synthetic
ttaaagg

SEQ ID NO: 17499 - DNA, 24 bp, Artificial sequence
  Synthetic
ttaaagtgtggatccacactgatc

SEQ ID NO: 17500 - DNA, 8 bp, Artificial sequence
  Synthetic
tatttgtt

SEQ ID NO: 17501 - DNA, 17 bp, Artificial sequence
  Synthetic
tttttactatggggtag

SEQ ID NO: 17502 - DNA, 8 bp, Artificial sequence
  Synthetic
attaatct

SEQ ID NO: 17503 - DNA, 8 bp, Artificial sequence
  Synthetic
tttggtgt

SEQ ID NO: 17504 - DNA, 8 bp, Artificial sequence
  Synthetic
gaattact

SEQ ID NO: 17505 - DNA, 17 bp, Artificial sequence
  Synthetic
tacgatttttatctaac

SEQ ID NO: 17506 - DNA, 14 bp, Artificial sequence
  Synthetic
taaaatgcctttta

SEQ ID NO: 17507 - DNA, 12 bp, Artificial sequence
  Synthetic
tttggtgaattt

SEQ ID NO: 17508 - DNA, 8 bp, Artificial sequence
  Synthetic
tcacccct

SEQ ID NO: 17509 - DNA, 10 bp, Artificial sequence
  Synthetic
ggttaatggc

SEQ ID NO: 17510 - DNA, 9 bp, Artificial sequence
  Synthetic
tgtctattg

SEQ ID NO: 17511 - DNA, 14 bp, Artificial sequence
  Synthetic
tttcaaaataacgg

SEQ ID NO: 17512 - DNA, 17 bp, Artificial sequence
  Synthetic
tccatgtgccacatggg

SEQ ID NO: 17513 - DNA, 9 bp, Artificial sequence
  Synthetic
gtccactcc

SEQ ID NO: 17514 - DNA, 13 bp, Artificial sequence
  Synthetic
ttattcatatatt

SEQ ID NO: 17515 - DNA, 17 bp, Artificial sequence
  Synthetic
ctttaaaatgctggatt

SEQ ID NO: 17516 - DNA, 11 bp, Artificial sequence
  Synthetic
cggtgcggggg

SEQ ID NO: 17517 - DNA, 15 bp, Artificial sequence
  Synthetic
gcaacggatcgttgc

SEQ ID NO: 17518 - DNA, 17 bp, Artificial sequence
  Synthetic
ttggccaatttggccaa

SEQ ID NO: 17519 - DNA, 9 bp, Artificial sequence
  Synthetic
tcgttaatt

SEQ ID NO: 17520 - DNA, 8 bp, Artificial sequence
  Synthetic
gacagttt

SEQ ID NO: 17521 - DNA, 9 bp, Artificial sequence
  Synthetic
cgttatttt

SEQ ID NO: 17522 - DNA, 9 bp, Artificial sequence
  Synthetic
tgttctatt

SEQ ID NO: 17523 - DNA, 15 bp, Artificial sequence
  Synthetic
ctggggggcgacgcg

SEQ ID NO: 17524 - DNA, 16 bp, Artificial sequence
  Synthetic
tagtcggttagtctcg

SEQ ID NO: 17525 - DNA, 15 bp, Artificial sequence
  Synthetic
taaacgtattgttac

SEQ ID NO: 17526 - DNA, 17 bp, Artificial sequence
  Synthetic
ttccagtgccactggac

SEQ ID NO: 17527 - DNA, 16 bp, Artificial sequence
  Synthetic
ttgttacacgtcacaa

SEQ ID NO: 17528 - DNA, 10 bp, Artificial sequence
  Synthetic
ggtcgactgc

SEQ ID NO: 17529 - DNA, 20 bp, Artificial sequence
  Synthetic
gtttccagtttaactccagt

SEQ ID NO: 17530 - DNA, 15 bp, Artificial sequence
  Synthetic
ttctaccgccggcgg

SEQ ID NO: 17531 - DNA, 10 bp, Artificial sequence
  Synthetic
ttctccttca

SEQ ID NO: 17532 - DNA, 6 bp, Artificial sequence
  Synthetic
taattt

SEQ ID NO: 17533 - DNA, 9 bp, Artificial sequence
  Synthetic
cggttaatt

SEQ ID NO: 17534 - DNA, 10 bp, Artificial sequence
  Synthetic
gcgaaggccg

SEQ ID NO: 17535 - DNA, 16 bp, Artificial sequence
  Synthetic
tttctggacagttagg

SEQ ID NO: 17536 - DNA, 10 bp, Artificial sequence
  Synthetic
gtgtcgacgc

SEQ ID NO: 17537 - DNA, 8 bp, Artificial sequence
  Synthetic
tggggcct

SEQ ID NO: 17538 - DNA, 16 bp, Artificial sequence
  Synthetic
tggccgttaattattt

SEQ ID NO: 17539 - DNA, 14 bp, Artificial sequence
  Synthetic
ctccagtttccagt

SEQ ID NO: 17540 - DNA, 23 bp, Artificial sequence
  Synthetic
agagtgtggagactccacacttt

SEQ ID NO: 17541 - DNA, 15 bp, Artificial sequence
  Synthetic
ggggcggaaaatatg

SEQ ID NO: 17542 - DNA, 15 bp, Artificial sequence
  Synthetic
ttcacgaaggcccag

SEQ ID NO: 17543 - DNA, 16 bp, Artificial sequence
  Synthetic
ttgtgacgttaacaag

SEQ ID NO: 17544 - DNA, 14 bp, Artificial sequence
  Synthetic
tgcgcggagcccgc

SEQ ID NO: 17545 - DNA, 15 bp, Artificial sequence
  Synthetic
ttgttaacgtcacaa

SEQ ID NO: 17546 - DNA, 9 bp, Artificial sequence
  Synthetic
ctggggggt

SEQ ID NO: 17547 - DNA, 13 bp, Artificial sequence
  Synthetic
acgactgagtcgt

SEQ ID NO: 17548 - DNA, 9 bp, Artificial sequence
  Synthetic
gttgggttt

SEQ ID NO: 17549 - DNA, 18 bp, Artificial sequence
  Synthetic
tccacacttcagtgtgga

SEQ ID NO: 17550 - DNA, 17 bp, Artificial sequence
  Synthetic
gggtaattaattagtgg

SEQ ID NO: 17551 - DNA, 8 bp, Artificial sequence
  Synthetic
attgttat

SEQ ID NO: 17552 - DNA, 8 bp, Artificial sequence
  Synthetic
taaataac

SEQ ID NO: 17553 - DNA, 16 bp, Artificial sequence
  Synthetic
ccattcatttatttgt

SEQ ID NO: 17554 - DNA, 13 bp, Artificial sequence
  Synthetic
agttattgtaact

SEQ ID NO: 17555 - DNA, 21 bp, Artificial sequence
  Synthetic
ttagtaaaggccctttacggt

SEQ ID NO: 17556 - DNA, 15 bp, Artificial sequence
  Synthetic
taagggactcccctt

SEQ ID NO: 17557 - DNA, 10 bp, Artificial sequence
  Synthetic
cattattttt

SEQ ID NO: 17558 - DNA, 10 bp, Artificial sequence
  Synthetic
cggggcgggt

SEQ ID NO: 17559 - DNA, 16 bp, Artificial sequence
  Synthetic
agtgtggatccacact

SEQ ID NO: 17560 - DNA, 14 bp, Artificial sequence
  Synthetic
taagggttccctta

SEQ ID NO: 17561 - DNA, 21 bp, Artificial sequence
  Synthetic
taccctaaaggccctttaccc

SEQ ID NO: 17562 - DNA, 17 bp, Artificial sequence
  Synthetic
atttgattaatcgacat

SEQ ID NO: 17563 - DNA, 16 bp, Artificial sequence
  Synthetic
tttcattaatcactta

SEQ ID NO: 17564 - DNA, 11 bp, Artificial sequence
  Synthetic
gagcgccctgg

SEQ ID NO: 17565 - DNA, 7 bp, Artificial sequence
  Synthetic
ttctatt

SEQ ID NO: 17566 - DNA, 10 bp, Artificial sequence
  Synthetic
gatttttatt

SEQ ID NO: 17567 - DNA, 15 bp, Artificial sequence
  Synthetic
gattaaccgttaatt

SEQ ID NO: 17568 - DNA, 16 bp, Artificial sequence
  Synthetic
gtctcgattaatgggg

SEQ ID NO: 17569 - DNA, 10 bp, Artificial sequence
  Synthetic
ttgtccttca

SEQ ID NO: 17570 - DNA, 13 bp, Artificial sequence
  Synthetic
tcgaactaactac

SEQ ID NO: 17571 - DNA, 12 bp, Artificial sequence
  Synthetic
tgatatttatct

SEQ ID NO: 17572 - DNA, 9 bp, Artificial sequence
  Synthetic
tactgcgtt

SEQ ID NO: 17573 - DNA, 8 bp, Artificial sequence
  Synthetic
ggttaatg

SEQ ID NO: 17574 - DNA, 16 bp, Artificial sequence
  Synthetic
gactccattaatggag

SEQ ID NO: 17575 - DNA, 10 bp, Artificial sequence
  Synthetic
tattaattat

SEQ ID NO: 17576 - DNA, 14 bp, Artificial sequence
  Synthetic
taaaggacaaacgg

SEQ ID NO: 17577 - DNA, 16 bp, Artificial sequence
  Synthetic
cgtctttcttcattgt

SEQ ID NO: 17578 - DNA, 9 bp, Artificial sequence
  Synthetic
taatgtagt

SEQ ID NO: 17579 - DNA, 8 bp, Artificial sequence
  Synthetic
tacgttta

SEQ ID NO: 17580 - DNA, 17 bp, Artificial sequence
  Synthetic
tacaaatgccatttgtt

SEQ ID NO: 17581 - DNA, 9 bp, Artificial sequence
  Synthetic
ttacgtcac

SEQ ID NO: 17582 - DNA, 14 bp, Artificial sequence
  Synthetic
ttttttataaatga

SEQ ID NO: 17583 - DNA, 20 bp, Artificial sequence
  Synthetic
tcatccagtggcactggatg

SEQ ID NO: 17584 - DNA, 16 bp, Artificial sequence
  Synthetic
tttcgagcattttaaa

SEQ ID NO: 17585 - DNA, 10 bp, Artificial sequence
  Synthetic
taacatgtta

SEQ ID NO: 17586 - DNA, 9 bp, Artificial sequence
  Synthetic
ccgttattt

SEQ ID NO: 17587 - DNA, 9 bp, Artificial sequence
  Synthetic
gaatgcagt

SEQ ID NO: 17588 - DNA, 7 bp, Artificial sequence
  Synthetic
ttactga

SEQ ID NO: 17589 - DNA, 15 bp, Artificial sequence
  Synthetic
tccagttccagtggg

SEQ ID NO: 17590 - DNA, 10 bp, Artificial sequence
  Synthetic
tcgggcacgc

SEQ ID NO: 17591 - DNA, 18 bp, Artificial sequence
  Synthetic
gaccacccctgtctattc

SEQ ID NO: 17592 - DNA, 10 bp, Artificial sequence
  Synthetic
gtgtcgactg

SEQ ID NO: 17593 - DNA, 10 bp, Artificial sequence
  Synthetic
gcgcgcaccg

SEQ ID NO: 17594 - DNA, 10 bp, Artificial sequence
  Synthetic
cccccgcatt

SEQ ID NO: 17595 - DNA, 9 bp, Artificial sequence
  Synthetic
gcaattact

SEQ ID NO: 17596 - DNA, 8 bp, Artificial sequence
  Synthetic
ggcggttt

SEQ ID NO: 17597 - DNA, 15 bp, Artificial sequence
  Synthetic
tagttacgttaacta

SEQ ID NO: 17598 - DNA, 12 bp, Artificial sequence
  Synthetic
cgactcagtcgt

SEQ ID NO: 17599 - DNA, 17 bp, Artificial sequence
  Synthetic
taagatctttaaagagg

SEQ ID NO: 17600 - DNA, 15 bp, Artificial sequence
  Synthetic
tttccctactgagta

SEQ ID NO: 17601 - DNA, 9 bp, Artificial sequence
  Synthetic
tgagtggtg

SEQ ID NO: 17602 - DNA, 7 bp, Artificial sequence
  Synthetic
ggcgatt

SEQ ID NO: 17603 - DNA, 10 bp, Artificial sequence
  Synthetic
tggtggacag

SEQ ID NO: 17604 - DNA, 12 bp, Artificial sequence
  Synthetic
ccggtttcaggt

SEQ ID NO: 17605 - DNA, 9 bp, Artificial sequence
  Synthetic
cgcatttat

SEQ ID NO: 17606 - DNA, 14 bp, Artificial sequence
  Synthetic
caaatcttgttaat

SEQ ID NO: 17607 - DNA, 8 bp, Artificial sequence
  Synthetic
gtcgacag

SEQ ID NO: 17608 - DNA, 10 bp, Artificial sequence
  Synthetic
agagcgctct

SEQ ID NO: 17609 - DNA, 8 bp, Artificial sequence
  Synthetic
gggagggg

SEQ ID NO: 17610 - DNA, 18 bp, Artificial sequence
  Synthetic
ttccagtagatttccagt

SEQ ID NO: 17611 - DNA, 14 bp, Artificial sequence
  Synthetic
ttgatgttgagggt

SEQ ID NO: 17612 - DNA, 9 bp, Artificial sequence
  Synthetic
cggagtccg

SEQ ID NO: 17613 - DNA, 29 bp, Artificial sequence
  Synthetic
cttgtctagtttgaaatcgaagttatgtt

SEQ ID NO: 17614 - DNA, 14 bp, Artificial sequence
  Synthetic
ggggcgggtgcgtg

SEQ ID NO: 17615 - DNA, 6 bp, Artificial sequence
  Synthetic
tcaagt

SEQ ID NO: 17616 - DNA, 16 bp, Artificial sequence
  Synthetic
gacaccccccagctat

SEQ ID NO: 17617 - DNA, 16 bp, Artificial sequence
  Synthetic
gtggtcccccgcggtc

SEQ ID NO: 17618 - DNA, 14 bp, Artificial sequence
  Synthetic
attaattcgttaat

SEQ ID NO: 17619 - DNA, 21 bp, Artificial sequence
  Synthetic
cggacgaccctcaacatcagg

SEQ ID NO: 17620 - DNA, 11 bp, Artificial sequence
  Synthetic
tactgagtcgt

SEQ ID NO: 17621 - DNA, 16 bp, Artificial sequence
  Synthetic
tagaacaaatacatat

SEQ ID NO: 17622 - DNA, 22 bp, Artificial sequence
  Synthetic
tccacgataaaaatcgtggcct

SEQ ID NO: 17623 - DNA, 17 bp, Artificial sequence
  Synthetic
ttacgactgagtcgtgt

SEQ ID NO: 17624 - DNA, 11 bp, Artificial sequence
  Synthetic
gaaggtccttc

SEQ ID NO: 17625 - DNA, 13 bp, Artificial sequence
  Synthetic
gacaatgcattag

SEQ ID NO: 17626 - DNA, 15 bp, Artificial sequence
  Synthetic
aagctttgcaagctt

SEQ ID NO: 17627 - DNA, 15 bp, Artificial sequence
  Synthetic
ttgttattgtaacaa

SEQ ID NO: 17628 - DNA, 10 bp, Artificial sequence
  Synthetic
tcggtgaatt

SEQ ID NO: 17629 - DNA, 17 bp, Artificial sequence
  Synthetic
gggtggacggtagatcc

SEQ ID NO: 17630 - DNA, 13 bp, Artificial sequence
  Synthetic
gccgagatagtag

SEQ ID NO: 17631 - DNA, 12 bp, Artificial sequence
  Synthetic
tacttataagta

SEQ ID NO: 17632 - DNA, 14 bp, Artificial sequence
  Synthetic
gcagcacccaccag

SEQ ID NO: 17633 - DNA, 27 bp, Artificial sequence
  Synthetic
gcgtgttcttgtgttacatgggagggc

SEQ ID NO: 17634 - DNA, 16 bp, Artificial sequence
  Synthetic
gtaattcatgaatttc

SEQ ID NO: 17635 - DNA, 10 bp, Artificial sequence
  Synthetic
gaattaaccg

SEQ ID NO: 17636 - DNA, 13 bp, Artificial sequence
  Synthetic
tcagtatgacttt

SEQ ID NO: 17637 - DNA, 12 bp, Artificial sequence
  Synthetic
tacttataagtt

SEQ ID NO: 17638 - DNA, 10 bp, Artificial sequence
  Synthetic
tgggccttca

SEQ ID NO: 17639 - DNA, 13 bp, Artificial sequence
  Synthetic
gtactgagtcgtc

SEQ ID NO: 17640 - DNA, 10 bp, Artificial sequence
  Synthetic
ttaacccagt

SEQ ID NO: 17641 - DNA, 17 bp, Artificial sequence
  Synthetic
ccccagtcatctccagt

SEQ ID NO: 17642 - DNA, 8 bp, Artificial sequence
  Synthetic
ttttgtta

SEQ ID NO: 17643 - DNA, 8 bp, Artificial sequence
  Synthetic
gtaaaggc

SEQ ID NO: 17644 - DNA, 5 bp, Artificial sequence
  Synthetic
tttgt

SEQ ID NO: 17645 - DNA, 19 bp, Artificial sequence
  Synthetic
cccccgtcggttcgcactg

SEQ ID NO: 17646 - DNA, 13 bp, Artificial sequence
  Synthetic
cgtttcgtttgtt

SEQ ID NO: 17647 - DNA, 16 bp, Artificial sequence
  Synthetic
taacctgaaactgggg

SEQ ID NO: 17648 - DNA, 8 bp, Artificial sequence
  Synthetic
ccctcgtg

SEQ ID NO: 17649 - DNA, 12 bp, Artificial sequence
  Synthetic
accgtgcacggt

SEQ ID NO: 17650 - DNA, 17 bp, Artificial sequence
  Synthetic
tccagttgatttccagt

SEQ ID NO: 17651 - DNA, 21 bp, Artificial sequence
  Synthetic
gcgattagccttttgctaatc

SEQ ID NO: 17652 - DNA, 9 bp, Artificial sequence
  Synthetic
tctccctcc

SEQ ID NO: 17653 - DNA, 11 bp, Artificial sequence
  Synthetic
gcgtccacacg

SEQ ID NO: 17654 - DNA, 9 bp, Artificial sequence
  Synthetic
taacaaaag

SEQ ID NO: 17655 - DNA, 10 bp, Artificial sequence
  Synthetic
taaccgcgcg

SEQ ID NO: 17656 - DNA, 14 bp, Artificial sequence
  Synthetic
gtcaaagccaagag

SEQ ID NO: 17657 - DNA, 17 bp, Artificial sequence
  Synthetic
ttctaaaatgctggaac

SEQ ID NO: 17658 - DNA, 12 bp, Artificial sequence
  Synthetic
gtcacaccagcg

SEQ ID NO: 17659 - DNA, 9 bp, Artificial sequence
  Synthetic
tggtgaatt

SEQ ID NO: 17660 - DNA, 17 bp, Artificial sequence
  Synthetic
tgttcgttaattactta

SEQ ID NO: 17661 - DNA, 17 bp, Artificial sequence
  Synthetic
ctccagtccagtccagt

SEQ ID NO: 17662 - DNA, 16 bp, Artificial sequence
  Synthetic
tgatacggttggatgg

SEQ ID NO: 17663 - DNA, 10 bp, Artificial sequence
  Synthetic
accctaattt

SEQ ID NO: 17664 - DNA, 15 bp, Artificial sequence
  Synthetic
ttcttactcagtagt

SEQ ID NO: 17665 - DNA, 10 bp, Artificial sequence
  Synthetic
gttcacgcac

SEQ ID NO: 17666 - DNA, 16 bp, Artificial sequence
  Synthetic
ttctattctattctat

SEQ ID NO: 17667 - DNA, 10 bp, Artificial sequence
  Synthetic
ggtaggtagt

SEQ ID NO: 17668 - DNA, 15 bp, Artificial sequence
  Synthetic
ccgccctttaaactt

SEQ ID NO: 17669 - DNA, 11 bp, Artificial sequence
  Synthetic
tgactcagtgg

SEQ ID NO: 17670 - DNA, 13 bp, Artificial sequence
  Synthetic
tgaacccttatgg

SEQ ID NO: 17671 - DNA, 17 bp, Artificial sequence
  Synthetic
ctccagttttccagtgt

SEQ ID NO: 17672 - DNA, 15 bp, Artificial sequence
  Synthetic
cgtcggttcgcactg

SEQ ID NO: 17673 - DNA, 9 bp, Artificial sequence
  Synthetic
cgattaggg

SEQ ID NO: 17674 - DNA, 10 bp, Artificial sequence
  Synthetic
ttattaatat

SEQ ID NO: 17675 - DNA, 14 bp, Artificial sequence
  Synthetic
cgtggtccctgtcg

SEQ ID NO: 17676 - DNA, 14 bp, Artificial sequence
  Synthetic
atacttataagttt

SEQ ID NO: 17677 - DNA, 13 bp, Artificial sequence
  Synthetic
actgtcgacagtt

SEQ ID NO: 17678 - DNA, 9 bp, Artificial sequence
  Synthetic
gcaagcttt

SEQ ID NO: 17679 - DNA, 16 bp, Artificial sequence
  Synthetic
tccccagttcccaagt

SEQ ID NO: 17680 - DNA, 20 bp, Artificial sequence
  Synthetic
gaggccgcgggggaccaccg

SEQ ID NO: 17681 - DNA, 12 bp, Artificial sequence
  Synthetic
ttaatcgtatct

SEQ ID NO: 17682 - DNA, 15 bp, Artificial sequence
  Synthetic
tcacggtggatcacc

SEQ ID NO: 17683 - DNA, 21 bp, Artificial sequence
  Synthetic
gagcccgcgggggaccaccgg

SEQ ID NO: 17684 - DNA, 9 bp, Artificial sequence
  Synthetic
tccctaatt

SEQ ID NO: 17685 - DNA, 21 bp, Artificial sequence
  Synthetic
gcccactggaaactggggact

SEQ ID NO: 17686 - DNA, 8 bp, Artificial sequence
  Synthetic
cattaatt

SEQ ID NO: 17687 - DNA, 19 bp, Artificial sequence
  Synthetic
gacttgaaaaaactggagt

SEQ ID NO: 17688 - DNA, 8 bp, Artificial sequence
  Synthetic
cattaatg

SEQ ID NO: 17689 - DNA, 12 bp, Artificial sequence
  Synthetic
ataatgcattgt

SEQ ID NO: 17690 - DNA, 18 bp, Artificial sequence
  Synthetic
cctttcgctttggttttg

SEQ ID NO: 17691 - DNA, 10 bp, Artificial sequence
  Synthetic
ttgtatacag

SEQ ID NO: 17692 - DNA, 15 bp, Artificial sequence
  Synthetic
tcttgtcttacaaga

SEQ ID NO: 17693 - DNA, 17 bp, Artificial sequence
  Synthetic
ttagcgattaatcgcga

SEQ ID NO: 17694 - DNA, 10 bp, Artificial sequence
  Synthetic
atgcgcgcat

SEQ ID NO: 17695 - DNA, 10 bp, Artificial sequence
  Synthetic
ttgtatacaa

SEQ ID NO: 17696 - DNA, 16 bp, Artificial sequence
  Synthetic
cgcccgtgcactgttg

SEQ ID NO: 17697 - DNA, 18 bp, Artificial sequence
  Synthetic
tggccttcatgtaggcca

SEQ ID NO: 17698 - DNA, 8 bp, Artificial sequence
  Synthetic
taattagg

SEQ ID NO: 17699 - DNA, 17 bp, Artificial sequence
  Synthetic
cggtggtctaccgtgat

SEQ ID NO: 17700 - DNA, 12 bp, Artificial sequence
  Synthetic
tctattttccct

SEQ ID NO: 17701 - DNA, 9 bp, Artificial sequence
  Synthetic
cgactaatg

SEQ ID NO: 17702 - DNA, 16 bp, Artificial sequence
  Synthetic
gccaaatttttattgg

SEQ ID NO: 17703 - DNA, 12 bp, Artificial sequence
  Synthetic
tttttagttatt

SEQ ID NO: 17704 - DNA, 11 bp, Artificial sequence
  Synthetic
ggttattttgg

SEQ ID NO: 17705 - DNA, 18 bp, Artificial sequence
  Synthetic
tggccttcatgtaggccg

SEQ ID NO: 17706 - DNA, 8 bp, Artificial sequence
  Synthetic
gtaacaat

SEQ ID NO: 17707 - DNA, 8 bp, Artificial sequence
  Synthetic
gtaacaag

SEQ ID NO: 17708 - DNA, 9 bp, Artificial sequence
  Synthetic
ccatttgtt

SEQ ID NO: 17709 - DNA, 6 bp, Artificial sequence
  Synthetic
gtgcgt

SEQ ID NO: 17710 - DNA, 12 bp, Artificial sequence
  Synthetic
acgggggactgt

SEQ ID NO: 17711 - DNA, 12 bp, Artificial sequence
  Synthetic
ctttaggggtcg

SEQ ID NO: 17712 - DNA, 12 bp, Artificial sequence
  Synthetic
caatttataatt

SEQ ID NO: 17713 - DNA, 14 bp, Artificial sequence
  Synthetic
attcttgttaccct

SEQ ID NO: 17714 - DNA, 10 bp, Artificial sequence
  Synthetic
ggtggggggg

SEQ ID NO: 17715 - DNA, 16 bp, Artificial sequence
  Synthetic
ttccattaatcgagta

SEQ ID NO: 17716 - DNA, 10 bp, Artificial sequence
  Synthetic
tcgtgaactc

SEQ ID NO: 17717 - DNA, 19 bp, Artificial sequence
  Synthetic
ggtaccggtttattccgtt

SEQ ID NO: 17718 - DNA, 8 bp, Artificial sequence
  Synthetic
ttccccgc

SEQ ID NO: 17719 - DNA, 16 bp, Artificial sequence
  Synthetic
tacgcccatgggcgta

SEQ ID NO: 17720 - DNA, 16 bp, Artificial sequence
  Synthetic
ctctggtagacaaggg

SEQ ID NO: 17721 - DNA, 12 bp, Artificial sequence
  Synthetic
gtcgccccccag

SEQ ID NO: 17722 - DNA, 13 bp, Artificial sequence
  Synthetic
ttgggccttcatt

SEQ ID NO: 17723 - DNA, 17 bp, Artificial sequence
  Synthetic
actgcacggtccgcttt

SEQ ID NO: 17724 - DNA, 12 bp, Artificial sequence
  Synthetic
ccaatgcgttat

SEQ ID NO: 17725 - DNA, 12 bp, Artificial sequence
  Synthetic
tttatttgttat

SEQ ID NO: 17726 - DNA, 10 bp, Artificial sequence
  Synthetic
ataatgcatt

SEQ ID NO: 17727 - DNA, 11 bp, Artificial sequence
  Synthetic
aaaggtccttt

SEQ ID NO: 17728 - DNA, 13 bp, Artificial sequence
  Synthetic
gccggttttactg

SEQ ID NO: 17729 - DNA, 13 bp, Artificial sequence
  Synthetic
acaacgatccctt

SEQ ID NO: 17730 - DNA, 11 bp, Artificial sequence
  Synthetic
ggtggacagtg

SEQ ID NO: 17731 - DNA, 8 bp, Artificial sequence
  Synthetic
tggcaata

SEQ ID NO: 17732 - DNA, 11 bp, Artificial sequence
  Synthetic
tgaatcagtga

SEQ ID NO: 17733 - DNA, 17 bp, Artificial sequence
  Synthetic
cggtgtccttcactcct

SEQ ID NO: 17734 - DNA, 14 bp, Artificial sequence
  Synthetic
tataacgttttagt

SEQ ID NO: 17735 - DNA, 18 bp, Artificial sequence
  Synthetic
ttcatccagtttccagtg

SEQ ID NO: 17736 - DNA, 16 bp, Artificial sequence
  Synthetic
tcccaataaaaatctc

SEQ ID NO: 17737 - DNA, 16 bp, Artificial sequence
  Synthetic
cccggcacacgttttt

SEQ ID NO: 17738 - DNA, 17 bp, Artificial sequence
  Synthetic
ttttcactatggggtaa

SEQ ID NO: 17739 - DNA, 17 bp, Artificial sequence
  Synthetic
gtattggtgaattgttg

SEQ ID NO: 17740 - DNA, 12 bp, Artificial sequence
  Synthetic
taaccgcggttt

SEQ ID NO: 17741 - DNA, 10 bp, Artificial sequence
  Synthetic
taattgtatt

SEQ ID NO: 17742 - DNA, 10 bp, Artificial sequence
  Synthetic
attttgtttt

SEQ ID NO: 17743 - DNA, 11 bp, Artificial sequence
  Synthetic
attaaattagt

SEQ ID NO: 17744 - DNA, 14 bp, Artificial sequence
  Synthetic
catttgttatttgt

SEQ ID NO: 17745 - DNA, 17 bp, Artificial sequence
  Synthetic
tgccgatcaattgtcga

SEQ ID NO: 17746 - DNA, 8 bp, Artificial sequence
  Synthetic
ttggcttt

SEQ ID NO: 17747 - DNA, 9 bp, Artificial sequence
  Synthetic
attaatttt

SEQ ID NO: 17748 - DNA, 17 bp, Artificial sequence
  Synthetic
taggtaattaattaact

SEQ ID NO: 17749 - DNA, 11 bp, Artificial sequence
  Synthetic
tgggcctacat

SEQ ID NO: 17750 - DNA, 12 bp, Artificial sequence
  Synthetic
tttccacagttt

SEQ ID NO: 17751 - DNA, 10 bp, Artificial sequence
  Synthetic
taacgtgttg

SEQ ID NO: 17752 - DNA, 14 bp, Artificial sequence
  Synthetic
tttggtgcaccaaa

SEQ ID NO: 17753 - DNA, 17 bp, Artificial sequence
  Synthetic
ctgaattaattaattag

SEQ ID NO: 17754 - DNA, 12 bp, Artificial sequence
  Synthetic
gtggtcccccgc

SEQ ID NO: 17755 - DNA, 10 bp, Artificial sequence
  Synthetic
taacgtgtta

SEQ ID NO: 17756 - DNA, 15 bp, Artificial sequence
  Synthetic
cttaaggtcctttat

SEQ ID NO: 17757 - DNA, 25 bp, Artificial sequence
  Synthetic
tgtatcactgtggatccacacttta

SEQ ID NO: 17758 - DNA, 17 bp, Artificial sequence
  Synthetic
tccagtggctctccagt

SEQ ID NO: 17759 - DNA, 11 bp, Artificial sequence
  Synthetic
tccttcacgtt

SEQ ID NO: 17760 - DNA, 10 bp, Artificial sequence
  Synthetic
taatgcatta

SEQ ID NO: 17761 - DNA, 8 bp, Artificial sequence
  Synthetic
tggcgggt

SEQ ID NO: 17762 - DNA, 30 bp, Artificial sequence
  Synthetic
tctcctctcctcttctcctccctccttctc

SEQ ID NO: 17763 - DNA, 10 bp, Artificial sequence
  Synthetic
tgatgttaag

SEQ ID NO: 17764 - DNA, 10 bp, Artificial sequence
  Synthetic
aatcgtcctt

SEQ ID NO: 17765 - DNA, 10 bp, Artificial sequence
  Synthetic
tcgttaatcg

SEQ ID NO: 17766 - DNA, 11 bp, Artificial sequence
  Synthetic
tcccattgtcg

SEQ ID NO: 17767 - DNA, 17 bp, Artificial sequence
  Synthetic
tatttaattaggggagg

SEQ ID NO: 17768 - DNA, 15 bp, Artificial sequence
  Synthetic
ttattagcgcttata

SEQ ID NO: 17769 - DNA, 15 bp, Artificial sequence
  Synthetic
gtaccggggtcccgt

SEQ ID NO: 17770 - DNA, 9 bp, Artificial sequence
  Synthetic
cccccgcct

SEQ ID NO: 17771 - DNA, 10 bp, Artificial sequence
  Synthetic
cgattaatcg

SEQ ID NO: 17772 - DNA, 10 bp, Artificial sequence
  Synthetic
cgattaatct

SEQ ID NO: 17773 - DNA, 11 bp, Artificial sequence
  Synthetic
ggtcgcgggcg

SEQ ID NO: 17774 - DNA, 12 bp, Artificial sequence
  Synthetic
tacgtattaaat

SEQ ID NO: 17775 - DNA, 8 bp, Artificial sequence
  Synthetic
ttaatcac

SEQ ID NO: 17776 - DNA, 18 bp, Artificial sequence
  Synthetic
tatagatctcgccttgcc

SEQ ID NO: 17777 - DNA, 21 bp, Artificial sequence
  Synthetic
ccgcgcgccgccactgcactg

SEQ ID NO: 17778 - DNA, 21 bp, Artificial sequence
  Synthetic
ccgccagtacgcacgcgctgg

SEQ ID NO: 17779 - DNA, 9 bp, Artificial sequence
  Synthetic
tagttagtt

SEQ ID NO: 17780 - DNA, 17 bp, Artificial sequence
  Synthetic
tggggattaatcgccac

SEQ ID NO: 17781 - DNA, 8 bp, Artificial sequence
  Synthetic
tattaggg

SEQ ID NO: 17782 - DNA, 15 bp, Artificial sequence
  Synthetic
ggcgcgcgggagggg

SEQ ID NO: 17783 - DNA, 8 bp, Artificial sequence
  Synthetic
tattaata

SEQ ID NO: 17784 - DNA, 18 bp, Artificial sequence
  Synthetic
cacggtcggatacggttg

SEQ ID NO: 17785 - DNA, 15 bp, Artificial sequence
  Synthetic
gaaagtgtggaaaag

SEQ ID NO: 17786 - DNA, 14 bp, Artificial sequence
  Synthetic
tcttacaagatctt

SEQ ID NO: 17787 - DNA, 22 bp, Artificial sequence
  Synthetic
tggtgatctaccgtgataacgt

SEQ ID NO: 17788 - DNA, 9 bp, Artificial sequence
  Synthetic
tgtttcccg

SEQ ID NO: 17789 - DNA, 11 bp, Artificial sequence
  Synthetic
tacatttgttt

SEQ ID NO: 17790 - DNA, 8 bp, Artificial sequence
  Synthetic
tattaatg

SEQ ID NO: 17791 - DNA, 8 bp, Artificial sequence
  Synthetic
tattaatt

SEQ ID NO: 17792 - DNA, 8 bp, Artificial sequence
  Synthetic
tattaatc

SEQ ID NO: 17793 - DNA, 17 bp, Artificial sequence
  Synthetic
cagccattaatagcgct

SEQ ID NO: 17794 - DNA, 8 bp, Artificial sequence
  Synthetic
tcagtgcg

SEQ ID NO: 17795 - DNA, 17 bp, Artificial sequence
  Synthetic
atagttattgtaactat

SEQ ID NO: 17796 - DNA, 17 bp, Artificial sequence
  Synthetic
gtagttaacgtcactag

SEQ ID NO: 17797 - DNA, 8 bp, Artificial sequence
  Synthetic
tcagtgcc

SEQ ID NO: 17798 - DNA, 17 bp, Artificial sequence
  Synthetic
ataagttccagtacgct

SEQ ID NO: 17799 - DNA, 15 bp, Artificial sequence
  Synthetic
aaaggtattaccttt

SEQ ID NO: 17800 - DNA, 9 bp, Artificial sequence
  Synthetic
tctgtggtg

SEQ ID NO: 17801 - DNA, 11 bp, Artificial sequence
  Synthetic
tataaatgtat

SEQ ID NO: 17802 - DNA, 15 bp, Artificial sequence
  Synthetic
gaccggtatataccg

SEQ ID NO: 17803 - DNA, 10 bp, Artificial sequence
  Synthetic
tcgtccacgc

SEQ ID NO: 17804 - DNA, 11 bp, Artificial sequence
  Synthetic
ggggccggagg

SEQ ID NO: 17805 - DNA, 13 bp, Artificial sequence
  Synthetic
tgatctgctctac

SEQ ID NO: 17806 - DNA, 12 bp, Artificial sequence
  Synthetic
tcggacagacgg

SEQ ID NO: 17807 - DNA, 11 bp, Artificial sequence
  Synthetic
gaaagtgaaag

SEQ ID NO: 17808 - DNA, 17 bp, Artificial sequence
  Synthetic
ggtagcatgcatgtgag

SEQ ID NO: 17809 - DNA, 18 bp, Artificial sequence
  Synthetic
ttgattaatggtaatagc

SEQ ID NO: 17810 - DNA, 12 bp, Artificial sequence
  Synthetic
ctaatgcaccgt

SEQ ID NO: 17811 - DNA, 7 bp, Artificial sequence
  Synthetic
tctaacc

SEQ ID NO: 17812 - DNA, 11 bp, Artificial sequence
  Synthetic
ttttcatttgt

SEQ ID NO: 17813 - DNA, 19 bp, Artificial sequence
  Synthetic
agtgtggattttccacact

SEQ ID NO: 17814 - DNA, 14 bp, Artificial sequence
  Synthetic
gctactgcagtctc

SEQ ID NO: 17815 - DNA, 5 bp, Artificial sequence
  Synthetic
attgt

SEQ ID NO: 17816 - DNA, 15 bp, Artificial sequence
  Synthetic
gcgccggtgcactgg

SEQ ID NO: 17817 - DNA, 14 bp, Artificial sequence
  Synthetic
taacaaatgcaaac

SEQ ID NO: 17818 - DNA, 17 bp, Artificial sequence
  Synthetic
ttctgcgacatttcgct

SEQ ID NO: 17819 - DNA, 12 bp, Artificial sequence
  Synthetic
tagttggctatc

SEQ ID NO: 17820 - DNA, 10 bp, Artificial sequence
  Synthetic
ctactgcagt

SEQ ID NO: 17821 - DNA, 9 bp, Artificial sequence
  Synthetic
tcctttact

SEQ ID NO: 17822 - DNA, 14 bp, Artificial sequence
  Synthetic
ttttggttttttta

SEQ ID NO: 17823 - DNA, 11 bp, Artificial sequence
  Synthetic
gacccaacacg

SEQ ID NO: 17824 - DNA, 7 bp, Artificial sequence
  Synthetic
tttgtta

SEQ ID NO: 17825 - DNA, 8 bp, Artificial sequence
  Synthetic
ccctaatt

SEQ ID NO: 17826 - DNA, 5 bp, Artificial sequence
  Synthetic
ttaat

SEQ ID NO: 17827 - DNA, 10 bp, Artificial sequence
  Synthetic
ctactgcatt

SEQ ID NO: 17828 - DNA, 10 bp, Artificial sequence
  Synthetic
gtccttcatc

SEQ ID NO: 17829 - DNA, 17 bp, Artificial sequence
  Synthetic
ttccagttgtctccagt

SEQ ID NO: 17830 - DNA, 11 bp, Artificial sequence
  Synthetic
cagcgggggtg

SEQ ID NO: 17831 - DNA, 7 bp, Artificial sequence
  Synthetic
taaatac

SEQ ID NO: 17832 - DNA, 15 bp, Artificial sequence
  Synthetic
gtcaaaagcgcgcat

SEQ ID NO: 17833 - DNA, 14 bp, Artificial sequence
  Synthetic
tcccctaaaggtcc

SEQ ID NO: 17834 - DNA, 7 bp, Artificial sequence
  Synthetic
tttgttt

SEQ ID NO: 17835 - DNA, 12 bp, Artificial sequence
  Synthetic
tccagttccagt

SEQ ID NO: 17836 - DNA, 10 bp, Artificial sequence
  Synthetic
gtaattagtt

SEQ ID NO: 17837 - DNA, 16 bp, Artificial sequence
  Synthetic
tccgttgaagggagat

SEQ ID NO: 17838 - DNA, 15 bp, Artificial sequence
  Synthetic
tgggttctaccgccg

SEQ ID NO: 17839 - DNA, 7 bp, Artificial sequence
  Synthetic
ttccagt

SEQ ID NO: 17840 - DNA, 13 bp, Artificial sequence
  Synthetic
cttactcagtcgt

SEQ ID NO: 17841 - DNA, 11 bp, Artificial sequence
  Synthetic
ttcggtatttt

SEQ ID NO: 17842 - DNA, 8 bp, Artificial sequence
  Synthetic
cgcagtcg

SEQ ID NO: 17843 - DNA, 6 bp, Artificial sequence
  Synthetic
gtactg

SEQ ID NO: 17844 - DNA, 10 bp, Artificial sequence
  Synthetic
tccagtaatt

SEQ ID NO: 17845 - DNA, 14 bp, Artificial sequence
  Synthetic
atcctgtttccagt

SEQ ID NO: 17846 - DNA, 15 bp, Artificial sequence
  Synthetic
tggttttaccgccgg

SEQ ID NO: 17847 - DNA, 14 bp, Artificial sequence
  Synthetic
ccccgtttcaagtt

SEQ ID NO: 17848 - DNA, 12 bp, Artificial sequence
  Synthetic
ttgggccttcat

SEQ ID NO: 17849 - DNA, 12 bp, Artificial sequence
  Synthetic
ttgggccttcac

SEQ ID NO: 17850 - DNA, 7 bp, Artificial sequence
  Synthetic
gtcgacg

SEQ ID NO: 17851 - DNA, 9 bp, Artificial sequence
  Synthetic
gagtaacag

SEQ ID NO: 17852 - DNA, 15 bp, Artificial sequence
  Synthetic
ttaacgactgagtcg

SEQ ID NO: 17853 - DNA, 16 bp, Artificial sequence
  Synthetic
gttcaccccccccccc

SEQ ID NO: 17854 - DNA, 11 bp, Artificial sequence
  Synthetic
tggtgcaccga

SEQ ID NO: 17855 - DNA, 12 bp, Artificial sequence
  Synthetic
actgtggacagt

SEQ ID NO: 17856 - DNA, 11 bp, Artificial sequence
  Synthetic
ccccgcccttt

SEQ ID NO: 17857 - DNA, 16 bp, Artificial sequence
  Synthetic
ccgcccctttaagggg

SEQ ID NO: 17858 - DNA, 17 bp, Artificial sequence
  Synthetic
cacgcgattaatcacgt

SEQ ID NO: 17859 - DNA, 19 bp, Artificial sequence
  Synthetic
ggagcagtgcgtactaccg

SEQ ID NO: 17860 - DNA, 11 bp, Artificial sequence
  Synthetic
tggtgcaccgg

SEQ ID NO: 17861 - DNA, 19 bp, Artificial sequence
  Synthetic
ggagcagtgcgtactacct

SEQ ID NO: 17862 - DNA, 16 bp, Artificial sequence
  Synthetic
ttttaccgcggtaaaa

SEQ ID NO: 17863 - DNA, 15 bp, Artificial sequence
  Synthetic
ttgttaaagtcacaa

SEQ ID NO: 17864 - DNA, 15 bp, Artificial sequence
  Synthetic
tgtctaagaatagac

SEQ ID NO: 17865 - DNA, 13 bp, Artificial sequence
  Synthetic
gtattttgacagt

SEQ ID NO: 17866 - DNA, 11 bp, Artificial sequence
  Synthetic
cttactatagg

SEQ ID NO: 17867 - DNA, 10 bp, Artificial sequence
  Synthetic
tcgcgcgcgc

SEQ ID NO: 17868 - DNA, 14 bp, Artificial sequence
  Synthetic
tctagttccagtat

SEQ ID NO: 17869 - DNA, 11 bp, Artificial sequence
  Synthetic
ttctagtttcc

SEQ ID NO: 17870 - DNA, 8 bp, Artificial sequence
  Synthetic
actgagtt

SEQ ID NO: 17871 - DNA, 15 bp, Artificial sequence
  Synthetic
tccagtggcactgga

SEQ ID NO: 17872 - DNA, 10 bp, Artificial sequence
  Synthetic
ctgtccacat

SEQ ID NO: 17873 - DNA, 15 bp, Artificial sequence
  Synthetic
acgtgtgtgactttt

SEQ ID NO: 17874 - DNA, 15 bp, Artificial sequence
  Synthetic
taacggactccgctt

SEQ ID NO: 17875 - DNA, 15 bp, Artificial sequence
  Synthetic
tccagtggcactggg

SEQ ID NO: 17876 - DNA, 10 bp, Artificial sequence
  Synthetic
tactatgggg

SEQ ID NO: 17877 - DNA, 18 bp, Artificial sequence
  Synthetic
ttccagttgatttccagt

SEQ ID NO: 17878 - DNA, 16 bp, Artificial sequence
  Synthetic
tccacacttccacact

SEQ ID NO: 17879 - DNA, 16 bp, Artificial sequence
  Synthetic
gttaatcgtggttaat

SEQ ID NO: 17880 - DNA, 13 bp, Artificial sequence
  Synthetic
tccggtttccagt

SEQ ID NO: 17881 - DNA, 14 bp, Artificial sequence
  Synthetic
gttccagtaattgg

SEQ ID NO: 17882 - DNA, 10 bp, Artificial sequence
  Synthetic
gtggacgagg

SEQ ID NO: 17883 - DNA, 17 bp, Artificial sequence
  Synthetic
tcaaaaattaattaaac

SEQ ID NO: 17884 - DNA, 8 bp, Artificial sequence
  Synthetic
ggaaactt

SEQ ID NO: 17885 - DNA, 17 bp, Artificial sequence
  Synthetic
tgaatcaattgattttt

SEQ ID NO: 17886 - DNA, 10 bp, Artificial sequence
  Synthetic
ccactgcagt

SEQ ID NO: 17887 - DNA, 10 bp, Artificial sequence
  Synthetic
acatttgttt

SEQ ID NO: 17888 - DNA, 11 bp, Artificial sequence
  Synthetic
tgtgggtgaga

SEQ ID NO: 17889 - DNA, 8 bp, Artificial sequence
  Synthetic
gtacgtcg

SEQ ID NO: 17890 - DNA, 15 bp, Artificial sequence
  Synthetic
ggtagttagttaaat

SEQ ID NO: 17891 - DNA, 8 bp, Artificial sequence
  Synthetic
ttttttgt

SEQ ID NO: 17892 - DNA, 8 bp, Artificial sequence
  Synthetic
tgtcgcga

SEQ ID NO: 17893 - DNA, 17 bp, Artificial sequence
  Synthetic
ttaaaagtgtggaaaat

SEQ ID NO: 17894 - DNA, 14 bp, Artificial sequence
  Synthetic
cggggagggggtgg

SEQ ID NO: 17895 - DNA, 14 bp, Artificial sequence
  Synthetic
ttttcatccagtct

SEQ ID NO: 17896 - DNA, 14 bp, Artificial sequence
  Synthetic
ggggcgacgggccg

SEQ ID NO: 17897 - DNA, 11 bp, Artificial sequence
  Synthetic
tggtacctgtc

SEQ ID NO: 17898 - DNA, 20 bp, Artificial sequence
  Synthetic
agtgtggaatcttccacact

SEQ ID NO: 17899 - DNA, 10 bp, Artificial sequence
  Synthetic
gcgcgcgcgc

SEQ ID NO: 17900 - DNA, 17 bp, Artificial sequence
  Synthetic
caggtaattaattacct

SEQ ID NO: 17901 - DNA, 10 bp, Artificial sequence
  Synthetic
ccattaattt

SEQ ID NO: 17902 - DNA, 9 bp, Artificial sequence
  Synthetic
ttaaaaccc

SEQ ID NO: 17903 - DNA, 10 bp, Artificial sequence
  Synthetic
ccattaattg

SEQ ID NO: 17904 - DNA, 15 bp, Artificial sequence
  Synthetic
ttgtttgttgttctc

SEQ ID NO: 17905 - DNA, 10 bp, Artificial sequence
  Synthetic
taacgcgtta

SEQ ID NO: 17906 - DNA, 10 bp, Artificial sequence
  Synthetic
gttctaccgc

SEQ ID NO: 17907 - DNA, 11 bp, Artificial sequence
  Synthetic
ccagcattttt

SEQ ID NO: 17908 - DNA, 24 bp, Artificial sequence
  Synthetic
gagatcctttgcgttaagaccctt

SEQ ID NO: 17909 - DNA, 17 bp, Artificial sequence
  Synthetic
taggtgtccacgctttt

SEQ ID NO: 17910 - DNA, 12 bp, Artificial sequence
  Synthetic
agatttttatct

SEQ ID NO: 17911 - DNA, 10 bp, Artificial sequence
  Synthetic
tactcagtat

SEQ ID NO: 17912 - DNA, 6 bp, Artificial sequence
  Synthetic
cctaat

SEQ ID NO: 17913 - DNA, 8 bp, Artificial sequence
  Synthetic
gtgcaccg

SEQ ID NO: 17914 - DNA, 11 bp, Artificial sequence
  Synthetic
ttttatttgta

SEQ ID NO: 17915 - DNA, 10 bp, Artificial sequence
  Synthetic
ggcgggtgcg

SEQ ID NO: 17916 - DNA, 11 bp, Artificial sequence
  Synthetic
gacccaccagg

SEQ ID NO: 17917 - DNA, 15 bp, Artificial sequence
  Synthetic
tttctccttcacttt

SEQ ID NO: 17918 - DNA, 12 bp, Artificial sequence
  Synthetic
gatgtactgttt

SEQ ID NO: 17919 - DNA, 9 bp, Artificial sequence
  Synthetic
gggtagttt

SEQ ID NO: 17920 - DNA, 16 bp, Artificial sequence
  Synthetic
ttacggtctgcggtaa

SEQ ID NO: 17921 - DNA, 12 bp, Artificial sequence
  Synthetic
caaaccgcgctt

SEQ ID NO: 17922 - DNA, 16 bp, Artificial sequence
  Synthetic
ggcagcggtaccgttg

SEQ ID NO: 17923 - DNA, 19 bp, Artificial sequence
  Synthetic
gcaactggaaactggaaat

SEQ ID NO: 17924 - DNA, 10 bp, Artificial sequence
  Synthetic
gcagatctgt

SEQ ID NO: 17925 - DNA, 17 bp, Artificial sequence
  Synthetic
tttcccccgcaccgaat

SEQ ID NO: 17926 - DNA, 16 bp, Artificial sequence
  Synthetic
ggctggtagacaagtc

SEQ ID NO: 17927 - DNA, 13 bp, Artificial sequence
  Synthetic
ttggttaattata

SEQ ID NO: 17928 - DNA, 7 bp, Artificial sequence
  Synthetic
attaatt

SEQ ID NO: 17929 - DNA, 11 bp, Artificial sequence
  Synthetic
attaaatacgt

SEQ ID NO: 17930 - DNA, 10 bp, Artificial sequence
  Synthetic
ggaggagggg

SEQ ID NO: 17931 - DNA, 9 bp, Artificial sequence
  Synthetic
cagcatttt

SEQ ID NO: 17932 - DNA, 12 bp, Artificial sequence
  Synthetic
gtcgtggaccgc

SEQ ID NO: 17933 - DNA, 14 bp, Artificial sequence
  Synthetic
tggtactgagtcgt

SEQ ID NO: 17934 - DNA, 10 bp, Artificial sequence
  Synthetic
gtgcaccggg

SEQ ID NO: 17935 - DNA, 15 bp, Artificial sequence
  Synthetic
tcccccgccccggtt

SEQ ID NO: 17936 - DNA, 8 bp, Artificial sequence
  Synthetic
tcctaatt

SEQ ID NO: 17937 - DNA, 8 bp, Artificial sequence
  Synthetic
tcctaatc

SEQ ID NO: 17938 - DNA, 20 bp, Artificial sequence
  Synthetic
gttcattgtgcactgtgaac

SEQ ID NO: 17939 - DNA, 15 bp, Artificial sequence
  Synthetic
tcccccgccccggtc

SEQ ID NO: 17940 - DNA, 9 bp, Artificial sequence
  Synthetic
cactgcggt

SEQ ID NO: 17941 - DNA, 12 bp, Artificial sequence
  Synthetic
gccgtgcacggt

SEQ ID NO: 17942 - DNA, 12 bp, Artificial sequence
  Synthetic
gccgtgcacggc

SEQ ID NO: 17943 - DNA, 12 bp, Artificial sequence
  Synthetic
atggtgcacagt

SEQ ID NO: 17944 - DNA, 16 bp, Artificial sequence
  Synthetic
tttttggttaattctt

SEQ ID NO: 17945 - DNA, 6 bp, Artificial sequence
  Synthetic
ttgtta

SEQ ID NO: 17946 - DNA, 12 bp, Artificial sequence
  Synthetic
cgatttttatcg

SEQ ID NO: 17947 - DNA, 11 bp, Artificial sequence
  Synthetic
ttggctttggt

SEQ ID NO: 17948 - DNA, 10 bp, Artificial sequence
  Synthetic
tcggttagtc

SEQ ID NO: 17949 - DNA, 14 bp, Artificial sequence
  Synthetic
tataacgtgttgag

SEQ ID NO: 17950 - DNA, 20 bp, Artificial sequence
  Synthetic
tgtacgggcccgtacaggcc

SEQ ID NO: 17951 - DNA, 15 bp, Artificial sequence
  Synthetic
tcgtggtacctgtcg

SEQ ID NO: 17952 - DNA, 18 bp, Artificial sequence
  Synthetic
ggcttcgtccaccgcttc

SEQ ID NO: 17953 - DNA, 10 bp, Artificial sequence
  Synthetic
ggggggggtg

SEQ ID NO: 17954 - DNA, 17 bp, Artificial sequence
  Synthetic
gcgcgattaatccatag

SEQ ID NO: 17955 - DNA, 12 bp, Artificial sequence
  Synthetic
ccgctggtggct

SEQ ID NO: 17956 - DNA, 10 bp, Artificial sequence
  Synthetic
ggttgacggt

SEQ ID NO: 17957 - DNA, 24 bp, Artificial sequence
  Synthetic
ttttttatttagtgtcgtatacgg

SEQ ID NO: 17958 - DNA, 16 bp, Artificial sequence
  Synthetic
tatccccgccccagct

SEQ ID NO: 17959 - DNA, 10 bp, Artificial sequence
  Synthetic
ctaaacgtat

SEQ ID NO: 17960 - DNA, 12 bp, Artificial sequence
  Synthetic
gttgtccaccac

SEQ ID NO: 17961 - DNA, 7 bp, Artificial sequence
  Synthetic
gtctaat

SEQ ID NO: 17962 - DNA, 17 bp, Artificial sequence
  Synthetic
ggtggtcccccgcggtc

SEQ ID NO: 17963 - DNA, 10 bp, Artificial sequence
  Synthetic
tctagtttcc

SEQ ID NO: 17964 - DNA, 15 bp, Artificial sequence
  Synthetic
ggctctggggacggg

SEQ ID NO: 17965 - DNA, 10 bp, Artificial sequence
  Synthetic
ttccacactc

SEQ ID NO: 17966 - DNA, 16 bp, Artificial sequence
  Synthetic
ataaatatatatttct

SEQ ID NO: 17967 - DNA, 10 bp, Artificial sequence
  Synthetic
ttccacactt

SEQ ID NO: 17968 - DNA, 12 bp, Artificial sequence
  Synthetic
tttgtatacaaa

SEQ ID NO: 17969 - DNA, 16 bp, Artificial sequence
  Synthetic
tacaaaatgctgaaat

SEQ ID NO: 17970 - DNA, 14 bp, Artificial sequence
  Synthetic
tggcctttaggcca

SEQ ID NO: 17971 - DNA, 17 bp, Artificial sequence
  Synthetic
atccagtcagttccagt

SEQ ID NO: 17972 - DNA, 11 bp, Artificial sequence
  Synthetic
tgcctgtgtta

SEQ ID NO: 17973 - DNA, 21 bp, Artificial sequence
  Synthetic
tttcactttcactttcatttt

SEQ ID NO: 17974 - DNA, 16 bp, Artificial sequence
  Synthetic
ttagttaagttattaa

SEQ ID NO: 17975 - DNA, 15 bp, Artificial sequence
  Synthetic
taatacaatttagtg

SEQ ID NO: 17976 - DNA, 10 bp, Artificial sequence
  Synthetic
cccttaacat

SEQ ID NO: 17977 - DNA, 7 bp, Artificial sequence
  Synthetic
tctattc

SEQ ID NO: 17978 - DNA, 15 bp, Artificial sequence
  Synthetic
gacctgaaacctgag

SEQ ID NO: 17979 - DNA, 9 bp, Artificial sequence
  Synthetic
ccagtattt

SEQ ID NO: 17980 - DNA, 8 bp, Artificial sequence
  Synthetic
tttacatt

SEQ ID NO: 17981 - DNA, 8 bp, Artificial sequence
  Synthetic
catttgtt

SEQ ID NO: 17982 - DNA, 17 bp, Artificial sequence
  Synthetic
agcgtaattaattacgt

SEQ ID NO: 17983 - DNA, 15 bp, Artificial sequence
  Synthetic
gttctaccgccggcg

SEQ ID NO: 17984 - DNA, 10 bp, Artificial sequence
  Synthetic
tatctattct

SEQ ID NO: 17985 - DNA, 16 bp, Artificial sequence
  Synthetic
gggctggtgcaccagt

SEQ ID NO: 17986 - DNA, 21 bp, Artificial sequence
  Synthetic
ccgcgacaggcaccacgactt

SEQ ID NO: 17987 - DNA, 11 bp, Artificial sequence
  Synthetic
cggtgcgggtg

SEQ ID NO: 17988 - DNA, 15 bp, Artificial sequence
  Synthetic
ttggttctaccgccg

SEQ ID NO: 17989 - DNA, 23 bp, Artificial sequence
  Synthetic
gtctacggcgggtgcgtaataag

SEQ ID NO: 17990 - DNA, 12 bp, Artificial sequence
  Synthetic
gtcactgtccag

SEQ ID NO: 17991 - DNA, 14 bp, Artificial sequence
  Synthetic
gagcttgggcacgg

SEQ ID NO: 17992 - DNA, 12 bp, Artificial sequence
  Synthetic
taacgggcggcg

SEQ ID NO: 17993 - DNA, 15 bp, Artificial sequence
  Synthetic
gagggcgggggtgag

SEQ ID NO: 17994 - DNA, 12 bp, Artificial sequence
  Synthetic
ttaatcgtatgt

SEQ ID NO: 17995 - DNA, 15 bp, Artificial sequence
  Synthetic
gcatagctttggttt

SEQ ID NO: 17996 - DNA, 8 bp, Artificial sequence
  Synthetic
tggcgcac

SEQ ID NO: 17997 - DNA, 18 bp, Artificial sequence
  Synthetic
tagctattggactagcta

SEQ ID NO: 17998 - DNA, 6 bp, Artificial sequence
  Synthetic
gccttc

SEQ ID NO: 17999 - DNA, 8 bp, Artificial sequence
  Synthetic
tcttgtta

SEQ ID NO: 18000 - DNA, 11 bp, Artificial sequence
  Synthetic
atacacccagt

SEQ ID NO: 18001 - DNA, 12 bp, Artificial sequence
  Synthetic
ttacccgcaccg

SEQ ID NO: 18002 - DNA, 17 bp, Artificial sequence
  Synthetic
gtcggctgtgcacgggg

SEQ ID NO: 18003 - DNA, 9 bp, Artificial sequence
  Synthetic
tcgacagtt

SEQ ID NO: 18004 - DNA, 18 bp, Artificial sequence
  Synthetic
ggtggtctcccgcgatat

SEQ ID NO: 18005 - DNA, 10 bp, Artificial sequence
  Synthetic
attatgtaat

SEQ ID NO: 18006 - DNA, 16 bp, Artificial sequence
  Synthetic
tttctggacagttatg

SEQ ID NO: 18007 - DNA, 17 bp, Artificial sequence
  Synthetic
tgcgtcgacagttatag

SEQ ID NO: 18008 - DNA, 10 bp, Artificial sequence
  Synthetic
tcttataagc

SEQ ID NO: 18009 - DNA, 15 bp, Artificial sequence
  Synthetic
tctcaggtttcaggt

SEQ ID NO: 18010 - DNA, 17 bp, Artificial sequence
  Synthetic
tttttcatttgtttctg

SEQ ID NO: 18011 - DNA, 15 bp, Artificial sequence
  Synthetic
tccccagtctccagt

SEQ ID NO: 18012 - DNA, 13 bp, Artificial sequence
  Synthetic
tcttgtcagacat

SEQ ID NO: 18013 - DNA, 18 bp, Artificial sequence
  Synthetic
taaccaatataaccaatt

SEQ ID NO: 18014 - DNA, 14 bp, Artificial sequence
  Synthetic
taattaatggagtc

SEQ ID NO: 18015 - DNA, 20 bp, Artificial sequence
  Synthetic
tctcgtgacttcgcattggc

SEQ ID NO: 18016 - DNA, 17 bp, Artificial sequence
  Synthetic
gcttaattaattctttg

SEQ ID NO: 18017 - DNA, 16 bp, Artificial sequence
  Synthetic
ctattaatattaatcg

SEQ ID NO: 18018 - DNA, 10 bp, Artificial sequence
  Synthetic
ttggccttca

SEQ ID NO: 18019 - DNA, 15 bp, Artificial sequence
  Synthetic
cgttgttacatagtt

SEQ ID NO: 18020 - DNA, 11 bp, Artificial sequence
  Synthetic
tttagcactga

SEQ ID NO: 18021 - DNA, 13 bp, Artificial sequence
  Synthetic
gtcggttagtctc

SEQ ID NO: 18022 - DNA, 15 bp, Artificial sequence
  Synthetic
ctgtgacattgtttt

SEQ ID NO: 18023 - DNA, 10 bp, Artificial sequence
  Synthetic
attcatttgt

SEQ ID NO: 18024 - DNA, 15 bp, Artificial sequence
  Synthetic
gtgaagtaacttaat

SEQ ID NO: 18025 - DNA, 17 bp, Artificial sequence
  Synthetic
gtttaattaattatttt

SEQ ID NO: 18026 - DNA, 10 bp, Artificial sequence
  Synthetic
ttggccttcg

SEQ ID NO: 18027 - DNA, 8 bp, Artificial sequence
  Synthetic
ggttaatt

SEQ ID NO: 18028 - DNA, 8 bp, Artificial sequence
  Synthetic
ataaaggt

SEQ ID NO: 18029 - DNA, 9 bp, Artificial sequence
  Synthetic
gttgacggt

SEQ ID NO: 18030 - DNA, 10 bp, Artificial sequence
  Synthetic
ggcactgggg

SEQ ID NO: 18031 - DNA, 17 bp, Artificial sequence
  Synthetic
cggtgggagaccaccgg

SEQ ID NO: 18032 - DNA, 7 bp, Artificial sequence
  Synthetic
tttagtt

SEQ ID NO: 18033 - DNA, 10 bp, Artificial sequence
  Synthetic
tgtgaactca

SEQ ID NO: 18034 - DNA, 16 bp, Artificial sequence
  Synthetic
tacataattaattcat

SEQ ID NO: 18035 - DNA, 15 bp, Artificial sequence
  Synthetic
ttggtggacaactgg

SEQ ID NO: 18036 - DNA, 11 bp, Artificial sequence
  Synthetic
tcgacagtctt

SEQ ID NO: 18037 - DNA, 10 bp, Artificial sequence
  Synthetic
ggtgtactgg

SEQ ID NO: 18038 - DNA, 21 bp, Artificial sequence
  Synthetic
tcccttgtcttacaagacccg

SEQ ID NO: 18039 - DNA, 12 bp, Artificial sequence
  Synthetic
tacaattgtatt

SEQ ID NO: 18040 - DNA, 9 bp, Artificial sequence
  Synthetic
tacgggtgg

SEQ ID NO: 18041 - DNA, 17 bp, Artificial sequence
  Synthetic
ttaaaatgtacatatat

SEQ ID NO: 18042 - DNA, 9 bp, Artificial sequence
  Synthetic
tggccttca

SEQ ID NO: 18043 - DNA, 10 bp, Artificial sequence
  Synthetic
cgttattttt

SEQ ID NO: 18044 - DNA, 9 bp, Artificial sequence
  Synthetic
tactatggg

SEQ ID NO: 18045 - DNA, 18 bp, Artificial sequence
  Synthetic
cattaattgccattaatt

SEQ ID NO: 18046 - DNA, 10 bp, Artificial sequence
  Synthetic
gcgggtgcag

SEQ ID NO: 18047 - DNA, 11 bp, Artificial sequence
  Synthetic
cttgtcgacag

SEQ ID NO: 18048 - DNA, 7 bp, Artificial sequence
  Synthetic
cctaatt

SEQ ID NO: 18049 - DNA, 10 bp, Artificial sequence
  Synthetic
atacatttgt

SEQ ID NO: 18050 - DNA, 12 bp, Artificial sequence
  Synthetic
atatctgcgcgt

SEQ ID NO: 18051 - DNA, 13 bp, Artificial sequence
  Synthetic
ggaatcggttagt

SEQ ID NO: 18052 - DNA, 16 bp, Artificial sequence
  Synthetic
agtccgcgcgcgcggt

SEQ ID NO: 18053 - DNA, 14 bp, Artificial sequence
  Synthetic
agtattttgacagt

SEQ ID NO: 18054 - DNA, 12 bp, Artificial sequence
  Synthetic
tcttgtttcgcg

SEQ ID NO: 18055 - DNA, 14 bp, Artificial sequence
  Synthetic
gccactgcagtagt

SEQ ID NO: 18056 - DNA, 8 bp, Artificial sequence
  Synthetic
acatagtt

SEQ ID NO: 18057 - DNA, 8 bp, Artificial sequence
  Synthetic
caattgat

SEQ ID NO: 18058 - DNA, 13 bp, Artificial sequence
  Synthetic
gagtaaacgtatg

SEQ ID NO: 18059 - DNA, 14 bp, Artificial sequence
  Synthetic
aatacatgattatt

SEQ ID NO: 18060 - DNA, 9 bp, Artificial sequence
  Synthetic
gcacgcgtt

SEQ ID NO: 18061 - DNA, 12 bp, Artificial sequence
  Synthetic
tacgtatttaat

SEQ ID NO: 18062 - DNA, 10 bp, Artificial sequence
  Synthetic
cctccccctt

SEQ ID NO: 18063 - DNA, 11 bp, Artificial sequence
  Synthetic
gagtgcacgtg

SEQ ID NO: 18064 - DNA, 20 bp, Artificial sequence
  Synthetic
tccctgcgtcgacgaggggt

SEQ ID NO: 18065 - DNA, 8 bp, Artificial sequence
  Synthetic
gattagtt

SEQ ID NO: 18066 - DNA, 22 bp, Artificial sequence
  Synthetic
ttaattagctttagtttaattt

SEQ ID NO: 18067 - DNA, 16 bp, Artificial sequence
  Synthetic
tgctactgcagtagcc

SEQ ID NO: 18068 - DNA, 11 bp, Artificial sequence
  Synthetic
tcgtgcaccgg

SEQ ID NO: 18069 - DNA, 7 bp, Artificial sequence
  Synthetic
ggcggcg

SEQ ID NO: 18070 - DNA, 11 bp, Artificial sequence
  Synthetic
ttttaccgcca

SEQ ID NO: 18071 - DNA, 8 bp, Artificial sequence
  Synthetic
cagtgcgt

SEQ ID NO: 18072 - DNA, 12 bp, Artificial sequence
  Synthetic
actaacgttagt

SEQ ID NO: 18073 - DNA, 7 bp, Artificial sequence
  Synthetic
agtaatt

SEQ ID NO: 18074 - DNA, 9 bp, Artificial sequence
  Synthetic
taaggtccg

SEQ ID NO: 18075 - DNA, 15 bp, Artificial sequence
  Synthetic
cccagttcccccact

SEQ ID NO: 18076 - DNA, 13 bp, Artificial sequence
  Synthetic
gcgacgggagacg

SEQ ID NO: 18077 - DNA, 15 bp, Artificial sequence
  Synthetic
tgtacgggtctgtac

SEQ ID NO: 18078 - DNA, 11 bp, Artificial sequence
  Synthetic
ttttaccgccg

SEQ ID NO: 18079 - DNA, 15 bp, Artificial sequence
  Synthetic
aaccgtggcacggtt

SEQ ID NO: 18080 - DNA, 16 bp, Artificial sequence
  Synthetic
ttcgatatttatctta

SEQ ID NO: 18081 - DNA, 10 bp, Artificial sequence
  Synthetic
acgtatagtt

SEQ ID NO: 18082 - DNA, 12 bp, Artificial sequence
  Synthetic
tttattaattgc

SEQ ID NO: 18083 - DNA, 17 bp, Artificial sequence
  Synthetic
attaattaattaccgat

SEQ ID NO: 18084 - DNA, 12 bp, Artificial sequence
  Synthetic
ccaggaaaatat

SEQ ID NO: 18085 - DNA, 15 bp, Artificial sequence
  Synthetic
tttctactacagtag

SEQ ID NO: 18086 - DNA, 11 bp, Artificial sequence
  Synthetic
ttggccttcac

SEQ ID NO: 18087 - DNA, 8 bp, Artificial sequence
  Synthetic
agaatagt

SEQ ID NO: 18088 - DNA, 11 bp, Artificial sequence
  Synthetic
gtaacgcactg

SEQ ID NO: 18089 - DNA, 22 bp, Artificial sequence
  Synthetic
gtattaacgactcagtaaaatc

SEQ ID NO: 18090 - DNA, 18 bp, Artificial sequence
  Synthetic
gccaaatttttattgggt

SEQ ID NO: 18091 - DNA, 17 bp, Artificial sequence
  Synthetic
ggagtgaaggcccaagc

SEQ ID NO: 18092 - DNA, 8 bp, Artificial sequence
  Synthetic
ggtgaatt

SEQ ID NO: 18093 - DNA, 10 bp, Artificial sequence
  Synthetic
tgggttccct

SEQ ID NO: 18094 - DNA, 19 bp, Artificial sequence
  Synthetic
ggctttaaacgtataactt

SEQ ID NO: 18095 - DNA, 11 bp, Artificial sequence
  Synthetic
ctccagtcccg

SEQ ID NO: 18096 - DNA, 17 bp, Artificial sequence
  Synthetic
ctcttcccccgccctgg

SEQ ID NO: 18097 - DNA, 19 bp, Artificial sequence
  Synthetic
ggactggggttactgggct

SEQ ID NO: 18098 - DNA, 17 bp, Artificial sequence
  Synthetic
gcgcaattaattaatgg

SEQ ID NO: 18099 - DNA, 10 bp, Artificial sequence
  Synthetic
gtgtggacgt

SEQ ID NO: 18100 - DNA, 10 bp, Artificial sequence
  Synthetic
tcgtggacag

SEQ ID NO: 18101 - DNA, 17 bp, Artificial sequence
  Synthetic
ggataattaattaaggc

SEQ ID NO: 18102 - DNA, 16 bp, Artificial sequence
  Synthetic
ttcctcgacagttatg

SEQ ID NO: 18103 - DNA, 11 bp, Artificial sequence
  Synthetic
ttggcctttat

SEQ ID NO: 18104 - DNA, 13 bp, Artificial sequence
  Synthetic
tttttgtttgttg

SEQ ID NO: 18105 - DNA, 6 bp, Artificial sequence
  Synthetic
tcaggt

SEQ ID NO: 18106 - DNA, 8 bp, Artificial sequence
  Synthetic
tgtatacc

SEQ ID NO: 18107 - DNA, 22 bp, Artificial sequence
  Synthetic
tgttggagggacccctcaacac

SEQ ID NO: 18108 - DNA, 10 bp, Artificial sequence
  Synthetic
cgcctaattg

SEQ ID NO: 18109 - DNA, 10 bp, Artificial sequence
  Synthetic
cggttaatcg

SEQ ID NO: 18110 - DNA, 14 bp, Artificial sequence
  Synthetic
cgtggagcgtgtcg

SEQ ID NO: 18111 - DNA, 11 bp, Artificial sequence
  Synthetic
tattaccgccg

SEQ ID NO: 18112 - DNA, 7 bp, Artificial sequence
  Synthetic
gggcctc

SEQ ID NO: 18113 - DNA, 10 bp, Artificial sequence
  Synthetic
taaaacgact

SEQ ID NO: 18114 - DNA, 9 bp, Artificial sequence
  Synthetic
tctattctc

SEQ ID NO: 18115 - DNA, 10 bp, Artificial sequence
  Synthetic
tgggtccacc

SEQ ID NO: 18116 - DNA, 17 bp, Artificial sequence
  Synthetic
cttgtggtaaaaacttg

SEQ ID NO: 18117 - DNA, 7 bp, Artificial Sequence
  Synthetic
ttcgaac

SEQ ID NO: 18118 - DNA, 11 bp, Artificial sequence
  Synthetic
ttccacacttt

SEQ ID NO: 18119 - DNA, 17 bp, Artificial sequence
  Synthetic
ttggcgattaatcacct

SEQ ID NO: 18120 - DNA, 10 bp, Artificial sequence
  Synthetic
tcgtcgacga

SEQ ID NO: 18121 - DNA, 11 bp, Artificial sequence
  Synthetic
tcccggtcaac

SEQ ID NO: 18122 - DNA, 9 bp, Artificial sequence
  Synthetic
tctctattc

SEQ ID NO: 18123 - DNA, 8 bp, Artificial sequence
  Synthetic
tactgagt

SEQ ID NO: 18124 - DNA, 19 bp, Artificial sequence
  Synthetic
ggccggggcgggggagggg

SEQ ID NO: 18125 - DNA, 15 bp, Artificial sequence
  Synthetic
tcccagttttccagt

SEQ ID NO: 18126 - DNA, 10 bp, Artificial sequence
  Synthetic
caattaattg

SEQ ID NO: 18127 - DNA, 21 bp, Artificial sequence
  Synthetic
ggccaagtttggccaagaccg

SEQ ID NO: 18128 - DNA, 18 bp, Artificial sequence
  Synthetic
ttccagtaaagttccagt

SEQ ID NO: 18129 - DNA, 9 bp, Artificial sequence
  Synthetic
ccattattt

SEQ ID NO: 18130 - DNA, 14 bp, Artificial sequence
  Synthetic
ttgcatttgttgtg

SEQ ID NO: 18131 - DNA, 7 bp, Artificial sequence
  Synthetic
tcagtac

SEQ ID NO: 18132 - DNA, 17 bp, Artificial sequence
  Synthetic
gggagggaggggggggg

SEQ ID NO: 18133 - DNA, 16 bp, Artificial sequence
  Synthetic
ttattgtccacaagtg

SEQ ID NO: 18134 - DNA, 14 bp, Artificial sequence
  Synthetic
cagcacaccccttt

SEQ ID NO: 18135 - DNA, 17 bp, Artificial sequence
  Synthetic
ttccagtcagttccagt

SEQ ID NO: 18136 - DNA, 10 bp, Artificial sequence
  Synthetic
ccggtgcact

SEQ ID NO: 18137 - DNA, 17 bp, Artificial sequence
  Synthetic
gtactgactttaagtag

SEQ ID NO: 18138 - DNA, 21 bp, Artificial sequence
  Synthetic
tagcttatatatatagatcag

SEQ ID NO: 18139 - DNA, 30 bp, Artificial sequence
  Synthetic
acggttgaaggggtaatcaccagcggaggt

SEQ ID NO: 18140 - DNA, 17 bp, Artificial sequence
  Synthetic
tggtgattaatcacctg

SEQ ID NO: 18141 - DNA, 10 bp, Artificial sequence
  Synthetic
tactcagtag

SEQ ID NO: 18142 - DNA, 12 bp, Artificial sequence
  Synthetic
tcccaattattt

SEQ ID NO: 18143 - DNA, 10 bp, Artificial sequence
  Synthetic
tggaccaccg

SEQ ID NO: 18144 - DNA, 11 bp, Artificial sequence
  Synthetic
gtttggtgtct

SEQ ID NO: 18145 - DNA, 9 bp, Artificial sequence
  Synthetic
tttaaggac

SEQ ID NO: 18146 - DNA, 15 bp, Artificial sequence
  Synthetic
ccccagtttccagtg

SEQ ID NO: 18147 - DNA, 11 bp, Artificial sequence
  Synthetic
tcggtgagttc

SEQ ID NO: 18148 - DNA, 11 bp, Artificial sequence
  Synthetic
gacccatctcg

SEQ ID NO: 18149 - DNA, 10 bp, Artificial sequence
  Synthetic
tttggccaaa

SEQ ID NO: 18150 - DNA, 8 bp, Artificial sequence
  Synthetic
ggtaattt

SEQ ID NO: 18151 - DNA, 10 bp, Artificial sequence
  Synthetic
cggtgaattt

SEQ ID NO: 18152 - DNA, 11 bp, Artificial sequence
  Synthetic
tcaattcacct

SEQ ID NO: 18153 - DNA, 30 bp, Artificial sequence
  Synthetic
ctttttaaaggttatgaggtgagggggggg

SEQ ID NO: 18154 - DNA, 13 bp, Artificial sequence
  Synthetic
gtttccagttccc

SEQ ID NO: 18155 - DNA, 15 bp, Artificial sequence
  Synthetic
ccaattattaatggt

SEQ ID NO: 18156 - DNA, 10 bp, Artificial sequence
  Synthetic
ccagtccagt

SEQ ID NO: 18157 - DNA, 14 bp, Artificial sequence
  Synthetic
tgctttggctttga

SEQ ID NO: 18158 - DNA, 14 bp, Artificial sequence
  Synthetic
ttttttagttatta

SEQ ID NO: 18159 - DNA, 14 bp, Artificial sequence
  Synthetic
tgctggggggtgtc

SEQ ID NO: 18160 - DNA, 9 bp, Artificial sequence
  Synthetic
gcactgcag

SEQ ID NO: 18161 - DNA, 7 bp, Artificial sequence
  Synthetic
gaaacag

SEQ ID NO: 18162 - DNA, 11 bp, Artificial sequence
  Synthetic
ggtgaagggcg

SEQ ID NO: 18163 - DNA, 8 bp, Artificial sequence
  Synthetic
tttccgcg

SEQ ID NO: 18164 - DNA, 17 bp, Artificial sequence
  Synthetic
tcataaattaattaagc

SEQ ID NO: 18165 - DNA, 13 bp, Artificial sequence
  Synthetic
tccagtaattggg

SEQ ID NO: 18166 - DNA, 9 bp, Artificial sequence
  Synthetic
tctaccggc

SEQ ID NO: 18167 - DNA, 13 bp, Artificial sequence
  Synthetic
gtgaaggccaagg

SEQ ID NO: 18168 - DNA, 12 bp, Artificial sequence
  Synthetic
tagctaataacc

SEQ ID NO: 18169 - DNA, 10 bp, Artificial sequence
  Synthetic
ccccgggggg

SEQ ID NO: 18170 - DNA, 12 bp, Artificial sequence
  Synthetic
ttaaaatgctgg

SEQ ID NO: 18171 - DNA, 10 bp, Artificial sequence
  Synthetic
gccggctgcg

SEQ ID NO: 18172 - DNA, 14 bp, Artificial sequence
  Synthetic
gcgggggaccaccg

SEQ ID NO: 18173 - DNA, 8 bp, Artificial sequence
  Synthetic
tttattgt

SEQ ID NO: 18174 - DNA, 10 bp, Artificial sequence
  Synthetic
agcatttgtt

SEQ ID NO: 18175 - DNA, 10 bp, Artificial sequence
  Synthetic
tttagtgtcg

SEQ ID NO: 18176 - DNA, 14 bp, Artificial sequence
  Synthetic
aactgtcgacagtt

SEQ ID NO: 18177 - DNA, 15 bp, Artificial sequence
  Synthetic
gagggaccgttgtcg

SEQ ID NO: 18178 - DNA, 12 bp, Artificial sequence
  Synthetic
acgcgtacgcgt

SEQ ID NO: 18179 - DNA, 10 bp, Artificial sequence
  Synthetic
gccccccggg

SEQ ID NO: 18180 - DNA, 21 bp, Artificial sequence
  Synthetic
gtcaaagccaaaggcaaaggg

SEQ ID NO: 18181 - DNA, 12 bp, Artificial sequence
  Synthetic
ggtagttagttt

SEQ ID NO: 18182 - DNA, 12 bp, Artificial sequence
  Synthetic
ctttcgctttgg

SEQ ID NO: 18183 - DNA, 25 bp, Artificial sequence
  Synthetic
gccccgtaagacccttaacatcagg

SEQ ID NO: 18184 - DNA, 15 bp, Artificial sequence
  Synthetic
gtctggggggtgtct

SEQ ID NO: 18185 - DNA, 9 bp, Artificial sequence
  Synthetic
tttcactat

SEQ ID NO: 18186 - DNA, 13 bp, Artificial sequence
  Synthetic
attaacggttaat

SEQ ID NO: 18187 - DNA, 13 bp, Artificial sequence
  Synthetic
tccggtttcaggt

SEQ ID NO: 18188 - DNA, 10 bp, Artificial sequence
  Synthetic
tctgtacgga

SEQ ID NO: 18189 - DNA, 11 bp, Artificial sequence
  Synthetic
tatttaatacg

SEQ ID NO: 18190 - DNA, 9 bp, Artificial sequence
  Synthetic
gggatagag

SEQ ID NO: 18191 - DNA, 11 bp, Artificial sequence
  Synthetic
ggttccagtgt

SEQ ID NO: 18192 - DNA, 10 bp, Artificial sequence
  Synthetic
gcgactgagt

SEQ ID NO: 18193 - DNA, 17 bp, Artificial sequence
  Synthetic
taattccccagtgctgt

SEQ ID NO: 18194 - DNA, 8 bp, Artificial sequence
  Synthetic
tgagtacg

SEQ ID NO: 18195 - DNA, 14 bp, Artificial sequence
  Synthetic
tacgtaatgtattg

SEQ ID NO: 18196 - DNA, 18 bp, Artificial sequence
  Synthetic
gttgttagaagtaacagg

SEQ ID NO: 18197 - DNA, 12 bp, Artificial sequence
  Synthetic
tggtatataccg

SEQ ID NO: 18198 - DNA, 12 bp, Artificial sequence
  Synthetic
tggcaattgcca

SEQ ID NO: 18199 - DNA, 8 bp, Artificial sequence
  Synthetic
agtgtact

SEQ ID NO: 18200 - DNA, 9 bp, Artificial sequence
  Synthetic
tagtgcgct

SEQ ID NO: 18201 - DNA, 13 bp, Artificial sequence
  Synthetic
agcagtgcgaagt

SEQ ID NO: 18202 - DNA, 14 bp, Artificial sequence
  Synthetic
ttctattctattgt

SEQ ID NO: 18203 - DNA, 10 bp, Artificial sequence
  Synthetic
tactgagtcg

SEQ ID NO: 18204 - DNA, 9 bp, Artificial sequence
  Synthetic
gtatattcc

SEQ ID NO: 18205 - DNA, 9 bp, Artificial sequence
  Synthetic
gcacccttt

SEQ ID NO: 18206 - DNA, 7 bp, Artificial sequence
  Synthetic
tgttaat

SEQ ID NO: 18207 - DNA, 21 bp, Artificial sequence
  Synthetic
tttaacgactcagtcgtataa

SEQ ID NO: 18208 - DNA, 14 bp, Artificial sequence
  Synthetic
tttttataataata

SEQ ID NO: 18209 - DNA, 10 bp, Artificial sequence
  Synthetic
attggtgttt

SEQ ID NO: 18210 - DNA, 13 bp, Artificial sequence
  Synthetic
ggtggcctttaat

SEQ ID NO: 18211 - DNA, 14 bp, Artificial sequence
  Synthetic
tcaatgatccgttt

SEQ ID NO: 18212 - DNA, 7 bp, Artificial sequence
  Synthetic
gattact

SEQ ID NO: 18213 - DNA, 19 bp, Artificial sequence
  Synthetic
gttccagtaaagttccagt

SEQ ID NO: 18214 - DNA, 12 bp, Artificial sequence
  Synthetic
acggggtcccgt

SEQ ID NO: 18215 - DNA, 15 bp, Artificial sequence
  Synthetic
tacttattgtaagta

SEQ ID NO: 18216 - DNA, 10 bp, Artificial sequence
  Synthetic
ttaaacgtat

SEQ ID NO: 18217 - DNA, 8 bp, Artificial sequence
  Synthetic
tagtgcac

SEQ ID NO: 18218 - DNA, 8 bp, Artificial sequence
  Synthetic
attatttt

SEQ ID NO: 18219 - DNA, 12 bp, Artificial sequence
  Synthetic
gcgggggactgt

SEQ ID NO: 18220 - DNA, 10 bp, Artificial sequence
  Synthetic
attgccagtt

SEQ ID NO: 18221 - DNA, 12 bp, Artificial sequence
  Synthetic
cggagggtgcgg

SEQ ID NO: 18222 - DNA, 10 bp, Artificial sequence
  Synthetic
tttctagaat

SEQ ID NO: 18223 - DNA, 11 bp, Artificial sequence
  Synthetic
taacacgttag

SEQ ID NO: 18224 - DNA, 12 bp, Artificial sequence
  Synthetic
gttctaccgccg

SEQ ID NO: 18225 - DNA, 11 bp, Artificial sequence
  Synthetic
taacacgttat

SEQ ID NO: 18226 - DNA, 15 bp, Artificial sequence
  Synthetic
ttcggggggttttta

SEQ ID NO: 18227 - DNA, 22 bp, Artificial sequence
  Synthetic
acaccaagatttttatcttgtt

SEQ ID NO: 18228 - DNA, 14 bp, Artificial sequence
  Synthetic
gggcgggggcgggg

SEQ ID NO: 18229 - DNA, 7 bp, Artificial sequence
  Synthetic
gaatagt

SEQ ID NO: 18230 - DNA, 18 bp, Artificial sequence
  Synthetic
caagtcagtacgcactgt

SEQ ID NO: 18231 - DNA, 17 bp, Artificial sequence
  Synthetic
cacccgattaatcaagt

SEQ ID NO: 18232 - DNA, 9 bp, Artificial sequence
  Synthetic
cagtgcact

SEQ ID NO: 18233 - DNA, 14 bp, Artificial sequence
  Synthetic
attaactggttaat

SEQ ID NO: 18234 - DNA, 12 bp, Artificial sequence
  Synthetic
gactggaacttg

SEQ ID NO: 18235 - DNA, 12 bp, Artificial sequence
  Synthetic
taccgccgtacc

SEQ ID NO: 18236 - DNA, 12 bp, Artificial sequence
  Synthetic
ttttaacgactg

SEQ ID NO: 18237 - DNA, 13 bp, Artificial sequence
  Synthetic
ttaggtctacaac

SEQ ID NO: 18238 - DNA, 12 bp, Artificial sequence
  Synthetic
cttgtctaccag

SEQ ID NO: 18239 - DNA, 8 bp, Artificial sequence
  Synthetic
ttattttt

SEQ ID NO: 18240 - DNA, 8 bp, Artificial sequence
  Synthetic
gaaactag

SEQ ID NO: 18241 - DNA, 12 bp, Artificial sequence
  Synthetic
tggccttcacgt

SEQ ID NO: 18242 - DNA, 14 bp, Artificial sequence
  Synthetic
tttctagtttcctt

SEQ ID NO: 18243 - DNA, 13 bp, Artificial sequence
  Synthetic
ctgtccttcattg

SEQ ID NO: 18244 - DNA, 11 bp, Artificial sequence
  Synthetic
tggcctttagg

SEQ ID NO: 18245 - DNA, 9 bp, Artificial sequence
  Synthetic
ccacccctt

SEQ ID NO: 18246 - DNA, 15 bp, Artificial sequence
  Synthetic
tgcaaacaccaatcg

SEQ ID NO: 18247 - DNA, 17 bp, Artificial sequence
  Synthetic
agtgggtagttattagt

SEQ ID NO: 18248 - DNA, 11 bp, Artificial sequence
  Synthetic
cgggacggcgg

SEQ ID NO: 18249 - DNA, 13 bp, Artificial sequence
  Synthetic
attaaatacgtat

SEQ ID NO: 18250 - DNA, 17 bp, Artificial sequence
  Synthetic
caagtgattaatcaaat

SEQ ID NO: 18251 - DNA, 12 bp, Artificial sequence
  Synthetic
gttgtggacagg

SEQ ID NO: 18252 - DNA, 20 bp, Artificial sequence
  Synthetic
gaccacccccgtctattcct

SEQ ID NO: 18253 - DNA, 11 bp, Artificial sequence
  Synthetic
tgtcgacgacg

SEQ ID NO: 18254 - DNA, 10 bp, Artificial sequence
  Synthetic
gtagtttccc

SEQ ID NO: 18255 - DNA, 9 bp, Artificial sequence
  Synthetic
tttcaggtt

SEQ ID NO: 18256 - DNA, 14 bp, Artificial sequence
  Synthetic
cacaacaaatgttg

SEQ ID NO: 18257 - DNA, 17 bp, Artificial sequence
  Synthetic
cttttgatcaattgtag

SEQ ID NO: 18258 - DNA, 14 bp, Artificial sequence
  Synthetic
ggtggtcccccgcg

SEQ ID NO: 18259 - DNA, 17 bp, Artificial sequence
  Synthetic
gcttaattaattagtgg

SEQ ID NO: 18260 - DNA, 13 bp, Artificial sequence
  Synthetic
gtgaaggaccaag

SEQ ID NO: 18261 - DNA, 16 bp, Artificial sequence
  Synthetic
ccacacttaagtgtgg

SEQ ID NO: 18262 - DNA, 8 bp, Artificial sequence
  Synthetic
ggtgcagt

SEQ ID NO: 18263 - DNA, 9 bp, Artificial sequence
  Synthetic
tgcagtagt

SEQ ID NO: 18264 - DNA, 8 bp, Artificial sequence
  Synthetic
cgcggttt

SEQ ID NO: 18265 - DNA, 15 bp, Artificial sequence
  Synthetic
taacagtacgattac

SEQ ID NO: 18266 - DNA, 15 bp, Artificial sequence
  Synthetic
ggtgaaggcccaagc

SEQ ID NO: 18267 - DNA, 17 bp, Artificial sequence
  Synthetic
tttaaacgactgaatcg

SEQ ID NO: 18268 - DNA, 16 bp, Artificial sequence
  Synthetic
cggggcgacggcggcg

SEQ ID NO: 18269 - DNA, 15 bp, Artificial sequence
  Synthetic
gagacaaatgaaacg

SEQ ID NO: 18270 - DNA, 14 bp, Artificial sequence
  Synthetic
ccattaataattgg

SEQ ID NO: 18271 - DNA, 7 bp, Artificial sequence
  Synthetic
ttttatg

SEQ ID NO: 18272 - DNA, 19 bp, Artificial sequence
  Synthetic
cttgggtaacaagaaaagg

SEQ ID NO: 18273 - DNA, 19 bp, Artificial sequence
  Synthetic
taccggtatattcctctac

SEQ ID NO: 18274 - DNA, 12 bp, Artificial sequence
  Synthetic
actgtcgacagt

SEQ ID NO: 18275 - DNA, 10 bp, Artificial sequence
  Synthetic
tttagtgccg

SEQ ID NO: 18276 - DNA, 8 bp, Artificial sequence
  Synthetic
tgttgagg

SEQ ID NO: 18277 - DNA, 19 bp, Artificial sequence
  Synthetic
agtggacaacgatccgtct

SEQ ID NO: 18278 - DNA, 10 bp, Artificial sequence
  Synthetic
tgattaatcg

SEQ ID NO: 18279 - DNA, 12 bp, Artificial sequence
  Synthetic
tgcgggtgcgtt

SEQ ID NO: 18280 - DNA, 15 bp, Artificial sequence
  Synthetic
gttatcgccaccacc

SEQ ID NO: 18281 - DNA, 10 bp, Artificial sequence
  Synthetic
ggggcggggg

SEQ ID NO: 18282 - DNA, 12 bp, Artificial sequence
  Synthetic
tgcgggtgcgta

SEQ ID NO: 18283 - DNA, 10 bp, Artificial sequence
  Synthetic
tgtgcgggga

SEQ ID NO: 18284 - DNA, 10 bp, Artificial sequence
  Synthetic
ccagtatttt

SEQ ID NO: 18285 - DNA, 20 bp, Artificial sequence
  Synthetic
ccggtggtctaccgtgatat

SEQ ID NO: 18286 - DNA, 10 bp, Artificial sequence
  Synthetic
cccgttatct

SEQ ID NO: 18287 - DNA, 20 bp, Artificial sequence
  Synthetic
gttttgatccagtttccagt

SEQ ID NO: 18288 - DNA, 11 bp, Artificial sequence
  Synthetic
tctggtgggtc

SEQ ID NO: 18289 - DNA, 10 bp, Artificial sequence
  Synthetic
ccggtctgtg

SEQ ID NO: 18290 - DNA, 11 bp, Artificial sequence
  Synthetic
tctggtgggtg

SEQ ID NO: 18291 - DNA, 15 bp, Artificial sequence
  Synthetic
tttttctccttcact

SEQ ID NO: 18292 - DNA, 11 bp, Artificial sequence
  Synthetic
ttatttgttat

SEQ ID NO: 18293 - DNA, 9 bp, Artificial sequence
  Synthetic
ctgtgcacg

SEQ ID NO: 18294 - DNA, 11 bp, Artificial sequence
  Synthetic
gggtgcactat

SEQ ID NO: 18295 - DNA, 12 bp, Artificial sequence
  Synthetic
ttataagttgtc

SEQ ID NO: 18296 - DNA, 12 bp, Artificial sequence
  Synthetic
acgggatcccgt

SEQ ID NO: 18297 - DNA, 14 bp, Artificial sequence
  Synthetic
gtcggttagtcgcg

SEQ ID NO: 18298 - DNA, 8 bp, Artificial sequence
  Synthetic
atatgtat

SEQ ID NO: 18299 - DNA, 11 bp, Artificial sequence
  Synthetic
gtgaaggccgc

SEQ ID NO: 18300 - DNA, 18 bp, Artificial sequence
  Synthetic
ttccagttcgtttccagt

SEQ ID NO: 18301 - DNA, 8 bp, Artificial sequence
  Synthetic
agttaatt

SEQ ID NO: 18302 - DNA, 12 bp, Artificial sequence
  Synthetic
ttggttagtctc

SEQ ID NO: 18303 - DNA, 17 bp, Artificial sequence
  Synthetic
gtgaaggcggccttcac

SEQ ID NO: 18304 - DNA, 12 bp, Artificial sequence
  Synthetic
tttttctccttc

SEQ ID NO: 18305 - DNA, 16 bp, Artificial sequence
  Synthetic
tacgtattaattactc

SEQ ID NO: 18306 - DNA, 7 bp, Artificial sequence
  Synthetic
ctttagt

SEQ ID NO: 18307 - DNA, 10 bp, Artificial sequence
  Synthetic
atgggcgtat

SEQ ID NO: 18308 - DNA, 17 bp, Artificial sequence
  Synthetic
tcgcgattaaccagaag

SEQ ID NO: 18309 - DNA, 12 bp, Artificial sequence
  Synthetic
ttaaggaccttt

SEQ ID NO: 18310 - DNA, 8 bp, Artificial sequence
  Synthetic
cgacagtt

SEQ ID NO: 18311 - DNA, 15 bp, Artificial sequence
  Synthetic
ttaaactaactacac

SEQ ID NO: 18312 - DNA, 18 bp, Artificial sequence
  Synthetic
gattaatcgcgattaatt

SEQ ID NO: 18313 - DNA, 10 bp, Artificial sequence
  Synthetic
catcgttggt

SEQ ID NO: 18314 - DNA, 17 bp, Artificial sequence
  Synthetic
acttaaggatctttcgt

SEQ ID NO: 18315 - DNA, 15 bp, Artificial sequence
  Synthetic
ctcctactgcagtag

SEQ ID NO: 18316 - DNA, 8 bp, Artificial sequence
  Synthetic
gtctaccg

SEQ ID NO: 18317 - DNA, 12 bp, Artificial sequence
  Synthetic
tggcaatttgcc

SEQ ID NO: 18318 - DNA, 11 bp, Artificial sequence
  Synthetic
gcggttcctcg

SEQ ID NO: 18319 - DNA, 14 bp, Artificial sequence
  Synthetic
ttaatgaaggacag

SEQ ID NO: 18320 - DNA, 9 bp, Artificial sequence
  Synthetic
taacgtgtt

SEQ ID NO: 18321 - DNA, 17 bp, Artificial sequence
  Synthetic
tccagtgagtttccagt

SEQ ID NO: 18322 - DNA, 12 bp, Artificial sequence
  Synthetic
ctgcacagtaat

SEQ ID NO: 18323 - DNA, 12 bp, Artificial sequence
  Synthetic
tcgagttccagt

SEQ ID NO: 18324 - DNA, 13 bp, Artificial sequence
  Synthetic
tccctgtcgacgt

SEQ ID NO: 18325 - DNA, 14 bp, Artificial sequence
  Synthetic
ctaacacgttatgg

SEQ ID NO: 18326 - DNA, 18 bp, Artificial sequence
  Synthetic
ttacgaatgcagtcgtga

SEQ ID NO: 18327 - DNA, 8 bp, Artificial sequence
  Synthetic
gtgcacag

SEQ ID NO: 18328 - DNA, 11 bp, Artificial sequence
  Synthetic
ccattattttt

SEQ ID NO: 18329 - DNA, 14 bp, Artificial sequence
  Synthetic
ttttttagctatta

SEQ ID NO: 18330 - DNA, 11 bp, Artificial sequence
  Synthetic
cagggaaccct

SEQ ID NO: 18331 - DNA, 9 bp, Artificial sequence
  Synthetic
gatcccaat

SEQ ID NO: 18332 - DNA, 11 bp, Artificial sequence
  Synthetic
gaccttgagtg

SEQ ID NO: 18333 - DNA, 12 bp, Artificial sequence
  Synthetic
tgttattgtaac

SEQ ID NO: 18334 - DNA, 18 bp, Artificial sequence
  Synthetic
gggtatattcctctaccg

SEQ ID NO: 18335 - DNA, 13 bp, Artificial sequence
  Synthetic
ggtggtctcccgc

SEQ ID NO: 18336 - DNA, 15 bp, Artificial sequence
  Synthetic
tcgcgggggaccacc

SEQ ID NO: 18337 - DNA, 17 bp, Artificial sequence
  Synthetic
gcttgattaatcatgat

SEQ ID NO: 18338 - DNA, 13 bp, Artificial sequence
  Synthetic
tttttagtttcca

SEQ ID NO: 18339 - DNA, 14 bp, Artificial sequence
  Synthetic
ccccagtactgggg

SEQ ID NO: 18340 - DNA, 13 bp, Artificial sequence
  Synthetic
gattaaattagtt

SEQ ID NO: 18341 - DNA, 20 bp, Artificial sequence
  Synthetic
tccagtcccactggacccgg

SEQ ID NO: 18342 - DNA, 16 bp, Artificial sequence
  Synthetic
cgtcattcttcatatg

SEQ ID NO: 18343 - DNA, 15 bp, Artificial sequence
  Synthetic
gttctaccgccgccg

SEQ ID NO: 18344 - DNA, 14 bp, Artificial sequence
  Synthetic
gtgggggccccccc

SEQ ID NO: 18345 - DNA, 10 bp, Artificial sequence
  Synthetic
tactggaact

SEQ ID NO: 18346 - DNA, 8 bp, Artificial sequence
  Synthetic
ctcgccct

SEQ ID NO: 18347 - DNA, 9 bp, Artificial sequence
  Synthetic
gactcagtg

SEQ ID NO: 18348 - DNA, 9 bp, Artificial sequence
  Synthetic
gaattaact

SEQ ID NO: 18349 - DNA, 10 bp, Artificial sequence
  Synthetic
ggactccgct

SEQ ID NO: 18350 - DNA, 10 bp, Artificial sequence
  Synthetic
gcgcgctttg

SEQ ID NO: 18351 - DNA, 12 bp, Artificial sequence
  Synthetic
gtgtaaggaggc

SEQ ID NO: 18352 - DNA, 11 bp, Artificial sequence
  Synthetic
tggcactggac

SEQ ID NO: 18353 - DNA, 11 bp, Artificial sequence
  Synthetic
ccggtgcgggt

SEQ ID NO: 18354 - DNA, 16 bp, Artificial sequence
  Synthetic
tttccagttttccagt

SEQ ID NO: 18355 - DNA, 10 bp, Artificial sequence
  Synthetic
tctccagtgg

SEQ ID NO: 18356 - DNA, 6 bp, Artificial sequence
  Synthetic
gtggac

SEQ ID NO: 18357 - DNA, 10 bp, Artificial sequence
  Synthetic
tctccagtgc

SEQ ID NO: 18358 - DNA, 14 bp, Artificial sequence
  Synthetic
ttaaccgccctttt

SEQ ID NO: 18359 - DNA, 21 bp, Artificial sequence
  Synthetic
ttttacgactgagtcgtaaaa

SEQ ID NO: 18360 - DNA, 15 bp, Artificial sequence
  Synthetic
gtttggtgtttgggg

SEQ ID NO: 18361 - DNA, 10 bp, Artificial sequence
  Synthetic
gccgcgggcg

SEQ ID NO: 18362 - DNA, 11 bp, Artificial sequence
  Synthetic
tggccttcatg

SEQ ID NO: 18363 - DNA, 9 bp, Artificial sequence
  Synthetic
ttgactact

SEQ ID NO: 18364 - DNA, 13 bp, Artificial sequence
  Synthetic
ataaatgcattgt

SEQ ID NO: 18365 - DNA, 8 bp, Artificial sequence
  Synthetic
atatttgt

SEQ ID NO: 18366 - DNA, 15 bp, Artificial sequence
  Synthetic
ggcgtatcgttgcct

SEQ ID NO: 18367 - DNA, 19 bp, Artificial sequence
  Synthetic
ttgtgcctatagacaccag

SEQ ID NO: 18368 - DNA, 15 bp, Artificial sequence
  Synthetic
gaccgtttaacggtt

SEQ ID NO: 18369 - DNA, 16 bp, Artificial sequence
  Synthetic
agattaaacgtatgtt

SEQ ID NO: 18370 - DNA, 15 bp, Artificial sequence
  Synthetic
gtcgtggtacctgtc

SEQ ID NO: 18371 - DNA, 12 bp, Artificial sequence
  Synthetic
ttttggccaaaa

SEQ ID NO: 18372 - DNA, 8 bp, Artificial sequence
  Synthetic
tactggag

SEQ ID NO: 18373 - DNA, 7 bp, Artificial sequence
  Synthetic
gtggggt

SEQ ID NO: 18374 - DNA, 20 bp, Artificial sequence
  Synthetic
aagtgtggatctccacactt

SEQ ID NO: 18375 - DNA, 9 bp, Artificial sequence
  Synthetic
ttccacgac

SEQ ID NO: 18376 - DNA, 14 bp, Artificial sequence
  Synthetic
tttttcgccttcat

SEQ ID NO: 18377 - DNA, 13 bp, Artificial sequence
  Synthetic
gtcagtgcaccag

SEQ ID NO: 18378 - DNA, 9 bp, Artificial sequence
  Synthetic
gctggcaat

SEQ ID NO: 18379 - DNA, 11 bp, Artificial sequence
  Synthetic
tcggactccgt

SEQ ID NO: 18380 - DNA, 17 bp, Artificial sequence
  Synthetic
tatcactcgtgacaagc

SEQ ID NO: 18381 - DNA, 14 bp, Artificial sequence
  Synthetic
ttgcattggtgcat

SEQ ID NO: 18382 - DNA, 15 bp, Artificial sequence
  Synthetic
gtaaagggcctttac

SEQ ID NO: 18383 - DNA, 7 bp, Artificial sequence
  Synthetic
tttcagt

SEQ ID NO: 18384 - DNA, 14 bp, Artificial sequence
  Synthetic
ttcccctaaaggtt

SEQ ID NO: 18385 - DNA, 13 bp, Artificial sequence
  Synthetic
tgctgtcgactgc

SEQ ID NO: 18386 - DNA, 9 bp, Artificial sequence
  Synthetic
gttaatgcc

SEQ ID NO: 18387 - DNA, 15 bp, Artificial sequence
  Synthetic
tgacggagtcccgta

SEQ ID NO: 18388 - DNA, 14 bp, Artificial sequence
  Synthetic
tccttctaatggcg

SEQ ID NO: 18389 - DNA, 13 bp, Artificial sequence
  Synthetic
tttgggccttcat

SEQ ID NO: 18390 - DNA, 17 bp, Artificial sequence
  Synthetic
gaaagggtgttgtgctg

SEQ ID NO: 18391 - DNA, 19 bp, Artificial sequence
  Synthetic
tacaatttacatctaattc

SEQ ID NO: 18392 - DNA, 17 bp, Artificial sequence
  Synthetic
gagtcgattaatcaaat

SEQ ID NO: 18393 - DNA, 10 bp, Artificial sequence
  Synthetic
tacgattaat

SEQ ID NO: 18394 - DNA, 11 bp, Artificial sequence
  Synthetic
tctattctatt

SEQ ID NO: 18395 - DNA, 10 bp, Artificial sequence
  Synthetic
cgagtatttt

SEQ ID NO: 18396 - DNA, 15 bp, Artificial sequence
  Synthetic
ttccagtttccagtt

SEQ ID NO: 18397 - DNA, 12 bp, Artificial sequence
  Synthetic
tcaaagcgaaag

SEQ ID NO: 18398 - DNA, 15 bp, Artificial sequence
  Synthetic
tttacgcacccgcat

SEQ ID NO: 18399 - DNA, 10 bp, Artificial sequence
  Synthetic
ggggcgccgg

SEQ ID NO: 18400 - DNA, 7 bp, Artificial sequence
  Synthetic
tatttgt

SEQ ID NO: 18401 - DNA, 9 bp, Artificial sequence
  Synthetic
tgggcgtag

SEQ ID NO: 18402 - DNA, 18 bp, Artificial sequence
  Synthetic
tacgggtatataccatta

SEQ ID NO: 18403 - DNA, 10 bp, Artificial sequence
  Synthetic
gtactggtgg

SEQ ID NO: 18404 - DNA, 17 bp, Artificial sequence
  Synthetic
ttcaataattaattaat

SEQ ID NO: 18405 - DNA, 8 bp, Artificial sequence
  Synthetic
tcctcgtg

SEQ ID NO: 18406 - DNA, 8 bp, Artificial sequence
  Synthetic
taaaggcc

SEQ ID NO: 18407 - DNA, 15 bp, Artificial sequence
  Synthetic
tacttactttaagta

SEQ ID NO: 18408 - DNA, 13 bp, Artificial sequence
  Synthetic
cctactacgttat

SEQ ID NO: 18409 - DNA, 24 bp, Artificial sequence
  Synthetic
taatttactgtgcagtagaaagac

SEQ ID NO: 18410 - DNA, 10 bp, Artificial sequence
  Synthetic
atcccctatt

SEQ ID NO: 18411 - DNA, 18 bp, Artificial sequence
  Synthetic
ttgtacaaccctgtacag

SEQ ID NO: 18412 - DNA, 8 bp, Artificial sequence
  Synthetic
ttggagcg

SEQ ID NO: 18413 - DNA, 20 bp, Artificial sequence
  Synthetic
tccacactttaaagtgtgga

SEQ ID NO: 18414 - DNA, 10 bp, Artificial sequence
  Synthetic
cacactcagt

SEQ ID NO: 18415 - DNA, 23 bp, Artificial sequence
  Synthetic
acactgggaatcgttggctaatt

SEQ ID NO: 18416 - DNA, 15 bp, Artificial sequence
  Synthetic
ttttgggcctcgcct

SEQ ID NO: 18417 - DNA, 11 bp, Artificial sequence
  Synthetic
taattattaat

SEQ ID NO: 18418 - DNA, 10 bp, Artificial sequence
  Synthetic
ccattatttt

SEQ ID NO: 18419 - DNA, 9 bp, Artificial sequence
  Synthetic
gtgattaat

SEQ ID NO: 18420 - DNA, 16 bp, Artificial sequence
  Synthetic
ttacaattcaccgaat

SEQ ID NO: 18421 - DNA, 11 bp, Artificial sequence
  Synthetic
cggggcggggg

SEQ ID NO: 18422 - DNA, 10 bp, Artificial sequence
  Synthetic
tggttaattt

SEQ ID NO: 18423 - DNA, 13 bp, Artificial sequence
  Synthetic
ttaaatacattat

SEQ ID NO: 18424 - DNA, 11 bp, Artificial sequence
  Synthetic
ctccccggccg

SEQ ID NO: 18425 - DNA, 15 bp, Artificial sequence
  Synthetic
ctttcactttgactt

SEQ ID NO: 18426 - DNA, 15 bp, Artificial sequence
  Synthetic
tctattctattctat

SEQ ID NO: 18427 - DNA, 15 bp, Artificial sequence
  Synthetic
tttaaggtcctttag

SEQ ID NO: 18428 - DNA, 20 bp, Artificial sequence
  Synthetic
tctgtacgggcccgtacagg

SEQ ID NO: 18429 - DNA, 20 bp, Artificial sequence
  Synthetic
ggggggggggcgggggcgtg

SEQ ID NO: 18430 - DNA, 17 bp, Artificial sequence
  Synthetic
cctttcgctttgacttt

SEQ ID NO: 18431 - DNA, 11 bp, Artificial sequence
  Synthetic
tacaatgtatt

SEQ ID NO: 18432 - DNA, 10 bp, Artificial sequence
  Synthetic
ttagctagcg

SEQ ID NO: 18433 - DNA, 8 bp, Artificial sequence
  Synthetic
tcattgcc

SEQ ID NO: 18434 - DNA, 17 bp, Artificial sequence
  Synthetic
ttgatcccgtttccagt

SEQ ID NO: 18435 - DNA, 12 bp, Artificial sequence
  Synthetic
taagtggacatg

SEQ ID NO: 18436 - DNA, 7 bp, Artificial sequence
  Synthetic
tacttgg

SEQ ID NO: 18437 - DNA, 19 bp, Artificial sequence
  Synthetic
tgtcccagtttccagtgct

SEQ ID NO: 18438 - DNA, 18 bp, Artificial sequence
  Synthetic
tttccagtacactccagt

SEQ ID NO: 18439 - DNA, 12 bp, Artificial sequence
  Synthetic
gattcatttgtt

SEQ ID NO: 18440 - DNA, 11 bp, Artificial sequence
  Synthetic
gagactgcagt

SEQ ID NO: 18441 - DNA, 10 bp, Artificial sequence
  Synthetic
accgcgtttt

SEQ ID NO: 18442 - DNA, 12 bp, Artificial sequence
  Synthetic
gttgtatacgct

SEQ ID NO: 18443 - DNA, 7 bp, Artificial sequence
  Synthetic
cattaat

SEQ ID NO: 18444 - DNA, 8 bp, Artificial sequence
  Synthetic
taatgtac

SEQ ID NO: 18445 - DNA, 23 bp, Artificial sequence
  Synthetic
ttcatccagtggcactggatgaa

SEQ ID NO: 18446 - DNA, 9 bp, Artificial sequence
  Synthetic
ttttcagtt

SEQ ID NO: 18447 - DNA, 9 bp, Artificial sequence
  Synthetic
ccagtaatt

SEQ ID NO: 18448 - DNA, 15 bp, Artificial sequence
  Synthetic
atttatttgtaaagt

SEQ ID NO: 18449 - DNA, 11 bp, Artificial sequence
  Synthetic
ccactgagtct

SEQ ID NO: 18450 - DNA, 15 bp, Artificial sequence
  Synthetic
gtttttctcgttggt

SEQ ID NO: 18451 - DNA, 12 bp, Artificial sequence
  Synthetic
ttcgtgcactaa

SEQ ID NO: 18452 - DNA, 11 bp, Artificial sequence
  Synthetic
tattggcaatt

SEQ ID NO: 18453 - DNA, 9 bp, Artificial sequence
  Synthetic
tcaggtttc

SEQ ID NO: 18454 - DNA, 7 bp, Artificial sequence
  Synthetic
cggtaat

SEQ ID NO: 18455 - DNA, 11 bp, Artificial sequence
  Synthetic
gtttcatttgt

SEQ ID NO: 18456 - DNA, 12 bp, Artificial sequence
  Synthetic
acggtgcaccgt

SEQ ID NO: 18457 - DNA, 10 bp, Artificial sequence
  Synthetic
cgcgtacgcg

SEQ ID NO: 18458 - DNA, 15 bp, Artificial sequence
  Synthetic
gggattcatttgttt

SEQ ID NO: 18459 - DNA, 20 bp, Artificial sequence
  Synthetic
cctgtacgggcccgtacagg

SEQ ID NO: 18460 - DNA, 15 bp, Artificial sequence
  Synthetic
gcaacaaatgaattc

SEQ ID NO: 18461 - DNA, 9 bp, Artificial sequence
  Synthetic
tggacagtt

SEQ ID NO: 18462 - DNA, 13 bp, Artificial sequence
  Synthetic
tggtggacaacgt

SEQ ID NO: 18463 - DNA, 7 bp, Artificial sequence
  Synthetic
gtcaacc

SEQ ID NO: 18464 - DNA, 9 bp, Artificial sequence
  Synthetic
tggacagta

SEQ ID NO: 18465 - DNA, 12 bp, Artificial sequence
  Synthetic
gtctggacgggg

SEQ ID NO: 18466 - DNA, 13 bp, Artificial sequence
  Synthetic
ctcctactcagtg

What is claimed is:

1. An engineered nucleic acid comprising a promoter that comprises the following sequence: TFBS-AGA-TFBS-TCG-TFBS-GAC-TFBS-CTA-TFBS-ACT-TFBS-TGC-TFBS-GTA-TFBS, wherein TFBS comprises the following sequence: CCACGTGC (SEQ ID NO: 12265).

2. The engineered nucleic acid of claim 1, wherein the promoter is operably linked to a nucleotide sequence encoding a therapeutic protein.

3. The engineered nucleic acid of claim 1, wherein the promoter comprises the following sequence:

(SEQ ID NO: 12266)
CCACGTGCAGACCACGTGCTCGCCACGTGCGACCCACGTGCCTACCACG
TGCACTCCACGTGCTGCCCACGTGCGTACCACGTGCG.

4. A cell comprising the engineered nucleic acid of claim 1.

5. An oncolytic virus comprising the engineered nucleic acid of claim 1.

6. The oncolytic virus of claim 5, wherein the oncolytic virus is an oncolytic herpes simplex virus.

7. An engineered nucleic acid comprising a promoter that comprises a nucleotide sequence identified by SEQ ID NO: 41, or a nucleotide sequence at least 95% identical to a nucleotide sequence identified by SEQ ID NO: 41.

* * * * *

UNITED STATES PATENT AND TRADEMARK OFFICE
CERTIFICATE OF CORRECTION

| | | |
|---|---|---|
| PATENT NO. | : 11,718,860 B2 | Page 1 of 1 |
| APPLICATION NO. | : 16/493340 | |
| DATED | : August 8, 2023 | |
| INVENTOR(S) | : Timothy Kuan-Ta Lu et al. | |

It is certified that error appears in the above-identified patent and that said Letters Patent is hereby corrected as shown below:

In the Specification

At Column 1, Lines 16-20, the paragraph under the heading "FEDERALLY SPONSORED RESEARCH":
"This invention was made with Government support under Grant No. W911NF-11-2-0056 awarded by the Army Research Office and under Grant No. P50 GM098792 awarded by the National Institutes of Health. The Government has certain rights in the invention."

Should read:
-- This invention was made with government support under W911NF-11-2-0056 awarded by the U.S. Army Research Office, and GM098792 awarded by the National Institutes of Health. The government has certain rights in the invention. --

Signed and Sealed this
Twenty-eighth Day of November, 2023

Katherine Kelly Vidal
*Director of the United States Patent and Trademark Office*